United States Patent 9,862,943 (LONG NONCODING RNAS AND CELL REPROGRAMMING AND DIFFERENTIATION) - sequence listing, part 2

SEQ ID NO: 164 - DNA, 47338 bp, Mus musculus
tcattcccctccttatccctcctcttctctccccttccctccccgcccttcccctctgccgcagcccagctcctagcgcgtcagcgtgggcttcccggagcgagtcgctaggtaacagggctagctccgcagacccgggccagggaagcccgcgcgcgtcgtcagcatctgcgccgaggggcggggaacgcactgacactcccctatcggagcctgcagacccttcagctggttctcagtcccctccctggatgccttaagggtggctattgccaccgcggagttgcccctcccctgcggggaccccgacgtcgccgcccccttctcctcccacgctggtccgcaccactctccgcaccgccaggtaggcgaccctccgctgcggttgcggtggctgctggtaagctgcgatctggagctgaggcggggactacgccactagcggggcggctcgggccacagcggccggcggaccggccatgtgctaaagtttctggggctcggctgcccggcgggtgcgcggcgcggggcgcagagcgcggtgggtggggcgcgcggtgctgcccgcccccagccccgcggggcgcagctcagtgtgctctctcacgctttctttctctccttttccgggcgcagccaccctccgagatcttcccgccgagcccaggcgtggggcatgaggagcccctgggtgtcgcctgcagacaacccagcctcgcgcacacctcgccagtcgctgacagggacatgaacagcatgattgggttccggtgtccggcggccagcctcagccggaggcggccagtgggtctgcgctgtttgggagaatgaggcaggaacccacggcaacctctctctcctccttctcctcgccttcctctggctcccgctccccggacccgggccgggctgtggctctgctgcgtgccctgcgcgccccccacctgcctccggatgctcttctcggtaagccagacctttcgcctcgggaacaaagccccttcacaggattccgaggctgcctccgagccccctctccaattactacccagtgcctggaatctgtccccaaaccctacctggcttctgaacagcctaggtgccttcaagacccggtgttttcctgggctctctgggaaacagcagcgggcttaacacgcaggcaggcaagagacctgtttggtctagataagcatctatgtgtgcaacctggattcggacttagtcaccagggggaactggatgtttggtgagtgttcagtcattgctgggtggtggatctccaaactgctccaaggaagtagggtcccccctctccgtgtatcagacgaggaaactgaggcccagagatactaaatgtgctaatcaaggtcacaaggtgggaaccaaggtgctcaccacctcatcaaactgatcctttggtcacaaacacgcctgctttatttccttcactagctgcttccgtctcaagagccgctgcatgtgtgtgaaactacttccaatgacggccgagacggaataaattactagtagaatgtatatatcgttcacttctccttttagcgatggcaatcatcattagaagcctcatcttagttcagattgagggaatggaggcgtcgttactacatttttcttgtggtttctttctgggctctgttttccagggtccttggaggatgcggaacagttttagttactcccatgtgtcttccttctgtgttgtgtgtcccaagcaagttcaccctcactcagccttttcccgggggtaaaacccatcagcaccacccaggctgcttgtgcaggtattagaaatagcctcttcacaggggctgggggctgattccaaatggccataaggcaagcgccacctgggtcctgactcacagatgccatctgtctgtgtgtcagcaaaacttcacacttcttaacctagagggagaggggatagctttaatacagatatgagcctcttgctcacctgtgcagcacgtgactcttcgcccagatgcatgtagatggtcctaatcaagatcgtcacgggggaatcgtgtggtccttgtctgagcacctgcttaagggcttgagtgtttaattcgtctgtctacaccatgtggaaagtgatggtgttggagcaggggcagaccttctgccacagagggctcaatgcctatgttaggtgatgtctcagatccctctcagatccaggactctgtgagtagaagaactagtgggccacaggcctgagctagggtctggggctccatcagacacggacatatgtaaactgaatagacaactgttttccaggaacagtactccctgacgaaagagtggtgagagtctggttcaagccaaaggaggtgatgtctcagccatagtggattatctattaggttaaataatggctataaaatgtccctaggggccagactggggttattggataacttaggcatttcagtggaagagatgatgacattggcccctaagaactgataaaattcagtgtatcaccttgacgtacagcaggctaggaagcaacatggccaacaggccttgctgccctctgaaaaggatcggttacagtttgtgagtgaactctagcctgagccaccagtgaggagaacagggtggtgctttgctcttccggctctaccctctggtgattatgttaatgaccagtggaatccacagagagcattcaaagaggccatgaggagaagggtggccggctggctcctcagaccctcactggattgcattttattcggggctgctaatagagctaaacgcatcaagttgacctatgggccattaatgggttgtcatcggtctttttaaagatgtagattgatgaaccttttaaagcagtactgaatcccagcctggatggacacccaccaccttttcccagaacctcagctctcagcagggtttggtgggtattcgagagtcacaaagccagagaaaagcttcctttatttgtgacatgtgtgctcgtgggggtctgtgaagggaagacggtgcttcttggggcgggggcgggatgtgtgtgtggcattaatttcccagtgctgtgtgttttaggtcctcatgattaacgggtacagttttgaataaaaatgagtgcagagaaaggatcttcattaagttagttactcccaaagatgacaacgtaattatggaataacgatttttggatcgtctctcgtgccgctagcacacaaaactggatcacacagtacaccatcgatccccgttctgatattttaatttttaatttcatccgtttctctcacgtctcacactgtgcttctccccctaccccgcgtgcacatgcacacacatgccgtgaaagtggacaacacacagtagagtctcccttttcagttttgccccgctaaatccgcttcctgtctagaacttctcgaaagctgagcacacagtacctcaggctggcctctgactgaagtatgtctgaggtgcttggattcctgtcaggaggctagaggatatgtatggtgtgtaaataagtaagatgaaggccattccttcgtgggctcacctctctgacagggagcaaggccactggcttctgtgctggcaaggcatgctcagagctgtgaggtctctgaggtcttccatgctacatagtgattgtcacatcgaggtacatgagcagagcaagggactggggaactggcattcatcctcttgtgaacttggctttgtagcctgggacagtttattccctccttctgggtctagactctttacgatgccgctttattttttttacataaatgtgtatggttagtaacggatgatgtccttcgactctcagctcgaagaatccttagagtttggccacagccggttattaatagatccggaacgctgtgtgcactcgggttacataacgctttcaattaggcatccatacaaacaatgaagacccggtcactttaaaagatgcgttttgttagctgaagtcaagcctcagtgctctgggtgagtgatgatggaactcccatcctgagagatacacgccaggttccctcaaacttacctgagaataccggaatgagctgtgaccctctctgggatccatgtggcaggagacacaagaagggttatgtaatttgggtcagtggggtaggaagaacatgaagtcctagatgcagagcctcaaagtcaagggacttggggattttgccttgttcccaggctattcctggaaggtaaggagggaagatggtaattactgcttgcatttgttttgaaaatgcaaagtacttaattagagccctgagttcagtggaagtttcaaagtggtgaggcacagaggcttggtatttctgtcaatatcttcgtacagtcaaccctcctgtgtcatgtgggtaggtagcatgttgactggggtcaagacttcctgttgaagtcatttttcagctagagtgagaggaagcagccaccagaccttaaacaccttggctcttacattgtccagctcctgagctagagtgtgagtgcacagctggactcatagtgcaggtgagtcttcagctaactgaggtatcaaagtagcacgacctggaccattgttgagaggacccttgagagggaataaaccacctcacagtgtagctcgcgtcctctcgtgctgcagtgtgtctgtctgctaaccaaagtgtgcccttccttccaaatttttaaataataccactgtactaaaaaaagcacgtggaagatttgatgtgcagaccatatggagtgattcagctattgatagacttctgaattgtactttagaaaaaaaaaaggatgtcagatttcttttaactgaataatgtcaaattgcgcgtgtccccaaagagtcagaactcagccgagtgtagccttaaaaaggttggtgctagtcgttctttggggaaagagcgaaaataacttccccaggttccacatgcccctggggttctgtgggaagtggtaggcagatgacaccccagtctctttagaaggcactgcaagcctatacctgctgacaagggacacagactaaaagttacataatggaaactttcaaaggtcggtttctccgcctctcccggatgccagtgagttaatccttccaaacagcacaggcaggggataaatgtgaggctttcaaagtccaccctcagtgtggaggaagctcaggacttagggagcctcggttcagacttggtgagcaggcttggtgagcatggtggtgggttagcagtcgaagccggccttggaaacggagctgtcttcgttcttttctgatggctttgggtttgcagaacttcttctgaccagccctcctcccccaggactggagactgccaggtcccacctgcagcccagagtttatggagaccgaaggcagatcactgggatacatggtcactggctacatggctttacattctaggaatgaaaactcagtctggatattttccccagcagctgaatgtccagttctggtgtcagttttaccgttgtcttcctagtgatgtcttaacaaaagaacatacacacacacacacacacacacacacacacacacacacacacaacaacaacaacaacaacacaacacctcctctggactgccaagccgctccggtgccagaagccttaagtttcatgagaggtgattcatggaggggtgggggtgggggggagccaaacagaacgagatagaaaacttgatggtgattcagctgtggtccataaaaagcagcagcctcctgccgctcagcgtggagattttatttgctaagtgaggctttccaggacttgatcccagtgagagctgcagagttcaaactctgagagagcagatgggtgcctggtagccctagtgagatttttggtatgtgtagaaagttagtgacgcatcagagcgtgtgagcattgggaattacccaggacccgttaagttgattggatttaatgttcacgtctaacatgatcacaggatccattcagctaagccactctagacgttcacgttgcctgcgtaggccgtcagacagatgtcagtggctttctgggcgtaagcctacacctggtctggcccttcccgctagagaggtgtgtgttggtgcttgacacacttagtgatggaaacctgaatctcaaggtcagagtgtggcatctctgaggattgatggattcctagtgggttttgtttcttaataatctgatctgccgtggtgagctgccgccgtgtgcacctcatttagcatcaggaagcaaagaagcaaacagggaatgcccagggcattttcccatcagccccgagtctcagcctggatctgctaatgtaatcaggggatctcaccgatggctcacgcttcacccagcagaagagaaactggtagagctcagattgaccttgccatgtctgcacccccacgccagggcttctttaattcagaaagtggatgacagtgatgatcattgtcttttgatgagagtgacagctctcagatttttaaatgaagcaaacgtgctttattttaagcaaagcaccgcacgcgtgggcttagaatgatttgtgaacgtaggggcgtcccttccgcttgctttactgagtacttccgaaacagtaagccctgctctgcagtgctgaaatctgaacgtagaagtcagaagccaacatcctggactttcagtatgaaaggcgggagtggaaaaatccacccgcttctgaaaggaaactggagcctgttcctctgccactcttactgacaagatcaacatcgccatcagtccagaaagtccctgtgggttgggtgcagcttctacactcaggcctgctggaggacacccttgtggcacctcctggagctgtggtgtccatctgtgcagtcctggcactatctcctccaccagcggcatgccccactctggtactgcctgatgagcagaccacaccatcttcctccttttggacacaagcctgttgtcagcggcttggtgataacttagcagccataggctctgtttgatgtgaagccaccatggtagacacatatacctttcgtgtgtgtgcacatctacattacccctgccctttgtcagggacgccatctaaagcctggaggacttagctgtcacagtaggagctggaagcaggcttggtgaaagtgggtggggtgtgagttaggggctcccttcttaggtcttcttctctcatgtcccttaggtgcctagggacaagccagcatcccactcgtgcccttcacgggcttctgtacccgtctaggccgggaggctgccactgcctagtgttatcttccaaatgtgaccaggtacctgggccgtgcaggctctggagagcttgctgaattagtcacacatctgtagatcaaaacctctgagggaccgagccccatgtctgtgtttctagaacattctccccgtcagtgtcacctcaggtactggtcatttctgttctgaatgctcttcctagaatactttccataggtgggattgtccccactcccgtccccaccacatctctgccatcctttcaccgccccccccccccagcctctcttcctgtcccatcactgcccgctacagcttgtttctgtgggccatgcaatggacccgtgtccccctcggctggctcagtgcctgctgtgtccctgtaaggctctgcaccatttggtcttgagtttcacctgcgcttgcttgcgctctctctctctctctctctctctctctctctctctctctctccctctctctctccctctctctctctctctccttcctgccctccagccagactggcctcctggccagactttactccacctgtttgcccaggtgtgccctctgagatccagggtaaggtcatcagacaggaactgccatcttctgccccattgtttgaaaatccacagaacctgttctcttgcccctctgggacaagcccgagcttccacctcaccatcccagcaaaggctaacttcgaagtagctcctgtaatttccggcatggtgttatggaatgactcatcgttacaagggctggattgccagggtggctgttgaagtgtctttcaggaggagtttctagaaatagactgtgtctctcttgggctagactatctcgtcagctgtcttagacccccgaggccccatctttgctctccgttcctgactcacaggtcccttgctacatctaggcactgtggtggatcctggatactagtctgaagttttaagtcagccagctctcttaatttcatgcaggtcaacagtgtccctctctggctggctttatcttctccaacataaagcaagctccccccatttggttcatcaccaggccctcctggtatcctggttgaacaagccacactcggcttgctgtgtgactgtctgagagatgggactcaaggaggatcttagcttgtgattgggaaaatggggtcttcggggtggaacgtgtggctatcccgtgaagcttcggtttagtgcctggaagccagcctccccgtctcgggctagttacttacaggtggtacttttccaccctgacgagagacttgctttcctagcttgatgtttttgcaagaagcccattacggctgaacacactctgatagcatcttgttttctcctacacatcctggacctgtggttaagggtctccagctgcactccccagcgagtgcatatatgcccatagttgcctttcaataaatgagacttgaaacttgagcagatagcccgtgttgtctccattcttcaagtctcttgcccctcagtccccactctctctcttgaagaccctgttgactgacccgtggaccaggtcaacttcttttccacccttacctattgtgcacatacatgtgcatacatacatgtgcatacatacacgcatacacacacacacacacacacacacacacatacacacacacacacacacacacacacacacacacacacacacacgatcccaagagagaacctaagagctgtcattctaaattgttcatccaaagacagtcatgttttaggggctggagagatggctcagggctaagagcactggctgctctttcagaggacccaggttcaattcccagcactcatatggcagtccagattgtctgtaattccagtccaagatgatcctatgtctcttttggcttctgtgggtacactgcatgcaaatagcatacacacacacacacacacacacacacacacacacacacacacacatgatcccaagagagaacctaagagctgtcattctaaattgttcatccaaagacagtcatgttttaggggctggagagatggctcagggctaagagcactggctgctctttcagaggacccaggttcaattcccagcactcatatggcagtccagattgtctgtaattccagtccaagatgatcctatgtctcttttggcttctgtgggtacactgcatgcaaatagcatacacacacacacacacacacacacacacacacacgattgtattcctccccattcatacatttaaatctagattccacataggaaagaaaatgtgtatatatgtctttccgagtctgcctcagtttacttaaccaaatgatctctagttccatttattttcttgcagacgacacagtttcattttgtgatccaaccatactctctgctttctttacccttcctttagatcaggggcaccgtggctggttctgtgtctcagctgctgtgtgtggtgttgcaggaagcaggggcggctgggtgtctctgaggtgtgtcaaatcggagtcctctgtggatataccagggatgggcagagctacaccggagcatgggtctttctttctttctttctttctttctttctttctttctttcttatatttattttatttatatgatgagtacactgtagctgtcttcagacacatcagaagagggtattccattatggatggctgagagccaccatgtggttgctgggaattgaactcaggacctccggaagagcagccagtgctcttaaccgcaaagccatctctccagcccccgcctgggtctttcttagcactgattttctctgagttagcaaacgtggtccctgtttgtgctgagagaccagggccagcaggctacggaggatgaaggtaaatgaggtgatgtttcttctcaacaaactcggggacagtttggagaagcctgataggtaattatctgtagttaatcagagtggctggcgtgcccagagaggacagagatggagagtgtagattgtctagggaggatggagatgatgctttgacaagcagaaagggagggggtagcatttccggttggtgggaaggaaggaacgaaagcagtaaggcctggggggtggggggtggccagtgctgcagtaggctatggcactgggccaaggttactcaggcagaaggaggggccagtcctgtagtgatgggagtgggtcttgaatgccaggttcaggggtgtctcctatcttacaggtgacagggaaccatgggaggtatttgaacaagagtttgggatttaaaacaatgtctggcattcctgatccttggtaccctgccacctaagcatagaacagcaaagacaacgtgttggaatgttgcagaaaaaccattgcaagcttgactgtcaggtatgactgccagcactgcccctctgtttgcgccgtttgttcccgccagctgaccttccaggaaggtcctgttgcacggaccctggctcccttgaccttgccggaccttgcccagaaagccaggtagacgctggctgcagcccgggctgcccagctcttgtggacactggccaacaggaaatggagtgggcagtatcccagcctgattcactgagccgtggggctccccgtgtctctgcaaatgcagtcaagatgcttctggcctgaaaacagcctccaagatccacgtccacagctgagagaatacagggcaccggtctcccggagctttgccccagcagtggccatgacgggtgggaagagagagtcagtgtcccgcagccactaagactggatttgaagtgcgcatgctcagtggggcgggcggcttatgccgagtgggcaggagagagctaggccagggggaagcgagtcctgggtcacaggtggttacactcatggtccctccatttttcccaccgacccacccaaagccctactcgccagtggacaagtcacgtggggttttctgggaactgtgtctctggcagagaggcttcttcaagtcaggccggtgagcttgccatgccaagaataacaggcacaggaagaggtgccctctgaagggttcccgcccctgctggggacctggagaaagaaacatggctgtagtcatcaacaagacccccttataggtcaacaaactaaagacgagaggtaggaacgaactagcccagggtcacctagggactatgaatatgagggggacccagtcactttgcagccagtgtagttactgaggttggctggggcgcacagctggcttgtgtctacctgaaaataggcaggcatgctcacccggccgtgctggccacgggccctgggcatgtaactcctgctctttttctcccgtgtggaacatatccccagctttctggctctctggatgtttattcactccttggtttctgaagcctgtgtgggtcttcagtgctagtgaagaggggaactgggcaatcagctattaaaacagaaccagttgctaaaaatccctggatcttagttagggttttactgctgtgaacagacaccatgaccaacaatatttacttgtatggacaatgtttacttggggctggcctacaggttcagaggttcagtccattatcatcaaggcatggtagcatccaggcaggcatggtgcaggaggagctgagagttctacatcttcatctgaaggctgctagcagaatactcacttccaggcagctaggactagggtataaaagcccacacccacagtgacacacctactccaacaaggccatacctccaaatagtgccactccctcgcccaaggatatacaaaccatcacaccctgtgtgtggtaagagctgggtttgtggtctgtgttggagctctgaggttgtggtgtagtttcaggttgcacccctgggtttggggatgtcagtgcccctacaccttcccaaaggtatgcctgaattatttgtgggcatcgcccttaggggctaccctttttctcgtaggtttcttcactccagtacctgggacaaacataattcacaccgttagcaattgctgcctaccacgtatggctgagtgaggggtgctaggtttcatgggcatctcagctgggctttgtcagtgacctggctctctgtgctgccatgtgccttctcagatgcatcctcccatgtgtgtgaacactggatgtccctttctgccagctgactacagccaacaccttgctgggcatattgtacctacagttcccgcccatcgagtatctgtccctgtgctatatagaaagtgaaggaatggtttgtaagcattcccacgtcattatccccaaacttggcccatccggtgttaggtaaattatcttgacgggtccagtgcttactgcagttctatgtagatgtgatccacctggttctgagtggcaccggtttgccatctttattgattcctgttttaaagaaaggagagcagagttatgaaaaccaaaaagaattcaaggttacactaaagcaatagtaagaagtgtgagtgtcaggcaggcttttagggttaggatgaaggttattttagctggacatgactgtgatctcagtacttgttgggtggaggcagggggattaggagttcaaggtcatccatggctgcagagtgagtttgaaggcagtctgggatatgtgagatgctgtctcaagaataaaaataaaaggaaggaaggaaggaaggaaggaaggaaggaaggaaggaaggaaggaaggaaccaaaaaggacattttgaatatctttcttaagcttgtttttctgggcaaggactgggccacttacagattcccttccacttggctgatggctcctctgcctgaaatcccacatttggagtgacagttccctagcaaggttcttcacgctgtcacagctgcttccagggctccgcacctgttgcccgaagctgttctctgagaaaactggagccttgcacggatctggatttaagtccagcttcattcccccccccccaaccacctctgtctctgtctctgtctctgtctctgtctctgtctctctctccctctctctctctctctctctgtgtgtgtgtgtgtgtgtgtttggttcttggatagttctctttagctgttacaagcatcatttcctcttcagcaaaaggcacaatctagaagttactgagagtgtgggttttttatctaactgcttaccacgggtacagatttaactgtcagtctcacacaatctagaatcatcgctcgagaagtggaattttcatgaggaattacctagatctgcttggtctatggagaattgtcttaattgttcattggcttaggaatacctagcccaccgtgggtggcgctattccctaggcatggagtccagaacagtgtgaaaggaaggctagctgagggcaagtcagccaatgagaatgtgtttaatctctctttgctggtgactagtgtgatatgacgagctgcttgagttcctgcctctatttctttgaaatgatgagcacggatgtgaaattatgacttaaacaaaccctttctcctcaaaatgtcctgttcttggggtatttgttgcagcaacagaaatgaaactaggaggagaccctgctgacaaagtactcagctgctttcgttagcagtgtcatttcacagatgaagaactagggtttggggagtatttgcttctgcctgcaaaacgtctccaaacagtgcttttcgcctctagtaattgtccattttgttcagataaggtagttctcgctagggcctcgtgagagactgcactcaggtagaggctggagctggaaccatctggaagacaccgtcttcctggcctggcacctggacttagaagaggtgtacagcccaaggtgagatctgggggagggtgtgtcagtgtgtgaataggggatgatccttcctccatcactttgtgggcactccatgttggttggcagaggcaggcaggagatctgtgcatcccatgtacagctgacgtgctggggacacggcacagaagtcttccaaggatctgcatcttctgtcagccttggaaatcgtgtggcatcgcctctgacatagagttagaagcaagtcattaatatttgggggaaaaagaaaagcaggactctgtcttttgcctagggtagtgtagaaggaattgcagtacaacttttggctaaatggactactttggtgatgcatgtggcaggccacatcaccagagttctacacacatctacactgttgcccctttcggctaaagggctcttagtccagccctggtacacaccacccttcccatcccatctcttcatcctttcctcagcctacagttgcatctatacttttttggggtcctgaagactttcaccttcgtgggtaccttcagagtggatgtgtgggttagacactcatattttatattgcatgtgttttgtgacacgtgagttaatatgaagaggaattttctatcgtgctgtattaaaacactttcactgagggacaatggtggcacacatctttaatcccagcacttgggaggcagaggcaggtggatctcttaagtctggggccggcctgattaaggatggccaggactacacagaaaaattgtatcaaaaatattctcacactctctctctttctctttctctctctctctctcatgaaaatggtatatttgtgtggacactagacaccgtgcctggcacatatcatggagagagaagtctggattgccttctttcctgcctacatcctctgccctcctggtcccctttcaggccatgtcctctcccaacctgaatctttgaagcccttctcagcgtcattgaacaagccccagtccattcccgccactgggagcctcctctcttcaggtccttcactggggaaaggcctgcctttagctcagagctctcttccctggcttctggctggtctcttgagagcagagctctggcagaccctcttatttccctgaagggcaatggattgtggtgctttggctgggtctccctgacttgagagaaagatttcccctaaccaggttctgatcctcatgttgcctccgtccactttgtactgcatggatgctccgtgccaggccttccgcaggggctgcctcatctctgccctcagagactcggtgtcaaaaaggcaaacaagaaaaaacaacaaacgcttgcaagcaacagagaggagttttgataagggatcggcgtttctcagaattcagagcagtgagttcagtctgcttgcatgagagagaatggcaaccagatacgcatctggtgtgtcctctgtccccagccctgggtcctgctgtctcctatatcccccatctctctcggttttgtctttccctctctcctctgaatagatagtcagatgacagtcacctcatcatggcagccttcatcctgcatcccaatgacctgactcattcagtctccctgggcacactggttcctctaggaagctgagtggcctttcagggcgagcatgcctggcccacgaagctgtggctagtcattgggtctcatggtgaggagagttacctcatggggctataagtatgatatgttcccccagaaagtgcatacagggtggggagtcggaggtgacatgccctttgtctcgggactgcttcctggtttagggtggcagtttccagactgctggtaagcatccttgagaaaccagtgtatggtttaatattataatgtgataaataattcaaggactagggagaccttgatattaggatttatccagagtaattccttttaattagttaacaaagttaatcggtcaacaggtactgtccttgtttggatttggtttggtttttctaccccagctcaggttttggttgtagactcaagtgagtcgtgtctgtggacttttcactggggactgaaggcattaggaatcctggaggtcacttaacctaaagtctggacactggcagccataagaagagttggctcgtgttcagaactggccaaggctggcttatagggaaatgatatcctccagccagtggcttagaaagaaagagagcctctggcaattcgagagacctgtgtctggaacactctgtccagtacctacctctgagtcaagagatgcaggctgagccaggcatggtggtgcatgtccataatccaagccctcaagaggctgaatcaaggtgacctctgcgtgtttgaggccagtctgggctatctatctagcaaaacatcgtcacacacaaacacacaacagaagcaggctacaaagatgtgggagtgatcttggctttgatcgttgagtcctttctgagggaaaacccctgtgctttttcagaaggaatgctgtcctctctttgctagattgctatcgtgaaccttgtttgttacacccactcatgatggccccagatgacaaaggaggaaacaggctgggaccgcaccgcgagtttgttctgggtcactcggctcctaagaagtgggacaggagtgtggatcagagctgcctcttgtcaagttacctgtgacagcatgctaagaagcctgtcaccttgtcatgggcaacctgctcttgtgtagtggagacagtactcgcctgagactctggcagtcccttgttcccagctgtgggagggtttttccttcttaactcttgcctgtgtgcttgcatcgctgatctcagtcctcccctttctccttgcttattctcctttgtgtggccaagctaactggccctcaactttgagggtatcgcctgtctccacctcgcatctcactgtaggcgcactgacattactgatgggcagcgttttgtccaactttgtgagttctggggacatagactcaggccctcacacctctttacacacagaggtgggtttatgtccccagccttcccttagaagcactctacacagtctactaaccaaacgggggggggggggcgacggtaatacactgcctcctagcgtggagatgagaaaccaaaagccaaattggccagcctgctgtccttgctggtctcagggaagggtgacccctccactccacgcctcttccagttcacagtggtggccagcagctcttgctgaacttggcgtgcagaaccattctgttcccgctgtcctcaccgtcttcctgcatgtctctggccagctttccatttctttctcttataatgacatgactcaggtataggacccactctaacccagcatgatctaactaaaacttggacatagctagtggagggacgaagctcatgttatcgcagggtatgtgcctaaggtcctctggggggggggcatcacactctcagctagaaggttccatgtgtggttagtgctgccctaccgtgtggttagtgctgccccaccccgggacctcactatctcctgcttaggtcatcctggtgagtgtcaccatgatgtcccctggactttttgccaggatggggatagctcctgctgctgccttcttggagccatggagacagtttgtgctgctctggcatctgtttggggccactgccaactcctggcacggcgagtgggtggcagcttgggcgcagtgtgtgtctgcaaggctcccctcagccccagctgtgtgtgtcagtttcctcggggcttttggcagcccctgactggtcagggtgtcatcgacccccgtgtgggtgaggggcggctgtgcttgggtttgaggcttacactgtcaactgatctagttcccttcaccaagtgacagcagagtctgtttcctctcctcactttcatgcatgtgggaactgctgtgtgtcatcagtttctcttgcctcctgggggccatgggagactcccttgggcagattcctcactctgtgggattgctacaacctgaaaggattcctattaaaatctcgtccttgagtatgtcgccactagcctttgagcctgggacatgcttggctgaggagcaccggaagatgatgtccccatatatctcctggaggcgtgcgtggggatgtggtcctgttctaaccactccaaagcttgagtctggaagaggtggccctatgacaaaactcgtcacaattgcaggtgaatgcctgaggggggcgctgtgttctccaacctgtcagcctgcagagattgacccttcctgtaaggaggttttcttacttgagggcagcagagagagggaacagggatcctccggagtttttttttgtttgtttgttttgtttgtttgtttgtttgtttgttttttggtttttttggtttttgttttttgtttttcgagtcagggtttctctgcatagccctggatgtcctggaactcactctgtagaccaggctggcctcgaactcaaaaatccacctgcctctgcctcccaagtgcaccccccccccggctcctccagagatttttaagggcgtcttctttcaaggatttcaggaaactcaaggagaggagtctagatgagatgaggggaggggtcgaaggcagcaaaggaacctgggcaagacaggaagctgcctgggacggctagaggtgatggtggtaatcagggctttaggaggcagggactttaggcaggcattctcgctaaaaccacagatatcctgggtctttatgagaagtattgctgcacagaggactccacagtggccctgtgctcgctgcaaaggtggctgcccttggtagagtctcaagcactgggagtgtggctccctcttccttttccagagctgcctatgtgcctgctgaggacaatggctggttccgaagaaggaaagagtccccagtacatgaggtctcctgcacaggcactgcaagtctcaattcataggcattccagaacattctaataggtggccattggaaagtgctggtatcattgaagggggtcctccattgcctaaagaaggcctagtgggtctgaggtagggtctagggaccagttattcccatgagtgctatatctaaaattgaatgtcaccagcaggtctaggatatgagtggctgtgtggatgctagccctatctctatgggcctgtttctttattggcaaatgcccaaaggcccaactagcagagagaagtatagaaagtccagtgagtccaggcacactgaagcccttggctacaatggagccaaggctgcatgcctgctgctgctgtgccaactgggtaggtgctatcattggttgtgattcaggctttgatgagatttagagtcccggggaaaacaagcctctgggcatgacttggagggaagttttcggctgagttggttgtagtgagaaagcccatgctgaatgtgggtagcaccaccatcctcgcactgaatagaaaggaaaaagtgagcgagcaccagaggccctgaagacagttacaaggttaccacccttccccaccaccatggtatcagtcctcaaaactcaacccaaagcgaacacctccttctccacttgctttgaagcactgagtccctgcaatgagtgcggcttcttgctgacatagccctgttcggggaagctgagcagagaagccaaactggtaaaaaaataaaataaaatgacattttttttttgcaggaaatctctctccttggggaggaggcagttctgttagtaatgagtttgaattgaacacgtgctatgagccgcagcttggggaccctaaatggattcgacaaattagacagagccatgccccattagagcccagtatgtttgaggtccccctttgtttagccctcaggaacaggtttgtagggagagaggcaggaagggtaggattcacccctcaggaccagggctttagagcttggggtgcctggggccctgggcagccttcaccctcatcaaagcatttttctcttcttttgctataaaccgttcaccgtcagctgagaaaggagatttggaaccaggcccatgaccttctgcaggtacctagcggtgggtcgatagattgttaggtttttacataaaacagagagtccccagggctgacctggagagaacaagccgccccatgggttgacctgcttctctgagcacaccgaggcttcttggatcgtgagtctgccagcctcgcagtaacctagatggctgcggaggcgttgggtagagtatagtcacagggcgaagcaacagagactgggggtggggggaacctctaccaccacaaacctctgcttgctgtttgacaacttaagcgcagtaggattaagcgcaatagtagctctgctcaataaaatgcccaccctgctgcctgtatctgcctaatgtgtctcttctgatgctgctgggttgtagcccagggcacagagaaggtccagacaggggagtcagactagacagctagcactgggaattcgaataggaacacatctataacatagagaaacctcgactcacacataacctgcctgcatcctgagcaggtgattctgagctgctcctgaagaggggagatgccttgagcaggggtggtctctgcttcgagaacaggtctgtggccaaaccagggaggacagtgctaggtcaggcctgcttaggcttggcgcaggctggaagggagggctggagcccaggactgctgggatacacccagacttgtatgcagagtggatttagtagaagttccagcattcaaagagcttggcctagcaaagcatgtgtgtgtgtgtgtgtgtgtgtgtgtgtgtgtgtgtgtacctatatgtttctgtatgtgtgtgtgtgtctatgtctgtgtatgtatgtgttgtttctgtgtgttggcagctattaggagtgtatgtactttacatatatggtatgcatgagaagaagggagagaatatgaagaaatgcagagtggagctaaccaaaattcaggccgtgggacagacaaatgaaccagtgccttacaagatggtttccaacccacgacactaccaggtcacctggggtagcccctctgccatcatggactcctaagcctcccaacttttctatagagttggaatttcccccacgtctcaggttcttcccagtgctgccaggagccttttgtgccactggcgccttccatgtgtctttctggaaacttgcttggctcttagcatcctggatctcagaatttctcttgggttgggtgcttccttccctggagccacagcatgcacagactcctccttcagctcctggctcaggcatcagcttctccctaacctgtgacactcacctgcctgcaggccgccatgtcactgggccatgtgagactgcagtgcctgcttgtgtaactcttgacccccccccccccgccttaagcatggtacctggccccaggctggtgctcgaggatcatactttgagcgagtggcagacgtcacggctgtgactttccatacaaccccagcctttcttcttgaactgtgagaattcgatagctgacaacaagagaaacatcccagaaactgtttactagcaagagagtgttgggttaaaccaggcctcacgtcagggccttgttggtcaggctctctcaggaaacagacaaaagcccagaaacagactgaccggagccagctaagtaaagtgtgtgcggacagacattatcctgtgccacaggagacctcagctatggcagttacatttttctcagcctgctctctggggaggggacatgacaactcctgtgccgatgggggttccatggagggtctggacacaggctgggagctggagcaggctcactggcgcttacctttccacagcctcacttcaccaaccgcgcgcgggtggaaggtcctgccgtgctcaccttccagtggtgcggcaaaagtgtggatcctgtcagatacagtttgcagaggcacacagggcttccccaaaggtgatttctcttatttcctgtttgcaaaacagccaaaaacactttgctgcgccgatacactgtgcagagcactccacagtttgccttctacagtgcaagcggcagcatctccccccaggcctccctgagactcccccctctcctcagccctcctcctgtctttcttcgccttgccctctatccatcatccccactacaacctcattctccttagctgcctctaaagcagtaacaagcacttcgtgactcactgttatttttttaaattagattttacgtattcactgggtggagggtacagtggtcagtgtataagaggtaggagtcagttcctcccttctatctgtgggacctggggattgaactcgggtcatcagctagcatggcaagctcttttatctgctaagccatattgtctgcccccactgtttctgctattttgagaccaggtttcactgtgtcgcctggctgagtcttgaatccctgggctcaagacatctcctctctcaatttcctgggtcgctgggacctcagtcacacacttctcacgatttgctccttcagatcgctctgcctggcattttttttttactttgtattaaaattactttttaattaacacattcacatgataaataaaattgtgcagacaggcatacaatgaactcctgttacatattgaatgcttacgctgtcctgagacatttcccagataaactcatttgctcctctctgcagcccagtcgcctgctgcagacactaagactctttgtccacatgattgagggagcccctgtgtgcctgccacagtcatcctaatggaaaaaaaggaagacttggccccgttctagctgtccagactcatctgtgttttctcaggcacatctagttactttttctgtggaaagtttgtcatttgtttttttttaatttcattaattttattattttatgtgtatgtttgcctgtatgcaagtctacataccacatgcgtacctggtacatctaaaggccagaaaagaacatcagatcctctgggaattagaattactgatgactgtgagctgccatatagatgctgggaactgaacctgggtcctctgcaaaagcagtggacccttaactactgggccacctcccagtcccttctgtgggttgctctttaatctgtaaatctgccattgtcctttctgcagtgcctatgtcttcttgttttgtaagacaagggcattggtgtcctactctttctcccacctccctttctctgcctcagtgtcacccactgtcatcagaatccttcacttatgagtcttgtcctgagttctccatagctattgcccatagcttggcaaaggacttggaagcagaaggtgtcaccgccattggttgtactacaatggaagtgtcaaatgctggagtcagccatgtgctgggacacctgaagccttagaccagtgaaacagaaaggcctggaacattctctttgcttctgctccctcatcatcctgtcctgagacatttcccagataaactcatttactcctctctgcagcccagtcgcctgctgcagacactaagacgctttgtccacgtgattgagggagcccctgtgtgcctgccacagtcatcctaatggaaaaaaggaagacttttagcatcctaccatattttacttggatcatgtggtgccagacagtgtcccccacaggctcccgtgtttgaacacttgttctctattggtggtactgtttggggagggcacagaacctttaggaaggggaggcttgctgggggaagtacatcactgagggaaggctttgagagtttatagcatcacccacttctagatcttccccctatatccctccccccctccctctctagctccctctgtctttctgctttctgaatgtggttgaaacatgatctcttagcttcctacttcagtcacttgttgtcaagccttctcccccctccagcccccctcaatcttgaattctccccctagaactgtgaacagaaacaccctttcttctataagtcgcttttggtcatgatgttgcaatcaccaatcacagcaacacaaagtaactagtgtagattgcaacttgatgggccaggatttttgtatcctagggtttctaggttcttttgtttatttatttttcttttctttcttcagtcaggtttgcacttaagctaggctggcctcaaactcactgtaatcacagatgacctcttcaacctccgacccccatgcctccacctcctggtgctgtgactactgtcatgttagcagcacgcttggcttatgtgatgctgggcataggactcagggctctgtacgtgcttggcaaacactccacccaatgagctccaccccagggctctctacctattctgccaagccttacctttgcatcctagagaactccttccttcctgggatgttttctgttccccttccaaagtgttcttgggtgcctccacaggtcagcgtgtgttctctcattgtttcccatgagagcttctactgctccagcgttggatcgtgagctacctgaacatgcctgtattttacactcacaccgaaggtggatttccaggtccacatgatttcctccaaatttttgaaaacctcacaggagtggaaaatctgtgttcttttcctagaaggcttaaagaattcttctttgtccttagtatgcagacattacttgaaggtggtacattgttttggacacattgagatccccttggctttaaggattttagtgcatgtggtttaaaactaaagcaatcctggttttcgtttttcattgctgaatgcacttgccattcctaagaacttacagaatggacctttatttctctgtgtacccttttctgtgttttcccctattctttgtacattttattggctttgttttctaattctttaaaacacacacacatcaccaccaccaccaccatcacctctccttgttttttttttttttttcctgtgagctttgtcttgctctaaacaccctttttcctggaaacgactctgttagatgatgcttgcaggtgcgtaaggttctggaacgcctgtgcctttgtggaaggctgaggattatttttctctcctcggaggtcagtttctgtgtttgtttcgatctccctctacatactcttctggttccttatacactgctcatccagggttgagagcagtctaattaatagttacggtccccctctgtctctgtggagtccatgctgcagactgggtgcttatggttaggcaggcctgtagtgatacagcctacacctacaccaaatgtgtgctgttttttttttttttttttcaaaccatcatttgccgaacaccatagaatgacttaaacaaaattcacatcatattaagggttataagtatgttaaagacagtgtgaagtaggtaggaggcttgtggactgtaagaaaatactgtgcatttttgtgtgagacttgtacactcgtgaacttttatatccatgaggatcctggaaccagctaccaatatctaccaaggatgcctgacagcaagctcaggaagacctcatcattggccagagtcacagagggggaaacggggcatctgctgatagacttcccagtctccactctgcttgtctttcaaagcagttgatagatttcaagtagattttagggtcgaggggctttcatcttttctgactgcgaaggctgctctttcttgctgataggcttctgggaaagtgtggcatttgtgtcccccttgttccaaagactaaggtgttcccagcttttgggcgctgagtggccccattctaccatactagtttctttgtgctgagccaacatccttggccagaggctagaccttccattccataccagatgtttaacaacaagcaccactagaagctttagtgtctcccattccgatcacaagacactgccatggataccacatagggaacccaatgtgcctgccggctgctgtggggtaacactcactgaaaggactcctggagcccaaggatcacgtagacagacatctccgccacagcgagacatagtcagtgaaggctctggcttcagacagatagacgtcttagtcctcgtgggtaccaggaagtcttaggtccagcttcagtgtctggtgaggaactgcttcccagatcataaatgacaccttagctacacatgatatgggcagtaaagggatttcccccaatacgagcagacagggaacttactgaaaatccactgtgggatggcagcgagcatatgagttcccacagaagggaccacaccccgagaatgagtgggagtcttctcacaacagttaatgacaagttccctggtcttatcctgtgggccatttgtggggagtccatatccagatcagtgaggagacatccttgccacctcgttaagtagtaaattttacagcaaagattgtgtttttcttgagattggccgtttgggttggacgctgttaagagttgggctccagatgtctatgtaagacaccgtaagtcactgggtgtctgtcagactgcatgtggtcagggccaggttctcagacggggattttaatttaacctgggttttttgtttgtttgtttttgtttttgtttttactgtgttcttgtggtataggagcagggagggctctctggattgctttccatcagggcactggctttccatccctgagagccttggcttcctgactccatcacctccttcaaagaactttacttctaataccatcatcttggcagctaaaactccaacatgcggatttggtgaggacacaggatctggaccacacagcacggaattaggagaaggttacataaacattaagcggtcacttcaactcatgttaccttcactgtctgctgctgctaagaacttttgtctgtagagtcttctgacaggaagagagaaaacagtaaacatttcttttttctttttttaagaagctcttcagagccttccagcttggcaagagcctcagagggagccacttccttggatgttttatttatttccttatgttcccatgtatgcagcggctatatatgggaatctctctgtaagcacaaaactgctctttcaatacaagaagcttgatgtctgcacagcagggcatgtttcccacccccctctgcccccagaaggcagtgggctggctgaagagagcagaatggcttcagggaactgaggcaccatgagcagaggctactggggctgggctggatacgagggtctcttggcagatgaggacccggtatcaatccacctcaggcacggggctgtgacagattgtgttggccctgacaggtggtggcttcttgctgggggaagggaaaccataatccacagcaactcctagcactgaccacacgtaggtagccagagaaggacccgtgtggagggaaagttatgctgagttttgtgacagtagcagccttaacaaacagttcacaccttcaaacagggtaagaccatccaagctgagccctcattcactggtcaggacaacagggtagggagagggtggctaattgatgtagcaagtcctggctgaggaaggctgcccctactcactctctccccctccccctcccctccccctccccctccccccccctctctctctctccctctctttctttctttcttatattatgagagtgcactttctgttttttattttccgtaattatttattgattcccttttctttgcaaacctcatgcttgtgatgggtaagaaatgatgtaggacccagccttagaaggtacagggaggggggtgggagtagaagggctgtaaagagacagaaacaaatgtgactccctgtgagaactctgcccaccagagctgtcagaagcagtggcttacgagctgctttgagaagtctctactcatgcagccacatgctctacggtgctctgagggaatgctgtgtgaccatgggtgaaattcttggagaagaggaagggttccataggaattagatcacatggctttaatatcttttcctttcctgacactgggggccagggtcctctacacctgcactcatgccttctataggcagggatcccgtgaggtcacctagataccaggctcccaacagatgccaggtgataaagatctcctgtcagtagataaagtgcttcccttgcaagcatgaggacctgaaagtatccccgagaaggcatgttcaaaacatgttggatgtggtagtatgtgcttggggtccctgtgatggggaggtggagacaggtagatcctgaggcaagtattttggctcacaggtcaagttcaaggtacagtcattatgatggggaactcaaggtggcaggagcttgaagcagctggttacattgtgtccatgatcaggaagcagagagtctgttcctgctcagttcccattctccatttgtatagcctgggatcccagctagggaatggtgcctcccacagtggatggaacatgtcttcccacctcaattcaaataagaaaacccccaaagggatactcagagtcccttttcccaggttgttttaactcctgtcagattgaccattaacactaaccattactctgatgggggtggggataagagaagtggggggacctgtgctcagaaggtgacatctgtatgttaagttagaaaacaccagcttgaaggtctgaacaaagcatgccactggagtgtggagggcctaagatggtacattcacaaaagaccaaggacgccagtaccatcgatgtggggttgactgagggagaacatggcagaattgaggtaggtagacagggatggcatggtgtgcattttttagtgatgggagcacttgggaaaatcctttttactccctattagttctggacaagcattggatcacaactgtcagcctggcttttctctgcctgccaatagctctttcttcaggaagttatcatccagaaagtccagaaggtgccatttccagcctggacacactcaaaaatgattgcaaggattcatatgcagagatgaggttttttttttttctttcctgcatctcaggagctggtaaaacccacccagctgtctggtcctgtcggaaaaaatcacattaaaatgtaaatgctcccgagtaagtgaaatttggatgggtagcaccctgcagaggatgcagaggagattcataaaggctgtttatccagcgctagcccagctcagccatttgctcttcaagagctgagtactggggaaatctcagttataaagcccgttctgcccagaccccagatctctccagggtgtttggaaacagggaccctgctacacgtaagtgctacttacatgaggtagtgtgggaagcctaagtgcactgtctggccacatccctgccaatctcctgttgccacctctcagcttgaacctaggggcaaagagtctagacagtggccgtccactttgccaagagttgaggtcttcacatccctgcacaccctccagcttctttgatttgtgatctgaacagggtcacccgagtaaattttctttaaaagcttttaccttttccttggggggatttaaggtgttacaatgtctactttccgaagtagatagcacttatgtgtaaagttgagccataaagcatgacagggaaggaaggaaggaagctgtaacagcttctggaatgttcctcatttcatgtgggcagcagttatcagctgaggaggagtatggtctcattttgtggccgggagatgagggcacagatgctttttagtgacacgcttagattgtgggcttgtccagactgtgtgggtctggatctgtctttgctttgtgccctgccagctgtgggtccgtctgggaggcctgctgggagccatctccctccatcttcctcctacagagctgacatccttcatctatgaaatacgatggtggtgtctccccttccgcatgattgcaagtgtgaacgctcggaggactgggggcagggggatagcttaattgagaaagtgcttgctagggtctgagtttgagccgcagaagcggtgtgaagacatctggactttatggtgtacgcttatagacccagcgttaggaaggtggaaacaggcaaatggctcaagactcatagcccagccagtatagcatggtcagtgagctccagaaggagagaccctgtctcaaaaacaaggcagatggctcctgaggaatggcgtctgaggttgacctcttgccacacacatgcacaaactcgtatctcctgattgcatcagcagttatgaagtgcttagaataatgtctcctgcctacctggtggcttagctagcacggagcgtgtagtgatagttcttgtaagagaaaaccaaacccactacccagaagcaagcgctctatgaccatctcatttgtgaggatgaagacatgaagtcacaaggattctagaataagcacctcccacaactcccctacatacatagtgacagacttaggatacagttacaaatccagcaagcttgttcggctcacagttcttgctggactgcccagagaattattctccccactttgcagatgagaaaactgaggttcatattctttgagtctcttcagaaggcttcaacctgcctgcctcagatgtcaccagaatctcttactcctgcctgaagaaaacaccttttcctttaggatggcaaacatagcctcctcgagcctgccttccagtgttcactgctaagtaaccagcccctcaccctaaagtgcatggcacagaaacaaatattgttactagctctcttgactctgtggcttgtgttgactggacccagtggccgtttcccatgagtctcccatgtcctggagtcagatggtcctgaagctggagcaaagaaggcttctgtctggtgtctgtttgggctggacagactgtacaagaagtggacattaccatctcttgaactacttcttttggggggctttagatttagaaaaaacaatctgccattttaccaagctcacgctcagatgacgccagtaccttttgtatgtgcaggtggtgaatagcgttttttttcagtatcctccaacccgtgaccactgctcatcttccacgaccttggcatttcagaagagcacttagcaagtttacccaatgtctgtctcctgacttagccatgggtaaggttgacctttttaggacagattcccctggagctattctgtatccttcttggtccctcatatcagggtatgagacgtcaggttctccatggcgatgttgacctcgattgcttggttaaggtccttccaccagattggtagagcagccatctttcctttctttatcacagtcctggaagagaagcttaagagcatgtgactctttctgtcaaacatttctcactagttccagtgtccctcagcgggtctggtccatggttgctgcgtagtgctgttgctggtggcaatcatttatctctgtttccttttgcgtgtatcatctggggctctactggaagaaacaactgacccgcccacacatttattcttttatgtgatcaataaagactcgcaggtgtggattttactttacgagctcccatctgatgctggacttttcccctagttcacattgttctagctctgggcactgagggctgttcaggtttacgctagcatcccctgccagccctcccaccgatctttttgagcactttgttactttgtgccactacagggtgtcagggcttttctcggaagagcactggttgcttccgttggagaatggtgtactccgacttagagctgggtaccaggcatacatattgctgctaggctgctcttgctcctcctggatgtctgtggtcagaggtaaaaattatagttgctcagaagggtcttagtatcttaccatcaatgagatgtgtgtgaaatgaaggtgaccatatgggatcctgccacctgatgaagccatcaccaccttggcttgtgtgagcttctacagcccagctccttggagccacgcacgaatgcaaatccccacccttgcccgtgagtcttgcctgtcctctggtggggtggaatctgttgacttctcagtggggtctgtagcccagaggaggtggcagccatgaagggtagctttgctgacaaacaacagtctctcaagcctaggtctcatgtcccctgcttagcttccgtgcccttggctcaggactacctggtgacttgcactcctcagggaagtttagtctggtataattaattttccacacctaaaaatatgttcttcactgagtaagggaaatgctgattaatttattcttaagtgtgagtatggggagctcactcttctccatatagtgctgttcaaggtttttggtttgttgtttttctttcagtacagcacacagtgaaatgacctttcttgtcatcagacttcaaggtgaggaagaaactaagccagaccaccaagggctcttgacgatggtcaacccaactgttctccttgtccagaaggatggactcctctgggaggaaccgttcaggctttccccgggagcaggcagggctggaaattgagtcttgtctgtgagctcccagtgtcatgctttgagtttggcacaggtgtcactatttttagatagtgagaacagagagacacaagaagttgctgagctagaagggacagtccttgccttgaggcaaaggactccgttgtcacctctaggtcttccctactacacacatgttctggtacatgtgcactaccaggctgactctgcttggtgatccacggactagcacatgctatttagacacagattctcttcgctgggtacccatacatagtggcaccctgtcgggtgtcagagttattctcaccacctagctcttctggttcctgtgctttttctataacctggactgacctctccaggctctctttagttctttccatccatccatacatccatccatctatccatccatccacccactcatccatctgcccacccacccatcttcccattcatccatccatccaccattcatgcatatatatatgtacatatatttatgtatgtatgtgtatatatatacatatatatatccatcatcccatccatgtatccatctatccatccatccatccatccatatacacacctattcatcatccattcataaattcacctatcatttgtctacacacttagccatccatcactcagtcttccactcaccatcagagtctacccatcttccgtgcattatcttgtttattcttggagtagcacagtgctttcatagcagacctagggttggaggttgtggagatggatcatccatccatcccagacaaactcatgggttagtgcagaaagaccgggtaaaaggatgaccacaggccagcatgaaagatgctcagatgtggccagaataaagggtcctggaaatgctgctaagcctgcacctctgagagtgaccagtggttgtgtaagtcaagaagagtatacaagcatccgcactggggtgagagtgtggcatttgaagcattgggcaggctgggggatgaagcatccgtgcagctcctgcctcagtttctgctgagatctttgctttagccacatcgatcttcctggtacttacaacagtgcctggcacagtgtaggtgttcacaaaaaaatcatttttgaccaaagaccttgtttctaaaataagaataatatttgtctgcgtctcgtggtacatccctaatgtactagaacgggtcctggcatataatagatgctaaataaatgtttaacgattcttggaatacagttatagatgctactgttattaaatttttaaaattctcactgtgtaccttgtccctcgttttgatttttaattctgaagtcctttactgggtagatacatacattaccatacagatcctggtccacattcttgcttagtcaatagccttgactcttgtcatcttacgtaactggaaagcagtcactgggtacagcgtgagacgtaccaagcacgaggctaggtccagatgctttgcagcgattagcgaggcagagctctaattaatagtcataaccgtgatgctctgttgagcaggctaaatgtcttacaaatgttttctgtcttcagtggctctcaggagctgctggtcagggtgggtttgtgattgcagaatgacccggcttccaccctccttcaggtaacttgtgttacaacaccaggccattctgtgaccacctgagctgtgcacagagccgggttgaggcgtctgtcccctggaaaaacgcttgtgccaccccttctgaggaccttatgtgaggacaggaagttggccacttgcacagaactctcagctcctgtcctgagagctagaaaggcaggaagtaagatccgtgtgcgcagcaccagctgagctggaagcaaggtgtgttgttctagccagcaagcaagctagcagtgtttgcttactgtggtttgatttgaggcgctaattgagctttaaaaatttattatgaaatatctcgtgcatacaggggagtgtgtcaatagtgaatgtgtgtggctgagaaaataaataggatatgaacatccgtgtcacccttgcatctactgaataaattccaaaatggctttccgaagcttacggggcttcggctacgatccctgcttcaccctccggcccagccctcccgcctaactttgatctttgtggactcgccttgcaatacccccatgtgtattcatagtcccatttcccttacacacctgtcagcctctcactcacgtactctctcctgcactcactaaggtaatctcattctgtttttccacttcagcttagaccaaccatcttcctggagtgattcctggctggccgtcccaggcagttagaatccccccacctccaccttttgggtttccccagtgccctgggctcacatggcctccatggtctgctgcttgcatttagacctggaaacgtaggccttgtctgacatgtcactccagcattcatgcttagaggatgctcaaggagtgatttcagagaccacccaggtcttctcttgagggaaaagctgatgctgccccagccctctatccccatcccctgggctcgtcaactggagagtctgaatataaagacagcagattgtccttgtaaacagagccagaatgaaccttcctcatcccaatgtatggaagtgttcttgagcagggagtgcttggaatgacaatcgagccgggtgactggctgcagagcgaggatgcagggaggatagagtgtgcatggacgcaaggctttctcctctcccttctggaatgtgtggtgcctttcacacaaggagcagagatggaattctgagataggcgttgctttgaaaagaagccggggggggggatattaatgcaaactcccactccgggtaatagttctgcttgtccagagagtattgagacattcaccaatgtgtgtatgtgcgtatatgtgtgtgtgtgcctgtgtgtatgcctatatgaatgcacacatatgtttgtatgtgtatacatgtgtgtgcagatatgtgtatatacacatgtgtacatatgtgtgtgcatgtacgtgtgtgtgtgctaacttgagggctacacctcagaagccatatactttgggttttttggtatagcatctccttttggcctggaattttctggctagccagtgagacccagagatctatctgtacccatgccccagtgctgagattataagtttataccaccatgctaggcgtgtgtgtgtgtgtgtcttcgtggacatggagatcattattctcttctagactcacagcccggcatccccacctgaccccatttgccctcccttccatgctggtgttccaggtgcacggagctagggatctgaatcgcagttcgcacgcttacacagcaagccctcttacccactaagccttctcctcagtctcggaacttttctttaaaatgtggattctgggttggacaccgtggtcttcatgcttgcaagacaaaccctttgccagctcagttctctccctagccctagaagcttcatcctttacggttttcacacccagctccaacccgtttctgaccctctcttgcctcaccagcagaaacagacaggcatgcaggtctctcctcacacacaccggcaatgagtgccttcttcttggcacctgggagcagctgttcttctaagactgagataaaacagaagcgctcagggtcttcattgctacttggtatcgattgcttagaatgggacacaaacaaaataacaaccaaccgtgctgcagaaaatttctgaattttttccccctcgggcattttttcctattcaagtaaggcttattaaagttattatttgtaaaggggacctgaattttaatacccttcgtcttcccttcctgtgcatgacttccttattgctacatggtctttgccaccattgctttttaagaactacaccatcattctctgagcccccagcttgctgctgatcattgactggttctgctagggttgatctccaattcctagtaagattctctgagaaacgaatgcagagaactcataaagaaagaactccgtcctgcatcgggtcagagcgtgccaggagcagtgtaggagctgtagtaattacggaaaccctacccgagtgtaatctcttgttttagtgcgagctttcccaagagaagggctatggcgatctgggctctctgcatgagtgaggagcaggaaggtgctgagttagggaaagggggtctcgtgaagagcctccatctgtgtcacccttgagcatggcagctgccattcactcagttgggcaggtgcatcttttatctttcaacctacgtgctacccctccaccatgttaaagatgaggcatctgaggttcagagggagccagcatccttagcagatcacacagctgctcagccatggagacaagctagggtccctgccatacccaaagccagagctactgatggtaatttttcacaaacagagatgttactgagggtgatgaggcctcaccttggcttagcgactagtttttgagatggccccagttgggggcaagatggagagaagagattttaagacaaataacgtttctgaataagctgtcagggcggaatcagctgggttgagaggtgttaagttgcaaaatggtgaggagaatcctgttaaccctccgtcgagttctagcaggcacgttcagcctacagttcacggggctgtgtacagctgcgtatggctgaggacaatccaacacaaagctgtgaacttacttaaaaacaattttttccacatttttaaaaaataattccattgcagtccttaactatgaactctctaaatgataacgctggtttgcagtcttaaaaggtcgggccatcctcgtaggagattttaggtatcaaatgaggaattcaaaacagaataactttgaatatccattccggaagggaaatgttctctggttacctgggatagttgtccatcacaacaggttccaactggctttagcaaaaacagtattttcgtggcaggaatgtgggggttgctcttgggtgcccaaggatctgaagagtggagctctgcagagggctaattccaagaggcagccatcagtgtgctctcctctgggcactgtggcaggatgcatctccattggatatcagtgtggatgaatgagaatttgaggtggccccactttgtatctctttataaggtccagggtagaaagagacccatctgtttggtaaacttatccggatgcagggcatcccttcagtgccttgactgacagcgcccacgatggagggtaattttccagaggaaacctgagatgctgagacagagggatgcatgagcatgagcgctggacaatgctgtgagctgctgtgagtatccttgttgcctctgcccagctgtgactccagcaagcacacagagccctccctccctcccttctactctccctaacctcccgctgtgtccacagcagatccctgcaacactgtatcactgtgtactcgtggcttatttcccaagacaggcatcccagttaggcgagcgattaaaactctccagtgtgtttagcaggagcagcccagccgaggaccaatctgctgagtctgctcaaagtgaggggcccatcaattttgcaccttagggatgctaggctgtgaacagtattctgtctttgcacaatcacgacctttctggtggcaaggaagggcttctttgacagctaacgggacactaggtatggtattgttgttttaagtgttgtttctcttgggagcctgaggagctgactcagttggcaaagagcttgccaggcaaccatgaggagctgaattcggttcctagtattcgtgtaaaaagctaaacgtggtagtgtgtgcattatctcagtggcgtgcgggagatagagataagggatcgctggagctccctagtcggccagcctagcctaatgggcaagcactgggtctaagtgccaccaaaaacaagtggatgactcctgaagattgacacctgaggttgacgtctggcccccacatccatgtgcacacacgcacagacccccatgcctacacctgtccattcattcatgaccatttgcaaacacacccacagagttgtttctactaatgtcttatttttatcttcggtattgtctattaactgaccagttcacttatgaacatcagtaattgatttattagttcatggataagtaaaaggggcatatttaggaaatgatgttacaacacacaagtgctgtgtgccaggcagcggcttaagaaacagaaccagagcctcagagcatcctccaccaccaacccaccccatgtacttggtgggaaccattgccctggtgttggcgagttcacgccattgctttcttttgcggagtcatcgggtttatacttccaaatagtgtggtgttgggtttcccatagaaatggtggccttctatctgctgtacgctctgtccctcaacattgtgcctgtggtagcccaacatcgtgtgcactgtacgtacactgtaagggatcatgaaggcctatggccatctgcagtgtccagtgttccaccaagaggacatctactgcccataaacataagatcttgtccgtgcgccctgacgcgcgcatacgcaagtgtattcagggtttgtcacacgaggtagatgactgctcatcaggaactgagtgtgctcagctttaccaggtgacatacaggtttccaaggttacagccagacaggccctgaagcctagtgttcctgcagccctgtctttgatgctttggctggagttttcttccttgccagactggtgcttcttagctgttttaatttctctgatgactgttcagtttctctgtggctactctttagagaagtccctgggtaggattttattcacttttctattgtgtgcttatcattatcttgctggtttaatactaatatgcaatgtgtgttaaatatatagtatgttatatatcatagaccactatatatcattcaccgaccatatctctgcatcctagtttgcaacttccactgttgatttttttgtaagcatctgatcgtcagggtttcaggcataacccccttgagcttgtctgtcttaaggcggctgcctctaccctgtgaccgcaaacattctcctttctcagcactcttaaagatcccagttttcatgctatcccctcacctggctttccatctgaaattgatgagctactggtccaatttcacatacgtttaatgtggtgtatcacttacctcttcctggggaccagataaacatcaagaagcaacctgaggcaggaagcgtttatcttgaccccatttctgtcgctgcccctgtttccaggctgagcttccagcccctcatgctctgcagtccacactgctcaccccctgccctatgcccagttattacccaagttaacaatgccctccacattcccttctgtgaggccctcggttatgctcccaggagtcctgaggtagtctctatggggaagtatgggctgacatcctagcagcaactggagacttcgaggctacggctctcctgtaggtcagaaaggcctttctggttagccgcagagtcctcgggatgtaaacaccggcgacctgattgtgccctccaattcctcctgagtcagaaccaactggggttaactcagggaaggagctaaattaagccttgaaacgaagcagccagcctcgatgacaggcactctgttgtgcttgagtgaccgagatgaggggactctggttatgacggtagcactaatcacatctcttgagagcagcctggctgttcagctcccaccctgcagggatgggaagatgccaggtccctctcaggaccagctcggtcactcggcgtgactgggcactgtgctttaaagtagcaggttaaacactcctgttcccggactctcagcccatagaagagaacagacaagaaacaagagaccccagtaaagacggcactggtgtttggagacccctcaacccagagcaggatgaggagtggcttctgagtaattttttaaaggttttatgtaatggctgatccacagagtggccaaaatcaagggggagggagtccgtcctcatttgccaacgagcaaactcatatcaccgagttgaaaatctgtttgacagtactcccagagccctccacccacataccccatgcatgttttcctctgccaaatatatgcagctacgaagaaactacacatgtgtgcgctttacatcagaacaaaatgtaagtggatatgagactctaattggaacatgtatgcagcagcagtcttcagatctgcggtgtgctttgaaatgttctgaaacggagagtggggagatgtgtattgaagcaagggcaacgcagggcccaggagtggaggagcaggcgagcttgcggctgctcactggaagagcccttcagctttgctaaacatagatcctacaaagtgtgcacacaggacacaggagacaaggaacacaggaaggatggccacacggcagtgctatgcacagttgtcccacacccaacgcctctcgaatccctgtcagcagtaaaagagagccatcccaccacctgcatgatccaaaaggcctctgttcctaagtgggaccggatgagctagagctacagccagccacgtggatgagtcttacgaagcaatgtcaaggggaagaagccaatctcctaagggagaatgctgtgtgatttcattcgtaaaagttcccaaactgggcaaagctgcccatagcattaagagtcgctggagagttgtcaagaggaaaggacagtgacttagcgggtcaccaagggaggcccctgggggtgcagaaggctcatttttaatcttagcactgaagagtatatcaagctacacacacacacacacacacacacacaatgcacatagacacacagtgtttccctttttacaacattgaaaatagaagaaagaaaagaaagcccaaacagaaacttcccatgaccgctctgggggtcacaggccactcaaagccagactagccagcctcagttgtgaagaaaataggatgcatttcttcggaatacgtcatttgttcacgtctgcacacacccgtgcagtgcctgtctctgcaggcctcacagatgggctctgtccttcaccaaggcagtatactgtattcagtacagtgaactgctctgtgaggtgtggcccaggctattcactggatcacatgcacaatggaagaggtggaaagacatttgtggttgatcctcactcctaccacctggatttccaggtgatcctcctgggatatacttcctggaacatcatttgaccgtagaaatctccatagaaacagaaccagtgatgtgtgaggaagcatgtttgagtgagcatgtgtgggggtggtgagtgtgtgtgtgtgggtgtgtgcacttctgtacacatagcaacatacatgtgtctatctacatgaattgtcctagttagattcccattgctgtgataaatacaataccaaaagcaacttggggggtaaagggcctggttcatctttcagcggattgtctgccattgtggaaaagcagagcagaaacctggaggcaaggctgaagcagaggccccgagagcccactgctcactggcttgttctccgcagcttgcttatacaactcaagagtcaactgcccaggggtagcaccgcccctcccacatcagtccaccaatcaagaaaaggatccttagatttgcctgcagatcattggctggaagcatcttctcaggccaggcttctcttcccagataggtccatgtttgggtcaagttgacaaaaccaaccagcacacgtattatttatccatgccacccctaagtatcagaaagacttttgctgaaaaaaaaaaaatgcagtttcctcacggaggaagtctagtctggtctgtccccagatctcatcccattaagtccccataggtataattgtataccaaaagtataattggggtagaggcttcaatctctgaccctacctctgggtgactgggctacctagcttagtgtatagacattagtcttgcccatgaaaaatacacgaggcatacagaagaatggcagaaactaccaaaccccccagcagaaaatgatctgcatgctggaagctgctgtgtccccaaggtattccttactgctacagcttgaggaaggcacactcatgaatttcacggccataactccttgcttggaacagaactcaaaacacacgaggtccgacagtgtgctgtttggagccttcacagatagaggcaggctaaacacaggctagtgtgaggtgctttctccctccagtgtctgggcttgctccatgctgttagggacagctgcagcagctctgccacctcactgtcatgcagtattctagccttgtggctctggtatcacacgggcactgacgcacacctgggcagtctccggcccttttctgggacagctgtttctgcatctggagaagtgaagtggccttagtctccaggtacacaggttcgcctcccccacccccaggtgcacagctgggagagcaggtgcccagctgtacactgtgtctcttggctttcctaactagtgtcaagcgatcttccagagtacttgtgtcaacacgaattcctgccagcaaccatgggagtctcttgtggggccacctccttcacacctcacagggattgcttacagcttctctggaaacagaatcaccttccctcgggcctgcctattcctgttcctaccttcaaaacacatgtaactgggataccccctgtgccttcctgaacacagagaaggacccatctcctaggtgtgactgacccactagttttactgtgactgcaataggtgtgactcctgttcctgcttcccaggaaaggagagagcaagctacaccgaatgggtggcccaatggctgacgtcagggtgaattgtctttatgttattaatatctcacccctggaatccttaacttgtgttcttagatctgtgtgtgtgtgtgtgtgtgtgtgtgtgtgtgcacatgcatatgtgtgcacatacgttgaggccaaaggtcagccaccctcaggctgtcatcctgaggaaggttttccacctcctatgagactgtatctcttattttcctgaagctaaccaattagacgagactgactggccagggacctccagggatcttctgtgtctacctccatgtcttagtcagggtttgtattcctgcacaaaacatcatgaccaagaagcaagttggggaggaaagggtttattcagctcacacttccacattgccgttcatcaccaaaggaagtcaggacaggaactcaagcagatcaggaaactggacctgatgcagaggccatgagaggatgctgctttctggcttgcttcccctggcttgctcagcttcctttcttatagatccccggaccaccaacccagggatgcaccacccacaatgatccttgatcactaattgagaaaatgccttatagctggatctcatggaggcgttccctcaagggaaactcctttctctgtgatggctccagcttgtgtcacagttgacatacacacacacaaaaccccagccagtacacaccccaacactggggttccaccacgtgtgcacgcttcatgggtgctggcaatctacctcaggtccttgagctcgcaagccaagcacttgactggctgagccatctccctggtccccatgttctgccatctctcagtgaccaagagggatgttatccacgattgtgttagatgctgtggatgtcacttccacccatgatgtagtcctgaagcctgtagtcaccccaccctcccccctggcctcatcgaggatgctgggaaatgatccatctttcgctctgtctctcttcactacaggttagcctggagaggaagataaagacatttgcaaccaagatggtaatcacgagtggaaacgatgaagaccggggaggccaagagaaagagagcaaagaggagagcgtgttggccatgctgggcatcatcgggaccatcctgaacctgatcgttatcatctttgtatacatatataccactctatgaaaggccccattcagacctcggtggcctcaggatggccacgagacaagggtcctgtgcatccgtctatcagcgaccacacactgcggggggaccagcaggtttgaagaccacacaatgctccatcaatgcaccttcgaactttctgacgggtcacctgatggacccgtccttctgtgaggagcagacactctgaagcacaatgaatccagtgggactccttcaggccacaaggaactcccacaggggacccagcgggatgctggaaaggccagccttctgcaccggcggtgagcacgagggtgaggaagtgcttcaccctggagtgctgaccacatctcacactggaaagaggatgcgtggggtagtcgcagctccgctgacctcctcccaggactggcaagataaataagctctaggtgcggttcgttgacaggcattgcattcatcaaatgtttccagctgtttgatatgggagataacttatttttcctttttcattggcttgatatgtgtatctgttcatatcgaggtttataaatctatatttttaataaatgtgctctattttttagcatgaaccaaatatttggagaagcacttctggacccatagctcttcttggttttaatcgcttttgctccatcagctgcaagacgtctttgtctgtagtcatccggttgcctcagctcatctcaagccttgtcgtacctcaggttcttcttccttcccatccctgcccctcccttctctcctctctctttcccctgtctctcccttccatctcttaattcccctatccttccccatctccccaccccccatctcctctctcccctcctcctcacctcttgtctagaggacattttcccataataccagctgtggtcttggctggtgtgtgcttcaagattgtcgagcggcttttcattgttctgtcagagatataaaccgattgtgggcatgcagaccttagatgcaccctgtctttattgagaattatgcatgaacaagggctgagtggcaggccagcatctccagtttttaaagggactaccaaggaggaagatgagcagccctgcctgcaggccacccttgggacagagcagtcaccagctcaagtgcagtattgcttatttgctcctgtaaccatccaattatcagattctgatttatttatttatttatttatttatttatttatttatttatttatttttgtgaccatgagagatggaaacggggcgagctcgatgttcagtgcaccagccgtcatcccttccttggtgagctgcctggggaggtggagggtgggatctcttcagaagtcagtgggatatgagggaagtgagacctccccgctgtgagaatgcacacacagttcctgctgtaaaaacactgctgggacgagtgacccttcaagggcattgggaggggacttaatggtctctgttaaggagccctgcacattttaaagctgtttttccactcacacaaagctctttttttctctgaggggatggttgaataaatacaaatttgccctgctctctggctccgtaacacagccccaacctggatgcagtgtacagctttaaggagagggtccgcattcattctgccaagggcagaagtggcagcagccccccctttggattcagatgacactaagggggggcatgtctcagcttgcccccttccttaaatggcaccatgaaggagtcatttcttgggcttcactaagggaccagtctcttttataaatcaaatacccatgagcacctggctctgcccagagatgtctcctcttccccaccagaaggacagataccgtgtacacaagtaaccaggctttcatagttgctggtgagagggagagtctttctctctcacctgtgtggtagaaggaagaagaaaggacagctcggaccaggaatcttccctgaggtttcctggcacccagtggagtcagattctagcctcacctggccagttccttatcccagcgaggacttggatgctgttgtgggatgctgatgaggatagtgactgtggctggaaagcctgtcgctttgctgaggatcaacccagcacacacacacacacacacacacacacacacacaccacaccacaccacaccacaacaggaaacaaccttagaactccttggacactggcagaatttgacacaaataaaagacagtagagaggctggttaggaaggtgggaggcaccccggggcgagcactacctaccaggctgtgtgattcttgacaaactgtaattctgcacagtggactaaacaaacaataaaggtgcagtgggggaaactattggtgtcgccaacttcctcgtgagcccgtgtgtaattgtttgatttaataaaacttgaccgtggctgt

SEQ ID NO: 165 - DNA, 6634 bp, Mus musculus
gagcaaaacattcattcacatgaaatctaaagaaaaatgataatagagcagtaaaaggtgacttaggcgattcttgctgctggtattaataagtgttattaataagaccagccagtgtccagtgtaaggtctggggcctcagaggtaaaggcctggaggtacagacaggagaccacgcagaaatccgcttatgaacaagttcctgcatacacatgccattgcccctggagaagccagccaggtgattagcctctgctctgcaagaaacaggcagttgagtctttgattaatagtagggaggaaatcaccaaagaacatgttcaataaggtcatgagaaaccaggcatggagcatgtctgtaaaatagagatctgtgtataatgtctactaatgtcaccgtggaacaaagcacttaaattgaagcagctcatggatgtcctcagttaaacagccagtttaagacaagtccaggctatgtgacaagtccaggcttgtctcagaaaaagccacaagtttccaaactgaccgagcctgtgggttcctggcatgatgagagtcccaggagatttcaacgtgtcaaagccgctggagtcatcagatatgtgaggatgggatattaacttgaatgtaaagaattaaggaaaatgcttgttttagaacaccatagctacacagttgcttgaccccctagtccaaaacaactcgtggggaaaaaaaaagatgtcctttgaatattgacatttttccttttcttgagcctcccacaggaagactctgcccttttatcaccctatagtgaaacttacttattagtaactcttgtacataaacttccaacctgcattttagtgccttaaatgcagcagaagcacagatccaaacattagaagaatcctccaaaaaaaaaaaaaaaaagccaagagcaaaatacacaaaatcaaggaatctctggtaaagtagggtagaattatgcaaactcaaaagagaaaacactgtccataaagaaaatgtcatagaggggaagagttggaagctaaggagttcccatcctggtatacttgtttttagtctctgagcatgcataaataacaatatattgggtaggtaaaatctggtatactggataagtaagtagctagaaaggttgtaataatagaaaatcaagggacagacaaggtaaccctttgtcatgggaaacaccctgggatggactgggggtggggctcccatacgtcccaatatcaaatttgattgaatcattccctgtcagcttcagagaaactcatccacagagcaattaaaagatttaatgagagctgggcatggtggcgcacacctttaatcccaggtggatttctgagttcgaagccagcctggtctacagagtgagttccaggacagccagggctacacagagaaaccctgtctgaaaaaaaaacaaaaaaaaagaaacaacaacaacaaaaaaagatttaatgactgttaaaaagaacactgctctggaaaatcaaggacaagaaagcttcggtagataaaacaagaaattcaggaaaccaaaccaaaaaccaagtattttggtaagctgctataaatgtttagagaccaaagctaaaagtacaaataaatggcgttgaaattgaaggtttagttgacacaggaacagatgtaacaagtttcaccaaaatcttggcatccacattggcctcttcaggagctaagtatgaacactaaagtctaagtgtttatctcagggaaaaccaagttcaaggtgggttaagagtgtagggccagaggacagatagaaaaattaaagccatgtgtggccaaaatagccatgaatttataggaatgtgatttgtcacagcatggaaaacacagattaacattccccaatctcagaaacaaaccataatattaataatgcttctaaaagtatattcaaagatattatcaagaacagtcacagaccatttaggttgtccataagcagggcataataactgttggtcttttaaagggaccaactgccctacctttaaaatgattaactgacagcagggcgtggtggcgcacacctttaatcccagcacccaggaggcagaggcaggcagatttctgagttcaaagccagcctgttctacaaagtgagttccaggacagccagggctacacagagaaaccctgtctcgaaaaaccaaaaaaaaaaaaacaaaaaaaaacaactgacaaacctgtgtgggtggaataatggcctctgatgtcagaaaaagtgggagagtggagcaaaatacacaaaatcaaggaatctctggtaaagtaggataggattatgcaaactcaaaagagaaaacactgtccataaagaaaatgtcatagaggggaagagttggagtctaaggagttccccagcctggtatacttgtttttagtctctccaagcatgcataaataacaatatattggataggtaaatattggataagtaagtggctagaaaggttgtaatatagaaaaccttgtaatgaagtgaaattgtcaaaaattgaaattaatagcagcgaaaaggataccaagagtcaacccagaggaagtgaacgtaggattatcacagagaggcgcacgggaagaaggtgaagggacattcagtttaaaggcttgagacttggagagagggacgttacttctaggatgctggctgaggaggacggtcagctggatgctttctctgcctctgagctagcaggctttcacctcagtatctggctcccaagtcttcactggtaaaattgagtgatagagattttgtttaaaaacaacaacaaataccttcaaatttatgaaggaaaattattttcaactcaattgtatttttttctaagtgtgtgtgtgtgtgtgcgcgcgctcacgggtttgtgtgaaggtgttggggagcacacgagtggcagcatgcctgtggaggtctcctaccatatggatcctggggatcaaactagactgccaggtctagccttgcaccaacctcaacctcaatcatattctagacatacagctcaaagaatctgggccttagtggtataaatcatgcctacatccacaagacccaataaacaaacaaacaaatccctttctaggtgtagcacaaacctgtgatccttggcaggacttccagttttaagagcagcctgagctacatgcagtctcagctacagaaacaccaaaaccaaaattgcatctatctttctttcttcctttctttctttctttctttctttctttctttctttctttctttatttatttatttatttatttttaagagcagcctgagctaaatgcagtctcagctacagaaacaccaaaaccaaaattgcatttttcttttttttttttttgattgattgatttatttattatatgtaagtacactgtagctgtcttcagacgtaccagaagagggcatcagatctcattatgggtggttgtgagccaccatgtggttgctgggatttgaacttcggaccttcggaagagcagtcgggtgctcttacccagtgagccatctcaccagccccaaaattgcatttttcatgctttcaaagagacctgtcaaaggatgcagtgagcctcactaaaatagaaataaagtgtccaagaaaaaagatccagcttggaggagaagtgcccctggggatgcagagaagtcccagatgacagctagatagagacagcaggcagtgttcaccagagcaaacaaagctggtttacctaatagattggactggtgaacaagatgtgtcctgaaaaactgcattgtgtgcaaacaattattggtttaaaaaataaataaataaagccaggcagtggtggcgcacacctttaatcccagcacttgggaagcagaggcaggcggatttctgagttccaggccaacctggtctacagagtgagttctaagacagccagggctacacagagaaacactgtcttgaaaaaccaaaaataaaatacaaacaaaccaagagaaaaaaaaaaaaaaagcaaaagaaacaagtaatataccaagcttagcagtacttttactgtcagtgttaagtactctcgacttaacaatcatggcttcaatattttaagaaagtaaaagtgggaagttaatgggcaatgtctagaatgtgtaaatcaagaaataagccaggcatcacatgcctgtaaccccagccactccaggagtgtacaggcaggagagtagaaaattcagggtcatcctggactctgtttttaatattagggcgggagaaacagctcaacagttaagagggcttgctgttcctacagagtttagtgtctggcatctcagcaggtggatcacagcttcccgaaacttttttttttaagatatatattgtcactgtcttcagacatcactgtcttcagacataccagaagagggcattagatcccattacagatggttgttagccaccatgtggttgctgggaattgaactcaggacctctggaagaggtcttaaccacttagttctctctccagctcctgtgactctaattccaagagactgacaccctctcctggtcatctcagatacctataatctgtgcagggggtaaaaacaaaccttgaaaagttttaatgcattttatttatgcacagacattatttggagaaaaagattaaatgaaggatataaactgaaaacatgtaactgctactgaatgctttctgcttataataaaaaaattggttatgatgtaatgagaaaaagtctagagaggtatatagatgtcagattattaagggccttgtgtgtcatgttgagggtatatgaaagtcatattgggtaatgtgaagaggtttctgggcagaagaggtgactgaaatgcaggcatgtaatcagagagagaactcagaagcttgaggcaggagaattgtcaggagtttcaaagccacacctgacatacattgttacagctgagaagctgaaccaccaactgactataggtagttttgacatctactgtcccaatcatacagggtttctctgtttagccctggctgttctggaacttgctctgtagactggctggcctccaactcagagatttgcctacctatccagtgtttggactaaagtaatgttccaccacacctggctgcttgcattctttcttaactcaaattttttcttttctctttcttttgtcctttttttcctcttcttttcctttctttctttctttctttttcttctctgtatttctccctctctctaagagaggagttccctccatagtcctgctgtcctgaagctctctgtaggccaggctggcttaaactcactgaaagacacctgcctctctctcctgagtgctggaattaaaggtaagcgctaccacacccactcagtccatttctcaaactacttgttcatagagacgctgagattatagggataaaaacttgaacttgctcagccctcaaggaactcagtacggtccggtggcagcaactgtgctgtcagcagaatccaaaaatccgagttgaagccacccggcatccagggatccagttaggtcttcaaatccattctcttctgcagtcggtgacacttctcttccatccctcccctcctgcccgggaccctgcacacggttccgccagtcccaccgggctgagacttccaggtccagctgcctgaacccggagcacaggggacccagcgccgccctgtgggtgggcgggcagtcggccgcaagcagccagcgcggctcggaggcggggcggggccgcactgggctcggcccagagccgggagggcccaggccaccggaagagtcgcgatcgccagcggagcgccgggagtggggagcggaagcggtggcgggcggcgctgggacccgggagcggccggagaacaagggagctggcggcccggccggcggctgagtggggctgagcagcgggccgcgccgagcgccgagctctgccggagaggcccggccccgctgcccaagcaggccgcgcgccgcggggccgaggccggagccatgggcgagaccaagatcatctaccacctggacggccaggagacgccgtacctggtgaagctgcccctgcccgccgagcgcgtcaccttggcggactttaagggcgttctgcagcggcccagctataagttcttcttcaagtctatggacgacgattttgggtgaggatggcccccgccccgcctcccgggagcccgggtcgctccgctgctaggggccaacacagccagttccgactcccctgactgcactggtttctagccccgcttccagcaagggagcgactcggtgacttgggacacacttgactttgagggactcccagtcacctcttggaggccttgcccccctggtccagcgagacgtccctccctaagcaatcggttcctaccattcaagccccctcacctccccacggtccagcggccccccccagagacatacatcctttccactccagtccaaagccagaattctcagtccttccaggtgccaccatttaagcataaagttggagtatattgacacccggcctgccttcccggtcttctgagctctgcaactcagagcct

SEQ ID NO: 166 - DNA, 30030 bp, Mus musculus
caaaggaaataccattattaggtatatatcaaatacatccatgtaaaccgcatgagatggctcagaggttgatagtgatctttgctattattacagaagaccagagttcggttcccagaacacacatcaggcaacatcccaagggatcaagtgcctctggtctcctagagtagcccccccacccccaccccatgcacatcctcacagacatatacatgataaatttaaaaaagatgtatatagctgggcgtggtggcacacgcctttaatcccagcacttgggaggcagaggcaggtggatttctgaattcgaggccagtctggtctacagagtgagttccaggacagccaggctacacagagaaaccctgtcttgaaaaaaccaaaaaaaaaaaaaaaaaggtgtatataatatacatgtaaagctattagaagtggcagggttaggaaagaaagagaatggggggcggggggtggggagaaacgtgtgtagccatgtgatctgtggctggtaacgggactgtgtgctctgactgcttggtggcagttctaatagatcgctagactctatcaagcagaaatgtttattaactacatctctccctcgactgggggatggcactaatggatgtttgaaaatgatgaccctgatatgctgagaaccctgaacatctttttgaaacaggagaggggggaaaaaagattaaaggaagagccggctagtccatgacaggtgcattttactgtattctaatgtttttttgaaaacaagcaatatttttgccctgtgtagtatgacagtttatatactgcctaaataacttcctgcccatcagaacatcaagacaatacattgtccaattatggaagggatgaaggcttaataaatattcctctctgcaccggggatgtatgtagctcagtaggcagaatgcttgccttagtaagaatgaagcccttagttggatgcatgctctctctatgtcaggcatggcgtgccaccaggctagctgtacttttaattacactgggaggtggaggcaggaggatcagataatctgtgacttcacagtttgagggttgcctgggctacatgtggccctatctcagagaaatcattccttttttttttttttttttctcgagacagggtttctctgtatagccctggctgtcctggagctcactttgtagaccaggctagcctcgaattcagaaatccgcctgcctctgcctcccgagtgctgggattaaaggtgtgcgccaccacgcccggcgaagtcattccttttttttttgtcgagatgcacatttagaagatgatactgggagttcaaaactactctaagccatcatgagtctaaagccagaaagaggctgcctgagacctgctacctggtgtcatcttcttacttcctacaatttattattagcgcaatttttgtttgatttggagttttgagactggatcttaagtatgtagccccaggtgaccttgagtttgtggtccttcttctctagggcacgtattttgctgggccaggatttcatggtgggttccagctctaccctttactggtgagacaatatgtcaaaccataggaaggatggcctagcatcacaggttccacgcatagtgtgtcggtcctggaggagggggcaggaggggctctcagataaaggagaaatgcattttcaaaatctgcatctgtgaagatgccaggccataggagagacaggcggccaggagtcagcggtgcactgtagaagaggtagaagagaaacagacccttcaggaactggactcctcagggacacccgaaacacaaagcaggcctgggatcccccacccacgctgcagtctctcccgccttccctgttactcccccccgcaccaccacccccattcccgcagttccccttctcggcccctgtgttcgctctctgcataccacagaggtcaggcacaaataaaatccatacatggataagactcttgggtcacgggctttagttaaccacccggttaggagaaggtcctatcacctctccaggacagcttggcttgtcaacaccaatctccttggtaaagaccctcaatcgggcgtccatgggtcactatccatccccaactaaccttaaagcaactgcatcttcgcggcccccctccccaagagaggaaattccacagcccagaagtgatttgaaacgtgatccgcacgccacagctctctcttctcactctccctagccggtactcaaactgggtttcccggggcccctctcaggagggcttccccgcccccctctcgcaccccctgcttctttctctctgcattttacacactgtaacccgagaggttggaaatccagcctccttcatcttccgtttcccacatcctgcaagttcggagagacgaagcccacccagaggacggaattccaagcatttgctcctctccccctccccctcccccagccccattcacaaagcagattactgaaagagtccacgctctagggaggcccccctccccaacccgccccccttcccaagagctaactctacaccctcactcctcctcaccggcgccaaaaccgaagaaaaaatgaaaatttcccgggactctgattttaagaaaagcgttcaaaccttcactcattccaggactgccccttaaagagattctcacaaccgttcgcccgtctcctctcagttcttccagataaaaggaatcagagaaagacgcttctttggatctggagataagatagtaacgtcacacgtgaggactcaaagagacaatgtcccagggaaaagatcgcggtgttccaactttgggacacctctttctaagagatgtttccagaccagattaaacactggtttaaggcctggagaaggggctcattggttaaaacaaaacaaacaaaaacaaaaacacgtgttgctcttgcagtggaccgaggttcaatctccagctcccacatagtggctcacaccatccagaagccctgaccccggctatctatcaggcaggcaggcccacgtggtgcaaactgtccatagacataaagtaaaataaatacacacacacacacacacacacacacacacacacatttatattttaaagtggcttattggacctgtgcagacagctcatagggcaaccggcgattgccaccaaccttgaggacttgggttcgattccctgggaaccacgtggtaggagagaactgacctccatgcttaagtttgtccacacaaaataaattttaagatgtaacgacaacaaccaaatggctttatttgagaagatgaacaagagggtgtgtgtggggggggttaggtttaatttagtttttcttctttgtaggagctgggagtgcggacatacatgtcaagtgagtgttccactacccagcaaaatctccagcccccggtaatgtatttcttgttgttgttgggttgttttttttttccttttttattttcattttttcctttgataaatttcttgggtttcagctacctggaaattatcaatgactgcacgtgcccagctcttctggaccctctgatgttctgtcacatgggagcaaatggagagctgggacatcctttgacctcagccctcaaaggttaggaagcgggcccctcctccctccaagaattccttttctccaagggtgattaactacctcagccatccttccaggagggccaaaaaagctgttttgaatctgtaccggctcagaataatcagttcctggtatttccggctttgtgtgaagcaggatttcctgtttcaaggcgggctggctcccctgtcctgatattagggagtctatgtaatagattactaatccatactgtttttgtttttctattcaggataattaacttcttgctcaatccctcagcatttgaccaaaataccaagataaaaatgtaggcccgtgttagtacaaaaggtcctgcattcaactgtcctccttatattgcccaagaagtcttgtggaattccaagaagaattcaaggggccagacctggaatatgcatcaatgagaataagacactgacgaagctaacgacactaacggggaatgaggataatcgactcctgtcctttgttttactctttaacctagtaataaatccctttaaaggcccgtggtattcggagcatcccgtgtgtgaagtgctctcgcagttgtggccggaatgtgagacctataggctaaagatgtcaggctgaatctcaggcaaggggtgtgctgaaaggatcggaggaagggcgaggggagcccagccgagataatgagggccagcaagatggattagtgaataaaggtgtttgggttttttgttttgttttttggtttttatggtttttcgagacagggtttctctgtgtagccctggctgtcttggaactcactctgtagaccaggctgcctctcaagtgctgggattaaaggtgtgcgccaccactgcccggcactttttttttttttaagacttatttattttatgtatgtgactacactgtagctgtcttcagacacaccagaagggggcatcagatcccattacagatggctgtgagccaccatgtggttgctgggatttgaactcaggacctctggaagagcagtcagcgcttttaaccactgagccatctctccagcccgtaaaggtgcttgttgtcaagcctgacaacctgtgttggatccctagaacccacatgggatagagggaaagaacagactaacaaaatttgtcttctgatctctacttctgtggcatggtatgtaagaatacacaacaaaacatacaaacacaaataaatttaaatgcaatgaaaaaaattttaaagaaatgaccaggtatggcaggaaagccaagtagtgggcaccccttcagctcctccagtacttcaggatttgtgtgaacttgagaactacctgtaaatgcagatctcaccaccccgccccgccccgccccatccccacacatgatactcaacagcctcccagatgcaatagtctagactttgtatctggaaggttcgctgttgcagggcagaaatcctttggtcttagagagttccaagaagttttgttttctcaaacgatgaagcgcaaattcacgcctgtgatttctattctggctagggtaatggaggtgccttaacacagctcagcaaacgaagcaattaaaggaccgtcccccaaaattggttttcagcccctcctttattttgagaaagggtcccattatgtagccttggctgacttggaactcaccatgtagagcaagctggccttgaacttgccgggggcctcctgagagctggcgtctcaggcatgaggtatcatgcttggccatcaacattttacaaatgcctgtgtgtgtggaaagagagccgtaagaaaccacatcatcacaacggggaatgaggataatcgactcctgtcctttgttttactctttaacctagtaataaatccctttaaaggcccgtggtattcggagcatcccgtgtgtgaagtgctctcgcagttgtggccggaatgtgagacctataggctaaagatgtcaggctgaatctcaggcaaggggtgtgctgaaaggatcggaggaagggcgaggggagcccagccgagaactcctctgtctcaaaaactcagcacctcaatcaagggataaagcgttaattaggcctcattatcatgcaaggcagcctcagcgaaattggaacataccggagagacgaaaggctggaggcagagcctgctacggctggagacaggctttgatgtctgcaggcaaggttgtgtttcattcagccatccaaccaaccaaaaccatgcgggcgggcgggcggggaggagcaacccgaaaccctccagatccaggctgaaggcagacctgggcgagcgctgggcctgagttcccccgggtgggtgtctgggtccttctccaccttccccatctcagaccagcgagggtaaccgattctgacaatcagggagaacctggctaagctacagctgacttttgttttgttttaatctgctgaggggaggaaggaagagagatagataatggcttctgtgtgtccccgagaggtcccaactagcgtcgcagatgctgccagagccctgggaggctgcgagctaccgcagcgtttacactcagtgatgtaggagagagaagaaaatgagcgaggaaagtaggttaatctcccagagaagaggtggcaggtatctttttttttttttttcaaatacaccgttcactcttaattgcttcagtcccagaactgtagggaatgaggaattcctcttgtccttatctcaccccgtacatgcctagtgaatctatttctttattcccttttatttattttttaatttttttttttgaaagtaagtggtcctggcacttagatattcagcctgaaactgaatatgtagactctgggctggccttgaagtaagttatttgcctgcctctgcctcctcagcactgggattaaaggcctgtggggccaacccctgccttgtcttttttgttccgatgttttgaggcagattctcttgtagtcctggctaggcaattgagccacacaccccaccccaattgcttttctttttggatcggcaggtcagtacacaccacttcaaaaccgcctggatacgtttaagttttcacttcaaaaacagctgtcccggagatgactcaggccaaggcacttgccaccaaacctgaccaccgaggtttgatcccaggacatatctataggagaactatagaggacttccacaggtcgttctctgacctcccaacacacacgcactcaaccatacacgtacgcgcacacacacacacacattaaaaagaaaaaaagagaagataaaagtctggggtattgcctctaacggacatcccagcctttgggaggatcaggaactaaaggacattatcactacaccgaaaattccaggctgtcttgggatgctcgaaaatctatctaggataaaacgatgacttaacgaaccatttagaaatgtaaaaagcctctgccaggcggtggtggcggacactttgaatcccagcactcaggaggcagaggcaggctgatctcagggagttccaggacagccagggctatacagagaaaccctgtctcaggggaaaaaaaaaaaaaaaaagtcccaggccagcaggagccagcttcttgaggaccagtgtcaagcaaacacaaaggtgctccctgttcctgctgctggcagctggcagcagaggaggcagcatctgccctttccagctttttaatccccgcagggaggaggcagaggcaggctgatctcagggagttccaggccagccttctctaaaggctagttccaggacattcaaggctacacagagaaaccctgtctcgggaaaaaccaagaggaaaaaaaaaaggagagaaaaaagaggttctgtatccggtacacagctgtttgtttttctcctctcttcatttgcttgtggtcctcagcatctgctagttttgcgttttctggatgaagcactcctgagggcttgggctatggaggaagagcctcagggtagctccaggtggaagcctctgtccctccttcacctcactgtcctccaggaattgggtgagaagtcttgcagggaatgcacgggtcccttgttctccttaaatgttgcttgattttggagaaactccgtaatctcttgtctaaaattccctgaaatgactctaatagtgttccccaggaatttgggataaacggattgcacaacattgaaattacccttttgatagcttattctgcagaagttttgggaacagcacataccatctatctttgtgtgtgtgtgtgtgtgtgtgtgtgtgtgtgtgtgtgtgtatgtgttgttgttgttgttgttgttcctggttggtaagactaagtctctctctgtagcccaggctaaccttgaactaaaagcaatccttctgcctcaacctcccaagtgtcgggattacagatgcagtgtctcatgtgagttttgttttcactcgagttgcagggtggaggcatgatgtggggggaggggaagagccccagcagctgtatgggttgtttctaagtaataaaatagcattctccagagtttccagtaaaagccataagctccaggcagctcatccccaaaatatgtgtgggatgctgggagctccctggattttccaggcaaccccaacccccttcctacaccccaaggagaaaaaaagaaagagagagagagagagagagagagagagagagagaaagaaagaaaggaaggaaggaaggaaggaaggaaggaaggaaggaagaaaggaagaaagaaggaaactcactcctgggggaagaaaaagcctatggattacatctgaacaagtccaactcccccgaggccggagctctgtgctctaaatgctagcagagtggatagccagaaacctacgtttggtaaattatttatcttatctctggaactcagcaaagcgtgggggacagcagcttctgaagaaggatgctgtctatgggtctcgacttcggctggaatttggacttttactagaaaagggaaaagttcagagaccagtggggcccatgaagcaatttttttttttaaatgacggaagcaaagccaaagaaaactgacttcagagttccgtggaacaggtctggttcgtgttttgtctagctggctttgtgttccgtccgtattaggagaacatcatagcacaccacaccactagataataaagagcccaggcaactccgttcagaacgctccacccacccttccttggaaccaacagcccaaagaaacctatgatgggttggttctaggctgaacttggttcccttcaggctccctggatctgttactcttcccaatgctgggccactatttggtgccagtttctgcgtgcctcagtgccacgtgtggaaactcactggcctggaatgtgtactggggacttcttcaatctagattggattctgtaggatctatgggttttcctctagaatatcatagaggttgtggggcttgacggctttgattacagagaaattagctttcataacgatcttttatttatttatttatttatttttatttatttatttatttatttatttatttatttatttatttatttatttgagacagggtttctctgtgtagccctggctgtcctggaactcactctgtagatagaccaggctggcctcgaactcagaaatccacctgcctctacctcccaggtgctgggattaaaggtgctcatcaccactgcccagcagaacgatcttgagaagtcaatttcatcatgattacaggatttgggtttttgttttggttggttggttattttgctgttattttatattgaggtctcattttgtagccctggctagcctggagctcactatatagatcagaatggcctacaatccacagagatccacctccctctgtgatgtgttagaatgacaggttgcatctcacctgcacgctaggccaaggcagttccacatggaagaggttttatcaggagagagacaaggtagtggcagaaagagaagagggggagagaaagggaggaagtggcattttccttgtatataaggaaaaggacataacacatgtaaaggtgggaggtgagccaaatggatgctgggaatatggtgcctgttgtcttggcaaccggtctgcaggtcacaggttgctctcacctatgtgatgtcataggtttgggatgtcctgatgccaatactctgcctctaaagtacttggattaaaggagtgtgcctttaattcatcctgttggacatattactcttacatcctaggtgtgtgctggtttgtttcttttattggttttgtttggttttgttttaaggctttcacagttttaagcagaaaatttctcatcagagcaatggtaaccttaactaagacagaaattggtaccaggagttgggtatcgtggtgacagcctgtccctgttgttttggggtaggattgtagaaggactttggatttggggttaggaaagccattgagtgttctaagcttggtgagcttctgtggagcctcagaagataagagtgttgagagagtggggaggagagctgggctgggaaaattccagaggagtttcagagacacttcatgaatctattggggccattgtatattttgaattaagaatctctggtattggtcagccagagctaaagaatcaggtgtgagccaggcagtggtggcacaagcctttgattgtagcactccagaagcagagacaaattgatctctgtgagttcgaggtcaacctggtctataaagagcgtccaggacagccagggctattacacagagaaactgtgtctcaaacacaaacacacacacacagagggagagagatattttgggaatttataaactgtatgttgatgttgtaatgttgatattaatgtgtgctcctggggataaacaagaaaggaaaagtggtttaacagtgatgtttgtcaagtgagcaaggggtcaattgtgctgccgggcgtggtagcacacgcctttaatcccagcacttgggaggcagaggcaagtgaatttctgagttcgaggccagcctggtctacacagtgagttccaggacagccagggctgcacagagaagccctgtctcaaaaaaaaaaaggggggggggttagttgtgtagactagttttatgtcaccttgacataggttagagtcatttgacagtagggaacaccaattgagaaaacacctccataagatgcagttataagacattttctttttcttttcttttctttctcctggaaatcactttgtagaccaagctggcctcaaactcagaaatctgcctgcctctgcctcctgagtgctagtattaaaggcgtgcaccaccacactgggcaagacattttcttaattagtgattggtaggggagggtccagcccagtgggtggggctattcctgggctggtggtcctgggttctgtaattaagcaaactgaacacaccatgaagagcaagccaggaatgagaactctccatggtctctgcatcagctccttcctccaggttcctgccctgcttgagttcctgtcctgactttttgataaacaggtatgtggaaatgtaagctgaataaaccctctcttccccaagttctggccatggtggttcatccgggcaattgtaatgctaactccgagtctttctctgggttaaatatagcccaggttggcctcaaacttgctatgtatctggagacaaccttgaacccctgatcctgcatgacagacatgtgcccataaccagcttatgtggtgctgggattagaatgaaggctttgatggttccacacctgctaggcagtattctaccaactgatttacatccccagccccaaagaattccccaaagaattatcgggacaacttcaagtctttccttctcttatggctgcactggagacttcccaccttgttaaagagccagtgctgttcccctggaatgtgagtgtatgcccccgcgctactggactttcgctgtttctttttgagttttaaggtgcacatgagatacctccaatgccctttaaagtccctagtcttagctgggcgtggtggcgcacgcctttaatcccagcgcttgggaggcagaggcaggcagatttctggaaacgccctacatagaccagaatgctccacccctgccccgcaccctgtgtggacaagaatgttccaccacctgcacacacacacacacacacacacacccttttaaattttgacacaggatactatgtatccctgactgtctgggaactcactatgaagttatgacgggcctggacctctcagaggtccgctgcgcctcttccttgagccctgtgattaataaacatgtgcattaccacgcctgtgccaccaaagtccctaccatttttaacatttattttcaaaggtcactttgcagcaatttattgggattaaacaaacggttcctgattccaactgaacatcttatttttgtaattttagggagaggtgtctcctctaaacccctggcccacagggctctagagtggatgccttgaagtaacacatatggtgtaatctctgcttctgagccctgctgggggaaagggcagccctgcttcctgtgtcaccctagagtatagctaactgcatgcctgggaagttgccaggtcatgtgggatgggcagctgtctgcatggtgtcattggtgggtttgaggaaatccccctgcataaaaatatcttctcccgtccagggccttggcacttaccctaaatgtatctcttaccattggttgcaaggtgatgtgggaggccaattgtttaccaagtttggccagagagtcccactagctctcagcgatgcttcttgcatccaaattcaccagccaggatgaagtgtacaggagacagttccttttaattagggacttgattcttcaatgtgagaaatctggggtgatggccactcaggggaaggaccgtgacgaggactcttaagttaccttctgactgatcacaagaccagtccaggagatggaaagagacgactgcttatgttcccaagagaattccaggctgccatgatggcctgggagtctttaatcccagcactcaggagacagaggcaggtaggtctctgtctctataaggtcaaggctagcctatagtgagttccagggttgtagtgagactttatctcaaaacatacaaacaagccgggcagtggtggcgcatacctttaatcccagcatttgggaggcagagacaggcggatttctgagttcaaggccagcctggtctacagagtgagttccaggacagccagggctacacagagaaaccctgtctggaaaaaagaaaaacaaaacaaaaccgaaacaaacaaacaaaaaactatacaaacaaaaataaaacacacataaaaataagtaaaaaacaaaaacaaaaaacaaactcaccacagaaccctaggcgtgctgaacaggtgtaagagtgtcagccaaaaccttacttgaggtgccacagcgaacaggtcggttaattaccaggctaagtcaccatgtcccaggtacctgtgatgtccttggcaattacagaattgtgtctaggagggagggagctattattagcctcaaattacaggtaaggaaactgagtcttcagagaggttcagcttgctcaacctccaaatggctgagtcaggacagaggtaaaggcagcacacatgggaaacctggcacagcctcctgctccagggctggacagacaactatgacttaccccgagtcatctcaaaaggaaaggaccttgtcctgccatagccttgatggggcctggatcagagtcaggtttgggttttgttttgttatttttctctctaaggccttgcgtgtgcttgagcaagtgatcttcctttgaatatagaaccgtctctcatttaaaaaaaaaaaaaagtattttcaactgaacaggcaggggtgctgcacaccttcagtcccagcattcagaagcagaggcaggcagatctcccagttcaagactagcctggtcgacagagcgagttctagcctggtctacagagcgaattctagcctggtcgacagagcgagttctagcctggtctacagagcgagttctaagacagccagggctaagcagaaaaaccatgtctcacaaagccaaataaaatataaatagggctagagagatggcttggtggttaagagcactgactgcttggccagaggtcctgagttcaattcccagcaaccacatggtggctcacaaccatgtgtaatgagatttgatgtcctcttctagtgtgtgtctgaagatagctgcagtgtactcatataaataaataaataaataaatctttaaaaataactaaatgagttaaataaataaaaataaatgagcttgtaatttattttgagatagggtctgactgtgcagacatgcctgacctgtgattcactatgtagtccatgctgaccttgaacacaagagagatctcttcctgcttctgcctcctcagtgctgagttaaaagtgtgtgtgtgtgtgtgtgtgtgtgtgtgtgtgtgtgtgtgtttaggtatccttggaggccagaggaggcataagatcccctggaatctggaattgctgggtattgaacctgggtcctctagaagagcagcaagcgctcttaaccactgaggcatccctccagtcctttccccctctttttttttttttttcgagacagggtttctctgtgtagtcctggctgacctggaactcactctgtagagcaggctggccttgaactcagaaatccgcctgcctctacctcccaagtgctgggattaaaggcgtgcaccaccacgaccgacctcctcccccccaccccccttttatgtgaatcttgaggcagagtctcagtgagttaccttgaatttgagatgccccagcctcagcttgtggaaaagttgtcagggaaatctctcgcttactagggctttgacatgaagagctgaaacctgggtttcattcacaacagaaaccaattaccctctttgttctagatgctatagcttgcacatagctgtcttctcctccttgtgtcttctcaaggttgtctcttggtgtcccaaccctccctccacccgacccccacctctctattttgaggtacagtcctgtgcttaacaggctggccttgaactcacagagctccacctacctccggatctctgggtttaaaagcgttttggaacaccacacttagggaatccagggaggcttaggcaggagattactgtgagttccaggtcagactatacaacatcgagactctgtctcgagtgaacaaacaaataaagaatgggaagcagtggtggcaaaggcatttgtcaccaaccctgaagatggctatcctttgatatccacaagaacacagtggcacacctttaatcccagacaggcagagctctgtgagttcaaatccagtctggtctacatagtatgagttgcagaaacagctagagattcatagtgagaccgaacacataagctaaaaatgtacttaagcaaatctatttggaggaattttaaatctatttgcaagctgcaagctggtaatccgggtatttaggagcctgaggcaggaagattgtaaactggatgccagtccaaacaaataaaaagcagcaacaacaactgccaggcagtggtggcgcacacctttgaccccagtacttgggaggcagaggcaggcggatttctgagtttgaggccagcctggtctacaaagtgagttccaggacagccagggctacacagagaaaccctgtctcagaaaaccaaaaaaaaaaaaaaaagcaacaacaacaacaaaaacgcaagcagatggttgacatcctccctgtctttctcagtttctgatgctgtgggtctggaatggcccaaatttgcatttctgatcggcttgcaggtgctggggctcgggaggaccacacactttcagaagcttccccttgcgaacccgtgactggggcgaagccgaacggacaggtgcgcaaagcagagaaaggccattttccatatctgttctgagagaggactggaaagtccccacacacctgaaaattccccagaaaaagttctggttatcatagtgggccaacttgtaaacaggttaccggaaagtgcctacattgcctggaccatcagcttgcccccttgccaagtagagcctgtccttactagtagtggtgtctccgtgagcactgaagcagcctgggtacgtcctagctgccatagaattttgacacgtcagccgtgtctctgtgacttggtgtcagtcgtctatagagcagagtgtgagtgtgtgtgtgtgttcctatgcgtgagtgtgagtatgtgtgtgtgcatccacaggcatcttcatgaaggcctgggtgtgaatgggccatggtgtgcttgtggaaatcagaggacaacttcagatgtggcctgggtgcttaccccccacccagagtgagggtctttcttttgtttgctctcagcagccatgtccgagattctcctgtctcagctcccatctctccatggaagcattgctgacattactcccttgcccagctgtgtgtagatttgaactcagctcccctgccctttctagacactgagttatctcctagcccagatgggcagctctttaaatatcatcacagctttcaatctttgtgtgtgtggatcataaatgcctatgtgtgtatacacgtaaaataaatgaccattaaacagaggcaaggaccatgtctttgtttcttctccattcttttctgcttcccagaattttgggcagtgtcttgaacgttgcagccattcctattagttacttcctcattttgtcaagattagtcagtactagggcatgacctgggagagtcacatttgttgagacaaggtctcacagtgtagctctggctagcctccaattcactaaatacaccaggcaggcttcaaactcacagagatcctcctgcctctgcttcctcggtgttgggattaaagacttgaggcaaatatcttttatttgtcctgtgacaatttcatacacgcaaacacaatctatcctaatcatatgcttcccaagtgccctctgggtgctgcgcgctggtcaggggtgggggttacgggcggggcttaatatagacttctggtttcaggctgagcattcaacattcacttatttccagactttagttagttatgagtctgtgcatcagctgctgctcacagcagataaacttcccgggacaatgttcactcgttcactctctttctttctttctttctttctttctttctttcttttttcttttttttttttttccgagacagggtttctctgtgtagccctggctgtcctggaactcactttgtagaccagggtggcctcgaactcagaaatcagcctgcctctgcctcccgagtgctgggattaaaggcgtgcaccaccactgcccggcttttttctttcttttcttttctcctttcttctcttccttccttcctttcttccttcctttctttcttcttccctttcctcccctctcctcccctttcctcccctctcctcccctctcctcccctctcctcccctcccctcccctctcctctcctctcctctcctttcctttcttccctccctcctgtcctcctcttctcctttacctctccctcctctcttcctctcccctcctcctccctccttttctccctttctccctatcttctcctcttcctcccctccccttcttcttcctcctcctcttctgctactgctgctgttcaccctccctcccctcctcctcctcccccctcctccttcttctcaccttcttagacaaaagggtctcactgtgtagacctgactgtcctggaactcctatgtagactaggatggccttgaactcacagagatctaagagtctatgcctctctctgctgggattaaaggcattccatcctatgcctagtccaggaccagtgtatcagcctgccctatgctctattagtgcttcatcatggaggcagatctcagccctggcttcctgtgatgctcaggtgccatttctcctgggcacaacagtctgcctgttatcccacgtcctggttctcttgaagatgggcctttactgtctgtgacctgagtgtgctttctaacagacagcaacaccccaggcatctcccaggaatgaatgatggcttgcatctaagtcacctgtggtccttgggcaagttatttcattttctaggtatgctagcaattaagagaattagagaaaaatatgcacatatgggccatatggatatacatgaatatgtatgtgccatatgtgccgtagaaaaggattaattaacacacagctaatattagatagcagttggacacagccatgtatacctgtaatccaatgacagtgacaggggaggctaaggaaggaggcctgcatgcagtagcttcaagctcagcctggtctacatagtgacccccaggccagctaggaatcaggtgaaaccctgtttcaactgctcaccctccgaaaagctagattttatgtgttttatttgtttgcaatggtaagacagggtctcatgttgttcaggctgtggttgaactccctttgtagccctagataatctttttttttaaattgtctttatttgtttgttttcgagacaaggtttctctgtgtagccctggctgtcctggaactcactttgtagaccaggctggcctggaactcagaaatctgcctgcctctgtcccccaagtgctgggcttaaaggcgtgcaccactgctgttcagctagccaaagataatcttaacccccacttctcctgcctccacctctgaggcctggggtgacactcaggttccaccctgcctggcatagatattattcttcattggatcacacctcacaccttcttcactgggcctctgctttaggaaactggttatctttttattcatttatttatagctatttatttctagtgttggggaaagaatccaggactttggaaatgttatggaagagctctctgccactgagatcggcccccaggctggaatctggaaatcaatgcaaatctctctctttctctgtctgtctctgtctctgtctctgtctctgtctctgtctctgtctctgtctgtctgtctgtctctctctctctctctctctctcttgtttgtagaccaggctattgaactcagattcacctgcctctgcctccggagtgctgggatcgaacgtaagagccttcacatctggcgaagcaccttcttgaagaaggcaaaattttgcttcaaaaatttgtttttggtgccaagaagtgaactaggcaagatctctcaccaagctacacacccagccccggaatttgcttgttttattttacttttttgagatagaatatcaatatatagttcaatgtggcctccgatcagaggtcttcctgccttgtcctcacttccttcctttttcagtcatcggagtccatggggttagaatcgtcctggccacctctgcctcgacgtttgtctttttatgagactgatcaattacgtttgtaccagtgaggcacgtatgttgtggctgtgttgtggaaaagcaaacagccatctgtcttttcattataatttatcaagacggtgactgggacagagggagagccagggagcaaccacatcgtctcgtgtgtgtggcctcagatcacatttgattctttttttagagttggcaacacagttcagcgggtaaaagtcctaccgccatgcccaccagcctcagcttagaccccaggacctgtgtggtggaaggagagagctgaccttctgcaagctgccctttgacctttatgcatacattagagagagaggaaagcatctgagctgctcatgggctctacatacacaacaggcctgcctcagccttcctaacagctgctagtaggtgtgtgccacctctagtgatgcttgctggctttttcctatttactaattggttatttatatttacatacatgtgcctgtgtgtgcacctaccctacatgtggaggccacacacacacacacacacacatcttggtgctggaattataagcaccaggcctgcacccagcttttatgtaatgttctcatggtacagaactcaggctctcattcttgcttcgacaccactttgccaactgcatcatctccctcgccacccccatttttatttttttgagaccagttttccagactggtctcgaaatcaagatcctctagggtcaatatcctgagtgctagaattacagatatcagcatcccatattgacttaaataatgtggcggtttaaatagtaaatatgggccgggtggttgggcacgcctttgaactgaacacttgggagtcagaggcaagtggaattctgcgagtgtgagaccagactggtctacagagtgagttccagaatagccagggctacacagagaaaccctgtctcgaaaaaaggaaaaacaaaacaacaacaacaacaacaacaacaacaacaaactagtggccaggaagaagagagaaagatcaggtggcctctccagtttggaaagagacaggatgaactcaggactagctgtttgccagctcggcttccattcataagaagggtttcaggtgcggctctgacctataaaaggatgaccttctgacctagttagtgtgtgagtgtctttttctggtctttactacttagctcaggctgccctagaacggccccatttctcccgcttcagcgtgtgccacggtgccccagccaagtggttccttagtaaagtggcactgttggacacctaggcaaagaaaggtgataccagtgctgtgtgtgggcagcacagctcgctaagttcccgggatcagccagttttctatgtagacacttggggactctcacttctgagcacctggcacatactgttgaggtctgtagtctcagggagctgaggcaggtggatgattccatgagaatgaagggtttgaatcccatctcaaaaatgtagcaaagctaagactccagtctaagtccatgtttaataacaaaaagaagattggggggctggagagacaactcagcagttaagagcactggcagctcttcggaggacccacgtttgattctcagcacccatgtgggggctcacaaccatatgtaactccagctccagtctcagaggacctggcgccctcctgtggccttcacaggcactacgtacacacgtgctatacatacatacatacatacatacatacatacatacatagcacgcagacacagaaattaaattaaatggagctgggcatagtgaagaaactaaagcagaaagatccctttaagatggaagtgtctatctccgagctagagtgagttttaagccatgctgggctacagttagattctgtggaaacaaataacatcaaccagagcaataacaataataacgagcatagagagaaaacaaagcaagccaggtatggttgtacttcagcggttgaggcagaagaatcacaagacctgtaccagcctgagctgggtagtgagatactatcttactgtcttagggttttactgctgtgaacagacaccatggccaaggcaactcttctgaggacaacatttaattggggctggctcacagtttctgagggtcagtccattatcaacatgacgggaatcgtggcagcatccaggcagacatattgctagagaaggagctgagaattctacatcttgatccaaagaaagcagaaggggactgtgtgccacactgggcatagcttgggtatcaaagtcctggacctcacagtgacacacttcctccaataaggccacacccagtcaacaaggccacacctccaaataatgccactccctgggctaagcatattcaaagtatgacacttaaacaaaacctcaaaacaaacccagcctggcagtacaacactacaatttcagtcaggaggctgaggcaggaggagcacaatttcaagtgtatctactgattgagttcatgggcagctcagagtccctgtctgagagggtgaaagacttttaggggatgcagctctgtagcagagcaattgagcatgccagaggatccaggttcacgcactcctccgtactgtaaagggcatgggaagagcaggtgagtggctcaccacgtacgggccttgctgtcaaacctagagaaccgagttctgttcccccactcagggtgtggaaggaaaaaacagattcttctaagttgttctctggctccgtcacacatcggacacatatcccacacactgacagattgtaaagagttagctattgtgtgcgtatgtgcatatgcataacccctgtgggatttatagccactgtgtgtgtcatgaacgacccagaggccagaaaaagatgatttcagatcccctagaactagagttacacgtgattttatgagctattgtattagtgctggcaactgaatccagacccaatgttcaagttcgatctatctatctatctatctatctatctatcttttttaaagacagggtttctttgtgtagccctggctgtcctggcactctgtagaccaggctggtctggaactcacagaaattgacctctctctccagcaaatgctgagagtaaaggtatatgccaccaccgactgcttaaaaaattttttttctttaattatgaagaaagcaaaggggggctgaagagatggctcagcagttaagagcactcgttgctcttccagaggtcctgagttcaattccctgcaatcactggtggctcacaaccatctataatgagatcggatgtgacagaagactgtgacagtgtacttacatacataaaataaataaatctttaggaaaaaaaaaagagaagaatatggaacagaacttctctgagaacataagttgattggtacccctcatctgatggttcacaactgacaataactccagctccagggaatccagcgccctcttctggccttttgaggacaattctgttaaagtatacacacacacacacacacacacacacacacacacacacacacacacacacatacatacatacagagagaggtggggagagatataacccaagccatcttctgtttattgtctggttacttatttgagaaggtggctgtcctacactcactatatagatgaggctggcttccaactcacaaagatctgcttgcctctgcctcctgagtgctgtgattaaaggtgtgtgctaccatgcctgcatccttcctgattttaaccattcctttctatcttttagatatctacactttaagatctatttttaaaaagctgactgtgaagctgggtgtggtggtgcacgcctttcatctcagcactcaggaggcagaggccagcctgatctacaaagtgagttccaggacagccagggctatacagagaaatcttgtaaaaaaaaaaccttgaaaaatcaaaaaaaaaaaaaaaaaaaaaaaaaaaaaagctgggtgtgctggtacatgcctttaactccagcactcagagggcagaggcaggtgaatttgtagaagttcaaggccaggcagattcatctcaaaacaaagcaaaaaacaacaaaatgggggggggggatgcacgtggaggccgtccttagaccttgccaccttctttgaacctttgccttggccatacaatccaaacataaccatagaatacgttttttgttgtttgtttgtttgtttggtgttttgagacagagtttctctatgtaacaacccgggtctgccctggaactggttttgtagatcaggccttaaagtctctgcccttttccccagtccctctgtctgctgagtcattctactggcccatggcttccaggttagggatgctaggactctaacaactgacctacagcctgcccccatcctcaccttcctgtttagaagatttattcattttgttttctttcattttcatgagtttggaaaggggaccaggccttttccaaactcatgaattcatagagagctgcctacctctgtctccttagtgcttctgaaattataacacaagtgtcctgttagttatgtgtatataagtccacttaacacacatgatgtcttcagaaactagagagcttgttagatcccctgaaagtggagttacaggtcagtataaactgccttgtgggtgctgggagttgaaccctgatcctctgttagagacaaatgcccttgagcatggagccggctctcctgctccacacccatccttttttttttttttttttttttttttttgagacaggggctcccatagtccaggctgagaaggtcttgaattcctgatcctcctgcctccaccttccaagtcttgggtaatcacagacaatgagtcaccatgtggatgctgggcatgagacctctgcaagagcagccagtgtttttaacagctgagacagctctctaagccccagaaaaattatttcagtgaattttagctatttattttttaggcatgttctcactagaccatcctatctggcatggaatttactcagtatttccaggctgatcttgaactctgagagatccacctgcctctgcttccaaagtgctgggattacagatgagggccactacaaccagcctaggataattactttgtaagagagaaatcagccatccagatactaattgcttctactgaattacttgaaaaaccttaataagaaaaagccagaagcccagtaggctgactcagtggtcggtctgtaaacctttcctaatccaaggccctggataagctctgtagcattgtaaaacaaaagtactttaaagccagtgtgggtacctggctgtggaggtgcacgcttttaatcccagcacttgagaggcagaggcaggcagatctctgagttcgaggacagtcaggtctacagagtgagttccaggacagccaagactacacagagaaaccctgtctcaggaagaagaaaaaaaaaagtttggtctggctatcccttcaaacttcctcctacacttctctgatgataagcattgcccggcaacctttgacattttgattcctgtacagtttagggataacaaacactactctttacccagatctgcaagtatggcttttgtctttccaaaaccatttgttatttaatcattagggtaattttcccgactcttccttagacgattatatgcatgaataggtatgtatgtgcgtgtgtatgcacacacgtgcatgtgtgtgtacaggttcacgagagggcaagtgcatgaagggaccagaataggacataggatcagtctcaagggagtcactagacttgggtgctagaaactgaactcaggtcctctgcaagagcagtaagcactattaacaacttagccatcatctcttcagtcccctttacttgtttgtttattgagaaagaggagagagagagagagagagagagagagtcagaggacaacttggggatttaaggacaaggacccaggagatcaaactctgtttggcagcacctttatccacttctcagttcccttatccgacatttttacctttggacccttctaggtataaggaccttccaacatcagctgtcctctgacctccacacacccactgtgatgtgtgcccatccccacaaatatgtttgtaataaaaagacgtgccaacaatttcttttcaaggtgcttgctgtcataattgccatcacaatgggctctgttgccatgtcatagctggggttagctttgtgctgggtctggggctagccttcacacttacaggccgactttgcttcttccagtgaggaggtaggtgatgttatctgcacccatgttacagcttaggaagaaaggctgagtaacttagccggtttcataaccaccaggtacctcttctcagtcccgaaagcttccttaatggaatcttctggtttatttatttctcacctttggccttattttttcctgtgctcacttaaatatcctggttgctgttgttgttgttgttttgtctgcttgggtttttttttcttcccttgttgatcatgaaccccaggcatgctagatgactatctgatcattgagctacatcctcagccataaggcttttccttttgacatatggtcttggttacaccactgtctggcttcactatactgctcagtttggcagtcctcctgtttcagccttccaaatattagaatgacaaggatgacccactacatcaggttcatgaattgctgttaagtgttctttacgttgggtcatctcccatcagaaacggttggataaagggtggttgtgcttgcagtgtgggcaagagggaaggcagaagcaaacgatccatgaatttgagaactgtcctggctttggcatgcacagtgagattgtatattaagaagcagaaaaagggggctggtgagatggctcagtgggtaagagcacccgactgctcttctgaaggtccggagttcaaatcccagcaaccacatggtggctcacaaccatccgtaatgtgatctgactccctcttctggagtgtctgaagacagctacagtgtacttacattaaataaataaataaataaatctgtttaaaaaaaaaaaaaaaaaaaaaaaaaaaaaaaaaagaagcagaaaaaggaaacaaagcaggtagacagtataaatcaacgaagagatagcatacagaaagtcttcttgttttaaggcaggatcttttgtgtctctgactgactttgaactttgacctgactctacctcctttgtcctgggatcaaagtaccatttatgcagtgcccagggatcaaacctaggattttcttctgtatgccaagcaaggaccctaccaaccgagcagcatccccagcccagaaagatttttttttctttgtaagaaccccacatgaccatcagatgggtggcagtgaacgaaggcttagaatttgttcagcaaaaaaatgtggaaatacacgcgccttgttcagaacgcaaggctttgaataagcgacaggactggagtgtatgtaggttggtgacagggtgcatgtgtaagaccctggattgatttcccaacatcagacacattccgagaagaggacagggcactttggacaggtggacttagttttcagaggcacaaagtctggaatgtgctgggagattgaaaacaagtggaaatagtcctgtttggacagagctgagggcctgatagagaactggaggtagttgtactggtgtttaacacatatttatttatagacagagtttctctttgtagacaaggctggcctggttagaatgttgtggttttaacgttgggcaccactctaggcatacctgttttctgattgcctgctcaataccagtgccatagatgtttttaggctgattaaagggagagctctgaaccctcaggagcagaatttgggccattctctctgctgtcgtatgaccctgtgtcatcccagtgacgagtcattttcctatctgcaaaaaaggaagtaattctccttcccctgggtttttctcctttcgtcatcagaaatgaatgagttagtccacagaacacaaacaaagggaaatatgtaatgttttgtaagaggcatccataaaagttatggagtctctgggcatctttataagcagcatggaaaacttgtaaaggaagcatttaaacgcgtgcgctaatgactacatccacaacaggctcgttcctcctttaaagatctctcagacctaagaacaacaacaaaaataacgaacaaggggtgtagctggctgtccatgactctggccaccagtatctcagtttatatggattacacagaatgagagtttacccatttccacacgtcgttatcaactctccatgaagttcaaaaggacaaaagatgaaagcggactcggctagctttccgtggtatttccacgtgcatgtggggactttcctttgagacaaggctggggtgggggccaataatatctggtatcgcctgactgctaataccaagctgatgagaaggtaactaccgcaacaacctctgattaaacccagcggcaccctcccaccctcgcccgcgatcaggaattttcctgctcctcccgccctctcagaaggggctgaggcagcatttggcaagagaaagctaacgtttgtgtcgtgatttcctctctcaggcgctcggacatggaccgaggggatcaggtaccccgggtcccttctaattctctctgcatttctaaattgagaatctttgtcaccggctcctcgcatcccaggtctcccccacttttcctcgcaggcctgtgactggcctcggtgtgcaaaatgccggtgactcacgtcttgcacagccttcgcccccaaaaacacaatcatcacccccaggatctagcccacataacatcgtcaacccgccccagcagccttggaggtctccgggctgagtcacaccagaggaccaccctggtcggcatccacacacacgcggtccctactcatggcttccgcgcccgccacaccaacgcccttccatttctcacaacttgctacgctccagctccaatcctcgacccccctccacaacccaaatctccgggaaacacagagccggcagagctggcctcgggcggcctttgatggctttgttattgtttgggtttgaatcgatacgcccctccccatccttcctcccccgcccgcgcgcgccacccagctcccgcctccctgcacgcccagcgcccctccccctccgttttggcgccttttccttcccgccacgtcgtggcggcgttagcgaccattctgaccgcgaggcgagaggcggggcccgcaacgccttatgcaaatagggcgtcttctggttggctgaagccgcgcccgagggcggggccggggagaggggtgtagccgcgagggggcggagcggaggggagcggccctggtcccgccgcctccccgccccctctccgccctccgccgccgagccagcccggctccccacctcggcctcccggagaggccccgccccgtccccgcccgccgcgcgcgccctccccagcggcgcgctccgcccctttactcctggcggcggggcgagccgggcgtctgcagcagcggccgtggcggcggaggaggctggaggggagtcggcagtgccggcggcgggatcggcagtagcagcagcagcagcagtcacagtcagcagcagccctgggtcccgcagcgcctctcgccctgccgcctcccgcactgcctgacccagccggcgaacccgcccgcggccagccccgccagcgccctcagtcgtcctccgactcgccctcggccttgcgcgccagccgcagccagagccgcaacgccacccgcagtctgagtcccggccgtcggctcagccccagctcgctccgccgccgctgctgctcgtcccggcaccggcgccgcaccgacaccctggaggtggggatgctcctgtccaagatcaactccctggcccacctgcgcgccgcgccctgcaacgacctgcacgccaccaagctggcgccgggtgagtgtccccaccccaccctgggcgcgcgggtcgttgggacgccgggagacccccgcgtgggtcgagcgcgctgagtgtcccgtgcctctttcctaggcaaagagaaggagcccctggagtcgcagtaccaggtgggcccgctgttgggcagcggtggcttcggctcggtctactctggcatccgcgtcgccgacaacttgccggtgagtgggcaacgccgcctcggggagggcgcgcggagggatgctttgagcaggagggtctgatggagactcgggggtcttcttccaggtggccattaagcacgtggagaaggaccggatttccgattggggagaactggtgagtgagccggagccagagaccctctcatgggtgggtgggtggcgacgggcgtgccggaaccggcgcgctaaccctcgccctcactctgcagcccaatggcacccgagtgcccatggaagtggtcctgttgaagaaggtgagctcggacttctcgggcgtcattagacttctggactggttcgagaggcccgatagtttcgtgctgatcctggagaggcccgaaccggtgcaagacctcttcgactttatcaccgaacgaggagccctacaggaggacctggcccgaggattcttctggcaggtgctggaggccgtgcggcattgccacaactgcggggttctccaccgcgac

SEQ ID NO: 167 - DNA, 25753 bp, Mus musculus
gtgaaacaagtcattttattgcctgattttgtggctgtcatcctccaaaggccttgtgacatttgtggaaatggcccaagatctgcgcttcaaacttgagatacttacgccttaaactgaccaaagcatgagtgaggtgtaaagtggagactacttcaagatggcgagagatcattctgggtgtactcgatggattttccaaaaccaaactgaaaagaccaccatggataagggatgaccatgatgtcacacaagctgcctccgttcttcaaagggtggaatcggctcttaagtcattgttctgaaggcggaaaagttaaaataaagtatgctccaacaggtagaagaaaggggaccccctggaagcattcattccttggagacttcacttgtctccatctggttttcctttatattataagcaggcttctgctggctggagtaccatatacttgtctgatcacatttctagccacggtctctgcagctgacatgggcctgtgggacatctactcaaaccacctggtactgtggcaccaagcgagccaagatggctggcctgggcccttcaatgtagccttggcagagaagctgactgactcatggacagtggagctctccgttctgaacctcatggcctcatgtgatgattgcagatgcttttgagccaaggagagaaccccttccaggtgcagctgaccagggaatgctagccagagctgccaaagaaaaggcgtggggagcagagagctatctcttgctggctgtgggatctcatctccttttgtcttgtttaggtttctcctctgcctcctacttaaaggtccatgttaaaacccaccacggtgttccccttccccaggtctccaggcaccaggaacccatcctgaatgggggagcagcgttccactgcgccaggacctatggcaacaaaggcaagcgaccccttgctctgcactttgcttctctgcgcagactgtgttgtgggggcgctgggccgggtggtggggaggcaagaatcgcagtgctctctaggacaaagtttgccacgggtttctcactccaggacagtgagtgaggctttagggtactgctgatccagcctgcctcctcttccccagccttcttccttcctcttggctagcccccattgactggagccctacagggttgccctagggcaggaagaggagcactgcatgaccagttactctgggcttagatactgcctattgccctgtaggacctgtgtggacctggtgctgaatgctttcttcttggttgatcttgtgggtgggtgggagccagcggctggcttatctatgatatcggtggtcggttgtcatttgtgagacgcatggcagtaaatgagctacctgattgcctctggtttgggattggtgtgacaagagtttccaggctcattgttaacttgttggttcatggtgtttggggtgtcatgttgttgccttttgccaggacgtggcggatggtagagatggcatgccccgtgctcccatcacagacctcccatcttggaatggctctctggacccaggcaggaagctggtagttggtagtagaccccagtgtgggccaggcaaggtagggcagtaaggaacatccatgtcttggtctagatgggctccccagctgacagagctgttcagagttgcttttcatctgtgtgctttggctgtatggccctggaaagggctttgcagaaatggaaatgtagaccttgtataagcgttggttgccgtgtgagccatcagtaggatctagccgagtagaggaactcatggttctcgttcggcctgctttgtgaaggtagccactggtgtagcgcagggacaagccaacgacccctgctcatcataaccagaacagttttgcacctggaggcacctggagattggggatctctgggttgttctgggcagaagtaagggggatccctccttggccttccgcccttgaagcaggctgaggtgatggtgaagtctacacacacatcctcatttagagcttatagtgagggaggctggtggctccagggcactgtcatcttgcccctacaggcattccatgctcctactcagaccagccaaacctccatgggttctgccaggttagtgactgagctggcctgtcatggtccctccaggagggaatggctctaatgcctggcctcatctctgccctcttttgttttgccatagaaggccagaaatgctcacatcaggatctgattgagagctccgactcctacggtgacctctccgacgccagcgacctgaagacgccagagaaacagagtgccaacggctccttctcctgcgacgtggcagtccctaaaaacaaaatggagtctgacggggagaagaagtacccatgccctgaatgtgggagcttcttccgttctaagtcctacttgaacaaacacatccagaaggtgcatgtccgtgcccttgggggtcccttgggggacctgggccctgcccttggttcacctttctctccccagcagaacatgtctcttcttgagtcctttggatttcagattgttcagtcagcgtttgcatcatctttagtggatcctgaggtggaccagcagcccatggggcctgaagggaagtgagacatgctgtgtccccacagaacagccgctggggactgctgagcaatgctgtgaatgcagagggaagtgatgtctttgggttctgtagctgagagatttttattcatttttaaaccccatccctgcccctccctccctccattaaccccacctgctgtggtcttagaaacagactctcatctgatactctctgtagaaatactgagagacccaatatggggcaagggcagaaagcactacatcggcctctgaggcagtaccagttctggtttctctagtggtctgaagccagaatttctggtgctcagttattggtgtcctcaccccaactctaaggcactcttgggcctcgcttggtagttttggtccctcccacttctttcattcctcacccccctgcctctgtcctcaaaagaagttaagtagggtctctaccctcttatggccaactatttttaaggaagccagaaacctacagcatcccatggaccatacaaagagtgtcctctgaggttggccctggtcttctcgagctgctggaagctaacatttcactgccaggacaagctcacctactgaggacacttctaccccaaattccagttcttacttgagtttaaccattcagcttgctgttgggttttgattctctaattcttattattgttatttttaggaccagttgtagtgaattgctactgaaagctaccccaggtgacacagctctttgtaaaccgcagtcacacattagggttagtattaaactttgtttaggtgtaccataattaacttggctagttgtttgaagtctatggaagaaatagttttatgcaaaattttaaaaaaaaaattccagtttgatcaggaagagggttccgtggtgctgagagccaggaaggtgggagaacctcaggtagagacatcgagtaccttgattgtcttacacttgagcagcccaggttgaccttgtgatgtgaattgacctgatcagactttattaaaaacgttagtatgatatctctgcctgctcccccgagtccactttttcagcagtgtcttcggaacctggaatcagccgtctatacccactgcccaggaggggccgtgagggttccggagagaccttgtttcttctctgctgcacctgttcattgtgcctggcagaacactgggtagatgttcccaccaaaggacttaagttccaggactcattaacgcaacacatactaagcctatattttcactgctgtgtaccaggtatgtttcagggtctgtaatgaacaaaataacccttggacttaattggagacagagttaacaagcagatttggatctggcttctggataatgagaaatgcaagaagaaagacagcagaagtggtgggtcagtgacagcagaagaccacagtaggtagggtggtctaggaaggtttgaggcaaggggattcaaggccgtcatctgctatggagggacatggcagggaaaagaaatgacttgtatatatgtagccacttgaggtccgctcccccatgttatctagcttgctttgctacttgttacttgtgaatgaatgaagaaaagacatatttcttttttctttttcttttttttttttttttggttttttccagacagggtttctctgtgtagccctggctgtcctggaactcacttggtagaccaggctggcctcaaacccagaaatccacctgcctctgcttcccaagtttggttttggctttggttttggtttgaaaagacattccttataaagatatacttagttctgagggtggaggtaggagtagcaagcaacacacaggacagggaagtatgtctgtccgtctgtctgtctgtctgtctgtctgtgtgtgcatgcctgctaatgtctgtctgtgtgtgtgcgtgcttgcacatgtggctgtcaaagggcagtccccagttccccagtgctgttctacaggagtcatctttttttttttttttttttaatgttcactgatgtttgcctgtgtgtatggctgtgatgacgtcaggaactctggaactacagctacaaggcaggtgtgaggtgccatgtggttgcagggaaatgaatgtgggtcccccggaagagcacccatgcttttaacctctgagccacctctccagcccccatcttattttctgaggagctctttcactgccccagggttcactaagcaggctatgctggccagcctccggacccctgggattactggtctcccagttctggggttgcaagtgcacttcactgtgcttggcacttttttctttttaaacgtgagtttcttctggggctcatacgcaggttatgttttcaaggcaagcacttcactgactgaactatcttccagccccacagaggcttaatgggaacaaaaccaatcgccagagggactggcaaacttaaagcacttccaaggatcttgagaaatcaagatcaaatgaatagaaatagtctttcatctccaaacagaaaaaaaagaaacaatcactgatgaagagaaagagacaagaccagaagggacaaagcacaacttcccttagccccgagttaatactgattaattacattgctgttctgctataaaggcagagccttcaagccatgcatttacatgagctcttgggtgacctgctgggtgggctctggccatttgctctgacttagcaagcaggatgatgtagcatgctcaagttctatagactcagctttgtgaccattacagagtttgcaactgatcatacttgtgttgaagtgtaggcctggccttgagccaaggacttgatgaagttgctgagtccttccaaagattttcttagttctgtgcttagaacccctgacactgccttggacaggtggggactgtatttatttctgtcactgtcctatggcaggaaatgaacaacaaagcaagcaggtgcgtttgcctgccccaacagcctgtatcctccatgccatagacagaagctgtggagatcatgatgcagagagggtgatggcctccatagctgcccaggatttgcttctgcaaatttccaaaggtcagtctcccatcagtagacagagggaggctgaaagaccgccatcacaagctaagggtgtacccatgcttagagtgaccctccgtatctactgggaccacaccccaaacttccctgggctttactaaagtaaaggtagatgtgtctgcgagcgcaccacagagctagcccagcgctgctggaggggaaatttgatcaccagaacatagaagccggaggcctagtcaggtgggtttacggcagttgtagaacacatttgagatgctttatgcaactctggcctgatgtttgcttgtaatgtgggaaacaggactgctggggagggtgtagtaaagctgttaagactgttatcaacagggtatgaaagcagcctcctgtgggaatgagtaacggctcttggcttcctgttccttttctctttttttttttttttggtttttcgagacagggtttctctgtgtagccttggctgtcctggaactcactttgtagaccaggctggcctcgaactcagagatccacctgcctctgcctcccgagtgctgggattaaaggcgtgtgccaccacgcacagcctgttccttttcttagcagccctcccccaacccacccccaaaaaacaattgtgtagctcacctctgaattccccaggctggatttgcttcctacttggtatttcctgaacacaagtccacacttgtaggtctttttgttttttaaacgtgtcagcctttatgatttccagtcatatgctgttccaaataaatacactagccattagtagtaatgacacactaaaggtgccaactacctgtctaactatcacatatatcaattcatagtcactcagaataaggagtgactaatttaacaaccaacaggcttgatcccaacacagccaaagcaagcagtgagaatggatcccacagtgcaacctgagctgcttctgtgccatcccccagtgggactgttaggactttaccacagccgtcccgtccagctagtgtctacagagagctctcaagcttagagcctgagtcacccccagccttgtgcctcttgctctaccccaccaagtagctttcactacaagtcccccactcatccccgtctgtatgcctgcatcttccacgacccacaaccaccttgaactgctgctgctctaagcacagtctcttctctgggcaatcgtcactgtgccctggttcatgctcatccaggagacagagagcctggttcagaccctccaggaacttctttcagaatgatgtgggcctgtttcctcaccaaaacctacgataacaaaaaagcagtttttccagggctgctaggagaacaaagtagctgatccctacctagtaaagcacattaggaaacacgcaaaactcctttcaggttacctcaaccatctttgctcaaaccccttcactgtaatggagacagtgagcaagaacaggactagcaaacaatttctgtgcagtgccaacaggtaagcatttttgtcattaaaagagggagaatttgttttatgtattttgaccattttaaactgcaggttgggtattgctcttttataataatcccaggacttcccaggaggtagaggcaggaagatcaggagttcaaggccagcctcagccacatagggagttcaagaccagcttgcttgggctgtgttcaaagaaagtaaagcacttagctgtaaataaaattgaaggaagtcaatgactgtgaggccaggcttgggttaggcttccagctgccagtgtatattttgcgaggcctcgtcctggcttagagggtctagcctcctgctggacggctctggggtcctggtctgctgtgcagtgccttatcttccaggaaggctgtactgaggcagtctattcaaggaggtccaatgtgcttattgccacggctgcctaaccagttcactttctaccctgttttttgagacagggtttctctgtgtagccctggctgtcctggaactcactctagaccagactggcctcgaactcagagatctatctactctttgcctcctgagtgctgggattaaagtacaacacacccagtttacaggaacctctttagagtttgattttccactgtggatccaacagatccaactcaaagattttgcagaaagcactttacctttttgggggggagggacttagaagtgggggaggcagggtcccatgctatgcactggagccctgagccctttcacctcacagctcctgtttatttgcttgtgtaagctgcttcctctgcctgtaaagttcttatctttttatctgcctgagaaactccagaggcccatatctgattgctgctgtctacagttttccctgcccccacctctgctgtaagacagctagctggcacacttgctgggtgccaggcacagtgccccataaggaaaatattctacttgaaggttcagagaagtctagtgactgcttatgtctgaagatgtgaagggcaaggtgagggctcagatctgagctgtgtgtcacttctgtacacttccctgttctgcacggttcccacttgtgcgtggtctgtcccttatgatactcaggctcaaatgaacaagcacactagacaagagtaaaagaccaagccgagatgcaggggagaggtggaagcccgggacaggtagacatccccacaacttgggacccttcccaggataccttcccctccagttcttggaaacatcttaaatgctttaagctgtaaaaggcacccaggaactccaaataggtcatctttgtctcttgtgacaaggacttggactcggccctccaattcaccctaccccaacaaggagattactcttcataccaataactgaaaccaaaatgctttggtccatcccacaaggaacactgacaaggaacccttaaagatgagcccttcctcctccagcatcagctcagacctgcaacctataccttctcctttactttgttctaaatcagtacgtgttcagatgtggacacaggttcaagggaacagagggtttgagatacagatacacctacttcaggccttccatgattccagccacagggaacacgtccctgactgccccctagtggctcactcttcctctcccttgctgccttcctctattagctcccctccttttttccttcatcctgggccaacccttactctcagggactcagaactcctcccactgttttgcagagtacattctccctttgtggggtgggggaaagcaaaagaataccaatgataagaagaatgggcgggggttggggggtgtatagttctggtggtagagtgcttgcctaatctgcatgaagcctagtactctatcttacagagtatacaccacagtaaataggtgtggtgcatagcagttagaaggttcaagagaagttcaaagtcgtacttagctatatagcaagtttgagaccagcctgggttatacaagactctcaaaaacaaaaacaaaaaaattgtcaagccgggcgtggtggcgcacgcctttaatcccagcactcgggaggcagaggcaggcagatttctgagttcgaggccagcctggtctacaaagtgagctccaggacagccagggctacacagagaaaccctgtcttgaaaaaacccaaaaaaaaaaaaaaaaaaatgtcaacaacctttaaaatatcccctttaaattaggaattccactcttcgaagctatacaacaaagcaactctaaagatcttattgtccaaaactcatgcaaaatgtccatcagttagctcatatataaagatcatttcaaaacatttgataccatgagagaaaaaggcttatgttaaaagctgttatggtttgggtggtggtggtacatgcctttaatcccagcacttgggaggcagaggcaggcggatttctgaattcgaaaccagcctggtctacagagtgagttccaggacagctagggctacacaaagaaaccccacctcaaaaaacacaaaacaaacagccaaaaaagtaattatggtacaggagacatagctcagcagttaagaacacttgttgctcttgcagagaacctgagttggttcaaggtactctcatggtagatcacagtcatccataactatagttccaggagatctaacaccctcttccaacttatgcaggcatacataagagcagacaaaatattcctacacataaataaaatataaatctagaaatgatacgaggggctggggagatggctcagtggctaaatgtgcatgctgctcttctggagaagggtgactcctagcacgtacagaagttagttcacaactacttgtgactctagctccagaggatggaaaagctctggcctctgaggacacctgcacccatgtatacccagacacacacacacacacacacacacacacacacaatgttaagggttacggaaaagcagttattagaaagcagcaggctagccagtcgtggtggcgcatgcctttaatcccagcactcgggagacagaggcaggcggatttctgagttcgagatcagcctggtctacaaagtgagctccaggacagccagagctataaagagaaaccctgtctcaaaaaaaaaaaaaaaaaaaagaaagaaagaaagaaagaaaagaaaagaaagcaggctgtaaggaaacaatattgcttatgttacaaggtttaaacagttaaatacaggaaatgtaattgcagctggtttgcttgagtccctcatactgttaacataaagatgtaatgccaagtcaagccctttcccactgagtagcttgatgtgtaccaagcatgtgcttggggtgttggctcagtgctaagagtgcttggccaggaataaagtctgcgtttgacgcggggtaacacaaacaacacagaatttaaaactagtaagaagtgtctctgttgtgaagactcattttgaatgtttacagatacaaaatgatccactttggggctggaaaagggctcagtggttcagaggtactcttacaggggaccagaatcagttcccagcacacacatggtgacttataactgtaactaatttgagttccagtgtatctgatgcctcttctggcctccacaggtaccaggcacacatgtgatgcacagacatacatgcaggcaaaacacccataagtataaaattaaactttaaaacaacaaaaatattcattttgattttgtgttaatgcaggagcttgctcatgctaggcaaagacactactgtcagactacaatcccagttctagtatttatttattttagttttttaagacagggtttctctgtgtagtcctggctgtcctggaactcactttgttgaccaggctggcctcgaactcagaaatccgcctgcctctgcctccagaatgctgggattaaaggcgtgcgcgaccatgcccggccctagtatttatttttaagatgtctctctcaagcttccctttcctggtgactcatgtggaaggcagatgttatagttcagacctagaatgtcctccaaaagcctgcctgtgtattaaaggcttggtccccagtttggcactattagttttggtaaatttgaataaagctgccataaacatccatgtgtaagctaggtgggcggacatatgctttcaacaactttgtataaataccaaagaacatgcttgctgaatcatgtggtaggaacatggcaattttttcctttgtgtgtgtgtgtgtgtgtgtatgtaaggcagagattgatactgggtttcttcctctaccctctagtttctttgtttaaagctggcaccctggtgagggtgctccagtgctgggattacacacctgtgcggttgagcttggcttatgtaggtacaagagccatttccacagtctaccctctttctcctccccctcctcctcccccctcttcttcctcctccgttttttgagagacaggatcttatttaaccttgaactcataatcagtcaagtaggccccaaattccacatccttcttctatttcccaggtactgggtacagatgcacagcactacaaacagctctaattttgttttgccttttgagacagagtctcattacacactttacaaagctggttttgaactcacagagattctcctgcctttacctctgattgaagctgaatgctggggatggaggcctagccctctgaatcttggtgagtgccctgacactaagccacagtttggagaggttgttttttatttttatttttattttagcttattttgaaaatgggttaagttttaagagtatatgttgcaggatatttgttcacactgtgaaccccaagattgttatttactggggggaaaaaaaaaactgtttctagttgtggtgtggttcagcccttagcgcgctcttttaaaaaaagttgttttatgtatatgaatacattgtccctatcttcagacgcaccagaagagggcatcagatcccagtacagacagttgtgagccaccatgtgggtgctgggaatcaaacttaggacctgtgaaagaacagccagtgctcttaaccgctgagcatctctccagccccctagcatatacttttaatctttctggctggaaatgtagaaggaagcactcctgttagaaggatttaacagaataagatatgcccagttctcagagaagagagggaaacgaagctacttaagagagaacggcacaaccgggcgtggtggcgcacgcctttaatcccagcacttgggaggcagaggcaggcggatttctgagttcgagatcagcctggtctacaaagtgcggcgttccaggacagccagggttatacagagaaaccctgtctcaaaaaaccaaaaaaaaaaaaaaaagagagagagagagagagagagagagagagagagagaacaaacagcacagagaggaaggggaggagccagtttcattgggagagttttacagagacaggctgaagagagagcaagatagacacaagtgaaaacagaaagccagtgaacgagaaaaagctagattagaacagattgctaggggctggagagatggttcggcggcggttaagagcactgactgctcttccagaggtcctgagttcaaatcccagcaaccacatggtggctcacaaccatctgtaatggaatcggatgccctcttctggtgtgtctgaaaacagctaccgtgtactcacataaaataataaaataaaaatatagagcagactgctagagttagcatggggccaagcacatcaaaagtcagaggctgagggtgaagccagattgaatgagtcagcttggagaggacttcgaggcagaacagctgagttgaaccaacctgtcagagttcagaaagaacaaggaagggtgagcttagtcagcagcaagcctcagaggctgaaaacattttgagcaatataagattgtatggaggctagaagcttccaggactatgcctaagttagcagactgaggcagtaagcctcagagatgacaattacaacaggcaaataaaagttctgtaacaagtatagcttagtgtatagcgtagtgtatagtttagtgctgtataacacttgtctaaataaaataatctaggtttagtggtccatatgctgcagttaggagactaaagtaggaggactgctgctatgagttcaagacgagtctgagcagtggaaatcctatctcagcaaacacaaaattagaagaaaaaaaaaagtattgcaaataattaggtcaggtgtgctggcattcggtataaggcaggggaattcacagtcctgacacaggggctggacgatggctcagcttttaggagcacttgttgctctttcagaggacccagcacctataaggtggctcacaaccatcagtaactccagttccaggggaatctttgacaccccccccttctgacctctgtggatatcaggcacacacatggaacacacctctacctgaaggcaaaatactcatacacataatttttttaaaaaatctatctatctatctatctatctatctatctatctatctatctatctatctatctatctatctagggccagatgtggtggtgcacaactttaccagccctcaagacgtggatctctgggagtttgaggccagcctggtctacatagtgagcttcaggcaaatcaggactgcaatggtgagactctgtctcctaaataaataaatctatctaaaaatttttttaaggaaagaaaaagtttcaggccagcctgagtgtagtagtgaagtggtaagttctggcctggcagtggtggttcacacctttagttcccagcatttgggaggcaaggaaagtggatctctcagcttgaggtcagcctagtctacagagtgagttctatgacagccagggatacacagaacccatctccaatccctgcccccacagaacaaaagttctgtgtatatttgctgagtagtcctccatcactgtgtctcacacaagtatttcctttgactgtgttggctcatcctctccctctctgacattgtctttcccagagcatacattttagtaatttccattaagtccatcctatcagtggcttctttcattgcatcaagcctttgttattctctcccatacctgtctgtctgtctgtctgtctgtctaggatgtagtctgggtcagcatcaaaattgtggagtgccttctgcctcaacttcctgattgctgggattgaccactgtgctgatgtgttgtctctataagtagtcactaacccacaccctctaaacgttaagaaaatcatgtgtgtgcacatgcatgctcatattagatgactactgttagagttggttcttgtcttctactgtgtacattccagatattaaactcaggttgtcaaacatggcaaacatggcctttatttactgagccatctcactggcccctcatttagctcccacacccttgtggagttacatgtttggttttacactttatatcttattctatgatatattaatttttgtgagatgtatgagtctaatttttttatgtggctgcatagtttttctgtaccaacatactgtattgtctttgttcctttgtcaaagatcagtttccctggaaataggggcagcatacctgtagcctcagcttcttgggaggacaaaggctgactcaggagttcaagattgatctgggcaacatagtgaaacccaccttaaaaaaatctgcttacagtatttcttgttctatttgtgggctgtattcttgcactgatatacttgtctagtacatgaagtatgtgcgtcttctgacaataagaggctgtctcagtgtaagaagattttggtttgcatttatttatatgcatgtgtgtagcttgaatgtggaagtcagaggacaactttcagttggttgttggttgtctctttctaggatgtgggtccagggatagaactcaggtcgtcatgcttggtggcaagtaccattacccactgagccatcttggcacccccaccaccatcctgttctgagtctgaagaccaaagaatttctgttctcaaagtgtagccccttacttcagtgttggtttggctattctgtgtctttttcctctctccatgtaaacattaggaatcagtctatctagaactacaaataacttactgggattttgggatggttatgaacctataagttgtgttggaaggactcacatatcttggcagcatcaagtcatcctatccataaacatggacagtgttattagttatttgattttgttcatcagcattttataagcatttcattaaatctgtcttatgttccatttttcttctgtctcactttgagtgtactgggaagcaactgagttttttatatttgtcctacatgaccatggaagggactgcttagcatggttctcacccctggcgaagagtcagaagagcatgggcctccaagactgtttatggttactgtggtcacagggcttgtctgtataataatgtacatattttactttatgttcccccttcaggagatatttcccctgccatgataattagaaacagtacaagtctgggagttaagggtgtatctatgttcctcagcaaaaatggtaaacactgtgactttcaggacggcccttaaaactgtgggaaagaactctgaacttgaacatgagttcaagaatatataatttctcaactatgcaaaatataaggatgctctatgaattgtataaggagcttcacggacctaaaagaacagaggcagctgcaccaataaaccagcttgtcagaaagatacaaaggtgggcagatacttgagttcaaggtcagtttgggacagagccaatttaagtctaggcatggtgggaatgatatcaggatggaaccccagccgggcatggtggcacacgcctttaatcccagcacttgggaggcaggggcaggtggatctctgagttcgaggccagcctggtctaccaagtgagttccaggacagccaggaaaccctgtctcggaaaacaaacaaacagggtggaaccccacccagctagtctgtgcttacaaaggcatgcaaatctctgaattcattttcttttctttttctttctttttttttctttttctttttttctctttttgatttttttgtgacagggtaactctgtgtagtcctggctgttctggaactcacttgaattcattttcaatgttaaaaaaaaaatgcacttgctgtcttttcctaagaatcaaggtgctttggtcataaaatgctgattcatgggataatcaaaaggaaacctggagtaactggcttgatatgtaaataaaagactgggttttgatctataagagagaactgcttggagagtgaacacagatcttttagaattattttttctagcatgagagagctgtcttgagcagactacaaagctaagggctatctacagagctgtctcaagcagaatacagagctgcccgcttgcaccccacctcattggtgtttcttttgctgatctcagaccccctcttcaatcaaggctgatccttggcatatatcagccttatatcctgcagcgttctctgcaatgtcttattacaaacaggttgtcttgtctgggaagtggtggcgcaggcctttaacctcagcacttgggaggcagaggcaggtggatctctgagtttgaggccagcctggtctacaaaggtagttccaggacagccaaggctacacagagaaaccctgtcttgaaaaaacaaaacaaaacaaaaaaacaacaacaaagaaacagcttgtctgccagttctttgggttttctagagctccttacatgacctgtgagcacggacagtatctccccttcctttcaagctttgtacctttttattatttctttttgttgttatattgcatttactaggacttcccatacggagagaaaatccttgtctttcttgttcctcaccttggtgaaaaaactcgtaagttaactataatgttcaagtgtttcacagatattaccacatcaaagaagttcctgtttattcctagattgtaattttaaaattataaatggatattaaaaatctttattaccttttatttagtgtgtgtacaccatggtggtaatgtatgcaggtcagagaacaacttgcaggtacgagtgggtcccttcctcccaccattgggtcctggaaaaaactcagctttggcagaagccgacacctgaattcaaatatttctttctttccttttaaaagcttaaacagtgtaaacatttttatgtgtatgtgtttttttctgcatttatgtttttgtatcatatacatgtccagaatttgcttctggcaccagtccatcaggagtacttgcttctggcaccagtccatcaggagtacttgtatgcatgtgaccagaggagaccagaaaggggaaacaggaaaaaaaatttaattcttcagctagacaaaacacaagggcaagggtatagttacatagaagagcattgcctagtatctgtaaggccctgggctcagtcaccaccaagacacacacacatacacatacatacatacacacacacacacacacacacacacacacacacacacacgaacagatagacagacacacagtaacacacagattcacacacatagacacacacagatacacacgagagacacacaaacacagagatacacagatatagacacaaacagatacacacaaacacagacacatattgagcaaatacagacacacacatgaatatacagatatgtacacatagaaacacatgaactcagagatacacatgaacacacaaatgagcagatatacacacacatatgatcacatagatacacagaaacacaaacacatacacactctcttacactctcacatatacccatgcagacagacagacagacagacacacagaaaaacacactcggtctcatagacacacaatcacactcagacatacacacatgaacacacacatacaaacacacagatacacaatactaagtacatttttgaaatggcagttttgaggttcaggtgagtgaaaagccatatggatgttgtactttcctctgggataaaatatcacatcgtgaagcgaaactgttaaaatgaaatatattctgagcgttgtggagaatattccatccagaggacaaactcattaaaacccaggaagtatataactcaaaagatttcagcacgtccctgaaatgagcaagaatcactaagcccctttattccccaaaatacgtaagcagtaagaacatgagagacagcttggacaagagcagctacctcagagaaactcagagcagttgaactgcctgagaccttttccaacttgtccagctgccccggctgtggggtggattttggtgattcagtctttgagtctttctgtcttataactcttcacccatactcctgtacataacaccagggccggctggctttggtggtatctttctttgttctatcatcgttcacagtctggatgagtaaatattcgtgcacgaatagtgtcacacaacaatggagtctgtctgtccatccatccatccatctacccacaatttactaaggggctgggatgcagatccactgctaaaatgcttcttaggaagcacgaggcgctgggttccatccctaataaccttgtgcattaccaggaagagctgcgagaactggtagcaaagctctaagcatctgggacaaggtggtgggtaggaggttcatgggattcaagtgggacagacaaaagaataagcccggcgtggtggcgcatgcctttaatcccagcactcgggaggcagaggtaggtaaatttctgagttcgaggccagcctggtctacaaagtgagttccaggacagccagggctacacagagaaaccctgtctcaaaaaacaaaaacaacaacaaaaaagaatataaccagggctggggagatgcttggtgcttcaatgcacttgctgctcattcagaggacttgagtttgatctgaacactcacatcggatggctcacaaccagctttaactctggattcagcaccctcttctggcctccacaggcacttaaatggatgtggtgcatataaactcaggcaggcagacatatcattttttaaaagaaaaaggtaagcatgataccacatgccttttatctcagcactcagaatgcagaagcaggcagatctctatgagttcaaggccagcctggtctacatatcaagtttcagaccagtaaaggctacaaagcaagaccttgtctcaacttctccagtccccaacaacaaacaatgtgaggccagacagcactgactctacagatagctcagtggtagagcacttgcctagcatttaacaggttttaacttcaatttacagtatattttacacacatacagaaatgtgtacacaagtgtactgtgaaccccccaacacagacagagagagaatgttaggtataataacatttccaaaaggggctggagagatgtctcagtggttaagagcactggttgctcttccagagatcttgagttcaattcccagcaaccacatggtggctcacagccatctgtgatggggatcctatgatctcttctggtgtgtctgaagacagtacagtgttctcatataaataaaataaataaatcctaaaaagaagaggaaggaggaggatgaggaagaggaggagatgaggatagtgacagtgtactcatacataaaataaaatcttataaataaatgtcaattcatttagtccatactaacttcagtaggcacaaagactagatagttagctggacagtggtggctcaagcctttaatcccagcactcgggaggcagaggcagacggatttctgagttcaaggccagcctggtctacagagtgagttccaggacagccagggctacacagagaaaccctgtctcgaaaaaccaaccaaccaaacaaataaacaaaaaaacaatgaaaacaaaacaacaaccaccaccacaacaaaacccaagactaaatagctatgttacaaatagttatgtatcaagaactttactgacatgggcacagaacctaaaaagaaatgtcaacttgatttttcagaagatgaaaaggaactcaaaactgtctatggaaaaaaacactgagatgcacattctctgtgttgctcaaagagaaaagagaactcaataaagacaggaaagaaatccagggatgtgttggggatagggtggggtgaatcagaagtttgaagtcagcctgggtgacagttagaatcactactataaagagtagagtcaaaaagaacatttacaaacctaaataaaattatatgatactggtatagaggatgtgtgtaactcaatgaacaaaactaaacagtctaaaaataagtagatttatggactgttaattttccacaattgaattaaaactgcttaaaacagaactgcagttcaacaagatttaaaacttttatacacagaaagactatctagaaagtgagaggggctgtgcgtggtggcacaagcctttaatcccagcactcaggaggcagaggcaggcagatttctgagtttgaggccagcctggtctacagagtgagttccaggacagccagggctacacagagaaagcctgtctcgaaaaagcaaaaaaacaaaaaaaaaaaaacaaacaaaaaaaaaaaaacaaaaaaacaaaaagaaagattgagagagagagagaagagagaaagaaaacatgaaagggagctggagatgtattaatagagtccttgtctaatattcaagaggacctgaatgaaagccaggtgggcgtagggcacccacaggtgtgtgtgcatacatgtgtgagtaacaataattccagggagcactttagtctcagaccccaggattagatctgtaacactggccacaggcaactgttaaggacaccccaatacctgaagcctgtgacaaccataacaagccactgcctcagactgctatcatgccctaaggtaaacatacagtgccagagagtgacaagacacccagtgtcctcgctggcctcatgcctgcacaattatcctggcccactgagccatcttgccagctttttctttctctcaacctctcccttgctccccatctcttctggttttgttttggacaacatctcactgagcccaagacagtctcaaacttaaggatcctcttgccccagcctcctactggtataattacaggcatctgcgacaatgccaggcttccagtaattcctacatgtaaacaggtcctccatatttgtccttctgctttctccactttgcattggagcctcaaagaagcacagctttcttattctacctttagtactagtgcagtgctttgaaaacagagatgacgacaataattcaatgtttcataattcagttatacatttattttttaagataggttctcactcaagccctgggtggcctgaactcactatataaaacaggctggccctgaacttgcagcaatactcccgactctgccctccaagtgctgagacacaggtatataccaccataacagtcaagtataagatattctttacagtcatcctgtgaacgatttatcatcatcttcattttacagaagccctcctcttccacatatccttatgggttttagcaaactgcttaacttctgtacgactgattcattgtacaaggaggtatgtctacacagtttctgaatgactttagagacagggtatagaatgcactaagaacagcagctgtctcgtgaatgtctcccaatgttagatacaacatttattactgttccgtggcaaaccattctttggaatatactgggtgatcagatttctgcagagatagttaggttatccatcccatcctgcaggcaagtctaggtcagtctcttagcaatccagagagggatgtgagggcctaacactaaagtgaaaatactttggcccaaaagacttataaactgactaatggccttaagtaactgaaaaccaagactttcctggccactctataacctgttgccgtggtcttaatttttctttttcaaaaactgccatcaccaggtgtggtgggtggcacatacctttgatcctaccactccggagacagaacaggcaaatctctcagtacaagaccaatcttgggctggagagatggctcagtggttaagagcactgactgctcttccgaaggtcccgagttcaattcccggcaaccacatggtggctcacaaccatccataatgagatctgatgccctcttctggggtgtctgaagacagctacagtgtacttacatataataaataaatctttaaaaaataataaaatattactgccaaaacaaaccaaacaaaaaagtgcaggcaatagttttatgaattatttgttaaagaaatattttagtcaaaattacaaattataaggcaatctctttaaaagtatgggcttccatgtcacatatgcttgatgtatagttttggatttttcagtcctgttgatggaactcacagccctgtgcgtgctaggtaactgttctgtcactgagctacgtacttagtcccacgttgtttattggtaagattcattcttaattattgtatttttatttctgtgtatgtgagtgctggtacctgtggagccagaagagggcgtcagatctctggggttcctcccagaatagcaaatagaagtgaatttatttcagctgctgttgttcatgtgcctctatagaaaaacgtgtttttgtggcttgtggcttgtccttgtgattgaacaccttactcatgtgattcttctgatgttctgagtaaagctggctattgcatgtgactctctcccccagactcatgccaccatctagtgtggaaaacagccctcctgcctcaccttcctatgatgggcatgcacccagcttgtatacgttctctatccagctaaacacactccatttgtctctctcttgccttgtatcactttcttttctgtgataatgctgatgttttaaatatcatgcctctcccatccagaatttaagcttcataagagtacaaattcaaatatttttgttcacacaatgaagtcccagtatctaaaaataccagctaatatggaggttttcaaaattaaatatttgtaaaattaacaaaaacatttaccaaactttaaaaaaatatttttttggcacagtgcctcgtgtagccagtgctggcttcaaacgtcctctgtacatgcccaaggatgaccttgaacttctgaccctcctgtctccgactccagagctgggattccagacttgtactcccctactcagaatgttgcattagggatcaacaaaagggttctgacatgtcaactgaggtgttttaaaaggacaaggctctgcacctatgagatctgagctcaaatctttagcgcacacattaaaagccagacatggttatgtgtacctaaaacccagcactggagagcatagacagggtccccacaactggagaatgtagccaggagccagcagcccagcttaaaggtcacacttttggtccagtaagagaacctgtttcaaggtagtaagacactgggcatcctgttctgacttccttatttacacacatgggcacacaccatgtgatctgaccctacacacacacataccacacacatatatacacaccacatgcacacccccccacccctccccaaccccacccccacacgcacacacacgcactctttggggggcggtgtttatatgtgtgttttgccagcatatgtgtatgtgcatgactgagtatcagaggagggagtccatattctggatctggacacagatggccttatgctaagtgctgggaactgaactaagtgctccgcaagagcaacaagtgctcgtaactaatgagccacctccccagtccggacaatggttttaaaaggcatgtcaggtggtttggggacatggttcagagactaggagtacttgctgctcttcaagaagagctgacccgagttccactgcctacttcagctacctcccatggtcgacaactgcctataaccccagttcttgaggccctgaagttttcctatggcctgagtacagacacagataaacccacaaataaaaataacccttttcttcttaaaagacacatcagggttcaatcacttctcatagttagaatcacattagctttccactatgataaagtctataaaacttacttcatagtgttatttttttcctccctacattgtggcaagatcaaaacagagtttctattcttggatttgccccagtcacaaggtagtcttggcaaaccaccctgttctctcagtttactgaggctgcttgggaacttcaactgccagccaaatagaaactccaaaagccctaagttatgtggatgtggtttaactgtagacacaaattattgcaactagatttcctatatactgcttgaggggagttggaaggaagacattttacttctgggctggtaaaaagggtggactttacaatatagctaaaggaattcaatgtttgtgtaacatgtattttcagctaatgataccctttctgtgttcctactatatatggataacccaaacctcaaatgttagtaaaggaatgtgactgaactggccctagcaaagtacaatttaaatatattgcttccagacagataattcttagttgtgctgtctatgtggtcttaaattcttcctgcttctgcaatcagcatccgctcttacaactgtgtagtgcttttggggctcctaatccaccccactccacgatgccttctgacacagtgactctgtactcacactggtggaaaaggaagaaaagccctgggcatgcagttgtgcaggtctcacgcggagctgctgctaagcaaaacctctctgccactctcggcttggctgagttcctctcttggctcagggttagtgatctggtaaggtctaggaggcttaggacccagggggcgcctttcagctgaaaaacacctcggctgcagcaagctagctgggaagctcccagttctaaagagaggctgtttaccagaagagcataacaggggccggccagtctgactgcaaggagacaaaactgctgccaaggaggaccccccccccccatttggacactggctgttgagtcacctgcgagccgaagagacgaggatgctgttggcttgggtacacacatttcttctcagcaacatgcttctggcagaagcctatggatctggaggtgagattacgttttctccccctttctgcagcaacttaaatgaaacagattccccaaacgtggtcaggccgacagggaaggaaggttttggctgcttttctcgttatcctacgaaagcattcttctctcctctctccttccttgccagaggcttgcagctccatctttgccatt

SEQ ID NO: 168 - DNA, 34759 bp, Mus musculus
ccacattaaaaaatttattaacatctgtttctgaataataattccagtaatagatgacttgccaagagaggtcctgcccagtggctatgactttggcttctctaagcttggatttggatcatttgggaaattcctctctttctgaactttgacctcttccgttactagtgttgtacacgttcagaagcacctgttaaggaatggggaaagcgatagctcagttggtaaagggcttgcagcaaaagcatggggacctgagttcaagccctagaacctacattaaaaactaggcatggaggtacatgcttagaatccaggcactgggaagatgaagggggtgggtccccaggacttactggccagccatcccagccacgagtctccaggctagtgcaaaacctctgcctccaaaacaagataaaacacgactgaggaagacccgtgaggtttatatctagccacacacatgcacacccatagatacacgaacatgtacacatgtgcgagcatgtacgtacgcatgacacccacacgtaatgcatcaatgtacttttggcatgtcatgccatctttggatagactgtagatatatactcattttgtgacaaatttcatcttattcactgagatagagagagcaatggtcacccagtgatgccagaaatatccaactgtaaactgaaccttagcaagaagctatactatgacctcactatttttattaaaatcgccaacaacattcccaagcaagcaggggtaggctctgaccttgtcagaaaagccacagacagcatcatgatgtctctggtgctcctgtatttacctggtgcacatgttttgacatatgtcaaaacttgctttgatatacatcaattctttgcagcacagagccctgggctgggaacaccactcagaagagctagtggctcatctaaaggttagtgtagcctgagaagtggacagagaaggaccatttattaccaggtgaaacagagatgccttggcacagagccaacaggacttcaattaggccaagacaaacaaaggaagaggaaatgaagatgccccgcattgccttcctagaaacatatacacaaagcaaagccacttcagaccccacttgtctgttcccagccctgtcctgcagatacacagggagggacagaaacagttagctaaggacgtgcctctgctgtagatgatgaactggcagccacatgccagggtgaaatagatttaggacagagacaatgaggcccccttgggtggggggttctggttctgtttgcttgactgggttcagtgtttgtctggcaaagaggaggaagctgctctttgagacccgagcactggttttataaagtcctatttcctctgtgatgaaccaatgatttttaatcacagaattgttaattaaatgaaaaaggagggtgtgtgatttctgaccatgttgaccttacactgtttctttatcatttcccttttcttgaggcatatataatatacttgtgagccagttcaatagcatgtggttctagtccacaagtaaagaagtgaacctgcaatgatatcttcagctatgatgtaatatataactctgaagcctgccactttagtatccaaatcatgggttcttccaggctctcattttaaggaataatgtaaagaggcaaggaagcccagatactctgataaggtgcctccatagtccagttaaatgccccttctatttctattggaaaatttaacaaggagatacaacaaagtcagagtttagagctagtgagatggctcagtgggaaaagaagcctactgccaagccggacgacctaagctcaacacttaggagccacgtggttggaagcagagaacggactcttgcaagttgtcctctgaactccacactatgccttttcacatacattcctttcccctcacggggttatgtgtacacacacacacacacacacacacacacactaagtaaaaggtactttttaaaaaatgaagtacaaaaacatggaatttttgagagtagaaatatttaaaacaaatgccacattaaacaattaaagtaggcatagagtttaaaataactaactttctattctaggtgattggatgagttatttttaaattacttgtctgctcctaccacggccactgttctctttgcagtgtgataaataaatttgctttctttctattaaaaacgcattgttttcaaacgttacttactctgtagtatggagagttcctgaaagcgacggttctggttctcgcgacaagaccggggaagcgcttggagggtagagtccacagatgctaggcgtgcgaacagtttgtcctgcccctggatccaccttagccttggagttcacctcacttacgggtcatctgacttgtttgttgaagggagtatttgtcttctgaattttccctcaggctacggaagaaaataaagaatcagacacttaccccaggaaacctgcgttgtgggcgtgcgcttagtagactcttggtttcacccgcacggtctgtttctcagggtctctactgaagcttcagtgttgacgcacgagggctggggagatgactgagtaatgaaagcgtttgctgtgcaagcagaaggccctgagttttaataagtagagacggtggtgcccacgtgtaattctagcattgggggtggagctaggtggatccttggggctcattggctagccaaccttccagtcttcgagctcctgagttgcaatataagaaccagtctcaaaaataagaaagatggctcccgagggacagcacccgcagttgactggcatctgtatgtacccacatacataaacacacacatgaaagtgggacacaggaaggtcctttcgatttcattttgcggatcatgccatctggcgcatctccagattcataattgcgatgcctactggccatgtttacttgctggacttgactctcaggctcccgtctctgtatgtgctaagctgttagctctctccttcttctcacctctcctcctctacctcacaaatctcagggctgcaaacctgagagtgtcaagtgtagctgtagagcactgggtgggaagacagcatcttaacttccaaacttaggctagtgtttcctttttcttttctttctttctttttcttatttttgttggtttttttgtttgtttgtttgtttggtttttgttttgtttttgtttttttgaggcagggtttccctgtatagccctgactgtcctggaactcactcttttgactagactgtccttaaactcagaaatccacctgcctctgcctgccatgtgctgggatcaaaggtgtgcgccaccactgcctgccatttccttttgagaaagctgaatgaacgagcttgtctcactgccgggcctgcagatttgggtagaaagcacaatcaactgtggccaaatcaaatctctgttcacagaacacaaagtttcacatcgggaggcaggattgtctctagtgacgtggctttgaccacacctactataccacagagcagaaagagaggttaatttgacccttaactagacagggaccagatcgtattcaagcttacatgttgcttcttacattgtgactgtaattcttctctatggatctgctggcaggactattgattagacacaggaggcagatggattgtacccagttggggtcatatttcataccccgtttataacatattactattttacacgttacagggtttcagtctgaagagttttggtgtgtgtgttgtttttgtttgtttgtttgtttgttttttgtagactctgggtaaaaaaaatattatatgcagatacctgggggagagaatatttttgtgattttgaatttgcttttaagtgaaaatacatgtgtgtctgtgtgtgtgttgtatatgtgtgcgtttcagtgttggtacacctgggtgcatatggaggccaaaagttggcatcaggtgccttccctaacctctctccatcttactagttgaaataagatctctcacaggatctggagttcactgtaggctggctatccaaaggagtcccagggagctgcatgtctctgcctccttggtgctggggttacagatgtttcaatgccacctggctttctgtgtgcatgctgggaatccgaactcagctcctcgctggtgtggtgaccactttactacccgagccatgtcccagcccttgctttcacttttaagctactcatttcaaccacactctgtcttctcactcccggaatggcgccgaccttggacaggacattatagatggatctcagattttgtgtaagtgttccaagaagcacgggtgagctagatacagcacaggtgatttcaaagaagatctgacatgggaattgcaagaggatgtggtgggttgtgtttgctgtgggtttttttcctctcccttgcagtcctttcactttctggggatgctgctaagagcagagacagtaaactgcactggtaaaatctgacagattacttcagaactgggggcaaatagagggagccaccctacagtctccttttgacgttctattctaatttcatgtttgtctcattttacaactctccccatcacctcctgcctccaagtttttctatacttggaaggagtgcttttccagaaagcatgggtttaggcgatgtgtttagagaggtagcagagaggtctgagagttgttagggggtaaagacagatccagggttatatgaactgtctctaagttcactgcagaaagtttgcctaaaggggctttgttgcttatttctgaagaaggaggaggaggaggaagaggaagaagaagaggaggaggaggaggaggaggaggaggaggaggaggaggaggaggacagttggagagatggctcagtggttaagagcactaactgctcttccagaggtccagagttcaactagcaaccacatggtgtctcataaccatccaatggagtctgatgccctcttctggtgtgtttgaagacagctacagtgtactcatatacataaaataaatagattatttttttttcgagacagggtttctctgtatagccctggctgtcctggaactcactctgtagaccaggatggctttgcacttggaaatctgcctgcctctgcctcccaaatgctgggataaaaggcgtgcgccaccactgcccagcaaataaataattcttaaaaaagaagaagaaaagagttttgggtgtatgtctgtacatatgatctcttgctctgtgtatctgtacacatactcctctctctctctctctctctctctctctctctgtgtgtgtgtgtgtgtgtgtgtgtgtgtgtgtgtgtgtgaacttggttgtgtacatgcctcaacaagggtgtggaagtcagagggacagctttcggtcttagtccccaccttccatgttaaaagaagagctctttctgctctaatctggggtctcagctttggggactttcctgtccatctcccatgttcttgtaggagcccctggttagagagacttaggttaccgcacttgacttttatgtgggctctggggatttgaattttggttcaaactcctagctctccgggctgcattatgtagtaacaggcaaagcgtgaggattttctgagtctcggaattttggttgctgacatgaaaacaagaaacaaacaaacttagaatcacagcactgtaaagaatgtctggtgtggccaggcagtgctggcgcacgcttttaatcccagcactctggaggtaatgagttcaaggccaacctgatgtaccaagcaagttccaggacagttagagctacacagaaaaactctgtctcaaaaaaaaaaaaaaaacaaaaaacaaaacaaaacaaaacaaaacaaaacaaccaaccaaacaaccaaccaaacaaaagccaaaattaacttctcacaggatgtgttgctccagtggctgtctctttctctgggctgcaacggcaggatttgaagagaagatctgtccatctgtaagattcttggggcctaagaaatatggcatggtctaaacagcttccttctcagtcctcctgtatggacagcagagatagatgggaacaaattaacacataaactcttacttctttggctattattacagtccttgccaatatttcaagccagaggagaagaaggaggcgtgggaggaagaagaggaagggaaggaggaggaagaagaggaggaggaggaagaggagggagggggaaggagagtgggtaggggcaggggaaacatttatgcacacctgccaagctctacaaaaactgtacagtagtcatagaaaatctccaagcaagaaatttccccataagccatataattcgtcagggatttttttttttaagagaaaatacgatctttacttgaaccagttgccatgtcagatgcctgccttcttcgctcaggtttattaccaggctaaatacagtctgtttcgatgaaagccttttacagcgtatagtaaaatgggttcattagtcattttcctcttattatatgtcaattgctctcagtactgccgagagtggacgctaggccccagtagccagaatgcaatacagagtgcaatgatgatgatactctaaccctctaaagcacacagtcctgcaaatgctttcccctgatcccttagactgtgtgtcctgatcactaactccattttattttcttctgtaaaatagggacttcccctcttctcttccatattgtatctccctcccattctgccatggtcacaggccctattcaggtagcttaaataatgttccctacacacagagaggtgggggtgggtgggtaagggaggaagggagagtttatggatccaagtataatactgctagaaataactggtcagtcactaaaaacttcactcagactgacttcagacactatgtataggcaccattgtttctggatgactgtcaatggctacgttataatctaatccaaagaaagctgggtgacaggcccacaccatgtttatttattgcatgggttatgacctttcaacaaatcacttcctccaggtagattacagcccccctcactataacactgtatcttgatcctttgttgtagcacatgaaagttagaatccttgggctctagaaaagttgccttaggaaataaacaacactgcctttggtaattaatttaagtgaatgtcacttcatccataggttaaaatttttaaattttatttataaaaagcacaggagtttctctctgaaacagaaagctatttataaatcacatggctcctgtgggttggtaatactcatattcccatcacaagttgaatcctcatccctgagtaactcacataacttctttgtggtaccacctccatgttggctaaatgagtatatttctagctagttttccacattgttgaatacccataaggtgctcaccaaaggactgtattagaaactcataaaaatcagactttatggctatactcactattgtatggcatgtactttttctgtttaaatgtatttttttttgatgctgggattaaatcctgggtaccttacacatgttatgcgcatgctctgccactgtgccacacccccagccccatgatgtatgctttgatttaccatcaatatcagtccttgtaacatgatgaagtcactcttggtgttaatgttccgggtccatgtggggaaatcagtgaagagaagtaactaagcaacaactttcacatctgcctgtctcgcccatgtcgggttttcccattataacttgccttgtttaagagtccaagttctgagaggggcacgagaaggctttgcacctccatttgttccctgtcttgttgctgtgaacaatgacctgacaaaggcaaggtgaggaggcaaggctttaattcagtctgtagttttacaatgccatccgctatggcggagaagttaagacaggcagagcatacagctgctggtcctgctccatctgtagttggggagcagagaggtgacagctggagctcagcatactctctcctttgagtcattccatgactacagcccaaagcatggtgccatccacagttaggggctcagtttcccttcctcagttaatccagtctagaaccacctcccaagaagcacgcttgtcccctaggtgactctagatctagattggtagtgaatattaaccatcacagtgcgtatgctcttcatactgcttatgactcttaagccaccaaaggcatccctttaccccagccttgcccatgaagggcagaactattctattgagtcttttcattgcctggggttatgggagaggcctattcactggtgagctatttcttagtggttgagcgaataagaaacttggtgtttggttctaagagaaacactgtcccattctgggggatttattagtactcgaggtagtcaagaggtagattaacagcaaaaggcccttcctatgtcactgctgtaaatgatctcatgcaactggaaaaaaaaaggaacaaaaaatatcactggggtctacctcagtctcccaaatgaatttggctttttttgtgataaaagctgggcttcagaaaaaatgtggtcaggatttaaaatgattgagacaccatttcctcagaaagttggcttcctgtttcaaaaagttaacctagctttgattttcatccttgaaaaaattaccatgtgagagcctacttctagaaatgaccacagatgagcatcatatctgcatagacatctggaagcctgaaggtttccagcatcctctagaaacttcgcccgtcatttgaaagcaattcagttgggtctggtggattttcagcagctctgagatcaactgatgtgtaaagcagaaaagggaagaagaaataggaggaactgttgggagagttggtcatgtactgtaggtgagactcctcccattacctccattcattctcctgaccacctaatctgctcacatccttctagtctgcctcggacccagcagcacactctgctctgttcttgtttctccacctccatccgtcttttgaaatctgcctgtcccatgggtctcataaacatgactgctttgtcggcccaaccagatgatacacacttctactgtttcaagttccatccctcaggctcatgcgttagccttacggcacctgtgttgcagccaatcttctcttaaccagaacctgcagggtccagtttgaccttctttggtttaatattcattcaagtatattaattcgtctcctgccaactcactgttacttctctctatcctgcagtccctccttttcacttcaacattcaagccattcactttcactattgtaggtttccatagaaaacctagggagcacaaaggagaagccatgatagttctcttactgagtctgaacttgttttcctagtatgattatctccagttgaatccctgaaaatgacatgactccattcttccttgtggggagctggaatttgactcctaaactcttgtattctatcagttagcaacttgatgcacacctgtgtatgggagtcattcagaataaaaaattcactcttaaaactagactccattcaaccagaaactggttagacccttgctcaagatgcccacctcatcaactctctctctgtgttgtgttttacggtaccagcaacttagctcatgggaatgggatacatttgtactggtgttgctatgacttgcagttaggggaaaaatgcttctatgaacaaatatataataaacccaaaatatacaaatgattaagaactggagagaaagaatctgacctccaaggacccttaaactccaaagcgaaagaactctaaatccctctacacactattcccatgtcctcaaccctcacaactgtattcttgcttccaagttaatatatcatccttaggtaatttttttacttctatttaactggcttgtcttcctgagaaaatgggagtgatcaggatggtactagcttagccaataaatgttaaatgacagtcttaacagaacactgagaaactggaatgggtgtgtgtgtgtgtgtgagtgtgtgtgtgtgtgtgtgtgtgtgtgtgttcttgaggtggctaatgtcgtgtcactgctgggtatcttgaaattatcctttgcttcgttgatggtagcatttccacttagataccccaagaaggggaataggtggccatgtatgctgtagcctccactcatgtttggtcttgaaaacatcatgaactttgtcatcaagatgagtattcctgtagcaaagtctttgatgaggtgtgctgctttgggtcaatagctaaaccccacttactatgtgtctagaaccatataaatgcagacaacgtctacctccccagctttggaggagaaagtaattaaagaatgattattacaccttctagcctccacaaatagacaagaactatgttgtaggttttcaaggtggttttggctttcttctttcaaaattcaatggaagagagataaatgaatgtttacattcatgcaaatgtaatcacatgcccaaagctctctggagccatcccacaacatcgtgcagactggagtatagacatccataggcacctcactagctcatcagcaagggaatcttggagatggaccagtttttctttgtgatgtcttaaccaaaggggctcatgggaaagagaggaatagatttttttcttgagcattgcaggggcatggaaacaaaacagaatggataggaagtcaaaagaaactaaaaatagccagattacaaacctgttcgacttacagttctcaaattaatgaaccaaaatattttttggaattgcttgcttcatttgtgaacgagaagaattattcatttgtgaacgagaagaattatttgtgaatgagaagaattatttgtaaaacacttagggcccgtttctactaaaggaagactaagcttgcaacactccatttggccctggtgtttccattctggctgctggatgctttcaatggggaaagcatttgtcctctccccaaacagacatctctgcctcctctaagtccccagccccacccccacccctgtgctcccctcgctgagggcgctggtttctctttgtttatgctaatgtaataacctgtcctctgggaatgccactaaacataaccttaactagtcaacaacataatcaattattttcactggtggggaaccacttgtttacttaatctctgttttaaaaacagtcatttctagagaggcatttaataccttagttattttgacagcatcaggaaactccattgttaatcagaagcatgttaaatcaaacagacatacataaaagcaacagccgagatctgtcagctggtttgacttttacagcataaagctgtaaaaacattttataagagggacaggccatttagggtctgggaaatgctcattgaatgacaaagcttagtccagataagtccaaaggcagaaacacacgttgaatatccaaattcatcttaatacactcttcttgtagaaagaaatttcataatgaacaaattggtcgaaacaataaaatgctgagttctgaatcatgaagtgtattgggttgatttattttgacaggtgccatttagttttaatgattcaaataacactttctaggatcctaaaagagtctgccgcaggtgatttatgtgcgcagtaataaaatcttggccgtatgaattttattgtgtcttaatggttaaatcgtcattaaggagttgttttttaggtgtgtatattggggaaatggtacaatgtctgcctcctctacccaaaggttagaagtttttaaaatgacatttatttattgtgtgtgtatgcatatgtgtcatggtacatgtgcagaagtcagaggagaactcattagagtcagctgggcttctgccatgttcagcaagtttgtcatcctttcttgttgagtcatctcactgaccccgatttgagatttttttttaaaattacatcacttatttcagtttcattttgaatagggagcactgagaatttactcaatgtgcaattatccaaggactggtgccttttttttttttttttttttttttttggtgtgactgtcagccacagagctttcttacatcagctgtttccccaaactgaaacataaagacaattaacatctggaaggatcaccttctaaaagaactcttcttgagagacaatgttataccttgtgagatagaagaacagatttcaaatactatagaagatactgaaaattttgaaaaaaaatagcaaagggatataattatctccagaaagacacatatcactagatagactgtagggtagtgattttaaaaagtagtaatggccgggtgtggtggggcacgcctttaatcccagcactcaggaggcagaggcaggcggatttctgagttcgaggccagcctggtctacaaagtgagttccaggacagccagggctatacagagaaaccctgtcttgaaaaaccaaaaaaaaaaaaaagacttttgtagatctaagtatattggcattttaactatgattaatgtaacagagaaaccctgtcttgaaaaatcaaatcaaatcaatcaatcaatcaatcaaaaagtagtaaaaagacagtggatgaagctgtgaggggttatgggctgcctatttggttttgattgttcgattgagaagaaagcctcaattgaggaattgcctagatcctgttggttcatgggcatgcctgtggcagactgccttgattattaattgatgctggagggtctagcctactgtgggcagtaccaccattgtgagacaggggtccctggattgtgtcagagagacagttttgtttgttgttgttttgttttgtttttaaagatttctttatctgttttatgtatatgagtacactgtagttgtcttcagacacaccagaagagggcatcagatcccgttacagatgtttgtgaaccatatagttgctgggaattgaactcacgacctatggaagaatagtccgtgctcttaaccactgagccatcatctctcctgtcccagagagacacagttaagcatgagtccgtgagtcaggcagagagcaaaccagcaagcaacagtcctccacaggctctgcttcgagtttctgcttaagttcttagcctgagttccctgggtggtgtactgtgacctggaagtgtaagccaaatgaacctcttctcccctaagttgctctcattcacagtatttagcacagcaatgtaaagcaaaccaggatggagccttggccatcagcagagccccatattggaatactccaaatcaaatacgatcctgaaaaccaagtaagagtagctcttggtaagttgatgcctagattgcaaggaccctggcaatcactactacttttgggaacactcacattgtctccttgcctctgatgccccttctacgtatcattcttgatgctaacttgattctcaattcagagtacactgttctaaccacccttatatgtccatgaattcctttctctatcaactgccctatctctggttagcagagaagcactccacctgcttcatctacaggaaaacttcgatttccatggaacttctgcccctttccatcagttgtgtttggttaagtcttgctcacaaaatgacgtggcatttttagaaacccacattcttacaacccacttagtgaagaaagcatctaacttcctgaaggtattgggcaatactgtgcttcatgctacacaagaacaaataaccaaagccaggcaattgagttggtctgttcttcatctctgtgatacgatgtctgacagaaaagccttagtgttttgagggctctattgaggtccattaagaaaaatctatttccttctggtcaaaagaatagatggagatagggcattctgatctgcctaaggactggaactactactgtcttctctcttaaaagctactttctctgggcctacagaccacctcactaggaaagctgattcatctaaagccacactaaagaggaataattatgcccttaattacataatgcttttccttctaagacacccttcccttggtgcagtggattaggaagctgatgtcaggcagtcatgtctgcctgcctctctgggccctgacttacaggagactctttttccttttgctccttctccactgtcttcttttggtgacttcccaaagctccagggggtttctctggcactttgagctttctcattctctttttgaaagctattctgcttttatcatgcaactgcttgctgccctccattgaggagtgagcaaacctaagctggactccctcctgggggcagctcttttgagttactgttatcatgccttatgtttttcttgtcaaccctagtaaaaacatccttgaactttttctgaatctgttttatttttttatataaaaatcatgtttttcacgtatgtgactgtttcgcctgaatgcacgtatgtgcaccccgtgtaccttgtatggggcctgcagaggccagaagaaaggtgtcagattcccagcaccttggttacaatgtgtgggtgttgggaactgaaagagttccgcactcctcggtgagtgctcttaactgcagagctaactttcaagcccccctccacccaggttgtttttaaatcctttcattagaaatttaaaactcacactcagctcagcaggtaaacactgacagagtaatcagtgggagaatgagaaggaaagcttcaaaaacacttttgcatcttttgcaccgcaggagtcctgtaagaaagagactcatgctgggagtggtggcgcaggcaagcctttaatcccagcacttgggaggcagaggcaggcagatttctgagtttgaggccagtctggtctcagagtgagttccaggacagtcagggctacacagagaaaccctgtcttaaaaaaaaggagagagagagagaaagagagagagagagagagagagagagagagagagagagagagagagagagactcatcactcatccgttggaaagttaagattctccagtgaaatcctcatataaattcaggctattggaattaggtgttatctatagatgctgttctcttcaaactcttccttcatttaaatgaataaatgcctcagtttttaattccgctgttgtactctttaactgccctttggtattcagaagtgattcccacttttaacctgtttctaaatactaattaatcatgagcccctcccaagacttttaaaatagaggtcagaaaagttgttagaatctgtggttgctacactttccctaaagattcaaacataaatgctttttccctccaaaagtaaaacggaaaaaaaaaaaacaaaaaaaaaaccaaacctcctaataaatacctggctgatttgaaagtggaaaaaaatcaattgagaaattaaaatgatggataatcacaccgtggagctaagatattacattaacattcatatttttagaagaggattacattttaaatatggcaataattatcatatcatagagaagacagcctatattttttttattgaggctgcacctgaggacttcaggggagggaagccctgacactgggacaactgtccccagtgagggactgtacgtgttgcccaagaaagactacgtgtttttaggggtcagaacattcagctgcttacatggaaactaaaataacatccatcccagcagtacaaccacagagcaaacaccttcagctgccagtgtccagctcatagtctgaaacagtaacatacgggtccatccctagtcttccgcttagattttgtattattatctgtattgaaaagatgtactttttacaaattttaacaaacctgtatgtttggttctttcaaaacactaggttttattcccacctataaaacagagggattgaggtggaacgcggattctcacgctctcgtttgcatatgtgtgcgccaccctgggatcttgttaatgctgcaggtctgagttcaggaggtccgtgaggtcagctttcccactctgctctaaagtgaagcttgtggtactgaagtgaggcctgcatttggggcaatggcgggttgtgtgtttccttttatttctgtaaggaacttcttcagaggccccaacaactcctgttcccattatgcactgcctaagttgttcaaggagcttagagcgtcacttctcatcatgccttccctgttctccccagaaaaggttcggcttgggctctgtttttaaaaacttctttatagtgagtggaccttcgggcgaacagatagacgccactgtcaagttttcataaaagccacaggcttggaaagggattaattctgaaccagtgagataggtcagtgggtaacgaaatttgtcatacaagcctggcagtgtgagcttgatccctggaattcacgtaagggcagaaggaaaggaagtccctccacgagcttatcctctgccctgtgtgtgcgtgatactccctggcccctcgccctccacgcatcacgcacacagagataacgagtggaaagaaataaaagaaaggactgaaggaacaaacacataaaaatatataatattcactttaggtgaagatcagactcaggcttttttttttcagctttctctccagccacagttcttgtgatgtgctgtctgtctgtctgtctgtctgtctgtctgtctctctctctctctgtgtattcatgtgtacatgtttgtgggatgccaagagacaaccttagatataattcctcacaaactctttaaaaaaaactttaaaattcattacattttttagagatggagtctccctctctcccccaagatgcaaagaagcaggctatttggctgggataacaattaaacaaatatcacacacacacacacacacacacacacacagagagagagagagagatatgcgtgagtgtgtgtgtgtatcataggtcctagggattaaactcaggaccttatgactgcaacacaggcgttttactgaccgaggcatctcctcagtctccctgtgatgctttttaattgtcttaaatattttgtgaacactctactaatgagaaatattcactgtatttccttccagcatcctgcaccgctagatggccagagaaaaggctgagatgaggcactttaaactcatcaggagatgtcaagataactcaagtacacagcctcggcaacagagtaaagtgctacatttgttcctacttatccgtcccatggtactcaagttcaaatcccagagtaagggacgcgcaagcctcctgagcaggcacaccccctagtcttcaagtttcttgtctgtcggagttctggtctccttgactgtcaaggagattgagtggcatcattgcagtcaactgttgagacacctggcacacagtgagtgggtagcatgcggggacctgcttacactgctgtgcaagtgacaacttctggatttcatttcagactgcgtatgcatttgtttatatagggaacatacccataatctctacttgctgcatataaagtacattttgcagccataacccctgacatcaataaaaccttaccctttacaaagtcttgataacttatacatattagaaattaaaaaaaaatgtagagcctgcagacactatggagaacacaagattgtgttgttatcagtgtggtatcaaaaatatattgtctagggctggggatatagctctgtggtagactgcttctcaggatattcatggccctaagtttgatcctcagctttgaagaggaaagggagggggagaaagagaaagaggagttggaggaggacactatagcctagtagcatatgcctgtaattccagcacttagaaattagagtcaagagaataagggggaagttcaaggccaggctgaggggagaaaggacatcttctcatataaataagtgtgtggcacagcggttaagagcaccgactgctcttccagaggtcctgagttcaattcccagcagtcacatggtggctcacaaccatctgtaatgagatctgattactgagggcttctagtgtgtctgaagacagctatgtactcacattaaagaaagaaagaaagaaagaaagaaagaaagaaaggaaggaaggaaggaaggaagaaagaaagagagagagggagagaaagaaagagagcttttaaaaataagtgtgtgcttactacatggctcacatctgtaatcccagcactcagcaggtagagactggaggatcatgagtttgaggctagcctgggctacataccaaattccagtctaggatacctaggtagtgcctgtctcaaacagacagacagacatgtgatgaatggacggaatttaataaggagacactatttttgtttgtttgttttcaagacagagtttctctgtgtaaccctggctgtcctggaactcactttgtaaaccaggctggcgttgaacgcagaaatccacctgcctctgcctcccaagtgctaggattaaaggtgtgcgccaccagcttaattagacactgttaatcatcatagaattgataacaaatagatattttcccctactgtatggtaaaacaaataagaaaattcaagtcagggaattactgcttttgttctttcattttctttaacttctaaagactgaatttaatcttgcaaaaattattcttttcaaagtggcctagtgttattgttcttctgattacaaaagtaaggtagaaaggcagagcctacctcagggagatcagggaacacaggactgtcattaagaagggagcaatagtcaccttctggaatagatcttggaagaaggtcacctttactgtcgttgattttattctcttgtctcatttacattttgaatgtgtgcaaataactgaattaagtactccacatacaaggtatatcttatatattacatagtagatagagttaacgtataaaggatagacagtaaacattttcattttactatcattcaattattattatcatcatgtttccaatttctgtgagaagcttcaactccaggcagaagtgtaatttttaaaacctgagatcatagtatacatgctatttaaatatatcctcctcctcctcctcttcccccctccttcttcttcttttttggtttttcgagacagggtttctctgtgtagccctggctgtcctggaactcactctgtagaccgggctggcctcgaactcagaaatctgcccgcctgcctctgcctcccaagtgctgggattaaaggccgagaaccatagttgttaatgcctgttttggtctttgcatgtacctcattgattcagtcagctctcttgagatgagcattttcaagagttgtgtgataaatacatgtgtgcttccggcattgtttcttttcttagactagcttcctagaaggccgactgacaggcagttatacatgtagggctgagacttgctgggcccacataatgacttaggtaaagatgcctgatttctgctaagcctggcagcctgagtccaatctctgactcctacatggaagaaggtgagggagggctcaggggatggcgggtgagaataaacctgcaagctgttctctgcccttcacttgcacatcttggcatgcacatgcccacacatacatgcctgcacataccctaaataaataaattcagttaaacagcttttttaaaaaaagtatggttttgtatgtatttctgttttctctctcaatctctcaatctcaatctctctctctctctctctctctctctctctctctctctctctctctctctctccttcaagagacagggtttctttgtgtaacagtcctagttgtcttggaactcagtctgtacaccaggctggtctcagggttacagagattcacacccctctgcctcccgagtgctggaatcaaacgcacgcacgcaccaccaccaccaccctgcttaatgctgagatttaaactgatagcaggagtaaagaattgctgagttcgagctgggcgtggtggcacatgcctttaatcccagcactcgggaggcagaggcaggcagatttctgtgttcgaggccagcctggtctacaaagtgagttccagaacagccagagttacacagaaaaaccctgtcttgaaaaactaaaaatttctgagttgtctattcagcaattcttccaaaataaaagagacgctttgtgattcaaagacagagtagaagaaattcacctgctcttcttcccatggacagagtgtgcctgtgtgccaggcaggaaaatgctaggggcagcgtaggatactggacatcctcggttggatttgcttttgttcctctgctttccaaaaggaaagcccaggtttaatctttgaagcagtttagagttatctttgcttacagtctcaggatgaattcttgggactggagttactgttaacttaatgacaaaaggtagaatttgcaggggatcaagacagcccttgtaaccgctcagtcttgacaagcatcaagccaagtaggggagagaaatggacaggtagatgtacacaagtttggtcttttcccctcttttttcaactggaggatatttaaactgaaagcagtaactcatttgtccaagatggaagcagaatgtgaaactgaaaccaaactgtggtttgggactatttgtaccacatcaagcaggtccaagtgtctgacagggaagagtttctaaagactaaagctggcagagctagcctttcctctgctacttttattaatgtacttaggagatcagtggtgggccagtcagtgctcctgtctctcccctacttacgctcacctacaaagtgaaaggagcagagtttttctaggacagggatgagatctttacatctgaactgaatgggagacagggttcttgctctttcagtctgtgagtggcctaagtgcctgctgttgcagcgctctggcctctaactcagccagtggagcccagggaagatctgagttagcatccatctcttctccactaacccctgctgcttctggcagtcctaatggagagggtagcctcttgtagatctgctctctacaagtgacagccactaagtgcagcattatattctgggaggtaacagatgcaagcatgaggactgccttcagaataactggaaatctgctagagagagagggagggaaagagggaaggaggaagactgagggagggaaggggagaggagatgtggggaagggatggaggggagagaggctaagagggtgagaaagagaggggggagagaaagggagaaagagggagggacagagggagggagggaagggaggggagggaggaaggaaggaagggaaaaaggaaagaaagtaggattgcgaacacaaagacgtttaaagacttttttggaactatggaagcttccagaaacaacaaaaaagagcaatttgaaactttttaaaggaaagaaataagtgtgcttttttctttacaagtccaatggttcgttttccatggcacttgtgttcagccctgctgaacttgaagtcacagctgtcaacgtgaataccagatgaccagagggtcgttgagcttagatgtgatcctgcttcatgcacagagcagatcctcagtctgtacaactgatgtgaaatgtgttcaccctggttgtgcttgggacacttttttttttttttttttttggattttttgaggcagggtttctctgtgtagccctggctgtcctggaactcactttctagaccaggttggcctcgaactcagaaatctgcctgcctctgcctcccgagtgctgggattaaaggggtgcaccaccacgcccggtttcttgggacacttttatttgcaaagtatttattaagcacctgtcagctgtgtactagggatgtgtgtgaggtgcagggacggtgtacatcagtcgtgttctaagagatgaggattcagctataaaggtgacgaactttctactctcttggtgtgatcagagcccgtaagaaatagcagtgcagaactaatgacggctaagtacttcgagggagagcagtgcattgtggggctctggaggacacagtattttacaatgcatgatccaagagcaacacacttgagagaaataaaggaagaaatatgctgggatatatagatagatagatagatagatagatagatagatagatagatagatagatagataggaaggaaggaaggaaggaaggaaggaagaaagaaagaaagaaagaaagaaagaaagaaagaaagaaagaaagaaagaaagaaactgagcaagggtgtttccgacaaagatggcaggagatgcagaagccctgagacagggatatactctagctgacacacaaggttacgatgagagtgctcaacacctaagggccatgcactcttgcttctgcaaagagagaaggcaaaagagtaggactactaatactgctctgtttatttgttccttgattgtatccttcattagtcaattttaattatcaacttgacacaacctagattctcttgctcagtgaaaaacgctctagatcaggttggccagtggatgtgtctatggggaattctcttcgctaccttaattatgtgagaagacagcctgaaaaggcagctgtatgacctgggcttgggaccccgaactgtgtgaacgaatgcgctgaacactaagcatgcacgcgttattctcagtctattctctgctctccgttgtggttgtgagatgattagcggtcacaaaatcctgccttggtgactttccacaggaatgcgctatgaactgggatgctaagctaaaagaagcccttcctccagctagctgctttttatcggggtattttatcacagcggtagaaatgaaattaggatacacctcaagtaagtgatgtgaacatatacccaggtggctttctcccatgagcaattacaagtttctttcccaatgttgcagcaggtgaccttctacattaagatacatcagaagacaggtcaaaagtagagagtccccaataaacacgatgataatggagtgaaaaatgctacccgtgggccaagtaaagtcatggcgttggggaggagagcctacaccttggaatggtttgtttctgtttagtcggcctggcccagcaaacactcaattaacaatgtgctatcttaagatgtcactatcaaggctgctttgtgatggagctgctactgagccagcaggatcctttcaacaggctcccaagaccaaggctcaagataaagtaacagagatactgttgagagtgactcacagtggggcaggaaccacagctcacaggaacccagttatgcaggaacctgaagcagggtggttctgagttctaggtcattctgagttgaaagccattctgagcatcttagtgagattgatctcaagataaaaaagtaaggctcgttcggttggtctgtcgggtaagtggcttagtggattagatgcctgccctaccatgtgggaagacctgggttccatctcttgcattacaccacacacatttatccctagcagtgggcagctgagccaggcagagctctgagtctgaagctagcccggtttacacaaagagactctgtctcaaaaacaaaacaaaacaaaacaaaacaaaacagtaaaaagtgaaataaaggggacgggggatatacttcagtggtagaaagcttacaaaagctgcttgcttcaatttcagaatagtagtatataataataatgataataataataataataacaataacaacaagctattgtgtcaacctgtattgttctttgtagccgaaagagaagaaagccgccctgagaaagacctgcgactgctgactgttacttccacaccttcttctatcctgagaatctcagaggcctctgcttcatctggattgcatactgttgctgacattcggttgataaggcggcattcttaggaaaggtaccagcgtcccattactgtcacctcccgcaggtgggattcaccctttcttctccaatgacacaacacaagtcaagcctcttcaagtgcaaaccctgccatttacgggacccacaggtcgctcggaagctgggtaaataaataaactttgcttccaaaatctcaaaactgatctgtggcctttcttccaagatgggaatgcacaggactgaacaatctccatacagtcttctcagaagcgctaacactacacttgtttacagacagaaggagtctatcagtctacagacgacgttccgtccaaggtcatatcctccacctcacgtagcaaacgtttactgagtccctttgtggaacaaattaccaaggtaaacatcaggctcaagcagtgatctttagacatgtgggatttcactactaaaatgttatctaggcagggggcctatgattcagcaggtacaagcacttgaaacacaaatatgagatccccagaacccatgtaaatttgtaatcccagcactgtgagacatgagggaggagacaggaatgatctatctcaggggtttacttagtaccaacttaccctgtgagagaccctgacttaagggaataaggggagagtgatggatcaggtctgcttctccctcatgtctctttctctcctctctctctccccccctctctctctctcacacacgtgcacgcacgtgcacaacatctaaaataaaaaatattatttatgctaaaatgtttgcagttctcttctaagagcccaaggctttttgaaagatgagtagaaatatgtaagtgggctggtgagatggctcggtggttaagagcactgactgctcttccaaaggtcctgagttcaaataccagcaaccacatggtggccatcaaccacccgtaatgagatctgacatcctcctctggtgagtctgaagacagctacagtgtacttatgtgtaataataaatgaaaaaaaaaaagagaaatatgtgagtggtatctaactaagcaatatgaatagtgttgaaaataacttatttcaatcacagcaaactttataatgctcctgaggtaagaaagggtggagatatctatctctaggcgtcattttttcccaaggaccagctaggagaaaaatagattgtttgctctcatttatagaactgaatattaaattttaatttgggaatttaatgaaactcttccacttgtagattccataacaacgtttttctatgattttatttggttctggataatttagttaattatacagctaaaaaggaagagcatttcagttgcttgcctaccgtgcaggaaactttaggttcaagccccaacaaaacagatgtgctgatccacatctgtaagcctagcatttgtaaagttctggaggcgggggatagtgttgactatataatataataagcgcgcatcttgggttgtgtaagacccgggctcaaaaaacaaatacaacaacaacaaaacaaacaagcaagcaagcaaacaaataaaaacaagaaggaaggaagggacaaagggaagggaagaacacaggagtgatatgtggtttctcatgtgtcttctgaacaaagtgctttgtagtatagccggtttaagcttatctccgagtagcgtacaaataagtgagattcagaatatggttactttatttggctttgacaattaccagggtggaatcacctctaattactcttttaattactggcctggctacctcccaagggctgtatcccagatacttgctgtttctcctggccatgtgctcatggttcctctcccctaatggcggcttcctcctcctctcttccatgttcttcctccttctttcccggtctctcctcctccaatcaggtcactccaaacccacctacctctaatccctctgatgattggctatagccaattttgtttaaccaatagttttaaaccaatgagaacaaggtttgcacaacggaatgttacaaccgtaagaagccatttgtagcgctagatcttcccgtattaaaattttagcatcagaatacctagcaatagagtaaacctcaacattgcttaatccagctggtaaaattaacactttatgctcatatgtttgaacaaataccatccaacttttatataattcttcttttcaaaaaaaccagccaagatagccccaggtcatctgtggccacggctcctaccacactttgtcccaggtttcaattccggagccttctcccatataaaatgccttgttactttctctgctttctcttttccattttgtgagctccacgtggcaccttgtgggattgcttacagttgatttccccttaatggaatttaagtagacacaggacaatgtctaggacattgggagtcttcagtaagtgttcgtgactgagtaggtgtgagtgtgtgctgttgctggctgtttgaggtactgggacctgagccctgggcctggtgcatgctaagtgactattgcagggtcacaactggagccttgtctttagttttcaggtcttcgagagttttcagatctaactataaatactgacctcctcaataaactggcttaggaaactttggaagagttctttcaagacatgaacacaaggttggcacctccaagaacttaacatgataatcacaaatattaaaaaaaacaaaacaaaacaaaaaaaacaaaaccctcttaaatggctgataaaatagtactccctcaaagaactagtttaaatgattcattttgaaaattggaaacaattttacttttcaaagaacatctgagtactttatacacctaacacttaaaaggatgcatgatttgataggattatttcagctctgtatgcacagagttgttggctcactatcttacattaaacccagtcagacccacgtcttcccttactactgatgcctgtatttgccaatgttctttctattacaaacaaacaaacaaacaaacaataacaaaaagactaattttaaatttttctaaggcaagtcagtatttgcttccagtagatggcactgcagagcaagcctttatagatgtagtaatttgtccctttgatcatgaaaatcattatttattctgttatgaggtcatataaagagcttacacggtgacaccaaacacataagggactttgtactgtgttctgtcactgacatctcatctgtacaccttagctgggcacttgccaatatagtggactccctgttgctgaagtgacccaccatgtatgaaaccactttttgatattggattttacctgcttgttttaatttggttggcttattttatatgttcagtgggactgcatacattttcacggtgtcaaatttgacctcattcaggtttgttaacacacacaggggaaggatagttctagaaccagaaacaatatccctgacctgtatgtgcacacacacacacacacacacacacacacacacacacacacacagtgtttcaggtacagggacttagttggatctcagattgtgtatcaaatgtcaacaatgtttcttaaaaccatttaaaaggaatgtcatacatgatattggctggtagttattaaatgctatcatatataaaaacatacctagaagagtgtctggggtaaattaggtataaaatatccaccttggagctggggatatggcttagttggtagtgtgcttgcctaagatgcaaaagaccctgggtttgatcacaaggacctcattaaaatcagatgtggtgctgtttgccagcactgatcatcctttggtatataagtgagcttaaggttagcccaggctataagaaatcctatctcaaagtaaaagcccctctttttttctcctcagagagtagaggaatacaaagggccagaagcagaaagcgagcatctatatctttccacttaatagtacttaccaaataatcttagtaatctttctggattccagctctcaaaatggctggacctgagccttcaggacagggaacaagttttccaagagaaaacattgtgaagtatgatgtatgcgtcactgtcatcctccggtgttcaagccaatagctgtgaaaatcctaagtgatctttgtccgaaggattttcagactgacactctataagcaagctcttagctttttcagcaagttgtcccatgactttctaggaaccatgtacttttaaaacatttcgtttatgcttgccccttctttctttctttctttctttctttctttctttctttctttctttctttctctctctctctctctctctctctctctctctctctctctctctctccctccctccctccctccctccctcccttccttccccctttttctttttttaaaaactcttgtcaaaggaaacagaaatgtctccccccccccccccccaagacagggtttctctgtatagccctggctgtcctagaactcactctgttaaccaggctggcctcaaactcagaaatccgcctgtctctgcctccggagtgctgggattaaaggtgtgcgccaccatacccggttcagaaatgtcttgaaatcacacaagtagccatagcagtaaggaatctctaaaatttctacaaatatatgagattatatgcaaatatatgaggtggttatattttgtggacatcactataatgaatgcattaataattctttatctatgtgaggatgctctctgtctccaggtatttttcaaaaatcaccttcatgactggtactctcacctcacccctggacatgctagaggcaaggtaaaacttacacagtcatggtaacaataggagggaagtccagaaagaaagacatatgatccaaagaataacttcccaggatagtcaggtgaagaagagcctatagatctgttcacttgatttttcttttctctctttctgtggccccggagtttatgctttgcccaactgtgtggaactggtagtgatagtgtcagaatattacagaaagcaatttgtggctatggggtaaagcagaccactagataatctttggagtcataaaagacttttaggaacatccaaccctaacccggtgtgtttattttaactacagggggaaacgcagttagagagagaagccgctggactcccagaggtaacacagataagtaatgataaagcagggaccaaggtctcttgattcctagtactttggccaagaactgtaatgttgacaaaggactgaaaaaggagagagagagagagagagagaaagagagagagagagagagagagagagagagagagagagagagagagagagagagagagagagaagaggagagaatgtagacttggtgagttagaaggctaatagagtgttctcttatgtggtctaagaggaaacaagttttggggtaaaggtccttggaaagagaagattgcacacatttgtcaaatattggttttggctgttagctctcctgcttgtatgtaagcttccatgacctgcatctttaagaaatatttagatacaaagagtctgtggaaagtggattcttccttgcttttgaaggaaatgagcatgtaaaaaaaaatgactacatgcggctcaacaaatacacaacacttatttattacttataacgcaacaagatttaaaccactacatgcctctaatataaatataaacacacagtttttttttttaaccttgtaagttctcatgacatgattcttaggaatttacagaatataaaggagaaacttttcctctgtgaacttttctaatttttttctgtgacattagagaaatggaagagcatatacatatcttacagttaacaaaactaatttaattactttttaacacagtggtgaaatgaatggcttagccagaatttaggaatgcaagagcatatatagtcagtgctatcagagacttatttgaagggagatttttcagaaagtgttaattattttttagtgaatcacttagtactattaatcgtgagactgaacatgacttctcctgagttggagtgcattttgtctttggaaaggcagtctctgctttctctacttctttatttcttggcagtggttactgttttattgatttggagtgggtcccgcatttggagtcacacatccctaaagggtctggttgtgaaatgaaagtggaaattagacggcattggaacgggacgaaggagtacctttaacttcggagggaacctgctagccacttttcattgccttttgggtgccctgggataaaagtgggaggtgggttaaaaagaaacaaaaaacaaaacaacaacagcagcaggagcaacgatcacaaagaaaagccaaaggacataagaaaagccatgtgccaagagtgaattaaaagtaaaggatattgaacttggagaccgtttgctgtagacatcattggagtaatttgtgtaaacagtgcggccactacgtgcagtgacagcgcaatgttttttatttcttaatcatgacaggtagatagataaatacacaaatgaatgaatgaatgaatgggtgggtggaactccgcgccatttgctatagatccttgggcagaattacataatgtgggtctgaatatcaaccatatagagattgcttaattactttgtcgaatcaggtaagataatcaggtgtgtgtttaaaaattttgatggaacaacgttcagtgggcaatcgtaactttaaaccaggaaatagacccgcaacccttaccgcgttggtaggttacaactcaagcctcgtggctggtggactgataaaattctatttccttccaaaggggagctgcccggaagtcctggtagggaagctgggagctaggtgggcggtctaggacgcacaaaggagttctgctgcctaaggcgtccaacgcaaccacaacctgaggctttggagagttgggttggacaacctagtgtgagttgagagctattccggtctaagagtgctttgcgcttggttattggggggaggagggagggaagggggaaggacaggaccctgaccactcccctggacggaagcgcaggttgggtcttgtgggtctaagcctctaaaggtgactttgagcctctttcccacctctttctgaaggatcagctgcgagttgaaggagtgagaagaggtaagttgggactttgagacctaaacctggacatacactctggaatcctcggattcttcacctgagaccaccttgggttaataaaagaagcagttgcgggtgtagatgggatgaataatgttcagggacgggattaatttatttttgagaagtttctgccgtcaggagtctccgaccttaaggatgatgagctcaaaaaatacattggtgttcctaagagttggacaccgggaagctagcttcgggagtggcaaactccggcgggtgataaaagtgtgaacctcagagaatactgataagcgaatgactggggccttcagggtcttagatggctctgtactaaacggaggtgtatgggcaaggcgagacgctttagagctaaagaattctctaaaatgtgaaggaaatattctcagactggcagggctcagtcttttgtaacttccaccacgctttccgaatctctgactttcgcccaccattccctcccaccccccacccctgaggcccaataatggcgagagccatttctgcgcttctcccttctagattcttccagatgacctaaagcctcatagttggtgatgtctcccgcgcaaagttagcctctggccccgtcactctattggcggttcctagccctcaccactccctagggaaccacgtgtgggaatttcgctgggatgttaggatcagggagggtgactaaaaatctcagtatgtagttgttttttcggagagtggtgtaagggataggtgggcaatagaagactacggagtggaagatttttttttttttttgaagtcggggttgtaaaggcaaagaccttgagcaattgtgtcttctgtttcctagtcgatagaaccagctctatattcgctctactgcttcccagcttcataaacggtgagttttgtctacctgggcatctccagcttttctgtataggggacatttcgtttgtgttccgtaccaccattgcgcccaaggcccgggaagctcattagcccttgcgccacgcccgtgaaaaagtgcgggtagaccccgcagatcagattgggcggatcttccgctccattcctatagatcatgaaggacctggtttttcttgatatgggccagggaaaccccaccctacgggaacctgtcctggccaggtgtcccaccagaagcccagcgagcttcgtcactcgcattcctgtagattgcagctggtagatccccggcagtccaaacttaactcccagcatttttgggtgtggtacgggcccaaagaaaacctcttcttctctcccccaagaacagatttttttttttttgagagtcttcatataaaagcacaattaaagtacagggtggggtagaccagacgggaccttcgattttgtttttagggtcccccattctcctcacttcaaaaactcttggacgggtaaagcacgagattatgctctaggtagaccaggggattgcaaacctagaaaacaaacaacagctgagaaattggggtgtgagtccagttgtcggggcaaatgggtgttcgggtacgcttgcggtgtgaactttctacggatcacttgtggagggagttgaaggaaaggagggaagggaaccgccccaggggtcctcgtggcgaggtccgtgctcactgggggaggtgtctacctatgcctgggcggggggaggggggagaggcggggggaggcgggggggggcggtgggcggggggagagtgtcaccttgtgggcgggagaaggagtctaccacgaagagcaggctaattggctcgagacattttgcgagcattggaaaaaggtcgttgaaggagttcgctctacagagaaagagagaaatcttaaaaaagagtgccgggcatgcgcatagagaggatgccatattggaatgaggctgtagtgggagctggaggacccgagcgggcgcgctagggaggcggcgggtagagagcgagcgagcaagagagggcgggtgagccggacccgcgcccactccggtcgcccccgggggccaggttccaccattcctggcaggacaaacttaatcaggtaggacgccgccccagacacggtcccctcgtccaacccggcccgcgagcagatctctggcccgcaggttgagtgtgccgaaaggcgtctttttttttttttttttttttttcccagtttagttttttttttttaaagaaggaagctcgagccagtctgggtggaggggggaggcggggggttggggaggaaggaggagaaaaaccgaagcgcagaggctggagaggaaatgagaagcacttgagcgaagcctctaactcctctctgcgctctgggttgtcattttttctcattccccacccccttccccccgactcccggctctgaaaagccaggccttgcgggagtctgtccggagttgcaaagtgacctcgtcctcctccgggtgcagtctgttccctccccgccgcccaccttcctcgtttatgcactcgctttagcggcgcagcctcctctgccacctaccccgggttcccgcgtctcctcggagccggggtctccctcttttggtgtgcattgggggggggggggggctaggaggttgtagagaggaaagtgatggcgtggagagaattggaaagcagcaagggtggggtaggggctgttcccaaaaatcgcgcagacgtttggaatcgccggattggaaacatttgccttgtgcagcggaattgaaattgtcaatagtagtttcggagcgagctctagcaaggacgacctttttgttcatttttatcaccctttgaagtaatatcctgtcacttggggctttcttgtgtacactcatcctgccccttttcagaatgtctaacaggatcgagctctggagtttatttatttatttttatgtgcgtgtgtcttggtgaaatcctctttaaaaaaaaaaagcaacggcaggaactgctggatgtgttgttttttttttttttttaaatttttacctggagcggctgaacgggattaggctgggaaagggagaacatttgaggggtgggaagcgattggttttctgtggccggacacaggtccccagcccagtcaatacttgtgttttcttggaagcgctacagcagcggggaaggagtctttagacaccgtgccagttccaatatggcgggctaaggtggcttttaaaaactgaaaataaaggttttgaggtgggaaaaaacccaactgaagtggccacgccttagtttctactctctttggttactccaggagctgctttagcgaattaaataggaaaaaagaggtggggcgaggtattccagttttttccgtggtttatctgtacgaagtccattgctagaggatctagggtggagggttgcctcgggccagaacgagggtatccaagcgcaactgcctggtgtgtgtgcttgtggggtcgtgtacaaactctgcacgtgcagtcggtcgctagggtgt

SEQ ID NO: 169 - DNA, 38464 bp, Mus musculus
gcccttcacatagactctttaatgaccgaaagatcgagttcatgttaaatatactttaccatagaattgttcccattcttctgtggttttgtcaatttggcacaggggaaatggactcttaattgagaaaatgccttcgtatgattggtctgtcggcaagtctgggtcctgcttaatgaatgaggtgagaggtcccagcccatggtaggcggtgccagccatgagcaggtggtcctgagtgtataacaaagtaggctgagcagtgctcctccacggcttctgtttcagttcatggctccaagcttctgcgttgagttccctccagtgatcaagtgtgctgcgaaggctataagcactttccacttgtgggaatgtcggtttatcacaacaatagaaaccctaacctttgcttaaaaagtgactaggcagccgggcgtggtggcgcacgcctttaatcccaacactcgagaggcagagataggcggatttctgagttcgaggccagcctggtctacaaagtgagtttcaggaaagccagggctacacagagaaaccctgtctcgaaaaaccaaaaaaaaaaaaaaaaaaaagtgactaggctttagtcatcattagttgtcatccaaggactatctacaaggaggggagagtcagtaaccagatggcagggagtggactacaataatgtgaggaagaacagaaaggacagaaattgtcagactggtatcagagcctcactcaagaacaaggccaggctaaacagtcattacaatacacacatcacaatacaaacacacatgcacacacacacagacatgcacatcacaattcacacatatcacaactcaaacacatatacaatacacaagcacatcacgatacacacatacacatgcacacacacccattacgatacacataaatctgcgtccattgcacacatgtgtgtatacacacacacacacacacacacacacacacacacacacacattgagccactcaaccatcggttccatccccaaacattcccaaagcacaaagtgtcccattctgggcaaagtgaggttggacttccttctgtgtgggtgggagcatgtgactagtcagctcttgcccagcaaatgcaaaactggtcatataaaccctgatacaaggtcttctgggaactcttgctccctccggtgcagactctgtcctctgaacttgagtccaagtgagcatgaacagagcctctgttgacctgcagtggacacagagttagaagagagtaagctgctgatgtgggattcattcaaattcatgtggcttcctttttttttttcttttgtttcgtttttgttttttgtttttcgagacagggtttctctgtatagctctggccggcctggaactcactttgtagaccaggctggcctcgaactcagaaatccgcctgcctctgcctcccgagtgctgggattaaaggtgtgtgccaccaccacccggctccatgtggcttcctacttcagcatcatcctctccatcttggagaggtcaacacttggcctcctggcatctctgatgcagcctcagtgtgaaacagagacatggttaggaaagccaacaacacttcattcggtacctacttattaaataaagatgtgttcgttcctctatcctcctgcccctctagcaaaaggaaaagcctggcagagcaggcaggcagggaaggagcacaccccacctacctcctcaggctcctgcccttaagtaaaaaagagatgtatattaagttagataggattcaatttgtagccccaccaggcaaatctatagtaaactggaatgcacagaaagtaaggagagctttgatatcccaagtaccaagtatggtggcttgaacacgcttggcccaagggagtggcaccattaggaggcacctgctgctgtaggtatgtaaggccttgttgaaagaagtgtgtcgctgtaggggtgggctttgagagcttcctcctagctgcctggaagccagcctttgtttgctatcagaacaagatgtagaactctcagctcctccagcaccctgcctgcctgtatgctgccatgcttcctgccatgatgataatagactgaacctcagaaccagtaagccagccccaattaaatgttgtcctttataagagctgccttggtcatcgtgtctctttacagcaatggaaacccaaactagacaccaaggtagggaaagtccacaagtctttatcaaaagcagtaattgggaccccagacaagaccatcaaggagaagatgccatcttcacacagggtgaagagataaagaggacaggactatttccataatgacagacaagagaagaaaactctcagaggcaacagcaggaaggaagactggcattggtagactcagaaggagacagttgctgtagtaaaagcacagagtccatagtctccagaaggatgcccaatggttatagccaaatatgaaatggcttcataagctcacgtattaagtaggtcactgtcagcacctgtgaagcttatgcctggtctctatccttctccattctctgtcactctctgtctctctccctctccctctccctctccctctccctctccctctccctctccctctccctctccctctctctctcactctcactctccctctctctctcactctcactctctctctctctctcactatcttccatgacatgaacagcttcctcttctgcattcccctactccacttccatgatgctcggcctcactgcaggcacggaaccatggtgccaagtgaccaatacaagccatcttaaactatgagccaaaaccttttggttgttttttctgggtatttaaactatgactatacaaaagtaacggatatatcactctgaggccacctggctggttaataccctgacttcttccctgcctgtggtttccaaccagagttctggaactgatggaatctaatagtaatctagagatctgatgagtcatcgatgcatccagcagttctgagtcccaggtatcagattatagtgagtttacccagcggtccaaatggagataactcgacgcctaccttggctgagttgagagtgcctgtgaatttgtgcggtgttttcagaagttttttgtttttgctttttttaagatttatttatttattttgtgtatacaagtacactgtagttcttcagacacaccagaaaagggcatcagatcccattacaggtggttgtgagccaccatgtggttgttgggatttgaactcaggacctttggaagagcagtcagtgctctttaccgctgagccatctctccagacacacacacacacacacaccccaaggtttcttttatggctggtgtttcaaatgaggctggttgcaaaggaaaatagagcaggataataaatagttccatcaagcaatgggtgaaaagatagaagggaagaggactgggaacgacatcttcgagacagagagaatgaagagagcaaagaagtgaggtggccaggcttcctggtgccttccaccgcatgatgaggagagggaagaagagattgtctttattgggaacccaacaagaaaactagccaacaaaagcaagcacggagtacaggatgaaagccagtgcagcagacagtgtaaagaagagtgaggagaccaagtactggctgctctcccagaggacccaagttcaattctcagcacccacatgactgtttaaaccccttcttctggcctctgtgggcactgtatgctgatacacagacacacatgcaggcaaatcacctacactcataaaacaaataactaattaaaaagaagggagacagatgaggatgtgactcagaggtaaagatctatgccatacggggggctctgggttcagtgtggctcttgtgggaaaaggaaggaaggggagagctagacacagagacagagagacaaacagatcatgcttcaaaatgacaccagagtcgaccaagctacccctgatgtcatggtggctaagattgtattgaaatttttctgttagagccaggcatctctaagaaccccaaagaccccacggctgaggtataagaggtaaagttttacagagcaatacagcaacatggcctttgcctctacataactgccctctgacctccaaaagcaaaaatatctcaaaaacaggaaaacagtctgccttagtaatataaaggctaatgaagtccctagatcctcagagctggttgaatctggttcatatccttgcttccagaggccaggtggctggctgccacattgttcaggttttgtgtctgtgtatctctccatccgccacccctaactcctctctctctctctctctgtctctctgtctctctctgtgtctctgtctctgtctctctctctctctctctcacacacacacactcacacacacacacacacacacacacacacacacacacccatgcacaagcatgcacacgcaaatgcgtgccttttagaggactcagaccctgacattccaacactagccagctactgcctgtattttaaaggattgccaccttctggaaaaagcactcatcaacccagttaaagaggaaaggttcaacccctttagttggaatgcagtgcaggtgagcacgggaaaaggccagcacaatcctgatcactccctgctgggcacttaactagaggacagaacctacacggctctctctggcagcctgaagtgaaaaggctcgaaaggggacagtggtaagtagtccttgatgaattttgccgttaaaatggggagtaagcctttaagacttcaacttgttccatggttcttccctaagattgtgataacagagtacagcatagcaggtagttaactttatagcacaccctcaaccgcccttcttacgaagggtgtggctactgtaaaaaaaaaaaaaaaaaaaaaaaggccctaccctgcaacataactgagtaagcctagagggtctctgcgggagggggctttttccttgcacaaagatgctgcaatctgcttggcacagggatacattgtttcctggggactgccctgcctaggggtgggagaagagctctacagtagccctgcctagattcttcaagctgttaatggtactcagcacttcagctcttgaaaaaaaaaaacaaaaaacaagcctttcacaggagtgggagtacttcagaagagataaagataataatcccagtcagagtgacaatccatctgtgacaagtccttcccattttcaaaggtcacttccggtaggagatctatctccgtggggctcagggcaaaaccaggttctcctacggaaatctattcttttccatgtaaccttggagctgggattctaagcactgcccctgtgagcccagccttctgatttcaaattctctgctcttctcacaagagaaacaaaagataaactcataaaatatgcacatttggaaaaactcctaagtaaagaaaagggataaccagcactcacccacaagcatcctgggatacaaagcagtggttttccttaaagtcttgtatctagtttacatttacattttttaaaaaagatttatttcttttatgtacaattataaccatcttcaagccaggtgtggtggcgcatgcctttaatcccagcattcaggaggcagaggcaggcagatttctgagttcgaggccagcctggtctacaaagtgagttccaggacacccagggctatacagagaaaccctgtctcgaaaaaccaaaagagaaagaaagaaagaaagaaagaaagaaagaaagaaagaaagaaagaaagaaagaaagaaagaaaggaaggaagaaagagagagagagacagaaagaaagaaagagagagacagaaagaaagaaagagagagagagagagagagagagagagagagagagagagagagagagagagaaagaaagaaagaaagaaagaaagaaagaaagaaagaaagaaagaaagaaagagataactgtcttcaaacatatcagaagagggtgtcagatcccattacagatggttatgatccaccatgtggttgctgggaaatgaactcaagacccctggaagagcagtcagtgctcttaaccattgagctatctctccagcccctccattcacattctttagcctctgtctggccattttgaacactgcagagccctactgttaggccaggaataagcacatgactgcaccagagccaaggaaggacaactgcagccttggggactgggaatggacagagatgctctctttctcactgatctcaagcccaggaagtgactataaagggccctggtgacattcaaacctcagatggatctcacatccaagtacttcctatttccctcattttatatctcttaccccacctatctcagtgctggaagttgaactcaaggccagccacagcctaagtatatatcttgccactgagccacacccctatccaaagcctgtatatttttgttacttgggaagcttgtattgcatcatctgtcccttgcatctaacagatcttggctgctgcaggtaatttcttcctcttctgtctcattagccatgtgctgatgatggcagccatgtcctattgggaatcagcagaagttcccatggccaaaggcagactcacagaaccaactactgccatgatatggctaatcaccagctctatttagcaacctggagaagtcaggtaagttccttgtgcacagatgtgtgcccggatgtcccatggaacaacagccttgcttaatgcgcactgagagagaattgtgggtacaatgataagcacccctcacttcagaggagtagagtgtgggctaataccagacagtaccgccaacccttcatggtgaaagggtttggaggtagtggaaaaaaacagaaaataatctttctccaaacatgggctgcagtcccccacttctacctgactaagcctaggtatatatcatatactcgccactgggtctagcccaggaaacctcatcttagtcatctcagtcactattgaaagagtcaagagttcaaactgggattctgcagagggggaaaaaaaaaagtagggtttaaatatgggtgagagtgtccttatggtgtgtttatggtgacttgcgctctgtcactagaatctgagctcagccttccaactcagtttctcgcttgcacattgaggacagaactaacgacaccaacatccttctcctagtctaacatttagattaactccaaacactccaaacacgaagcaggaaagcccagggaaaccagaacagagtgggcggtgcccattccaattttgcttcactcgggggatgagctgatgggacacagatgtacccactttggtgggtactcgtgccgcaccgacgtcgccgtggttcccttgtttgtctcaatttacttccggatgccaagatactatggcttcataaatctgaagaaatcactattgcaaccttttgatttgctttgttgttttgttctcgggagtctgtcccccacatctgagaggccattataagatgtcttgtgcaatgatgagggggaggacctaagaattctttccaagaaagtgtgggaaaataaatgcctgttgcagcagttctcagaataaatcaatttagcatcctgcgtgttttcacagttccccttatcacttctggacttcattaaggagactgatgaccaaacaacggcttttctccatttcctctgatatttgttcctccttcttgggatagtctaaagtcacaagaatggggagtccatatagcaaattatctctgctggctctgtaaacactggcaacttctaaaagcctgtgagaagcagcctggctattagcattagactcttgtcagggaccctcctgcctcccatgtaccttggcaaccttgctgtaccttatcagggatgctgtgtacaagaattctgtcaaaatcagaatgtctctgatactgcctccctacagacaggctccaggacacaacccaggaccatcagatgaataaagctttttccagactgaaacacaaaacatagtacacaaaactcctcctagcttagcatgttttcctagaccatctcctgccagaatttactccatcacaataggctaagatggcttctagtttttaagaagaaagcagccaaaaaaggacaagccatgcatcagaaaaaaaaaaaaaaacagagaaatttactgaagaaatgtcactccataagctttggagctcaccagacatggctcacaggtctagggttcacatatgcttctgtttctatggaggtcaggggttctcatgtaagccaggctagccttgaactcctaatccttctggctcaacctcgcaagtaccaacattgtagttgtatggctcccaaatccgactccctattctttaagttgagagattctgcatataaatcctaatgtatatctactcctccaacccaacccctccaaacaaaaaccacagaaaaggaaaggtaaatgttagcgacattaggaactattcaattggcagcaagcagtcagacctgggtcagtctactcactgggataagactcctgccctattggagtccctcctctcacctgctaggcacattgcctgcctgtttcctcctggatgctcctgctgtctctcacaggtaagtgtgactgcaaatccttgtttgaaaactcttcctcggatcaccagtcagggccatggaatcttattttgattacaacaaccccatggtccaaggaagatgtagactttgactttctccaattccaaacaaaataagcaaaagattcccccaacctgctttactgggaagtcatttctgggtattcaaggtatatagttcagtggcagagaatttgtctcttgcacacaaggtccggagatccagccatatcaaagcaagaaaaagaaggaggaagaggaggaagaggagatctatgcagtggtgatctgttcttcaaagtctggatttttaaaatttatttgttttcttgtactaaacatgatgtgcataaaacaacagcacattataaatttcaggaatatcaggatgtagcctaacaccacacaatttagaaccactaggggtgcggcccaggtgccaagagtgtttaaagtccccagtggttctaatgcatccttgaggcagaatgccctgcctggagcttgggctaaacccaccagctgctcaggccactgggagaagggaggcatgctcaacatttcccagctccagaccaaataaaaaaattaaaaaaaaacaaacagatctttgatgtctaatgattcctgggatatatgcagaagagaatgtgttgtcctgcatcaaaaaggagctgagctttattgataaatggtagatgaataggtgatcttattccaaacaggttagaattacaactccctcccctggaaaagggcccattacctagtcatctctcatgcagatgaggggctctaagtagaactgcttataattctgcgcaccacagtgtctcaaccttcctaatgctacagcccttaaatgcagtttctcatgttgtagtgaccctcaactataagattatttgtgttgcaactttataactgtaattttgctactgctatgaattgtaatataaatatctgatatgcaggatggtcctaggtgccccctgtgaaagggtcattcgaattcccccaagaggtcatgactcacaggttgagaaccaccttaagcaggttgctaaagtcattttcctaaggttttactacataattatcttaaagaggatcagttcacatggaactcttcaaatattcccctggagaaaaagagttgagtaagaagaaaaccgtctgctggagaaggtgtagggctagcccaagaactgaggtctagggctagcccaaggactgtccatctatggcctgagccaggaactacatggaggcacaggaagtcatgagcagcctggggacatttaaaatgaggtaatgattttgttcaaggtctaccttgttttgataaaaatcattttaaaatgttccccagcctctgacttttaggactgacaacattccaataaatctaacactagaggctagagggggcgaaaacattcctaccctagctgagaaacatttggtcatttcttgaatcagaggtaaagatgagtcccatattagaagccaagaatttttgtctattagtttgattttcatctcaaagtgacttcaaagctgcaacaccttattagtcactggaagtatttattaagctactactggcttagagctatgcaatattaataaaaggtttgggtctccagttgatgcttattaagtatatgtcattgattgatggactgatgcactagtaagaatttgtcagaggacaaagcatgcaattgaggccaccactcacacagaggcattattaaaatgaaggtgacacttctccttccctgttgccacctagcccctagccagctctacggttctgaagtccactacaggctcatcagcacattactctaaaccatgcctcagcataaggatcacatctcctttcaggagagatgctaagcaaacttcatgtaccaataaactaacagagccagctgggaagcactgagttctgctgagaacacttcagggtgtcatcaaaaggcgaagtacggcggacaggtttccaggcaggaatagacaggaatcacccactcatccataccctgaaccataggaaggcatcagctcactttaatcttgactttcaatgcaacgcaacgagggttagacgagggatccatctaggccaattagattagggggtctgtttcgggacagatgccagaagagtgtgctttgagctattattcatctgcagttaagcatgagcacggtatagattatgaaggaggccgctgagagttggagctctgagtcatgagctgaagaagctcaggaaaatcgacctaaagcaaagacaattgatgctctaccaggtacaatattggctggatgggaatcctcaacggtgttacacagaatctactgcggtctcaaatgtccttggtgcagccccctcatcagacaagccttccgaaggtgatggtgggacagttccctgaagctccattacagccaccagcttagcagctacaggtagttccagcaagaattcagggccgtctctcattggtctggctgcaaatataccctcaggtttcaactagacggtgtagccagagaacaacagctttcttactggccagcacgggggccatttctctcatgaatagaagccagccctggtcatgacacaaggacaacggcttagagaaagaggttcccaaaagaaaaattggagtgcttaggatatttctcagtgtcctgctgagcaacactttggagttgatcactgatcactgatactttcctagagggccactggaaactaggtgtcaaaaaaatcactctctgctcattaactgtgtgggtctcatattagatatttttctattactatgcaaaacactatggcttagacatcttacagaaggaaaggtctaatgttggtttatggtttcagaggcataagaatctatcatgacagggagacattgcagcaagcaggaagtggagggggtcacatcttccacagcaagcatgaagccaagggaactagaaatgatgtgaggctatttgggatggtaggggaggtatttttttattatgtgtgggtgttttacctgcatgcctgcctgtgcagcacacactttcagtgcctaaggagcccagaagggctggtgagatggcttagtgggtaagagcactgacttctcttccaaaggtcctgagttcaaatcccagaaccacatggtagctcacaaccacccataatgagatctgacgcccttttcagatgcatctgaagacaacgccagtgtacttatttataacaatgaattaatctttggggccgaccagagcaaggtccaaaattcaattcccaacaatgatgaaggctcacagctatctgtacagctacagtgtgtactcatatacataaaataaataaataaatctaaaaaaaaaaaggaggccagaagaaggcattagaaccctgccccaggaatggaattatagatagttgagagccaccacatgggtgctgggaatcaaattggatccaccagaagagcagcaagtgctctcaaccactgaaccatgtctccagccccgtgacttaaggttgttgttgttttttttttaactctcaaattctgtcccatagtaacatgcctcctccaaaaagaccatgactcctaagcctccccaaacagcaccaccaactcggcaccaagcatctaaatccctgagacattagggattcaaacattagggattcaaaccaccactttgcactccctggcccccatactctcctgaccatatcataatgcgaaatgcatttagtctaacttcaaaagtacccacagtcttttatcatcttgatacagttcaaaaagtcccaaatcccttctgagactcaaggcctcttaattgcaacccttgcaaaatcaaaaatgcaagttatatacatgcaacacataatggcacggaatatactttaccattccaattgggaggaatggagacacagagaagaaatactggaccaaagcaaaaccgaaaaccaggaaagcaaacaccaaatccacatcccaagtccggggctttaatttcaaagggatcatctggcaccacccaaaccttgggaatctgcaaggcgacccaggctgcattttcagagctgcatgcaatggcctcccagggcctcttttaaccctccaagcccacccccaatgataaacctcctccagcaaggccgcacctcctaagcgtccccagttagcactaagtgagcaccaagattatagaagtccacagttccgaccaccacagccctctgtggactctgcagttataagaacaattcttagtctcactgtcattgagttttctgtgtctgaaatttaatagacaacttgaaaaatcgtttcaaatgaatgaatggaaggatagatggaagtatttgagggtctaaaacacaagcatttagatattccacatcctttggtgctatttctcaatggacaatgtatctacaaaaaagatgggaaactaaaaggaaggtcaggcctggccgatgactttaaaattagaccaggatggggagggagaaggaatgcattctgggtagggacataacaaagggacgacattaagtcagataggcactaccttatctagacacaaagaaaaacttcatgtagaggaacagtgggagaggtaagagagaggtggggcaactgtgatctgatgagctagacctgaatcctgaaggcccaggaatcagaagaaaggatgaaaactacagcaagactgttgtatcaacagcaagtgtacagtggagtatagtcatgccaatactgctgcagaaagataaacctccaggagaccctgagtgtggctggacagacaatgctgatgggaactgatcagaaagctgttgccaggtgaaagctgccaagtggccaaggtctagacttcagacagcctctcccatcaagcccaaaggcccaggcacaggtgcactccccatattctttcttgcttcatcttccatcccatttctctctgtctgtctgtctgtctgtctgtctgtctgtctctctctctctctgatttatttatttatgcatgtgagtgcactgtagctgccttcagacacaccagaagagggcatcagatcccattacagatggttgtgagccaccatgtggttgctgggaattgaactcaggacctctggaagggcagtcagtgcttttaaccactgagcaatctctccagctccccatcccacttcctaaaacctggtcagatagatgattgtttgcatccaagacacatagaaaccaaaagaggaaaatccagtgacaagagcttcgaagagttggggggggtggggacgacaaggtttattgagagacagggtgatagaaatgggctggtctcaagtggaccatggttgatatacctcaccagtacaactgttgagagcatcttcccggggaatgtcagtcaagtgtcttcactctctaaaccagctgactggctgactgggtttgaatttagcattcactggttgagcaatcatgggtgagttgttgctcctagctttggtatttctcatctgttaaaaagaaggtaatgattaaacgctctcctagggcttgattataaaaattgtgttgataatgtatgtgatgtgccagattcaatacccactatgggttgagtggccttatctggaaggctaaggaccagatgtgttgcagatttaggagtttttcagatggggtaggagttatttgcataggctatctaggttgagtaactccagttggaaaatcccatctgttccaacatctagaatttcttgagccttatcatatagagtcatgcaacctgcattattactatcatttggatctaggcacatcactagcaaccctgctgatagaggttatacagcctcccttcaaaagctaaaaacgcatctatgcaagagagacctaggaaacggggcaaactctcccacactgcacttcaagttaagctcacgctgcaggcttctagtctcttccagagagtggactgccagaaaacagagcccctgaaccccgcctctttcgagctgcagctttgaaaaacatcagtggtgtgatagcaacgtagctggacccaattagcattttctctcttttttttttaaaccaaaataaaatataatagaaaatattgttgttgtaaaagaatcctgtggttcttgtttcacaaagccttttgtgttcattacacaaggattggtgtgtgtgtgtccttgatatgtgtataaaatgtcttccaccgtggctcatgtgtcaactaacacaagaggttgacaagtatagtcttcatgcatgtataaaagacagacactaccatgtcccatcgaagtgaggcaatggtctatatttacaaaaaaaaaaaaaaaaatcagacaaaatggaggaccaatatgaacacccatactgatggaactggattactgccaagtatggtagtaaaagcctataatttcaggaagaggcaagagggacagtagtcagtagctcaaggtcatctttggctacattgagagttcaaggatagcctgggctacatgaataaagaggtggaagataaagatgacttagcagctaaaagcacagtcatctgctcttctagatgttcggtttccatgtggcacacatacaaatgtgcagacaaaacacccacacacttaatataaaatataataaaagtttaaagggggaaacattatttcttagctttccttccttgggtgttcattaaataccagcacctctcaaagtcaaacattttttttccctcttgtatgtgagcatgtgcttggtttctcggtgctgctgtaactcctaagtccaggtaagtctctcggaatcatgagtgaagttctctctctctttgaaggttctgggacttccccagttcagcctgtgtgaatctcaggataccatctgttcttcataaaaaggtcaaagaccccatcctgtggtccttgtattggtcccaatattctgataatgtgttgacagtgactttttcaaaaataaaatcatagagactctcttggaactgaaaccatctttgaagtaaagatatgcttgtcaaaaatctccttgttggccaggttgatggcaaatgctggtaatctcagcattctggagtctgaagcaagaagatctcaaactggagaccagcctgggatacatccagagtgtgactatgtgcttcaacaagaacaaatgaaaaactctttctgttgttgccttctgtaagcaaaatccaaaagccagccatcggcacccaggccaggagaaagtcactcagtggccgtggtgagacaacctgcccacaggcaagactttttttctggctttgcctttcgagcaactaccatattatctgattggtccaacgtgttctgctttccctggtctgtgtgattaacactgtctcctttcacatcctatttccaggcttgctttcacctttcctaaaaccatggtctatattgctgagttgtaacattgactcaaactttcttcaagaacttcagataacatgatagcaggcatggtggcacaagcctttaatccaagcattgggaagctgaaacaggtggatctccacaagtacaaagccaacctggtctatgtatcaagttccaggccaactatggctacatactgagatcctgtttcaagagaagagaagagaagagaagagaggagaggagaggagaggagaggagaggagaggagaggagaggagaggagaggagaggagaggagaggagaggagaggagaggagaggagagagaggagaaaggggagaggggagagaggggagaggggagagaggggagaggggaaagaggggagagaggggagagaggggagagaggggagagaggggagaggggagagaggggagaggggagagaggggagagaagagaagagaagagaagagaagagaagagaagagaagagaagagaagagaagagaagagaagagaagagaagaggaggggagagaagagaagagaaaggaggggagagaagagaagagaagagaagagaagagaagagaagagaagagaagagaagagaagagaagagaagagaagagaagagaagagaggggagaaaggatagaagaatggagagaaggagggagagaaggagggagggaggataggagggatgataggaggaagggaaggagggagaaagggatggaaagagggagggggagggagggagagaaggaggagggagggaattatttgtgcttgactatttgtgcacgaagccctgggctcaaggggaaggagagataaaccagaggaggtagtgcatgcctgcagttgggagttggaggcagaacggtcaggagttcaagagagttcaagatcatcttcagctgcatatggagttcaacaccagcctagggctcatgggaacttggcagaaggagaaaaacaacaacaacacatgagaaagcagactcaagccaggactgacaatgagtcagcgccagtcccaacaattcatcctgaccgcttggaatgctatcaggcagcctggggttttgtacaaacttagcaggaaaagttagtaaaggcacaagatggagaagtgggtattcctcatctacatgaaatctaatttttttttaacttcttcctacacacatcagcctccaccagtcaggacaagaactgcatactacttcctggatgactctacttgatccgctgctctgtacgactcttttcatcacacataccacctgttctcataatttttccctttcaccaccagctcttgcctcgacctcctcaaatggaaattttcacctagcccctgacatcctctatgaacagtttattacttctgagggtctgtcaacatcctcagctgtatagatgtgtgtgtgttcatgatattccacatcatgtatgtttcgacttctcctactggatagtaagatctttgaggaagtaagcaggccttgttcatctcacaattcttcaactcttgtccctcatttagacacagccagatttcaagagaagattgtaaaataaataaactctttagccaatattctgatagcattgtgacacatgacttaaaaaaaaatcagagaatctcttggaactgaaaccatctcagaagcaaaggtattcatgtagaaaccttcttaacaatgaagtgtgacagtaagcacctgtgtgacagtaagcaagcacctgttgtctcagctctcaaagccgggggggggggggggtgtctcaagtcagaggcaagcttgggctacatatgtggtgaaatcttgtgttaatacgtaaacaaataaatagaccagttgtgatagcatatacctttattcctagcacttgggaagcataggaagttggtttctgtgagttcaagaccagcctagtctacacattccattccaggacagtcaaagctacaaactagatagatagatagatagatagatagatagatagatagatagatagatagaaaattaaaattaaatgtccttgacaaccatgagcaaaaaacaaactttagaagccccaaatcaggaggtgacacaactgtgaattcaaaggaagaatttgtgtcattggaatagcagcaagatcctcatagacagccagtatatatgacacacctataaccctttcaccaatgagcctagaatacaatccacccagtataacacaaactctcaaaagaaaaggaaaatccaaacccatgtctcacacaaagctgtgtgatttgcctattttttgtaaatgcaagtgcagaggaaggaacctactcctagcaaaaaccgctattgtggccagatgtagtggtgcatgcctgaaatcctcacattcaggaggccaaggcaggagaatctcagaccaaagggctagcctgagctacatagtaagaccctgtctcaataaaccataacaatgctaagaattgctgtccttattgttattattatcagcagcaggagcctagaatgtcactgggcacctacgatctcagcttcctggtcagatgagaggggaagtatggaccattaagcagcttaggtaacagtagaatctcctctcttcaaatgtattgtcattactattaccattattcttagtgagtagaaaaaccactacaatcgcttctcagccttttggctaagatcaagtggaaaactactacactgaatagcaccatctaatctactgaagtttcaccccgagatcagcctacagcccgcaagccatttgtgacctcaaactgcacacttagccctgaaacaaggtgactattgttcagtagaggaacagtgagccaccttccacactcaggcctcttctcattgctcatttgtatagaagccactggcccaaagccttccccatcacatacatctccaacccatagcaacaagtccaagaacacaatttataacaacccatggagaagccccaagcaccagggacctcatctttcctttataggaaactaactttcactgctgttctttgaatgcctaagaggagaaaaataaattaaagagagacagtgacagactttataatttccaaagttggtgccaagttctgtctaggaggaaggacattacaggcatttcactcttccgggaaagcaaggtttgggggggggggggggtttcacgttaggcagtgaaaagcaaatggcctaagcccaaatcccaaagaacaccgtgatttcaacgatttgggggttatctgccctgtcttttccctctgtgtctgtgtggttcctcaaacaaagtgggctggaagggttcaagctcggttcacagaagggaacattctgtactcagcctgtgccgggctgcgttgtgtaaaacgagatcaacagaatgatctcagccgcagcgcagcccggcagcagcaggcaccaccgccaccccccagcccagcccagcgtttgaacgtgtgggcccagaagccatctgcggacagtgaccgcaaaagtgggcacacgtgtgtgcccccgcaccctccccccacccccacccccacccccaccccagagatgcctttctggtcctggaagttcagttctgctgtttctcactggaaggtcaagggagttgttagcatatttgtctttagagtttaattacaactgaagcacttccaaggaaactagcccctgtgtgcacacttctactttggcatcgattggagcttttcaatctgtttggatgtttccgtgcctcagatgacagcggtaatactaaatatgctacggaggccgcgcctgcgctaagaggaggcgggggcagggaaagaggacagaagaccaaagggaacgaacagtcaagaccattgccggggctccactctgcacccgcccccaaacttttccacctaccagatacgaagccttttcatcttttgtctagaatttagcgaacaattcgacacatatttatccgatgcttattttgtgcatgggcctgttcataaaagagtacctgaaacaaaattttttagcaaaacggaagcctgtcttccaaactagaggaccgaggggaacagaaaggaagaggagagctgtgtgaccataggtgggggagggggagttaggaagagaggtaagcagtctgagctgctggtaaggacctgaattcatgtaggtgttttccaaagctctgcaggcagaccacatggttgcctaccaggaatcttcccatgcctgttgtaaaagatagggggtgacacaaaatgcccaaatctccccgcagggggttggttgtaggctgggcctctcgatgcctcctttcaaggaaacccagtcctgccccgttgcaggaaaaagagaacagcgggttgaagggcagggagaagaacaaagggctttctgtgcaggatggtcttgcctcctgatttacttactgtccttgggacatcgggcaagcgcctcagacttggtgctgttgccggagagtgctcagttatttaactggggaaaagccacctgtttgctgaatttgcctcttatggggtccaaggaaacagaatgtgcctaattaagtaaatagtaaccatggttgttatgagtgtaagtgcgggtcagtgagagctctttcttagatgttgattaagaacatcactactgtgtcctctgaactgttttctcacccacatattttcagtgttttgacttagcaagtggttgttgagcagcctcgcctgcctccacgtctgtgctgagctgctgagccttgtcctggtgaagtgtccccctctttctggagcaagggtgtctgatccaggcagcagtacctggggcaagaatcaaatgccttctcaaagtgggccttcttgttatgctcagtctagtctctcatccatcttccaagactgatttctaaggcagtggcagcctattccagagacaaaggaggtgcttggcctgccagggagctggggcttagctggagcaaccctgaaacaaagcattcttgagattgtacttgcagaatgtaaacacccttttctcacttcagacccggagctcctgccaacactggagaaattacgatacaaagaacctccagggcctggacatattaccatgcactgctacccggggaggtaggaggaagatggcctctgggggacggcagtcatggctgtgtgtccatctgtaaaccagttctcactagaacagaagactaataaagattcacaagcctctctgggtatggtgaaccacacctgtaatcccaacacttgcaaaggctatggaggaggaggaagaggagggggaagaggaggaagaggaagaagaggaggaggaggaagagaaagaggaggagaatggattatttctatgctggagaacccagtaaagtaacctgagcaagtgaaatcaatgctaaatctggtagatagaggagaacttgaatgaacctacaagcgtagctgcattgaccttgatctttaaagagagatggtatcccaccacccctcaccctcataaatgacctattagcccagctctgagagacaacctgaagagacaactcaagccaaagactatacattgtcggcgaaccaccatagctgagcagagcattgaaaccaggagaaaatggctactgagcatagaagccaaaacgatgtggaagaacttctttttttttggggggggttttttggtttttcgagacagggtttctctgtatagccctggctgtcctggagctcactttgtagaccaggctggcctcgaactcagaaatctgcctgcctctgcctcccgagtgctgggattaaaggcgtgcgccaccacgcccggcttttttttttttttttttttttttttttttttttttttttttggtttttcgagacagggtttctctgtgtagccctggctgtcctgaaactcactctgtagaccaggctggcctcgaactcagaaatccgcctgcctctgcctcccgagtgctgggattaaaggcgtgcgccaccacgtccggctgtggaagaactttaaacaagagaatacaagctagaggcgtacatgtgtttttccaatacccagaagaaggtcgattgctttgagtttgggacaagcctgggctgtataacaaatatcagaccacccagagctatatagcaaggaaaaggcttgattttaaagaccgtatataaagcacaaactctgcccttaagttttattctagtctctagtaagaataaatgtgtcattcccttgccttctttctgttgttgttgagacaagtttctacattgccctgactgtcctagaactcactctgtagaccagggctgtctttaactcagagatctgcctgcctctgccttccaaatgcagaggattaagggtgtgcaactgctcttctgaaggtcctgagttcaaatcccagcaaccacccaacagctcacaaccatctgtaatgagatctgatgccctcttctggtgtgtctgaagacagctacagtgtacttacatataacaataaataaatcttaaaaaaaaaagagagagatacttagtgaacagaaactaaaacttcaatgatatgagccaatgaagacaggttgaggggactaaaattgcaaatggtagcgagaaacccagagaggaggaggctgcttctagtggctagtggataccctagaggaaacggtgacaggaggcaatagaagacggggctcttggaatgaatggactcttttagtggggacttaagtttggcttcatagtgttcagcatgagccctcaacttctctcccttgtgaccattctgacaaagccttcatgcctgagatgctctgagagatggcaagaggaacatgtgggaaaatcggttgatgtgaactgttgactctggcttcaaagtggatatggggaatgagcaggggctccctggaaaacccaatcatgttttgttaaatagatgtgagcactcaagttgagagagagagagagagagagagagagagagagagagagagagagagaggagaggggagagggagagagaggctcatcctaggagaagagttagtgaagatgcctttcataagagggatgaaaggccagaaaacattcccatcacaattggatgacggtagcacattcttatctaggctctaagagctactcatgcagtggcactggtttgattgacagctccaagcaaatattgatgaacaagaatatgcaggataaaatcagaaagaatagctggtcagtggtggtgtacgcctttaatcccagcactttggaggcaaaggcaggcagatttctgagtttgaggccagcctggtctacaaagtgagttccaggacagccagggctacacagagaaaccctgtctagaaaaaaaaaaaaaagaataaaaaataaaataaaacaaaaataaaataaaaaatatgtcctacagacttgccaacaggcaaaccttacagaggcattttctcagtcgagagtccttcttcccaaatgaagctagcttgtgtcatgtgacataaaactagcccagccactaaccttcaaatccttccaagtttcatatttactaaggtcgtttgttttgtctcgggagatgtgaagccatcgatttcttatcaactcatcgataaacaaaagtaaaataaaaagtggcagagctagacacaaacttccctagccccacctcacccataccacatgccaatatttactttgctgctaagcactaacgcttccatgtgccaagacccttcagaccctgtatcctggcagatgaaggattgccagagacaagcactgaacagcagcagaaagccggtgactattaacacacacttcttgacttatatatgcaactgtcagatgggacgattcatccactttgttcagagccaaaatatccagctatggagagtgcgcctgggaagcctctacattggtgtgcatttcaataatctcaaaaacatctgcagtacccttctccacagactcttctgacgcagtttgaaaatgttatataggtgggaaatttccgtagcagaatgaagtataaatacttataaactcacaatgaggacgtgaggcaaagcggtgagattgaagacttactctgaaggtgagtgaattcaggacattattcaaacgttcacatttctcctcattttctcctgcttctagattcaatcctacagttggcactaaaactttggtcccctggagcaattctgtcatcttgacctgaatatggttcttctatatacattctgaagaatggcagtgtgtgacaggcttatgtcgctcatggggcctttagtttatgcattcctggcacagctcttgcagtagctcaaaactcctggcaggtgagtgagcccctgtgagtgagcagaaggaacctcaaatcacttgtgctggtaaatattgaccaagcaattactatgtttatgaagccacggcagggtgctggaggtacagctaaggacaaagtagacatggctcttcccatcttgaagccagccatctggtttggggaggattgttgttaagtggggcatcttgtgaatcatttcaaactcagtactatatgtatgatacaatgtatcacatgttatatgagatgtatcacctggattactcagaaaataagacagacacctgaccttggctgtgggggaaaggtcatggaaagtcagtctaagagagggaagctcagatgatggatgagttagatagggacctgtgtgtgtgtgtgtgtgtgtgtgtgtgtgtgttctcctcggctgtaaaaaaaggactctgctaacaaggccttatccaaaaacaaacttgaaggagaggacataggaaggcaagtcataagggcaggacatatccctgagcaaaggtggataaaaagctggggagagggactataaagggaaaggggtcattcaaggttgtgaatcaaacaaagcctcctggagaggcttgcagaagatagcttgggttgcatgggagagggctgagagtgtttgcttccctgtatccacttgtaacaggtaaagcctcaaacattttcttcctgtccaggctaagatacagaatgcttccattgtttctgtattccatcagagatctatgtaggctgcaggaagtttaagggcagtccactgcatgcaggaagatgacaaaaggatgcaaggttatgcagaagagccaattgctacatagcaggtgaattcatgtggaattaaactgtgcgtgtaaggagctgagccagggacctgacatagtacttaagtgttcaatcaatattagttcctgtcatgggtgtttatcactaggcatcaacaggcctaggacaggcttcactttgcccagttcgctctgcccactctatcttcaggaaacccttcccaccactcactgccaagtctcccgagacaaacacacatataaatagagcgatatatatttttatttctcagaactgtcacattttgctgagctcataacagaagtgagcaaatagtgctgtcgtcctctgtaataaatcctatcactcagagcagcttcatctccctgtcttcccaggctcccaggactcagatatgaatacacatgctcttctgtccttaaattacatctgtactaacctgatatagtctccaggcctcccttttctgggcaacatggtagaattcttgggccagaggaatctccgtcaactgtttatctttctgagcaattatttgctacttgagaaaaaaaaaagaagttactagtttaaataaaaaataaaaatacagattaaaaaaattgtactagttagtttgtattgtcaacttgacacaatctagagttacctgggaagaggaaatctgaactactgaggaattgtccacaagagattgtcttgactgatgattaatgtgggaggattaagcccactgtgggcagcaccattcctaggcaggaggatcgggctgtaaaagaaatctagcttagtatgagccagtgagtgagacagcaagcaacactcctccatggttttggttcaattccctgtcctgactctcctcaacataggactacgaactggaagtacagatgaaataaatcctctcttcccctaaattgctttcggttgagtgttttatcatagcaacagaaaagcaaactagaataagaatgatatcaaatacattagtctgagggagaaagaagaagaagaagaggaagaggaagagggaggaagagggaggaagaggaagagagagaaagaagaagaagaagaagaagaagaagaagaagaagaagaagaagaagaagaagaagaagaagaagaagaagaagaagaagaagaagaagaagaagaagaagaagaagaaccaggcacatgaggtaagtccatattgtagaacttctagatcaggggaaattaatctgtagaggcagaaaacagatctgtaaagtgtttgcagctaggcctaaggcagctgtgaaggaggcataagaaaacagtggtgagatgacagcacttaagcctctattatagaggcagttgcactatacaattgttgaaattcatagacctgtaggcttctgatatgtatagtggattatataaattacaacttaataaagtgatttggggagagagggttacatactctgttaccgttgctggcctcaaacctgtagtaactctctttatcatattctcccaagttcagaatcacaggcggacaccaccacacctggcaataaagtgatttttgaaaatgagcaacattgccctttgttacctgatcagaaatcaaaaataaatccaaggggttaagggagtaacccagtccataaaatgcatgccatggaaacctgaagaccggaattcaatccccagcatccatataggaagtcagatatggtggagcacactagtgatcagagctctggggagacaaagctactacgctccctagagctcaatggtccgccagtctggcctcattgatgagttccatgtcctagtcaacaaagcagctggccactgaagtatgcctaaggtgatattagcctctggtctccacacccaagagcaaacacatacatatgcacctacatacacgtgtgcatgcacacatacagataccacacacacacagtccaagaataattataataaaccccaactagataaacatacaaactccttttaaaaaaaaaaaaaaaaaaaggcctattcttctagattagattttattctggcaagaagttagtcttgagagtccagaaaaagatgaaatcaaacacaagccattcattcaaagttggcactgagatgttgttttgttatctgtaaaaaaactattgtctgttcgacatgtccaaatgcatttgaagtggaataatgaaggccctgacttgttgggatccaggaagcacctccctcttcttacctggttccatttctgcttgcctctcaaccagatctaggccttccttcaaacaggctgtgacgttctgtgctgctgccgttatggcttactgtatagtgtattactttgcactcacttgcaatgatgatggaaggggtacagatgctaagcaaatcctagaacagtggcaagctcctagtaggtgcttaataaagaactatggggttgttaactgttctggacacataagccttgctaaatggcttgtgggggaaagggggttttgaaaattaaccagcattctctacttgcaggtaattgaaaaaagttgctacaaaaatcacattcttgtatttagcatgcaatcgagttgtctcgtgttctcacaactggtcctccagccctgacacttctgaggttggattcacccttcctcccatcgcctactctgtactttgtccactaaccacgtggaagtcaaatgtctgtttactagtctcagtcctggaccagactgagggccctttgagagcagaagctatggaggtcactaccccatccagctcggagaacagtggcaggctcctagtaggtgcttaaaaaagaactatggggttgctaactgttctggacacataacaacagagtttatttaaggttttgaaaatcaactgcacaaacaggaaaaccctggcgcttccaaagggaactccacccaaggagcgatccagcaggaaataccaaaaagtcagtatctagcacagaaggcacagggaaagtgtttccagtcaaatcctgagagctggtctccaagaggctgtgaaactgtctggaaaacctaagggtttaagagcagtacaacggaattctcctccaaggcagataataaggtatcggcaagggagccaccctggccctcctaatcccctgggccaaatagcacaccactgaattcatttctaacaccacgggttaaacaaagcaccatggaattcctagcaatgagggctagtcctggtcacctggactatcagtatccctgcaactgcctccttggaaaatatttgcaaaattccatatgaacattctctgtctttctcatttttgttgttttttgatttttgttttccctcagattgaatctgaggcctcaattgtatgtgttagatacattttctacaagagaactgttccccaactcttctcattttttctttatgttgagatagaactcttactaagttgccctagccaaccttgaacttgcaagccttctgctttggctttctccatacctgggtttatccatgtacattcttgaaggcactggcaccttagttacctgcattatcaagaacaatgtaataaaataccatctagaacagtggttcttgaccttcccaatgctgtgaccctttaatacaggtcctcgtgttgtgatgaccctcaaccataaaattatttttgttactacttcacagctgtaattgtgctactgttatgaatcataatgtctgatgtgcagaatatctgatatccaacccctgtgaaagggtgactcaccccccccacacacacacacacacaaaaggggtcatgatccatccacaggatggaaatggctgatctagaaccttaaagcacaagagatggaaggataggcacttctgaataataaccaccattcacaccttatggttcaaacagtggcttccaagacatgaataacccctgtcctcctttcttccgtggcccgctgggtattcacctttggcccatttactcagtagtgagtgaagagagcaaagagagcttaagtcaacttcatgttgccacattagcaatcctcaaattgggaaataaactggctaaaatgagcatgtaggactctctacctccagcttcccatgatcctccttgctgatgttctggttattaatatacctagacttaacattgcatagttgattaatgatacctttccttcactagaatacttaattaagaaatgatttggggccgggcgtggtggcgcatgcctttaatcccagcactcgggaggcagaggcaggcggatttctgagttcgaggccagcctggtctacaaagtgagttccaggacagccagggctacacagagaaaccctgtcttgaaaaaccaaaaaaaagaaaaaaagaaagaaagaaagaaggaaggaaggaaggaaggaagaaggaaagaaagaaagaaagaaagaaagaaagaaagaaagaaagaaagaaagaaagaaagaaagaaagaaagaaagaaagagaaagaaatgatttggggactagggtatagctcagtgacaaaaccctgcctggcatatttaagacccttgattagatttttaataccaccatcccaataacagtaacaacaataatagtagctgggcagtggtggtgctcatctttaatcccagtactcaggaggaggaaggcaggtggatctccgtgagttagaggccaagctgatctacagaggataaccagggttacacagaaaaaccctgtttaaaaaacaaaacaaaacaaaacaaaacaaaacaaaacaaaacaacaactggaaaaaaatctatctgaaaaaagaaagaagccatctggtgaatttaatactcctgtcatctatatcaaacaaatcaccaacttgtatttaaataatgaatcctgacaacgtacaaacattttctaacactatctctcaaatcaccttctggagatacttcagtgtgtatccccattgtgatatcaccagaaactcattccttaaatattttttttcaaccaaagagcaaaacctgtggaaccaccttcgaatccttctgccttctactaggggcagaattagtcaaattgcgtgtctcttcctttcaagattatagtcacaattactatattgggattaaaatttacagtgaagactttttgtttatgatgcagtgtctgtctatgtggccctgacttcctagagcctactatgaagatcaggctgtcctcaaactctcagagatcacttgcctccccagtgctgggatcaaaggccaccacaccctgtataggtgagtacttttaattattgatagtagcaatagtaacaactgttacccagagcctcatgtatattccagagacctacactcaattttgttttcttcttcaagaatgcccaacgacatctgggacaaagcacagctgttcatttggaatgttctttcaagcccaagagccattgcaaatgtgtttgtccttatgcccatatcctcaagtaaagacaagtttagagagtaacagaaatatacaatattatacaaggcagacttcataaacttctatgctccattggaccatgccatcagactgcattgagaggtaaagaaaagcttttatgagtaagaaccggatatgaagaagacacatatctaagataaatatatattaagcacaactgaagagcctcaggtcccatcttcatagtgtgcagctgtggcaaatacaactggcttataaacatggctctccctagccacagttccagtacactgtgcaagcattgcaagggatgtcaatacagtcaataaatatttatcatgtcttccctggaataggcaaggtaagagaaccaatctaatgcttgcatgtcccctcctcttcctgaagcaactaggcaaatgtttgatgacgtgaagagatcgttctattaactagaacatttatcaggagtctatcgtttgacctgtcctaatctgaagcagtttctctggagtctgcacctgagagctttgccaaagaggtcaaataccagagaggggtgtttgactggtctgttgtacttctcacagggtccaacaaagtgctgcacttgttgtctgtgctcagctttcagcactagccactggcctctagggagaggacaagggtatgggagcaggtttcaaaacctttgtccctcaactataagattcaagtgaatggctgaacttcttctggccatcccgagtgacagcaccctgtagaaggcatggaagatgtatgcctcttcctacgtatcttttggggttaggggtgttgtagctttatttttatagctatattataaatataaagctaatacgtgcaagtgttttccctagtcctgcaagccaccctaacaaattaatcaagccaaaaaaggacagtaagaaccctaatttaaagtaagttggtctaaaggtataggaagcaatttaccattacaaaagatatctgaagtacaggaatctgccttgtggggatcttcaacctgtgggatctatcactgtctccaagtagattcagtgttggcactgacgtggattatgggacacctaaatgagctatgctagagacccgtgtggtgaatcagaaaaccacacacatacactgtgctgtgttgagtgtaagcagggaagggagagattattgtttaactgtagagaaatcaaaggagtcaaccctagaaggatttgcaaagatcagccctctccaggaatatatgctatgcatccatccaacatacatcttcattggataactactaggtaggaggtctacagtaggtgctgaaatacaatctcagctttaatggggtttttaagaatccattaatcaaagaagaattgattgagcatctactatgccgcccatgtaccactgcttgttaacacccatgaaactggcccttccaacctgctggatgctgaagaggataagactagtaccattaccacctgcaagcctgttgcctcaacttgacttcacacattgcctggagtgacaagggcactgtagggaaggaaaataaatggctgacagagttgaccaaaactccctgtctctcatgggaagccatgagatgaatgcacagattctgaagctttggtggtaagcataaccaaaccaacaaaataacgtgcagtggccttaaaaatgacaacggggaggctgtggctgactgtggctgctgcctttgtggggcacgactgctgacacccagcagcttctagagagatgaggctgtccatttttagacgccatagaaagatttatttctgcctgggtctcttcggagcattgtacatttttataaaattttaaaacaacacagcaggcaaaagaataaaggtttttcctctccttttatctcaatataactgtgtatgaaggcagagagccaaaaaagttcatgtccagagactctggtgttatttgtagcagcttaatgagcaaaacttctcatccactcatcttgatatctgataaccccccaagaacctgagcacaggcacatagtaggtgctcagcaagcttttgttaaataggtgggtgaataagtgaataaacccaatgaatgaaatatcgagatcaacccacaatccatccagcttcctgagagtctagtgagactccagcatttgtcatccataactaccttgtatattttccaccagcaactgcaagcagagaggcttgtaagttctgattcccaggaggaagaaagtggagaaaatcgggtaaagacactgaaaaagatgactcaaggaagtatggcatacctgtcatctatacctgtaatcctcggtgggagaacacaagaggatcaagagttagagaacacggactggagagatggctcagtggcaggggtcaagagcatggctgctcttggttcccagcacctacatcagacagttcacagccacctgggagccatttcaacttcagggaaatgaatatctctgtcatccatgttcaaatgcacacacacacacacacacacacacacagagagagagagagagagagagagagagagagagagagagagagagagagagaacgaacaaattgttttgaaaagaacagcatgagctacataggtatgggagatggagaacaaagagttctatccaaaggcaatcagaagacactgaaattccacactgggaggagcttaagcataggagacctcaaagcccaccccaacaaaaaaaaaaaaaaaaagactgctcaaatcaagaaacagtattaggtggtttgaatagggttgacccccatagactcatgtgtttgaatgcttagcccatagggaatggactattaggaggtgtggccttgttggaagtgtgtcattgtggggtgggctttgaggtctcctatgcttaagctcctcccagtgtagaatttcagtgtcttctgattgcctttggatagaactctttgttctcccaacaccatgtctgcctgcatgtggccatccctcccaccatggtgatattggactgaactctgaaactgtcatccagccccaattacatgtttgcctttataaaagttgcagtggccatggtatctcttcaaagcaataaaatgcaaactaagacacagtactaggtagaggtcacagtccttagtgtctaagacttgcccagatcccaacaatcacctaactgaatcacaaatccgcactaagcttttgttgtgtaccttgagctgtgggtacccaatgaatcagagaacaccctccagttctcccagtttactttccctgattctcactgtggactcaccatcttgttgtctctgaccaactacccacttcttcatctctgtctctgagcttagagccctagaccaacctgatggtagccatgccctagaaatgcctacagtacctttggctgttctctttagtcacatacagccttcagatgtgacctgggagtgaaatctaaggccagcatcctcactcccacttcagcagtgcaggtaaaatcacacaggtgtgccaactactgccatttataatacatgacccaaacccaagccccttccactttttgtactccaataaatggtaccactattccctaccccagacactactcaaaaatcactttgagttttccttctctcctgtaccccatgtccaaatcattaccaagtttaaaaaaaatcttatttctacatgaatcttaagccccctcttgagctcccttggttacctccttgcccatctccgtgatctcacacctgtaccactaacgctgtctctgcgctggtctctcttttatgattcctgcttctgatttatccactgggaaaaagaaagaagaaaaaaagaactattgattcctcacctaaattgcagcctatatgtccctcccctagccttcagaattcacctttcaaccaccagaattcaggacatggcttcggtcgttaccttctgggtttctgtggttatgaagtggtttgcctacttttagtagaagcttgtacagaaaccgatgctttcataaataattgttacttgaattttgtgaacaaatagaacacaacaatagacacattgtactaagatttcctatcttagaacaattatgctcataatagcaaccggaagaagcaggattcaatggtgttttacgatgtaagcagtgtaatgtcaaatgctgagcattaaagataaatcagaagtaggcaaagatcttcaggcatcaccctttgatattctctttacctttctgcggagtccaagaagtgtacaatgaagtttagtaatgttgcatttagagtcaacaacagtaaacttcttttttcaaaaagaaacaacttatacatctggccaagaattcttgcgtgaatgaaatattttcctactttttccttttagagttcattgtcccttagcttatttgcatggtgtactgcattgatttgcatatgttgaaccaaccttccattgctgggatgaagctgacgtggacgtgatgtaggatgtccttaatgtgttcctgaattagggttgcaagtatttggatgagaatttctgcatctatgttcatcagagaaatgggtctgtagtttttgttgttctttacttggttctggtaccaagaaagcatcagcttttttttttaacagatttatttatttattatatgtaagtatactatagctgtcttcagacaccccagaagagggcatcagatctcattacagatggttgaggagcccccatgtggtggctgggatttgaactcatgacctctggaagagtagtcagtgttcttaaccgctgagccatctctccagtccagtaccagctttttagaaggaatttggcaatgttctttctctttctattttgtggaacaaattaaggagatcttcccttgacatttgtcacaattcagcagtagttctaagctttcctttgtgaggagatattgttattgttgttgttgttgttgttgttgttgttgttattgttgttgttgttgccaagaactcaagaagtcaaaacaaagaaaactaacacacgaacattgacacattctttggaataatgacaagctagaaaaatacatgtatataataaaaacaaacttggaaaatatatgtatatagtaaattccattagtatttcttcccctatatttctttaatacacatgtgtgtatgtgtattaaaaataaaactaaagtgtctgtactaataaacaaaccacaagtcatctaaggtcttgggtttttttttttaattttttatttatttttattttatgtgcattggtgttttgcctgcatgtaaatctgtgtgcggtatcagatcttggagttatgagccaccatgtgaatgctgggaactgaacccaggtcctctggaagagcagccagtgctctgactgccaagccatctctctagtcccaggttttgtttttttaagaatgaagaaaaaaataaataaagctggacttgttactgcagcctttaattccaggaaggcagaagcaggcagacctttgtgagttctaggccagctacatagctagttctaggacacagagaaaccctttctcaaataaaaaacaaagagaactgaatattgagatgtgattagggtaagtgacctccaacaaccatgcctcttacatctttatggaccctctttgaggatatgccaggctgaggataaccaataaagctgctgtgcccagccctgaggggaggtccaaagatgtgagatttttttttttcctaattgcaggaaagtcctgaggaaaagggtatgagttgatcaacaaggtagatgtaatgactttctcaagaatggaatacggcaggaaagaggaacacttccaaagttgtggcagtactcaggcttctgtgcgatgctctcagctaggccttctgctctggaagaagccataggctatgagcagtaccgtgaagcagctcacatgaatgaatttagaagcactttagaagccgggcgtggtggcgcacgcctttgatcccagcactcgggaggcagaggcaggtggatttctgagttcgaggccagcctggcctacaaagtgagttccaggacagccagggctatacagaaaaaccctgtctcgaaaaaccctgtctcaaaaaaccaaaaaaaaaaaaaaaaaaaaaaaaaaagaagaagaagaagaagaagaagaagaagaagcacatttgaggcctgccactggtcacgtgggtgaaatctgaagtccacagtctcccagtttgagcctccagtttgagcctccagttaatgatatcttcagactacaccttgatcgaagctttatgagacatgtcacgtgaccagatctcactaagtcacacccaggtctcgatgttcactgatggttggcggaagtaatttttgttccctatagtatgagagggtacatgagactggttgctcacactagtgtgagtcaggaatctgggagcaatgaaggcttatctctctttcctcctttctcttttcattccttctgagcctctacccatgagatgatgccacccacttaagggagggcctcccctcctaggttagttgtctttgaaaatgacccccatagaaaaaactaaatatgtgcctcactaatgcgctatgtacgactaaatccaatcaagtggacaaaaattaaccagcacaagttcacctttgaaccagcagtgatcacacatgcctttaatcccattacagaggcaggcgaatcacttgagagatgagtttgaggccagtctggtctacaaaacaggttccagggctacataatgagaccctgtctcaaaaatacatacatacttatgtagggatggtgctgatgctaaggtcctgttctccaattggttgttgatccatcaataaagatgctagcggccagtgagctgggtgaaataggcgggacttccgggtccccgcaggcaaagtagcagacacaggagaactaggagggggtggaatggggtaaaagaaggaggctagtggctgcaggagataaagccgaccagccaagagggttttccattagagtggccaaggaaacagagccattcaaattatgtagctccatgtgcatcccgcatcaaaattctcaggggcatcatagagactctaacagccattgtggccccccactcaagctctgaagcctctcttcggagcctgttccctccgtagctgcagttttcagcaaatgccccatgtttctgacatctccaacagcctggggtctcccctgtatcttagacttcatctttatagttttaagcactaacctttcagggcctcgatgtagggaatccaacccagccatacattgcctggctttggcagctttccatgcaagcctccttcggcaagcctccatgcgcc

SEQ ID NO: 170 - DNA, 38032 bp, Mus musculus
gccatattccatgtcctacaatggacatttctaaattttccaactttttcagttttcctcgccatatttcacgtcctaaagtgtgtatttctcattttccgtgattttcagttttctcgacatattccaggtcctacagtgtgcatttctcatttttcacgtttttcagtgatttcgtcatttttcacgtcgtcaagtggatgtttctcattttccatgattttcagttttcttgccatattccatgtcctacagtggacatttctaaattttccacctttttcagttttcctcgccatatttcacgtcctaaagtgtgtatttctcattttccgtgattttcagttttctcgacatattccaggtcttacagggtgcatttctcatttttcacgtttttcagtgatttcatcatttttcaagtcgtcaactgtatgtttctcattttcaatgattttcatttttcttgccatattccacgtcctatagtggacatttctaaattttccacctttttcagttttccttgccatatttcaggtcctacagtgtgcatttctcatttttcacgtttttcagtgatttcgtcatttttcaagtggtcaaatgcatgtttctcattttccatgattttcagttttcttgccatattccatgtcctacagtggacatttctaaattttccacctttttcagttttcctcgccatatttcacgtcctaaagtgtgtatttctcattttccgtgattttcagttttatcgccagattccaggtcctacggtgtgcatttttcatatttcacgtttttcagtgattttgtcatttttcaagttgtcaactgcatgtttctcattttccatgattttcagttttcttgccatattccatgtcctacagtggacatttctaaattttccacctttttcagttttcctcgccatatttcatgtcctaaagtgtgtatttctcattttcagtgattttctgttttctcgccatattccaggtcctacagtgtgcatttctcatttttcacgtttttcagtgatttcgtcatttttcaagttgtcaagtggatgtttctcattttccatgattttcagttttcttgccatattccatgtcctacaatggacatttctaaattttccacctttttcagttttcctcgccatatttcacgtcctaaagtgtgtatttctcattttccgtgattttcagttttctcgccatattccaggtcctatgtgtacatttctcatttttcacgtttttcagtgattttgtcatttttcaagttgtgaagtggatgtttctcatttttcttgattttcatttttcttgccatattccatgtcctagagtggaaatttttaaattttccacctttttcagttttcctcgccatatttcacgtcctaaagtgtgaatttctcattttccgtgattttcagttttctcgccatattccaagtcctacagtgtgcatttctcatttttcacgtttttcagtgatttcgtcatttttcaagttgtcaagtggatgtttctcattttccatgattttcagctttcttgccatattcaaagtcctacagtggacatttctaaattttcgacctttatcagttttcctcgccatatttcatgtcccaaagtgtgtacttctcattttccgtgattttcagtttcctcgccatattctaggtcctacagtgtgcatttctcatttttcaggtttttcagtgatttcgtcttttttcaagtcgtcaagtggatgtttctcattttccatgattttcagttttcttgccatattccatgtcctacagtggacatttctaaattttccaactttttcagttttcctcgccatatttcatgtcctaaagtgtgtatttctcattttcagtgattttcagttttctcgccatattccaggtcctacagtgtgcatttctcatttttcacgtttttcagtgatttcgtcatttttcaagttgtcaagtggatgtttctcatttttcatgattttcagttttcttgccatattccatgtcccacagtggacatttctaaatgttccacctttttctgttttccttgccatatttcatgtcctaaagtgtgtatttctcattttccgtgattttcagttttcttgctatattccaagtcctacagtgtgcatttctcatttttcacgtttttctgtgattttttcatttttcaatttgtcaactgcatgtttctcattttccatgattttcagttttcttgccatattccaggtcctacagtgtgcatttctcatttttcacgtttttcagtgattttgtcatttttcaagttgtcaactgcatgtttctcattttccatgattttcagttttcttgctatattccatgtcctacagtggaaatttctaaattttccacctttttcagttttcctcgccatatttcacgtcctaaagtgtgtatttctcattttccgtgattttcagttttctcgccatattccaggtcctatgtgtacatttctcatttttcacgtttttcagtgattttgtcatttttcaagttgtgaagtggatgtttctcatttttcttgattttcatttttcttgccatattccatgtcctagagtggaaatttttaaattttccacctttttcagttttcctcgccatatttcacgtcctaaattgtgaatttctcattttccgtgattttcagttttctcgccatattccaagtcctacagtgtgcatttctcatttttcacgtttttcagtgatttcgtcatttttcaagttgtcaagtggatgtttctcattttccatgattttcagctttcttgccatattcaaagtcctacagtggacatttctaaattttcgacctttatcagttttcctcgccatatttcatgtcccaaagtgtgtacttctcattttccgtgattttcagtttcctcgccatattctaggtcctacagtgtgcatttctcatttttcaggtttttcagtgatttcgtcttttttcaagtcgtcaagtggatgtttctcattttccatgattttcagttttcttgccatattccatgtcctacagtggacatttctaaattttccacctttttcagttttcctcgccatatttcatgtcctaaagtgtgtatttctcattttcagtgattttcagttttctcgccatattccaggtcctacagtgtgcatttctcatttttcacgtttttcagtgattttgtcatttttcaagttgtcaagtggatgtttctcattttccttgattttcagttttcttgccatattccatgtcctacagtggacatttctaaattttccacctttttcagttttccttgccatatttcatgtcctaaagtgtgtatttctcattttcagtgattttcagttttctcgccatattccaggtcctacagtgtgcatttctcattttttcaggtttttcagtgatttcgtcatttttcacgttgtcaagtggatgtttctcattttccatgattttcacttttcttgccatatttcatgtcctaaagtgtgtatttctcattttcagtgattttcagttttctcgccatattccaggtcctacagtgtgcatttctcattttttcacgtttttcagtgatttcgtcatttttcacgttgtcaagtggatgtttctcattttccattattttcacttttcttgccatatttcatgtcctacagtggacatttctaaattttccacctttttctgttttcctcgccatatttcacatcctaaagtgtgtatttctcattttccgtgattttcagttttcttgccatattccaggtcctacagtgtgcatttctcatttttcacgtttttcagtgatttcgtcatttttcaagtcgtcaagtggatgtttctcattttccatgattttcagttttctcgccatattccaggtcctacagttgacatttctaaattttccacattttttatgtttcctcgcgatatttcacatcctaaagtgtgtatttctcattttccgtgattttcagttttcttgccatattccaggtcctacagggtgcatttctcatttttcacgtttttcagtgatttcatcaatttcaagtcgtcaactgtatgtttctcattttcaatgattttcatttttcttgccatattccacgtcctatagtggacatttctacattttccacctttttcagttttcttcgccatatttcacgtcccaaagtgtgtatttctcattttccgtgattttcagtttcctcgccatattccaggtcctacagtgtgcatttctcatttttcacgtttttcagtgatttcgtcttttttcaagtcgtcaagtggatgtttctcattttccatgattttcagttttcttgccatattccatgtcctacagtggacatttctaaattttccacctttttctgttttcctcgccatatttcacgtcctaaagtgtgtatttctcatttaccgtgattttcagttttcttgctatattccaagtcctacagtgtgcatttctcatttttcacgtttttcactgattttgtcattgttcaagttgtcaactgcatgtttctcattttccatgattttcagttttcttgccatattccatgtcctacagtggaaatttctatattttccaactttttcagttttcctcgccatatttcacgtgctaaagtgtgtatttctcatttttcgtgtttttcaggtttctcgccatattccaggtcctacagtgtgcatttctcatttttcacgtttttcagtgattttgtaatttttcaagttgtcaagtggatgtttctcattttccttgattttcagttttcttgccatattccatgtcctactgtggacatttctaaattttccacctttttcagttttccttgccatatttcatgtcctaaagtgtgtatttctcattttcagtgattttcagttttctcgcaatattccaggtcctacagtgtgcatttctcattttttcaggtttttcagtgatttcgtcatttttcacgttgtcaagtggatgtttctcattttccatgattttcacttttcttgccatatttcatgtgctaaagtgtgtatttctcattttcagtgattttcagttttctgccatattccaggtcctacattgtgcatttctcattttttcacgtttttcagtgatttcgtcatttttcacgttgtcaagtggatgtttctcattttccatgattttcacttttcttgccatatttcatgttttacagtggacatttctaaattttccacctatttctgttttcctcgccatatttcacatcctaaagtgtgtatttctcattttccgtgattttcagttttctcgccatatgccaggtcatacagggtgcatttctcatttttcacgtttttcagtgatttcgtcatttttcacgtcgtcaagtggatgtttctcattttcaatgattttcatttttcttgccatattccacgtcctatagtggacatttctaaattttccacctttttcagttttccttgccatatttcaggtcctacagtgtgcatttctcttttttcacgtttttcagtgatttcgtcatttttcaagtggtcaagtgcatgtttctcattttccgtgattttcagttttcttgccatgttccaggtcctacagttgacgtttctaaaatttcactttttttaagttttcctcgccatatttcacttcctaaagtgtgtatttctcattttccgtgattttcagttttctcgccagattccaggtcctacagtgtgcatttttcatatttcacctttttcagtgattttgtcatttttcaagttgtcaactgcatgtttctcattttccatgattttcagttttcttgccatattccatgtcctactgtggacatttctaaattttccaactttttcagttttcctcgccatatttcatgtcctaaagtgtgtatttctcattttcagtgattttctgttttctcgccatattccaggtcctacagtgtgcatttctaatttttcacgtttttcagtgatttcgtcatttttcaagttgtcaagtggatgtttctcattttccatgattttcagttttcttgccatattccatgtcctacagtggacatttctaaattttccaactttttccattttcctcaccatatttcacgtcctaaagtgagtttttctcattttttgtgattttcagttttctcgacatattccaggtcctacagtgtgcatttctaattttttcttttttcagtgatttcgtcatttttcaagtggtcaagtgcatgtttctcattttccatgattttcagttttcttgccatattccatgtcctacaatggacatttctaaattttccaactttttcagttttcctcgccatatttcacgtcctaaagtgtgtatttctcattttccgtgattttcagttttctcgccatattccaggtcctacagtgtgcatttctcatttttcacgtttttcagtgatttcgtcatttttcaagttgtcaactgcatgtttctcattttccatgattttcagttttcttgccatattccatgtcttacagtggacatttttaaatttttcacatttttttaagttttcctccccatatttcacgttttaaagtgtgcatttctcattttcggtgattttcagttttctcgccagattccatgtcttacagtgtgcatttctcattttttcacgtttttcagtgatttcgtcatttttcaagtcgtcaagtggatgtttctcattttccatgattttcagttttcttgccatattccatgtcctacagtggaaatttctaaattttccacctttttcagttttccttgccatatttcaggtcctaaagtgtgtatttctcattttctgtgattttcagttttctcgccatattccaggtcctacagttgacatttctaaaatttccacattttttaagttttcctcgccatatttcacttcctaaagtgtgtatttctcattttccgtgattttcagttttctcgccatattccagatcctacagtgtacatttttcatttttcacgtttttcagtgattttgtcattttttagttgtcaactgcctgtttctcattttccatgattttcagttttcttgctatattccatgtcctacagtggaaatttctaaattttccacctttttcagttttcctcgccatatttcacgtcctaaagtgtgtatttctcattttccgtgattttcagttttctcgccatattccaggtcctatgtgtacatttctcatttttcacgtttttcagtgattttgtcatttttcaatttgtcaactgcatgtttctcattttccatgattttcagttttcttgccatattccatgtcctacagtggaaatttctatattttccaactttttcagttttcctcgccatatttcacgtgctaaagtgtgtatttctcatttttcgtgtttttcaggtttctcgccatattccaggtcctacagtgtgcatttctcatttttcacgtttttcagtgattttgtcatttttcaagttgtcaagtggatgtttctcattttccttgattttcagttttcttgccatattccatgtcctacagtggacatttctaaattttccacctttttcagttttccttgccatatttcatgtcctaaagtgtgtatttctcattttcagtgattttcagttttctcgccatattccaggtcctacagtgtgcatttctcattttttcaggtttttcagtgatttcgtcatttttcacgttgtcaagtggatgtttctcattttccatgattttcacttttcttgccatatttcatgtcctaaagtgtgtatttctcattttcagtgattttcagttttctcgctatattccaggtcctacagtgtgcatttctcattttttcacgtttttcagtgatttcgtcatttttcacgttgtcaagtggatgtttctcattttccatgattttcacttttcttgccatatttcatgtcctacaatggacatttctaaattttccacctttttctgttttcctcgccatatttcacatcctaaagtgtgtatttctcattttccgtgattttcagttttcttgccatattccaggtcctacagtgtgcatttctcatttttcacgtttttcagtgatttcgtcatttttcaagttgtcaagtggatgtttctcattttccttgattttcagttttcttgccatattccatgtcctactgtggacatttctaaattttccacctttttcagttttccttgccatatttcatgtcctaaagtgtgtatttctcattttcagtgattttcagttttctcgcaatattccaggtcctacagtgtgcatttctcattttttcaggtttttcagtgatttcgtcatttttcacgttgtcaagtggatgtttctcattttccatgattttcacttttcttgccatatttcatgtcctaaagtgtgtatttctcattttcagtgattttcagttttctgccatattccaggtcctacattgtgcatttctcattttttcacgtttttcagtgatttcgtcatttttcagttttctcgacatattccaggtcctacagtgtgcatttctaattttttcttttttcagtgatttcgtcatttttcaagttgtcaactgcatgtttctcattttccatgattttcagttttcttgccatattccatgtcttacagtggacatttttaaatttttcacatttttttaagttttcctccccatatttcacgttttaaagtgtgcatttctcattttcggtgattttcagttttctcgccagattccaggtcttacagtgtgcatttctcattttttcacgtttttcagtgatttcgtcatttttcaagtcgtcaagtggatgtttctcattttccatgattttcagttttcttgccatattccatgtcctacagtggaaatttctaaattttccacctttttcagttttccttgccatatttcaggtcctaaagtgtgtatttctcattttctgtgattttcagttttctcgccatattccaggtcctacagttgacatttctaaaatttccacattttttaagttttcctcgccatatttcacttcctaaagtgtgtatttctcattttccgtgattttcagttttctcgccatattccagatcctacagtgtgcatttttcatttttcacgtttttcagtgattttgtcattttttagttgtcaactgtctgtttctcattttccatgattttcagttttcttgccatattccatgtcctacactggacatttctaaattttccacctttttctgttttcctcgccatatttcacgtcctaaagtgtgtatttctcattttccgtgattttcagttttcttgccatattccaggtcctacagtgtgcatttctcatttttcacgtttttcagtgattttgtcatttttcaagttgtcaactgcatgtttctcattttctatgattttcagttttcttgctatattccatgtcctacagtggaaatttctaaattttccacctttttcagttttcctcgccatatttcacgtcctaaagtgtgtatttctcattttccgtgattttcagttttctcgccatattccaggtcctatgtgtacatttctcatttttcacgtttttcagtgattttgtcatttttcaagttgtgaagtggatgtttctcatttttcttgattttcatttttcttgccatattccatgtcctagagtggaaatttttaaattttccacctttttcagttttcctcgccatatttcacgtcctaaagtgtgaatttctcattttccgtgattttcagatttctcgccatattccaagtcctacagtgtgcatttctcatttttcacgtttttcagtgatttcgtcatttttcaagttgtcaagtggatgtttctcattttccatgattttcagctttcttgccatattcaaagtcctacagtggacatttctaaattttcgacctttatcagttttcctcgccatatttcatgtcccaaagtgtgtacttctcattttccgtgattttcagtttcctagccatattctaggtcctacagtgtgcatttctcatttttcaggtttttcagtgatttcgtcttttttcaagtcgtcaagtggatgtttctcattttccatgattttcacttttcttgccatatttcatgtcctaaagtgtgtatttctcattttcagtgattttcagttttctcgctatattccaggtcctacagtgtgcatttctcattttttcacgtttttcagtgatttcgtcatttttcacgttgtcaagtggatgtttctcattttccatgattttcacttttcttgccatatttcatgtcctacagtggacatttctaaattttccacctttttctgttttcctcgccatatttcacatcctaaagtgtgtatttctcattttccgtgattttcagttttcttgccatattccaggtcctacagtgtgcatttctcatttttcacgtttttcagtgatttcgtcatttttcaagttgtcaagtggatgtttctcattttccttgattttcagttttcttgccatattccatgtcctactgtggacatttctaaattttccacctttttcagttttccttgccatatttcatgtcctaaagtgtgtatttctcattttcagtgattttcagttttctcgcaatattccaggtcctacagtgtgcatttctcattttttcaggtttttcagtgatttcgtcatttttcacgttgtcaagtggatgtttctcattttccatgattttcacttttcttgccatatttcatgtcctaaagtgtgtatttctcattttcagtgattttcagttttctgccatattccaggtcctacattgtgcatttctcattttttcacgtttttcagtgatttcgtcatttttcacgttgtcaagtggatgtttctcattttccatgattttcacttttcttgccatatttcatgttttacagtggacatttctaaattttccacctttttctgttttcctcgccatatttcacatcctaaagtgtgtatttctcattttccgtgattttcagttttctcgccatatgccaggtcatacagggtgcatttctcatttttcacgtttttcagtgatttcgtcatttttcacgtcgtcaagtggatgtttctcattttcaatgattttcatttttcttgccatattccacgtcctatagtggacatttctaaattttccacctttttcagttttccttgccatatttcaggtcctacagtgtgcatttctcatttttcacgtttttcagtgatttcgtcatttttcaagtggtcaagtgcatgtttctcattttccgtgattttcagttttcttgccatgttccaggtcctacagttgacgtttctaaaatttcactttttttaagttttcctcgccatatttcacttcctaaagtgtgtatttctcattttccgtgattttcagttttctcgccagattccaggtcctacagtgtgcatttttcatatttcacctttttcagtgattttgtcatttttcaagttgtcaactgcatgtttctcattttccatgattttcagttttcttgccatattccatgtcctactgtggacatttctaaattttccaactttttcagttttcctcgccatatttcatgtcctaaagtgtgtatttctcattttcagtgattttctgttttctcgccatattccaggtcctacagtgtgcatttctaatttttcacgtttttcagtgatttcgtcatttttcaagttgtcaagtggatgtttctcattttccatgattttcagttttcttgccatattccatgtcctacagtggacatttctaaattttccaactttttccattttcctcaccatatttcacgtcctaaagtgtgtttttctcattttttgtgattttcagttttctcgacatattccaggtcctacagtgtgcatttctaattttttcttttttcagtgatttcgtcatttttcaagttgtcaactgcatgtttctcattttccatgattttcagttttcttgccatattccatgtcttacagtggacatttttaaatttttcacatttttttaagttttcctccccatatttcacgttttaaagtgtgcatttctcattttcggtgattttcagttttctcgccagattccaggtcttacagtgtgcatttctcattttttcacgtttttcagtgatttcgtcatttttcaagtcgtcaagtggatgtttctcattttccatgattttcagttttcttgccatattccatgtcctacagtggaaatttctaaattttccacctttttcagttttccttgccatatttcaggtcctaaagtgtgtatttctcattttctgtgattttcagttttctcgccatattccaggtcctacagttgacatttctaaaatttccacattttttaagttttcctcgccatatttcacttcctaaagtgtgtatttctcattttccgtgattttcagttttctcgccatattccagatcctacagtgtgcatttttcatttttcacgtttttcagtgattttgtcattttttagttgtcaactgtctgtttctcattttccatgattttcagttttcttgccatattccatgtcctacactggacatttctaaattttccacctttttctgttttcctcgccatatttcacgtcctaaagtgtgtatttctcattttccgtgattttcagttttcttgccatattccaggtcctacagtgtgcatttctcatttttcacgtttttcagtgattttgtcatttttcaagttgtcaactgcatgtttctcattttccatgattttcagttttcttgctatattccatgtcctacagtggaaatttctaaattttccacctttttcagttttcctcgccatatttcacgtcctaaagtgtgtatttctcattttccgtgattttcagttttctcgccatattccaggtcctatgtgtacatttctcatttttcacgtttttcagtgattttgtcatttttcaagttgtgaagtggatgtttctcatttttcttgattttcatttttcttgccatattccatgtcctagagtggaaatttttaaattttccacctttttcagttttcctcgccatatttcacgtcctaaagtgtgaatttctcattttccgtgattttcagatttctcgccatattccaagtcctacagtgtgcatttctcatttttcacgtttttcagtgatttcgtcatttttcaagttgtcaagtggatgtttctcattttccatgattttcagctttcttgccatattcaaagtcctacagtggacatttctaaattttcgacctttatcagttttcctcgccatatttcatgtcccaaagtgtgtacttctcattttccgtgattttcagtttcctcgccatattctaggtcctacagtgtgcatttctcatttttcaggtttttcagtgatttcgtcttttttcaagtcgtcaagtggatgtttctcattttccatgattttcagttttcttgccatattccatgtcctacagtggacatttctaaattttccacctttttcagttttcctcgccatatttcatgtcctaaagtgtgtatttctcattttcagtgattttcagttttctcgccatattccaggtcctacagtgtgcatttctcatttttcacgtttttcagtgatttcgtcatttttcaagttgtcaagtggatgtttctcattttccatgattttcagttttcttgccatattccatgtcccacagtggacatttctaaattttccacctttttctgttttccttgccatatttcatgtcctaaagtgtgtatttctcattttccgtgattttcagttttcttgctatattccaagtcctacagtgtgcatttctcatttttcacgtttttcagtgattttgtcatttttcaatttgtcaactgcatgtttctcattttccatgattttcagttttcttgccatattccatgtcctacagtggaaatttctatattttccaactttttcagttttcctcgccatatttcacgtgctaaagtgtgtatttctcatttttcgtgtttttcaggtttctcgccatattccaggtcctacagtgtgcatttctcatttttcacgtttttcagtgattttgtcatttttcaagttgtcaagtggatgtttctcattttccttgattttcagttttcttgccatattccatgtcctacagtggacatttctaaattttccacctttttcagttttccttgccatatttcatgtcctaaagtgtgtatttctcattttcagtgattttcagttttctcgccatattccaggtcctacagtgtgcatttctcattttttcaggtttttcagtgatttcgtcatttttcacgttgtcaagtggatgtttctcattttccatgattttcacttttcttgccatatttcatgtcctaaagtgtgtatttctcattttcagtgattttcagttttctcgctatattccaggtcctacagtgtgcatttctcattttttcacgtttttcagtgatttcgtcatttttcacgttgtcaagtggatgtttctcattttccatgattttcacttttcttgccatatttcatgtcctacagtggacatttctaaattttccacctttttctgttttcctcgccatatttcacatactaaagtgtgtatttctcattttccttgattttcagttttcttgccatattccaggtcctacagtgtgcatttctcatttttcacgtttttcagtgatttcgtcatttttcaagtcgtcaagtggatgtttctcattttccatgattttcagttttctcgccatattccaggtcctacagttgacatttctaaattttccacattttttaagtttcctcgcgatatttcacatcctaaagtgtgtatttctcattttccgtgattttcagttttcttgccatattccaggtcctacagggtgcatttctcatttttcacgtttttcagtgatttcatcaatttcaagtcgtcaactgtatgtttctcattttcaatgattttcatttttcttgccatattccatgtcctacagtggacatttctaaatttttcacctttttcagttttccttgccatatttcatgtcctaaagtgtgtatttctcattttcagtgattttcagttttctcgccatattccaggtcctacagtgtgcatttctcattttttcaggtttttcagtgatttcgtcatttttcacgttgtcaagtggatgtttctcattttccatgattttcacttttcttgccatatttcatgtcctaaagtgtgtatttctcattttcagtgattttcagttttctcgccatattccaggtcctacagtgtgcatttctcatttttcacgtttttcagtgatttcgtcatttttcaagttgtcaagtggatgtttctcattttccatgattttcacttttcttgccatattccatgtcccacagtggacatttctaaattttccacctttttctgttttcctcgccatatttcatgtcctaaagtgtgtatttctcattttccgtgattttcagttttcttgctatattccaagtcctacagtgtgcatttctcatttttcacgtttttcagtgattttgtcatttttcaatttgtcaactgcatgtttctcattttccatgattttcagttttcttgccatattccatgttctacagtggaaatttctatattttccaactttttcagttttcctcgccatatttcacgtgctaaagtgtgtatttctcatttttcgtgtttttcaggtttctcgccatattccaggtcctacagtgtgcatttctcatttttcacgtttttcagtgattttgtcatttttcaagttgtcaagtggatgtttctcattttccttgattttcagttttcttgccatattccatgtcctacagtggacatttctaaattttccacctttttcagttttccttgccatatttcatgtcctaaagtgtgtatttctcattttcagtgattttcagttttctcgccatattccaggtcctacagtgtgcatttctcattttttcaggtttttcagtgatttcgtcatttttcacgttgtcaagtggatgtttctcattttccatgattttcacttttcttgccatatttcatgtcctaaagtgtgtatttctcattttcagtgattttcagttttctcgctatattccaggtcctacagtgtgcatttctcattttttcacgttttgcagtgatttcgtcatttttcacgttgtcaagtggatgtttctcattttccatgattttcacttttcttgccatatttcatgtcctacagtggacatttctaaattttccacctttttctgttttcctcgccatatttcacatcctaaagtgtgtatttctcattttccgtgattttcagttttcttgccatattccaggtcctacagtgtgcatttctcatttttcacgtttttcagtgatttcgtcatttttcaagtcgtcaagtggatgtttctcattttccatgattttcagttttctcgccatattccaggtcctacagttgacatttctaaattttccacattttttaagtttcctcgcgatatttcacatcctaaagtgtgtatttctcattttccgtgattttcagttttcttgccatattccaggtcctacagggtgcatttctcatttttcacgtttttcagtgatttcatcaatttcaagtcgtcaactgtatgtttctcattttcaatgattttcatttttcttgccatattccatgtcctacagtggacatttctaaattttccacctttttcagttttccttgccatatttcatgtcctaaagtgtgtatttctcattttcagggattttcagttttctcgccatattccaggtcctacagtgtgcatttctcattttttcaggtttttcagtgatttcgtcatttttcacgttgtcaagtggatgtttctcattttccatgattttcacttttcttgccatatttcatgtcctaaagtgtgtatttctcattttcagtgattttcagttttctcgccatattccaggtcctacagtgtgcatttctcattttttcacgtttttcagtgatttcgtcatttttcacgttgtcaagtggatgtttctcattttccatgattttcacttttcttgccatatttcatgtcctacagtggacatttctaaattttccacctttttctgttttcctcgccatatttcacatcctaaagtgtgtatttctcattttccgtgattttcagttttcttgccatattccaggtcctacagtgtgcatttctcatttttcacgtttttcagtgatttcgtcatttttcaagtcgtcaagtggatgtttctcattttccatgattttcagttttctcgccatattccaggtcctacagttgacatttctaaattttccacattttttaagtttcctcgcgatatttcacatcctaaagtgtgtatttctcattttccgtgattttcagttttcttgccatattccaggtcctacagggtgcatttctcatttttcacgtttttcagtgatttcatcaatttcaagtcgtcaactgtatgtttctcattttcaatgattttcatttttcttgccatattccacgtcctatagtggacatttctaaattttccacctttttcagttttcttcgccatatttcacgtcccaaagtgtgtatttctcattttccgtgattttcagtttcctcgcaatattccaggtcctacagtgtgcatttctcatttttcacgtttttcagtgatttcgtcttttttcaagtcgtcaagtggatgtttctcattttccatgattttcagttttcttgccatattccatgtcctacagtggacatttctaaattttccacctttttctgttttcctcgccatatttcacgtcctaaagtgtgtatttctcattttccgtgattttcagttttcttgccatattccaggtcctacagtgtgcatttctcatttttcacgtttttcactgattttgtcattgttcaagttgtcaactgcatgtttctcattttccatgattttcaattttcttgccatattccatgtcctacagtggaaatttctatattttccaactttttcagttttcctcgccatatttcacgtgctaaagtgtgtatttctcatttttcgtgtttttcaggtttctcgccatattccaggtcctacagtgtgcatttctcatttttcacgtttttcagtgattttgtcatttttcaagttgtcaagtggttgtttctcattttccttgattttcagttttcttgccatattccatgtcctactgtggacatttctaaattttccacctttttcagttttccttgccatatttcatgtcctaaagtgtgtatttctcattttcagtgattttcagttttctcgcaatattccaggtcctacagtgtgcatttctcattttccgtgattttcagttttctcgccatatgccaggtcatacagggtgcatttctcatttttcacgtttttcagtgatttcgtcatttttcacgtcgtcaagtggatgtttctcattttcaatgattttcatttttcttgccatattccacgtcctatagtggacatttctaaattttccaactttttcagttttcttgccatatttcaggtcctacagtgtgcatttctcatttttcacgtttttcagtgatttcgtcatttttcaagtggtcaagtgcatgtttctgattttccgtgattttcagttttcttgccatgttccaggtcctacagttgacgtttctaaaatttcactttttttaagttttcctcgccatatttcacttcctaaagtgtgtatttctcattttccgtgattttcagttttctcgccagattccaggtcctacagtgtgcatttttcatatttcacctttttcagtgattttgtcatttttcaagttgtcaactgcatgtttctcattttccatgattttcagttttcttgccatattccatgtcctactgtggacatttctaaattttccaactttttcagttttcctcgccatatttcatgtcctaaagtgtgtatttctcattttcagtgtttttctgttttctcgccatattccaggtcctacagtgtgcatttctaatttttcacgtttttcagtgatttcgtcatttttcaagttgtcaagtggatgtttctcattttccatgattttcagttttcttgccatattccatgtcctacagtggacatttctaaattttccaactttttccattttcctcaccatatttcacgtcctaaagtgtgtttttctcattttttgtgattttcagttttctcgacatattccaggtcctacagtgtgcatttctaattttttcttttttcagtgatttcgtcatttttcaagtggtcaagtgcatgtttctcattttccatgattttcagttttcttgccatattccatgtcctacaatggacatttctaaattttccaactttttcagttttcctcgccatatttcacgtcctaaagtgtgtatttctcattttccgtgattttcagttttctcgccatattccaggtcctatgtgtacatttctcatttttcacgtttttcagtgattttgtcatttttcaagttgtgaagtggatgtttctcatttttcttgattttcatttttcttgccatattccatgtcctagagtggaaatttttaaattttccaactttttcagttttcctcgccatatttcacgtcctaaagtgtgtatttctcattttccgtgattttcagttttctcgccatattccaagtcctacagtgtgcatttctcatttttcacgtttttcagtgatttcgtcatttttcaagttgtcaagtggatgtttctcattttccatgattttcagctttcttgccatattcaaagtcctacagtggacatttctaaattttcgacctttatcagttttcctcgccatatttcatgtcccaaagtgtgtacttctcattttccgtgattttcagtttcctcgccatattctaggtcctacagtgtgcatttctcatttttcaggtttttcagtgatttcgtcttttttcaagtcgtcaagtggatgtttctcattttccatgattttcagttttcttgccatattccatgtcctacagtggacatttctaaattttccacctttttcagttttcctcgccatatttcatgtcctaaagtgtgtatttctcattttcagtgattttcagttttctcgccatattccaggtcctacagtgtgcatttctcatttttcacgtttttcagtgatttcgtcatttttcaagttgtcaagtggatgtttctcattttccatgattttcagttttcttgccatattccatgtcccacagtggacatttctaaattttccacctttttctgttttccttgccatatttcatgtcctaaagtgtgtatttctcattttccgtgattttcagttttcttgctatattccaagtcctacagtgtgcatttctcatttttcacgtttttaagtgattttgtcatttttcaatttgtcaactgcatgtttctcattttccatgattttcagttttcttgccatattccatgtcctacagtggaaatttctatattttccaactttttcagttttcctcgccatatttcacgtgctaaagtgtgtatttctcatttttcgtgtttttcaggtttctcgccatattccaggtcctacagtgtgcatttctcatttttcacgtttttcagtgattttgtcatttttcaagttgtcaagtggatgtttctcattttccttgattttcagttttcttgccatattccatgtcctacagtggacatttctaaattttccacctttttcagttttccttgccatatttcatgtcctaaagtgtgtatttctcattttcagtgattttcagttttctcgccatattccaggtcctacagtgtgcatttctcattttttcaggtttttcagtgatttcgtcatttttcacgttgtcaagtggatgtttctcattttccatgattttcacttttcttgccatatttcatgtcctaaagtgtgtatttctcattttcagtgattttcagttttctcgccatattccaggtcctacagtgtgcatttctcattttttcacgtttttcagtgatttcgtcatttttcacgttgtcaagtggatgtttctcattttccatgattttcacttttcttgccatatttcatgtcctacagtggacatttctaaattttccacctttttctgttttcctcgccatatttcacatcctaaagtgtgtatttctcattttccgtgattttcagttttcttgccatatttcaggtcctacagtgtgcatttctcatttttcacgtttttcagtgatttcgtcatttttcaagtcgtcaagaggatgtttctcattttccatgattttcagttttctcgccatattccaggtcctacagttgacatttctaaattttccacattttttaagtttcctcgcgatatttcacatcctaaagtgtgtatttctcattttccgtgattttcagttttcttgccatattccaggtcctacagggtgcatttctcatttttcacgtttttcagtgatttcatcaatttcaagtcgtcaactgtatgtttctcattttcaatgattttcatttttcttgccatattccacgtcctatagtggacatttctaaattttccacctttttctgttttcctcgccatatttcacgtcctaaagtgtgtatttctcattttccgtgattttcagttttcttgccatattccaggtcctacagtgtgcatttctcatttttcacgtttttcactgattttgtcattgttcaagttgtcaactgcatgtttctcattttccatgattttcagttttcttgccatattccatgtcctacagtggaaatttctatattttccacctttttcagttttcctcgccgtatttcatgtgctaaagtgtgtatttctcatttttcgtgtttttcaggtttctcgccatattccaggtcctacagtgtgcatttctcatttttcacgtttttcagtgattttgtcatttttcaagttgtcaactggatgtttctcattttccttgattttcagttttcttgccatattccatgtcctactgtggacatttctaaattttccacctttttcagttttccttgccatatttcatgtcctaaagtgtgtatttctcattttcagtgattttcagttttctcgcaatattccaggtcctacagtgtgcatttctcattttttcaggtttttcagtgatttcgtcatttttcacgttgtcaagtggatgtttctcattttccatgattttcacttttcttgccatatttcatgtcctaaagtgtgtatttctcattttcagtgattttcagttttctcgccatattccaggtcctacattgtgcatttctcattttttcacgtttttcagtgatttcgtcatttttcacgttgtcaagtggatgtttctcattttccatgattttcacttttcttgccatatttcatgttttacagtggacatttctaaattttccacctttttctgttttcctcgccatatttcacatcctaaagtgtgaatttctcattttccgtgattttcagttttcttgccatattccaggtcctacagtgtgcatttctcatttttcacgtttttcagtgatttcatcatttttcaagtcgtcaagtggatgtttctcattttccatgattttcagttttcttgccatattccatgtcctacagtggacatttctaaattttccacctttttctgttttcctcgccatatttcacgtcctaaagtgtgtatttctcattttccgtgattttcagttttcttgccatattccaggtcctacagtgtgcatttctcatttttcacgtttttcactgattttgtcatttttcaagttgtcaactgcatgtttctcattttccatgattttcagttttcttgctatattccatgtcctacagtggaaatttctaaattttccacctttttcagttttcctcgccatatttcacgtcctgaagtgtgtatttctcattttccgtgattttcagttttctcgccatattccaggtcctatgtgtacatttctcatttttcacgtttttcagtgattttgtcatttttcaagttgtgaagtggatgtttctcatttttcttgattttcatttttcttgccatattccatgtcctacagtggaaatttctaaattttccacctttttcagttttcctcgccatatttcacgtcctaaagtgtgtatttctcattttccgtgattttcagttttctcgccatattccaggtcctacagtgtgcatttctcatttttcacgtttttcagtgatttcgacatttttcaagttgtcaagtggatgtttctcattttccatgattttcagctttcttgccatattcaaagtcctacagtggacatttctaaattttcgacctttatcagttttcctcgccatatttcatgtcccaaagtgtgtacttctcattttccgtgattttcagtttcctcgccatattccaggtcctacagtgtgcatttctcatttttcacgtttttcagtgatttcgtcatttttcaagtcgtcaagtggatgtttctcattttccatgattttcagttttcttgccatattccatgtcctacagtggacatttctaaattttccacctttttctgttttcctcgccatatttcacgtcctaaagtgtgtatttctcattttccgtgattttcagttttcttgccatattccaggtcctacagtgtgcatttctcatttatcacgtttttcactgattttgtcatttttcaagttgtcaactgcatgtttctcattttccatgattttcagttttcttgctatattccatgtcctacagtggaatattctaaattttccacctttttcagttttcctcgccatatttcacgtcctgaagtgtgtatttctcattttccgtgattttcagttttctcgccatattccaggtcctatgtgtacatttctcatttttcacgtttttcagtgattttgtcatttttcaagttgtgaagtggatgtttctcatttttcttgattttcatttttcttgccatattccatgtcctacagtggaaatttctaaattttccacctttttcagttttcctcgccatatttcacgtcctaaagtgtgaatttctcattttccgtgattttcagttttctcgccatattccaggtcctacagtgtgcatttctcatttttcacgtttttcagtgatttcgacatttttcaagttgtcaagtggatgtttctcattttccatgattttcagctttcttgccatattcaaagtcctacagtggacatttctaaattttcgacctttatcagttttcctcgccatatttcatgtcccaaagtgtgtacttctcattttccgtgattttgagtttcctcgccatattccaggtcctacagtgtgcatttctcatttttcacgtttttcagtgatttcgtcttttttcaagttgtcaactgcatgtttctcattttccatgattttcagttttcttgccatattccatgtcctacagtggaaatttgtaaatttccacctttttcagttttcctcgccatatttcacgtcctaaagtatgtatttctcattttccgtgattttcagttttctcgccatattccaggtcctacagtgtgcatttctcatttttcacgtttttcagtgattttgtcattttttaagttttcaagtggatgtttctcattttccttgattttcagttttcttgccatattccatgtcctacagtggacatttctaaattttccacctttttcagttttcctcgccatatttcatgtcctaaagtgtgtatttctcattttcagtgattttcagttttctcgccatattccaggtcctacagtgtgcatttctcatttttcacgtttttcagtgatttcgtcatttttcaaggtgtcaagtggatgtttctcattttccatgattttcagttttcttgccatattccatgtcctacagtggacatttctaaattttccacctttttctgttttcctcgccatatttcatgtcctaaagtgtgtatttctcattttccgtgattttcagttttcttgctatattccaagtcctacagtgtgcatttctcatttttcacgtttttcagtgattttgtcatttttcaatttgtcaactgcatgtttctcattttccatgattttcagtttttttgccatattccatgtcctactgtggaaatttctatattttccacctttttcagttttcctcgccatatttcacgtgctaaagtgtgtatttctcatttttcgtgtttttcaggtttctcgccatattccaggtcctacagtgtgcatttctcatttttcacgtttttcagtgattttgtcatttttcaagttttcaagtggatgtttctcattttccttgattttcagttttcttgccatattccatgtcctacagtggacatttctaaattttccacctttttcagttttccttgccatatttcatgtcctaaagtgtgtatttctcattttcagtgattttcagtttccttgccatattccaggtcctacagtgtgcatttctcattttttcacgtttttcagtgatttcgtcatttttcacgttgtcaagtggatgtttctcattttccatgattttcacttttcttgccatatttcatgtcctacagtggacatttctaaattttccaactttttcaattttcctcgccatattttatgtcctaaagtgtgtatttctcatttttcgttattttcagttttcttgccatattccaggtcctacagtgtgcatttgtcatttttcacgtttttcagtgatttcgtcatttttcaagtcgtcaagtagatgtttctcatattccatgtttttcagttttctcgccatattccaggtcctacagttgacatttctaaattttctacatttttaaattttcctcgccatatttcacgtcctaaagtgtgtatttctcattttttgttattttcagttttctagccatattccaggtcctacaggatgcatttctcatttttcacgtttttcagtgatttcatcatttttcaagtcgtcaagtgtatgtttcttattttcaatgattttcatttttcttgccttattccacgtcctatagtggacatttctaaattttccacctttttcagtttttttcgccatatttcacgtcctaaagtgtgtatttctcattttctgtgattttcagttttctcaccatattccaggtcctacagtgtgcatttctcatttttcacgtttttcagtgatttcgtcatttttcaagttgtcaagtggaagtttctcattttccatgattttcagctttctagacatattccaggtcctacagtggacatttcctaattttcgacctttatcagttttcctcgtcatatttcacgtcccaaaatgtgtatttcttattttccatgattttcagtttcctcgccatattccaggtcctacagtgtgcaattctcatttttcacgtttttcagtgatttcgtcttttttcaagacgtcaagtggatgtttctcatttttcatgattttcagttttcttgccatattccatgtcctacagtggacatttctaaattttccacctttttctgttttcctcgccatatttcacgtcctaaagtgtgtatttctcattttccgtgattttcagttttcttgccatattcctggtcctacagtgtgcatttctcatttttcacgtttttcagtgattttgtcatttttcaatttgtcaactgcatgtttctcattttccattattttcagttttcttgccatattccatgtcctacagtggacatttctaaattttccacctttttctgttttcctcgccatatttcatgtcctaaagtgtgtatttctcattttccgtgattttcagttttcttgctatattccaagtcctacagtgtgcatttctcatttttcacgtttttcagtgattttgtcatttttcaatttgtcaactgcatgtttctcattttccatgattttcagtttttttgccatattccatgtcctacaggggaaatttctatattttccacctttttcagttttcctcgccatatttcatgtcctaaagtgtgtatttctcattttccgtgattttcagttttcttgccatattccaggtcctacagtgtgcatttctcatttttcacgtttttcagtgatttcgtcatttttcaagtcttcaagtagatgtttctcatattccatgtttttcagttttctcgccatattccaggtcctacagttgacatttctaaattttctacatttttaaattttcctcgccatatttcacgtcctaaagtgtgtatttctcatttttcgttattttcagttttctagccatattccaggtcctacaggatgcatttctcatttttcacgtttttcagtgatttcatcatttttcaagtcgtcaagtgtatgtttctcattttcaatgattttcatttttcttgccttattccacgtcctatagtggacatttctaaattttccacctttttcagtttttctcgccatatttcacgtcctaaagtgtgtatttctcattttctgtgattttcagttttctcaccatattccaggtcctacagtgtgcatttctcatttttcacgtttttcagtgatttcgtcatttttcaagttgtcaagtggaagtttctcattttccatgattttcagctttctagccatattccaggtcctacagtggacatttcctaattttcgacctttatcagttttcctcgccatatttcacgtcctaaagtgtgtatttctcattttccgtgattttcagttttcttgccatattccaggtcctacagtgtgcatttctcatttttcacgtttttcagtgattttgtcatttttcaatttgtcaactgcatgtttctcattttccatgatttttagttttcttgctatattccatgtcctacagtggaaatttctaaattttccacctttttcagttttcctcgccatatttcacgtcctaaagtgtgtatttctcattttccgtgattttcagttttcttgctatattccaagtcctacattgtgcatttctcatttttcacgtttttcagtgattttgtcatttttcaatttgtcaaaccacatgtttctcattttccatgattttcagtttttttgccatattccatgtcctacagtggaaatttctatattttccacctttttcagttttcctcgccatatttcacgtgctaaagtgtgtatttctcatttttcgtgtttttcaggtttctcgccatattccaggtcctacagtgtgcatttctcatttttcacgtttttcagtgattttgtcatttttcaagttgtcaagtggatgtttcccattttccttgattttcagttttcttaccatattccatgtcctacagtggacatttctaaattttccacctttttcagttttccttgccatatttcatgtcctaaagtgtgtatttctcattttcagtgattttcagtttcctcgccatattccaggtcctacagtgtgcatttctcattttttcacgtttttcagtgatttcgtcatttttcacgttgtcaagtggatgtttctcattttccatgattttcacttttcttgccatatttcatgtcctatagtggacatttctaaattttccacctttttcagtttttctcgccatatttcacgtcctaaagtgtgtatttctcattttctgtgattttcagttttctcaccatattccaggtcctacagtgtgcatttctcatttttcacgtttttcagtgatttcgtcatttttcaagtcgtcaagtagatgtttctcatattccatgtttttcagttttctcgccatattccaggtcctacagttgacatttctaaattttctacatttttaaattttcctcgccatatttcacgtcctaaagtgtgtatttctcatttttcgttattttcagttttctagccatattccaggtcctacaggatgcatttctcatttttcacgtttttcagtgatttcatcatttttcaagtcgtcaagtgtatgtttcttattttcaatgattttcatttttcttgccttattccacgtcctatagtggacatttctaaattttccaccttttttcagtttttctcgccatatttcacgtcctaaagtgtgtatttctcattttctgtgattatcagttttctcaccatattccaggtcctacagtgtgcatttctcatttttcacgtttttcagtgatttcgtcatttttcaagttgtcaagtggaagtttctcattttccatgattttcagctttctagccatattccaggtcctacagtggacatttcctaattttcgacctttatcagttttcctcgccatatttcacgtcccaaaatgtgtatttcttattttccatgattttcagtttcctcgccatattccaggtcctacagtgtgcatttctcatttttcacgtttttcagtgatttcgtcttttttcaagacgtcaagtggatgtttctcatttttcatgattttcagttttcttgccatattccatgtcctacagtggacatttctaaattttccacctttttctgttttcctcgccatatttcacgtcctaaagtgtgtatttctcattttccgtgattttcagttttcttgccatattcctggtcctacagtgtgcatttctcatttttcacgtttttcagtgattttgtcatttttcaatttgtcaactgcatgtttctcattttccatgattttcagttttcttgccatattccatgtcctacagtggacatttctaaattttccacctttttcagttttcctcgccatatttcacgtgctaaagtgtgtatttctcatttttcgtgtttttcaggtttctcgccatattccaggtcctacagtgtgcatttctcatttttcacgtttttcagtgattttgtcatttttcaagttgtcaagtggatgtttctcattttccttgattttcacttttcttgccatattccaagtcttacaggggcatttctcatttttcacgttttcagtgattttgtcattttcaatttgtcaactgcatgtttctcattttccatgattttcagtttttttgccatattccatgtcctacaggggaaatttctatattttccacctttttcagttttcctcgccatatttcatgtcctaaagtgtgtatttctcattttccgtgattttcagttttcttgccatattccaggtcctacagtgtgcatttctcatttttcacgtttttcagtgatttcgtcatttttcaagtcttcaagtagatgtttctcatattccatgtttttcagttttctcgccatattccaggtcctacagttgacatttctaaattttctacatttttaaattttcctcgccatatttcacgtcctaaagtgtgtatttctcatttttcgttattttcagttttctagccatattccaggtcctacaggatgcatttctcatttttcacgtttttcagtgatttcatcatttttcaagtcgtcaagtgtatgtttctcattttcaatgattttcatttttcttgccttattccacgtcctatagtggacatttctaaattttccacctttttcagtttttctcgccatatttcacgtcctaaagtgtgtatttctcattttctgtgattttcagttttctcaccatattccaggtcctacagtgtgcatttctcatttttcacgtttttcagtgatttcgtcatttttcaagttgtcaagtggaagtttctcattttccatgattttcagctttctagccatattccaagtcctacagtggacatttcctaattttcgacctttatcagttttcctcgccatatttcacgtcccaaaatgtgtattccttattttccatgattttcagtttcctcgccatattccaggtcctacagtgtgcatttatcatttttcacgtttttcagtgatttcgtcttttttcaagacgtcaagtggatgtttctcatttttcatgattttcagttttcttgccatattccatgtcctacagtggacatttctaaattttccacctttttctgttttcctcgccatatttcacgtcctaaagtgtgtatttctcattttccgtgattttcagttttcttgccatattcctggtcctacagtgtgcatttctcatttttcacgtttttcagtgattttgtcatttttcaagttgtcaagtggatgtttctcattttccttgattttcacttttcttgccatattccatgtcctacagtggacatttctatattttccacctttttccgttttccttgccatatttcacgtcctaaagtgtgtatttctcattttccgtgattttcaggtttctcgccatattccaggtcctacagtgtgcatttctcatttttcacgtttttcagtgattttgtcatttttcaagttgtcaagtggatgtttctcattttccttgattttcacttttcttgccatattccatgtcctacagtggacatttctaaattttccacctttttcagttttcctcgccatatttcatgtcctaaagtgtgtatttctcattttcagtgattttcagttttcttgccatattccaggtcctacagtgtgcatttctcatttttcacgtttttcagtgattttgtcatttttcaagttgtcaactgcatgtttctcattttctatgattttcagttttcttgctatattccatgtcctacagtggaaatttctaaattttccacctttttcagttttcctcgccatatttcacgtcctaaagtgtgtatttctcattttccgtgattttcagttttctcgccatattccaggtcctatgtgtacatttctcatttttcacgtttttcagtgattttgtcatttttcaagttgtgaagtggatgtttctcatttttcttgattttcatttttcttgccatattccatgtcctagagtggaaatttttaaattttccacctttttcagttttcctcgccatatttcacgtcctaaagtgtgaatttctcattttccgtgattttcagatttctcgccatattccaagtcctacagtgtgcatttctcatttttcacgtttttcagtgatttcgtcatttttcaagttgtcaagtggatgtttctcattttccatgattttcagctttcttgccatattcaaagtcctacagtggacatttctaaattttcgacctttatcagttttcctcgccatatttcatgtcccaaagtgtgtacttctcattttccgtgattttcagtttcctcgccatattctaggtcctacagtgtgcatttctcatttttcaggtttttcagtgatttcgtcttttttcaagtcgtcaagtggatgtttctcattttccatgattttcacttttcttgccatatttcatgtcctaaagtgtgtatttctcattttcagtgattttcagttttctcgctatattccaggtcctacagtgtgcatttctcattttttcacgtttttcagtgatttcgtcatttttcacgttgtcaagtggatgtttctcattttccatgattttcacttttcttgccatatttcatgtcctacagtggacatttctaaattttccacctttttctgttttcctcgccatatttcacatcctaaagtgtgtatttctcattttccgtgattttcagttttcttgccatattccaggtcctacagtgtgcatttctcatttttcacgtttttcagtgatttcgtcatttttcaagttgtcaagtggatgtttctcattttccttgattttcagttttcttgccatattccatgtcctactgtggacatttctaaattttccacctttttcagttttccttgccatatttcatgtcctaaagtgtgtatttctcattttcagtgattttcagttttctcgcaatattccaggtcctacagtgtgcatttctcattttttcaggtttttcagtgatttcgtcatttttcacgttgtcaagtggatgtttctcattttccatgattttcacttttcttgccatatttcatgtcctaaagtgtgtatttctcattttcagtgattttcagttttcctcgccatatttcacgtcccaaaatgtgtatttcttattttccatgattttcagtttcctcgccatattccaggtcctacagtgtgcatttctcatttttcacgtttttcagtgatttcgtcttttttcaagacgtcaagtggatgtttctcatttttcatgattttcagttttcttgccatattccatgtcctacagtggacatttctaaattttccacctttttctgttttcctcgccatatttcacgtcctaaagtgtgtatttctcattttccgtgattttcagttttcttgccatattcctggtcctacagtgtgcatttctcatttttcacgtttttcagtgattttgtcatttttcaatttgtcaactgcatgtttctcattttccatgattttcagttttcttgccatattccatgtcctacagtggacatttctaaattttccacctttttcagttttcctcgccatatttcacgtgctaaagtgtgtatttctcatttttcgtgtttttcaggtttctcgccatattccaggtcctacagtgtgcatttctcatttttcacgtttttcagtgattttgtcatttttcaagttgtcaagtggatgtttctcattttccttgattttcacttttcttgccatattccatgtcctacagtggacatttctaaattttccacctttttcagttttcctcgccatatttcatgtcctaaagtgtgtatttctcattttcagtgattttcagttttctcgccatattccaggtcctacagtgtgcatttctcatttttcacgtttttcagtgatttcgtcttttttcaagacgtcaagtggatgtttctcattttccatgattttcagttttcttgccatattccatgtcctacagtggacatttctaaattttccacctttttctgttttcctcgccatatttcacgtcctaaagtgtgtatttctcattttccgtgattttcagttttcttgccatattccaggtcctacagtgtgcatttctcatttttcacgtttttcagtgattttgtcatttttcaatttgtcaactgcatgtttctcattttccatgatttttagttttcttgctatattccatgtcctacagtggaaatttctaaattttccacctttttcagttttcctcgccatatttcacgtcctaaagtgtgtatttctcattttccgtgattttcagttttcttgctatattccaagtcctacattgtgcatttctcatttttcacgtttttcagtgattttgtcatttttcaatttgtcaaaccacatgtttctcattttccatgattttcagtttttttgccatattccatgtcctacagtggaaatttctatattttccacctttttcagttttcctcgccatatttcacgtgctaaagtgtgtatttctcatttttcgtgtttttcaggtttctcgccatattccaggtcctacagtgtgcatttctcatttttcacgtttttctgtgattttgtcatttttcaagttgtcaagtggatgtttctcattttccttgattttcagttttcttaccatattccatgtcctacagtggacatttctaaattttccaccttttctgttttcctcgccatatttcatgtcctaaagtgtgtatttctcattttccgtgattttcatttttcttgctatattccaagtcctacagtgtgcatttctcattttccatgattttcagttttcttgctatattccatgtcctacagtggaaatttctaaattttccacctttttcagttttcctcgccatatttcacgtcctaaagtgtgtatttctcattttccgtgattttcagttttttcgccatattacaggtcctatgtgtacatttctcatttttcacgtttttcagtgattttgtcatttttcaagttgtcaagtggatgtttctcatttttcttgattttcatttttcttgccatattccatgtcctacagtggaaatttctaaattttccacctttttcagttttcctcgccatatttcacgtcctaaagtgtgaatttctcattttccgtgattttcagttttctcgccatattccaggtctacagtgtgcatttctcatttttcacgttttcagtgattcgtcatttttcaagttgacaagtggatgtttctcattttccatgattttcagctttcttgccatattcaaagtcctacagtggacatttctaaattttcgacctttatcagttttcctcgccatatttcatgtcccaaagtgtgtacttctcattttccgtgattttcagttttcttgccatattccaagtcctacagtgtgcatttctcatttttcacgtttttcagtgattttgtcatttttcaatttgtcaactgcatgtttctcattttccatgattttcagttttcttgccatattccatgtcctacagtggaaatttctatattttccacctttttcagttttcctcgccatatttcacgtgctaaagtgtgtatttctcatttttcgtgtttttcaggtttctcgccatattccaggtcctacagtgtgcatttctcatttttcacgtttttcagtgattttgtcatttttcaagttgtcaagtggatgtttctcattttcaatgattttcatttttcttgccttattccacgtcctatagtggacatttctaaattttccacctttttcagtttttctcgccatatttcacgtcccaaaatgtgtattccttattttccatgattttcagtttcctcgccatattccaggtcctacagtgtgcatttctcatttttcacgtttttcagtgatttcgtcttttttcaagacgtcaagtggatgtttctcatttttcatgattttcagttttcttgccatattccctgtcctacagtggacatttctaaattttccacctttttctgttttcctcgccatatttcacgtcctaaagtgtgtatttctcattttccgtgattttcagttttctcgccagattccaggtcctacagtgtgcatttctcatttttcacgtttttcagtgattttgtcatttttcaatttgtcaactgcatgtttctctctttccatgattttcagttttcttgccatattccatgtcctacagtggacatttctaaattttccacctttttcagttttcctcgccatatttcacgtgctaaagtgtgtatttctcatttttcgtgtttttcaggtttctcgccatattccaggtcctacagtgtgcatttctcatttttcacgtttttcagtgattttgtcatttttcaagttgtcaagtggatgtttctcattttcaatgattttcatttttcttaccttattccacgtcctatagtggacatttctaaattttccacctttttcagtttttctcgccatatttcacgtcccaaaatgtgtattccttattttccatgattttcagtttcctcgccatattccaggtcctacagtgtgcatttctcatttttcacgtttttcagtgatttcgtcttttttcaagacgtcaagtggatgtttctcatttttcatgattttcagttttcttgccatattccctgtcctacagtggacatttctaaattttccacctttttctgttttcctcgccatatttcacgtcctaaagtgtgtatttctcattttccgtgattttcagttttctcgccagattccaggtcctacagtgtgcatttctcatttttcacgtttttcagtgatttcgtcatttttcaagtcttcaagtgtatgtttctcattttcaatgattttcatttttcttgccttattccacgtcctatagtggacatttctaaattttccacctttttcagtttttctcgccatatttcacgtcctaaagtgtgtatttctcattttctgtgattttcagttttcttaccatattccaggtcctacagtgtgcatttctcatttttcacgtttttcagtgatttcgtcatttttcaagttgtcaagtggaagtttctcattttccatgattttcagctttct

SEQ ID NO: 171 - DNA, 8404 bp, Mus musculus
gccagttctggctgggtcaccttagagagaggctgccttcccttctgctgctggggctcatctgtgtgaagtctggggctgactctcaccacaggaaagactgccagggcaaatgagcacctgttattgctcttcagccccactccacccctgggcccccttagggggacctttcctacactccccacccccaatcctgacagctggagataggatcaatcctgaattgtctccgaaaaaagccagtttctgccagacccgccttgctcccagtgccacacacccagccctgaaggtaaggaagagcccccccccccacccccattcaactaggggattgtggccaagaaggggtgaagggtcatctacctgggatctttggtctcatggtctcatgcctactccaaaccatgggatgtggacatctagaaaggttagaaggtttaatgggttgaggagcacaggcgtgaggacaggaaaggggacctgtaaggaagattagagtctagcccaccagtgataagcacaccccagcacttctgcactgggaacgcggcctcagaacacccaggtggaggtgaggttgatttctcacccagggctgcgggtggaggtagggatgagctcaggggccccgggcatatctttggggggtggggtgggggtggggctccgcctcctaggcctgcaggccagcgctcaactcccagccctgaatccgcgggatgtacaacccctgctcggattcgtgctcccaaggcacgcactggcccgcgctgcacctgcacacacacccaaacgcacactaatgtgcgctcgcacacgcctccctccgcgcagcgcctcctacctgccgcgtcgccgcagctggagctggactcccgggatgcagagcacagtgcgggcactggagcggaggctagaccagcccgcgccacagcctgggactctgcggggagatgataccccggcagcccgcaggcgggggttggaacttggacccccgggcttcagtctgtcccgcccctcctctcagcctcctcccattggaggccagaggcgtggtctcccggggtggggcggggcggggaaagggaggttgttgcgcatgcgaactagagaggctgtgcctccccccccccacccccctccctgaggccgcccgatagtgctggctcgaaactgaaagggtggccctgacccaacactccttcaaaccccactccagtgctgtccgcgataggagagcatcccgggacgttggctgcctacctcgccattggccttggaggacctgcgtgccccactaagtgctggcagagaatgttggccgacttggggtatgcatcttagccgggctcagacagggccaaggcagggcagctgagaatgggaagacccaatgagatgagaaccactccctttccatttgtatccaaacacccattcccaagattttagctggagaagaggaatgtaggccctggtgaggtgtccagagggccccagtcagttaagggaagctggccctatcctgtccagacctgtcctgtcctgggcatttatctgctctgagtgtagactaaagcagcagggcccagatttttgaccctctctgactgccttcagaatgccctggaatacaccaagccttggtttcttactctgtgaagtggaaactgcaatctcctcaggccaggcggtttgggggaatcccagggagatttatagatgaccagggctggccaacagtaggctgggtcactctaaggccacagagacaaagcttgtctgacctggtcatactagtcgctcacaggtcagaaactcaggcccactcatccctctagtttcctggtctctgttaatgattacctcaacctcagtcatccggccctctacctcacccctgtccctggccacctaagtgtagctccatctggttacctgactgaccaaatagtttccaaccatgttgctgttccccctacccaccaccacccacgcacaatgttccaagactactaggttccgctctccatttaccctagtcctggcctatggccgccggcctagggtttttacattctttccatccccacagaaaagctcttctattgcctccacacagcctcagcgtgtctctgtccagaagcccttggtccacaaagcagatctggatcaagggctcactccaccagttaccgagaaagttctatatcctttaatggtctcagtttccttgtctgtaaaatgggctttctaggagaagcacatggtgattgtggagacaaaaaatgtcaaaaaggttcagtcaaagtcctcaagcaaggtagcaagtagcattacctctgtcagggcacctctcaaatcttccgagatagagcaggggtcatgtctgggaaagtgtgttcttcagcccacaaagccatggtatccagagaatgctctgactctcttctatagctctgagtatggagccaggagagggtactatgtgttggtttcattcgtgggctctgccttgactccttagctgtgtggccttggacatgagacctgtactgcagaactcaaagcagcacccacactgcagtcgtggggtctcattggcttaactcctgggaagtccttatggggccctctagctgttactgtcctctagcccagcctgctcattgtataaagatacagtgtctccagcagcagagacacataccctgcatcatgatgtttaggcccaggtgccttagaaccgggcttggactgggaggcctgtctcagagcccatctctggcagcgtccaccttcctgacagatgagggaagaaacctagagagacagcgacctgtcgagggcatctggacttgatggaggagcagaggctctgatccttggggagcagaagatcaaggcatgccaggaagagctgggctgcctacctaacaaggctttctggggggcggatgatgcatctttgccaatgtgttggcctcaggaccctgccaattggtttttataagcttagtcatctaatggtgccattaacgagcctgatggctaggtgtttttccattaaattctcacagttattagccccacttagtcaatggcagacctgaacctcagggagatgccccaggtcacaaaattagtaaacagcagaaccgggatccagacctaccgaactatgctggttctatctattttgtgttgggcctctccttctcctctcctggctttcaggaaaaggacatcactgtaggccccttgatctacttaaagtcccttgtaactggggactcattccttccagggatagccccatcccttctactggtcagaatcagaacccgttctacctagctctgcagagctctatgcctctcaccaatgcccagaatcagaatcttctctgctcaggtcagtaacaccatcattactgttcctgagtaatagtgttacagagtttcccaggtgaaattcataatgatcgggttttcttttttttttttaaaggtttatttatttatttattacatgtaagtacactgtagctgtcttcagaccctccagaagagggagtcagatctcattacggatggttgtgagccaccatgtggttgctgggatttgaacttcggaccttcggaagagcagtcgggtgctcttacccactgagccatctcaccagcccccatgatcgggttttcttccttccttccttccttccttccttccttccttccttccttccttccttccctccttccttccttccttccttcctttattttcttcctcttcttctcctcctcctccttttccttctcttcctccttccttccttcctttcctcctactccttctctccctcctcctcctcttcttctttaatcattttggctggccatggactcccaagttcaaatgtttcctccatctcagcctactaaatgctggaactataggtgttgctgtgtctgaatgtgaactgtgcccacgtaggctcatgtgtttaaacaggtggtgtccatcagatggtgctgttttggaaggttgtagaactttcaggaggtgaagcctcaaaggaggaagtaagtcatttaaggaaggccttgagattttacaaccccacccctgtccactctgtgcttcttaactgtggactcagtgtggctaggaaccttgtgtgtcctttctcaatctataagtcaaaacctcccttttctaaatagcaactgtcatagcaatgataaaagtcactaatacagaaaattggtatcatgaatggggtttttgttataataaacctgagcaagtcatttggaattgctttgcaagaggaatgtgggagaacttggggctatggactatagaaccttcttctagaaaggtgtagacagagctcaaagggacattgtgagggagtctagaggatgagaacgccaagggtaatgcataccacaggactaagttgttcaatagggcaacttccaagacaggatctaatagtaaccaggctctgtcatggctgctgctcactgctcttgtcaggcctacagtgagaggaggaacagaggagcagagagatatgaaaatgtgtagtttggtggtgggaaggagggagcttaaagttgcaggcaagaccagtgcaagagcagttgttattgaaaggagtatccccatcaaagagagaatctagtactgtgccttgggatgatttaaaaagaagattctcagaaggcaagaccttgcccatcagaagagccatcctatggaaatgcaaattcctttccaaagagagaacctgagctgagaacgttggagaaggggtttttagtttgcttccttgttgctccgataaaaaccaaagccaaaggcagcttggagggtatagtagctattcctggttatcaacttgactatatttggaatgaactacaaccagaattggaaggctcaccagtgacccttatctggaggcttggagatagaagtttctgatctggatcttggtatggagatcttcaggcatagtggctatggattccagaagattaaatctccgagttcaaggtcatccaggattaagggtgtggtggaacacaccttcaatctggctacaccttctgctggagacaatataaggacattggaagacaggagtcttgctcttgctccttcgcctgcttgctgtgtgagactgagtgagtaactgctagatccttggacttccattcacagctactactgaaccattgttgggaattgggctgcagactgtaagtcatcaataaattcctttactatatagagactatccataagttctgtgactctagagaatcctgactaatacagaggggaaagggtttatttcgtcttatgctttcaggccgtaattcatcatggacggaagtcagagcaggaacctagtggtaggaactgaagcagagaccatagatgactgttgcttgccgacatgttccttgcttttactcagctgacttgcacaacacaggaccacctgcccagcgtactaccacctacagtggggtaggctctcctctatcaatttagcagtcaagaaacgccctacagagatacccacaggaaaatctgatggcattgcttcctcaatggatgttccgtcttcccaggtgtgccaaggggacaaccaattagtcatgataaagggcctctctgctaaaaacaacaaataaacaacagtctaagaatgtattttttcatattcagccaccaaaacatacagaacccactacagctttggtccagggggataaagctacatcctgagctgaaagcagaacttggcaatgttgttcgcctggtactagatgttcaggcatgggacaaagaatgaagggcatcatggaggtttaccctaagattccagaagatcctccccgacccctgggctcaggcaatgcatggcagttctgcaaggaggtcctaagtatcctcagcattaagctggaaacgtgaagtctaaattacaatggagagcgtaggatactggaggtgcccggacatggggcatccaccaaggaaagttgcaggcatgagatgaacgaagccaacccagaagagaggctatgtgtgttgcaggtagcagagctaaagaggcagcctacctaaattatttgaagcccagatgacttcatcacaagccccaaatactagacatagaatttcgggctttggtatctgccctgatggattttggttttgctttgatctgatctttctttgccatccttgattccttccatttggaatggaaattttactctatgccattgtatgttggaaatatgtgacttgtaccattattgttgttgttgatgatgttgttgttgttgtacagaggctcacagttaagggacaacctcaactctcagaaaagatgttgggactgttaaagactatgaggacttttgaagttggaataactacgttttacatcgtgagatggtcgtgagctttggggaaccagaagtagaatgctgtggtttaaatgtgaaacgtccctcactggtgcatgtgcctgaacactcggtcctcagctgatggcattattttggaaggctatagggccttctggaggtaaagccccactacaggaagtggatcactcagggtgggccttgaggtttgatagcctgacctcatttcctgtccactctccgcttcctgatactgtggctacaagatgaccagccactcatgttcctaccaccaccttccataatgcactatatctcttcttaaactataagccaacacaaacccttcctgcctaaagttgcttcttgccaggtatttggtagcagtaagaaacgtaataatggtgcgtcattgtacctgaactagtatcctttttttttttaaactcccagcaaccagcttgccaatctattattgaagagggtggaggagatgacttggtggactaagcacttgctaggcaagcatgaggacctcagttcgagtccccagaacccgtgtaaagccgggtgcaaccgtatgtaatggcgcactcttgcaccgagacggggagtggagacggggcatccccagatgcaagtccgtcaacccactgtataagtgacggacagtaaggggcactgtctcaaacaaggtggaagatgaggacagacatccaaggttagactgagatttccacacacaccacaacatggacgtgccccaatcatacaacatatatttacatatactaaaatacaacctgcagagagccccctcaacatgtggagtggtccaacacagcggctcttagtgcctggtttctttaggtgagacgacatgggagccatgttaaccggtcccacaaaacgattgcaagccagggatccagaatgcaagaagctggggtctggagagatggttcaacagctaagagcactggctgctcttccaaaggccctgggttcaattcccagcacacacatggcttttcacaactgtctgtaacttcagtttctgagaatctgacaccctttcacaaacacacatgtaggcaaaaacaccaatgcacatcaaataaaaatagattatataaaaaaagatcaaaatgttagaaacaaaacatcaacaacaaaaccaaactgatttaaaaataaattttaaaaaatgcaaggattgtccagttagaaattcaggacttacagttaggctgggtaaagtgatgcacgtctgtgacttcagtgtctcaggagattgaggcaggaagattgaaagaccagtcaggagatggagagacagctctgttactagagtgtttgttgtgtggtaatgagaacctcctatctgattcccatcaagaaagaaaacaaaccatgagcaatggcctgtgcctaaagttccacccctggggaagcagagactaactagcaaatccctggagttcaatggccaacagagcagaagaggggagcaccaggctcagagagcgaccctgcctcaggaaacagagtggtgagcaactgaggaatacagcaacttagatctctcccttctacgtgcacatgcacacgcatacacacgcatgcacatatgcatgcgcacgcacacagagttcacagtcagccacggtgacactgtctcagaaataagcaagcagcttctggtttggagcagctgctagtgccctgcacagagattgagaagtgaacttgtacttcacagagtcagatggcatgccaagccagcgcgggggacagaatgtccttaattctagcctttgcggaaacactgctcatattttgttactggacattagaagccagctgaggctggagatggggctcagtggagcagcacgtgcttggcatgcacaagtttggcttctagccctggg

SEQ ID NO: 172 - DNA, 13379 bp, Mus musculus
gttgttgcagctgccctagggagtggctaactcaccggtcctgctggctggggccctggggctgtggtggggcctggctgaggtttccccgctggttggctggcagcaggggctgtgccccgggtggttggctggctctgaggctgtagccgagcctgggatggagcctgctggggggcttgttgcccaagaccctgctgttgctgctgctgctgttgctgctgttgtgtctgtggctgacgtgatgctgtgcccgagggtgtctgcctggatgatggtggctgcgactgctgcggtcctggagccgcctgccgaccttgcatctgtggctgagcctgggtgtctgcctttggctgcagtgcagaaggcccagtgtgggcctgccgggagccctttttgctctcagaggcatggtggtatgctgacggagcccgggacgactgtgaataatcagcagagctggggtacccgggctgacccttcttctgcatggcaggggcagggctggcctgagggtgaggtcgggcctcgtggcgacccatgtcccgagcgtgcggtttggcagcccgccgtcctggctcctcaccagcgtggcggcctgagtgcctcccgtggtcactgtggtgccggtgttccttggctgaggtatgccggcctggaccaccctcatcatgaggccataggccctcctcagggggctcatcgtagtcatggtagctgtgcctggcagggcctcgcttctgggaggaggagactgtatggcccccatggtgcctgaaccggtcggagcgggcatctcggggcttatcaaaccagtctgtctcctcctggcccaggtgatacgcttcagagaccaaaaacagaacaccatcaacccctggctagccatagaaggagacctagctgaagccatgcaagggaaccagagtggacagacaccacagccacaagcaggtaggccacaaggtccccaccctccagcaaccaggaagcagggcacaggtagagcagccaaggactgcctgcagcagggcccactgatgagatgccaagacagaccctgctgggacatcttggggaccagggcaggcaggcagacccccaggtgcagagcattttcagcaatcatccccagctgccattaccttcgctgtcagaaaccacgcagtgggaatcatccaacatgtagccctcctcacgcttatacgcgtgggcccgcggtccgtccttgacatgttcctggacgtcaggcatggaatggctggagcagaactgtgggcaggtgtccccgggaggaagagcgccccctgcggggcggggccgccctaaggggctgacagggctctcctcttcagaggcctggctcctcatggggggccgtgcccggccatgggccatgctcagggatgagggcttggagcccgccttttgaagtcgctctgcagtgtcccgttcccgttcataccctttgcctcggctgctatagtcatggctggacagcttctccccactgtatgccgacgccattcgggaccggctgctgctaccgtacatgcgctcatcctcctctgccgcgtcgcggctggacaccccgtagtaccgctgctgttcgtacacgttcttcttgagcccataggtgatttcatcctggaactttctgccccgagaggtcagactgctgctgacggtgggcgggggataggaggccaggtcggattccacatccttggcctcctcgatgggtgagaacttggagatcttttgctccatgccttgcttccggtgcttgctgcgctttgaggagatggcagctggggccaggctcttagagggatgctttggccccatgggtcctggaccgtacttgtctgctcgagccccgtgtctatagtcactgtcaccgtaatagtgggtgcttggccggccgttgctctccatgctccggtgatgaccagatttcccacgggggtcatatgagtcctcctcagattcttcctcacctctgccatagcagcagggcagagtgggtccctcaaggacggctggttccccaggatccttcccgggacgcccactgactccacctggccccaaaggctccagccgctggctctccgaggcagtgggggtgctgtccttcgtcagttcgctgatgtcgtcgatcatcacatagtttcgaggaacattctgttccagactggtgtagtgggagtcagagggatacgtgggggctgggctctggctcacgctgcttcgatcactgccccgggggtgctcgggggctttaccctgctcatagctgccgctcacagctggaccactgtagccggtttcagggggcgctgaagacatggtgacagcagggctgccaatcacctcgtaattggtgggaactttctgctccagatcagccagtgaagtctgccgtggcttctggtgggcagcacgactgtcagcttgcactgggaaaggggcgctctgcgtggttggcatgggcgttggggctgcgtaatggcctgtggggtggaaagccggttggcttggcaggccaggctcagctggataaccagtcccaggagggtaggtaggtgctgggtatgtgctagggccagtgtaggtaggtgcctggtgggctggaaatccattttgagttggtccactactgcctgcagtgtactgtggggctgcaggtgggaaccggggctgttggaaggcagtggggccagagggagtggcaggcacagcagctgaggcagggtagtccacatactggccagcgggtgtggtgcaaccctggagccgcagctggttgagctcgctgtcagacaggtagtcacgatgctcaccaaggccacgtaaaggtgggtagtcacggccaccccggtctttggccaacgactccttgcgctgggtgatgcccagttccaggtacttgagcttggcgtcaatctccttctcctcctcgtccaactccgcctgcttcttgcgcagcttggtggactcatgctccaccagccgcaggtcccggtccagctcccggagcaggctggccttggtagcagggacggtggtgggccccgccaaccctcgctgcagcagactggctgcatacagctgtgagggcacctggccagccaggggaaggtgagcttcctctggaggggggctgggcagtgtccgcttcaccttgcggaccaggccgttgggtggcagcgccgacacctgagacagagggaagggtgggcagcactgagacccaaggtgtgggtgactttgctgaggcatggggtagaagaacccaggtctggaggttcttcaaggcaggagctgggatccacactgttgatgccctgctttgccaagcagccttggggtttaccctgcccaccctctggttttggcttctttgccatgaggggaaaggcctgtggtcagtttacagtcctttccaaagctttgggcaccaggaaggtggtgagggtcagactgttttgtgtgctgtgcacagtggctttggaaggccctgcacatctccaatggacttgcctgtcactgaggtgagggaagagggatctggctcgaagtctgagacctagcagcctgtgggggctgagggcagggcagtcaggggaaggaggaacagagtagaacacgcgagacccaccaggctcctttaagaacagtcacaggaaggggcacaggataactgtcagctattcacaggctctgagtctaagcttcctcctttattcctctccagagcagtatgctgctcagctgcctgcccacctcctcctctaaccgcactaccctctgccatacctaagccctgattgtggcccacccccagcccactgaatctctctgtagacaacctctcctttcttgctagacctctctctagcagcccagctacctgctcaaggttcccctgccctgctagccacaccgcctacttgctccagaggctctgcaattctgggaggcccatgcagatggagtgctcaccctgggttccctttatctccggggctgatcactacccacctccaccaccatcaggtctataaacccaccccaaaaatgggcaaacacccctcacccccagtacttctgactcctccctcctctcctcgggatctctcctttggcctatcagccaacactgcattctgggaactctgaaataccagtcttgttctgttttacctccaaaaaccttccagagacttcaggaaaagccaaccttcctcagccttgcactgaaagtggttagcattcccgcttcccagtctctaagtcttcccacagatggcaccatggccaggctgtgtcttgcggttctaatacatggctgtgtaatggaagccatagacaaggagcctgcactgcactaggggaacaggcaggttaggaagtagggttactgaagaaggtgggtgggacacaaggaagcaccaagagtatctacagccctcaaatgggtgggtctcaaatgctaggccacaggcttgagcctgctataggcagtgaagcccatctagagatgggaagtggagactaaataaggcttggagtggaaggtgcctagactggaggtgagaaatgaagaggcctgaaaggaggcgacagaaatagaccaggtccagacagtgaagggacagggctgtggagaggctgaggttcctggaagtgtctgggcagatggctgtggagccctacgtgtgtctgactttgtccaggctgggccatgagctctgtcagacgtccattggggaactttgttcctcaactccttcccccgggcctttggagccagaggtgactccattcccaccccaggagaaacccctccctctggggcccctcaagctagaaatagacccccatcccaccctggaccagcccctgtgcccatacctggctacctagtcccccctggtgctggtagagggagaatctctctttggcagactcctcggcggtggggctcaggggcttagggtcggacagagaccgctgcagggtcttcatggggcgaggcagagtctgctggcgaagggtgctgtcagctatgaattgcttctggggactcacatgagccttgttcagcctctcactggaagcaaacgaagtgtccaggagccggtgtggggacaggggcgacactggagagtagagcacttgtggagacttaggaggctggcggctcacaagctgcgacagggactccgggggcaggtgggcctggtaaccgatttccagaggatccggcttcttcttctcaaatctgcccagggctcctggggtgactatctggatgccaggtaggtaggggctgatggcagttggtcctatgagctgtggcccagccacaccctgagcctgtccatccggttctgtctggcaggccaggctctccccgcgcccagtcttttctggtgctgatatgtacctgacaatctccacctttgggtcggtggcagccgtgatgtggatggctggagagaccctgggcagctgctcgggctcggtctggacggagcagtcgctgatggtctgtatgcccacgctgctcatggccctcgcagtggcggcggccgtggtggatgaggaagcagtggcatcgtgcttgctgtcagagcctgagtctgagtgacgggaaagacgagacctgcggcggcggacgggttgctcccagtcggcattgtcctcatcatctgtctgcacactgcagtcagcactgcgccgcgtcctgcgcctgcgagtcacaaggtagcggccctcaccctcctcatcatctgtctgaacactgctgtctgcaattctcctgaccgtgctgggatcaggtcccgactctggctcacaggcatctctcaggcgtggcatggagtgacgtttcttgatgccactacggcctgcctcccactgctcctcggtttgcagtgacatgtctgaggcggagctggggaggcccctgtgcagcacaggctcacgaggttgcccgggcccttcagtccccgccacagcaatgaaggccgcgtgggtcagcggtggccagtactggccattctgggccagctcggtggcagccgggggaggccctcggctaggtgcctcacaggtggcaggaaagggggccttctgcctctgcttctgctcctccagctgcagctgcagctgctgctgcagttgctggatctgctctagttgcagtcgctgctgtgccagctgctcacgctgcagtgcaaactgagcctggcgctcttcctgctgctgctgcagcacatgctgcttgatggtctgcagctcctgcagctctcgctgcaccagcagctgctcctcctcacgatgcctctgcagctccaccctctcccgctccagctcctcctgcagccgcaactgccgcagcttttccaactctacccgttcccgctccagctgcagcagctgctcctgttgcttccgctgccggtcctcctgagacgcttcctccttctccgacgcaggccggctgaggaccccactgccactcccagcgacggcctctcctgctggcttctggccaggtggtggggccggggccgggcccggggcaggggccacgggggcttccttgatgacagcaggggcagttgtggaaaagggttcttcacgagcaacccctgctggtagctcaggccttggcggacctcctgcccccgaggccttggctgcagcaggcttccccaaatagacaggtccttcagcaggtggaacgctggaagcaatggggaatcttggtgcaggatagcggtatagccctgctggtccaagaggtacccgaggagcaatcatgggcacacgggtcaggctggtaaggggcacagctgtgactccaccagatacataaggcctgtacatgccaccacgcaccatgggccgcagtaccgaggcaggctgggtggtgatgggcagcgttgcagcaattggggtattgatagtcgaatagatcatgccatcggctgcgcgcactgttgctgtggacgggagtagctgtctgactgctgttgcttggcttgctgcaggcccatactgagcaaggtttccagggcttggctgcccttctgggtaggtggggttgccaaggaggccggatctaaggggagccagaccctgtggagcactgaggccaggcccatgctggggctgatactgcacaaggtcaggcccaccactcccgctgccatgccgcccaccgtactggtccatggagttgagggcagcacacatgcggctgatctctcgggctgtggtggcactgtactgggccaggctggcctcctggaagccaactgcatctccccgtgggccgtacctatgatctgaatagatgtttgacaccgagctatagcgccgcaggggaagtgggtgagacaaaaggtctgtggggtgacgcaggtccgtgaaggagccatactgtaagccctgccctaagtagcgtccatcagcaaagcctaagctgtacgagtgcttcagtgagctgaggtccactgccgagtccctcccaggtccctggaagagctgcccaagcctctgggcatggtagttgaggccagcttcggccaaattggtgtcagacatggaggagtatagccttccaggcaggccctgtgggtagggcctctgttcttcatggggcccaggtcctactaccccctgtgtgcggaaggtgaggggctcagggggctcagggtctctgggactgtagaaggggccactgctttggccaggcagggctgtatcggtcacactcttgtcgggtgcgctaggggcaggatggaaggtgccagtgcagctactgccaaaaggaaacttgtagaccatgtcacagcatgccagctggctctcgggcctcattccggtgaggtccagggcacctgccggctcttctgggagcagggtagtcactgtgccggctgtgccctctcccatctgtaccaccactgtgtgtggcttcctggtacctggaggagcatgtgaccggagctctgcaggagtagcccggtggggttcagcaccgggctctggcactggtcctggcttcaggcccacaccctgggcggtgcccatctgggtgatcagaatgtcccttctggccagaggtgttacttggttgggaaggttatacctggcaaacttagcctccctgggtcttcccctgggcccacctcggtacggggctgtctggacagcctgctctacttgcttgacctgcgccaggcacacggggctacctgaaccctggccaaagtcgaggcggctctggaaaggatctccgtataccactggctgcttttgctgagccatgagcacagatgaggccattgtgatgctcaccgtggtggcagtggccaggaaggtatgggtctgctcttgggcattgaggttgataaccaaaggctgcacagcggttgactggcgtcctgagactggatccagggccaggccatacttccttgcttccacagcaagagaggtcagatccataccctggtcggtaaggataatgggggtgggcttgacggctgtgcggaggtctaccaccgcagtgcccgggggccgggggcctggctcaactctagatgttccagggacagaggagatccggcatagcgagatgttttcagcagggagggcaccccagccgtacagtgccaggggtccgtctgtaccagcactgggtgctcgtggaaagccaggtggcccagccggttccgagggcatttgagatgcacttggaggtgttgtctggctgtagctgtgggaggtgggctgagagtctgtaggtgagcacagaggggaagtcgaggcactggcatgcaccattctggtctggctcgaagcatccgacgccagagtgatgaccataataggggcctcctgggaagactgctgccacaccaatcgaggagtgctaggtcggtgtggagtctgtgtgccttgggctaccatgggggagggggggccggggctcctcggaatgtcagaggaaagcgttaggcttggcgtctgtgtagagaactctgctgtggccctggggcccagcttgcctggtgagaatgtggggctctcagagggggtagatggagagagaggtgggctagagcccgtaaagtaagaatatccccgagaaggctggggggcaccgacctcactgtcacccccactcagaggcttctctctgggggcccgtccacttccaggagggccactgggagcgtggggcagctcctccgtttgagacccatagttagcagtggttgggggctgcccatagctgtggattgtggaagacgttgatgggctacgctcagagccagctggggaggttggagtcatataccctcgtgtcggactggctgtggtggctggtgacccaggaccctgggagaaggtcatgcctacctccttagaggtcaaagtggaggagacaggagagctgtgcagcttgagaggatcctgaggctcttttgcaaaatgctgagtgactcggacatcggggataactcggccaccgctgctgtctgaggaggtggaggtggaaaaagacacgggggcagcaagctgggtggggctggtcccaggggtaagtgggccaccattttgcttcattgggtccatgtatgcgctctcggcattcagaaactgcttctccttctttttgtcctcagtgaagcccagatcccgcgaggaggcctgccgcatccgggctatgctctgggatgtctgaaggatctcctcgtacacggccgctccaaggcctgcgggcgtgctttctgccaccggctgagaagccctgccgccatagtcatggtcttgggtgtcttgatattcaaaggagccctggctgcgggggcccgtgggctgagaggggccaccatggggtccccgggcccctgccacctggccctgctgtctctggagcatctcagcttttctcatcatgtcctcgtaggcctcctccgcactcttaaggggccgtccagaactgggcgtggtggaactgcccgaaggggtctcagtcggtgagtagagagacataaaggccggcaggttgtactcgctgccagacttgtagagccgagtggggccgccatctagggtctccgcctctgagtccagggagggggagggggagtactcagagcaggaagagcggtgtagctcctccatctccgctgcctgcctcagctcctctgtaggggacgcatcttcaatgggtgacaggttactgggtggtgtcttggagcgttcacgccgccgctgagctcgaagctcttccttgtcacgccgggtcttgcgggctgtgcttcgaattcgctgctgttccacctcccgcatcttctcctgctcacgcagcagctcctcttcttcccgcagctcctcctcctcggaggagtcctcgatggtgggcagcaggggcccgtgggagcggtgccgcgccttgcgctgctgctttgcttcttctaggcgctgccggcggctggggctgctgtcactgtcctcctccagtgaagacagggaggtgggtgaggtgccagatgtatagctaggtgtggaggccggcaacgtagaggagtgctccccacgagagcggtcttcgggtgagcctgtgaggctctccatctccagctcaggctcccggtccaggttgggatcaggaccttggccaaggtctagctcatgaccatagctacccgtgctgttgagctcgatggttttaaaacgtcggagacctccctgaagggctccgctgctatccgtgggctctgctgggcctgcctcagataggagttcctcgtagcctgtggtggcattatggggaaggcgcctcttgggttcttggctagattccggtctgggcctggcacttgccttctgggcgctgtgtttggccaggcctcgtccagagacagcagtgtcgtcttcctccaagttgtcttcctcggcactcatttctaggatctgtcgccgcatgaattcttcatcagtcatgtctgcccgggctgggggctgaggtgggaggggagacaagccgccttcgctgctgtcttccacgtagtcatgcctcagctggctgccaaagtcatctgaagactcagctgtgtcctgctgttccctctgacgtccccatgccaaggagtcgtcctcctctagaatgtcccccagttcctcatccgagtcgaaggcctcgggcgtgatggacagggagtgaggacgccgtttctggtcttcaaccgcactgctgctgctgcggggtggcttgctccattccgcactgggagctacagcctgggcctccagtgaagggcgcaagctactacccactttgtggagctccgaggggctgggtggacgtgggcctgtcacccctgcactgtcaagctgttccacttcttgctgtacaacacctgtgatctcgctctgggagctggagacaccgtcggaggagtagcctgtgtcactgaggctctgtgggcttcgagacaggtcctgagaataaggcttggggactggttcctgcatagggtaaaaagcaggcatttactcctgatctcctgtcaatcccaaggaccacgggaaggggccctccacaccctaggggctatctctctggccccacataacttacagacttcacagcaagagaaactttactagatgaatgtgtgggagaccagcaaagtggcagacacaggacgtgtctccatcccacagactccagaccagctgaacttcatttgttgtttgttgttgttgttttgtgacagggtctctctacagagccttggctgtcctagaactcaccaggtagactaggctagccttgaactcacaaagatctgactgcctctgcctccaaagtgttgggactaaaggagtgtgccatcatcccagtgatctactgaaacttaatctagaccctctttcaactagggtgtctctgtgaccccaatagatctgtcttaggcctacattgttagcccttcctcagactatctcacctgaaagctaggacccttggtaatgaaatagaactgacctcagcctccccacccttgggagcttctggaacaggcttgacaactggggtggcagggtcagtcctcttcaccccactttttgctttaggagtcccaggaggcacagtagtctctggaggtggcttcggcacaggctcagctttagcagaggtcactgtcttcttttcctgggcgctgctagaggtcttgctgggttcagtagccctgagaggcttggcctgagggctggccttggtggtctgagggctggccttggtggcctgagggctggccttggtggcctgagggctggccttggtggcctgggggctggccttggcaggcagggagcctgagggctggcccagcccctgtggccctttctgcttcagaggggctgctccagctgctcggtgagggactcctgcaggaggctgctgtggggtgggcagaggcaggggggctggctcccccaagctgccctccagcagccgcttagtttggcagttcagacagagccactctgttttctgtaaggaaacaggagggaggttcgtgaaaaaccacagacccaggagcaagcagagagtatttccatcattctccctaaccttagggaggagtcagacctcactcttggtagatggaacccagagcgagccctgcaccatgtagacacatactgtagcgctgagccatccccagcctgagaaagtctttcagaacaggataccaaaggcataaagagaaaaaaactgacaggtatattgctcccaaattataaacttctcagggacatatacaaaatcaaaatgcaaatgcaaaggtaagaagaaagttttcttcttaacccatagagaaattttcactgggccagaaaaggaagataattaagagggagaggagaccagaaaaattacagaggcttgggatgaaacacagggggaagccagggccccaaccccaaggactgaattacaattcaggggctgtatggggagaagtcctgcaaaacacgaatgcattcagagagagagagagagagagagagagagagaatatgtaaaatatcctagaggccctggccctggccctggctcctagttctggggtctgatagtaccctgccatttccttccccaagtaaggcctatgctcagcttgggcaaactccaagctcttgatccttcgcctgcttgctgtgtgagactgagtaactgatagatccttggacttccattcacagctgcgactgaaccattgttgggaattgggctgccgactgtaagtcatcaataaattcctttactatct

SEQ ID NO: 173 - DNA, 4001 bp, Mus musculus
tctgtctctggcccgctgtcgccagaagtctcacaccatcgcgcgaatgtatctcccaggttaccaaggttttccctgggttcagagggcggaggcagtaccttgggccctaggtggggcatagtaagcaaacaagaggaacctgggagcgggagaccttgactggctgcagcagccacacctcgcgcgcctgtgaccccgcctggcttccccagctcctgcctccctctgcttatcttggtgtgcgtgcgtgcgtgcatgtgaggtgtcttggaggcactttcctcccgcatcctacctctgccaactaggagggacttgacattctgttgtccctagattacaaggctccgtgacattgacttaggtcagtgtgtataggttgactcattcttttgttttgttttgaaacgaggtcgcaggtagctagagctggcctgaaactctctgggtagtttaagtatgaccttgagtttcttaatcctcctgtctccactgctcactagtgggattaaaggacttgttctttaaattaaaaacaaaaagtgttttttcttttttttttttttagcgtgtatctgtacattcgtgttatattcgtgtatattctgtgcgtgggttcagatgtgtatgcgggtactcctgcttgtacgttggcaggcaggtagagttgacctcctgcattcctccatatttatctaggcaggttctatctggaatccctcctctagctgaagggtttgccccaaggctccctgtcttccttacgaggaatctggagctatacatttcagtcctcatatggtcgtgcttatccactgggccgtctcctagccctaatttattttttattaggatatgttaattatacaccccacccacacacacacatatattttttcattctggcattttcatgcactcacaacatatttttcacattcattttcacaacattcaatcagtttcatatctctgaggccttcgctcttcctacttaattagttagttaatgaattttgatgaccagatgagtttcattagggttgcttacagagtctcagttgagagactgttcacaggagcacgaagtccttatcctgaggccacacctctctctcttgtctctctcactctcaaaaaattttttttattaagcagaagaggacactagatgccattacagatggccgtgggccaccatgtggttgctgggaattgaactcaggacctctgtaagagcagtcagtgcaaactgctgagccatcttgacagcccagttccattctttgattcacttagagcagtggttcttaacctttctaatgctacaatccattaatacagttcctcttgttgtggtgacaccccaccccaccaccataaagttattttgttgctacctcataagtgtaacttcgctactttatgaatcgtaatgtaagtatctgatatgtgaccctaagggggttgggacccacgtattgagaatcactgacttagaggtgtctcgtatacttatcaatggccaccagactccttgaattcagaactctttgctgagcctgcagtaaggcctctgctaggacttagcagctacatatctgaatacaatctgaaatggggtatttaacaggtactaagtttttacagtgttagggatcaaatccctggtcttttttaaaaaaatattttccgatttatttatttatttattttatgtatatgagtacactatacactgtacactgtagctgtcttcagacacaccagaggagggcattagttctcattacagatggttgtgaggcaccatgttgctgggaattgaactcaggacctctggaagagcagtcagtgagtgctcttaaccgctgagccatctctccagcccccagatccctggtcttagagctattgcaagctctgcctctgagttaacaaccccaggccctctctgttagagagcactcactagaaacaagacttgtttctttttttttctgaagattcggctgtgagcaaactagaggagttctgggctcttcatatccacatgcaaatgcaggtgaggtcagggaatcgggaatcacaaaggcctgagagggataaggcagcatcagaggatacttccggtttggctcgttgcagcatccctagcattgccctgcctggcacctatcaaggtaccatcttgatctgctatatcaaggattgagttgaaggtagggcatcctagtgctctagggacgtgggggtggctcttgtgggacatgacttcacatttcagaaaaaaaaatcaccgtgttttctttctgttctagggaagcactatgaacccatgttcaccgaagaaaccatatctgggttgctgatggctgaactacaacttcaggctgtgaagagacatctgaatgttgcatagcatgagtcggaattacatggggctatctctagttccctttagcagtcatctgctagttctgtctgagtttacatctttgcgactcctaggtgcagcttttggaatgcactgcagaacttgctagaccactggtgcccaccgaccccgacactctgcctttgttgggcccccatcccccatatgtttggtaaatgtagtgatttatggcttcttttgttttgtgactataaaaagttcaagtcacctccttcgcagtggaacaggacattagggacagcccaaatccctgctcccagacacaggtactctcagttggcccaggaaaagtggctttcattccctttggaccaacaactgtgatgtgggacctcagagatgatcatctgaggagtcatcaggattggaaccaggtgccagcaccagccgtctccatccgtgttgtatctcagagtagataatggtgagtccttccaggagcccgtacccccacccgccttttgttgtggttggtggcttgttggtttattctaaactggttgttgtgttggacatcctattattgtttcaatacattcttttgggacatctgttgctagcactcgacttttcttttcttttcttttcttttcttttcttttcttttcttttttctttttggtttttcaagacagggtctctctgtgtagccctggctgtcctggaactcactctgtagaccaggctggcctcaaactcagaaatccgcctgcctctgcctcccaagtgctgagcactctacttttctaactttactttcctgtttcttgttcatcttcattgaaactttgccctgtttagtttggaaattctgagtgctggttgtaaagatgcctgagataagagtttcttctaacccagcaggtgggggtatcagaaggaactctgacatgtagtcgcctcctactgaggctttgggctggcaaaatggctcagcaggtaaagtctgaccacctgagttcaatcctggggatgcacaagagtaaactgactcctgccatttaatctctgacctccacacaaatggtgtggcatgtgtatgtcctatctcccaatacaaataaatgtaaaaaaacccaaaacatacaaacaaaaaacacctgaaccaaaacctgacttcctgggtcagaaagttccttttttggctcacttactgtagtggctattcctggttgtcaacttgacaatatttggaatgaactacaatctggaattggaaggctcaccagtgacccttatcttgaggcttggagattcttatctggatcttggtaaggagatcttgagccatagtggctatggattccagaagattagatctccgagtttaaggaacacacctttaatctgggctacaccttctgctggagacaatataaggacattggaagaagggagtctagctcttgctccttcgcctgcttgctgtgtgagactgagtaactgctagatccttggacttccattcacagctgcgattgaacaattgttgggaattgggctgccgactctaagtcatcaataaattcctttactatct

SEQ ID NO: 174 - DNA, 4717 bp, Mus musculus
aaggtaccatgggctacataacattttatttataaacctcgtgaaaaacacaaattccacttgctaaatcaggtgaagacacagaaaaaacaaaacaaataaaaacaaaaacaaacttctccaatagaaagctgttaatgcataaaaactgtttccaagccaccaggaaaaaaaaaaaaaaaagcaaagcaacacgtctttgagattccacctcaccgaagtcagagagtggccaacttcaagacaatgcatatccgtgatgatttgggaaagaaaaggtccctggtgcagccattatggttattagtgtggaacttcagcaacctaagactagaagtaccacctgactcagctctaccattcctgcacatgcaaccaacccggggttgctgttgttactattttggttttagacattttccctctgcgcagccctaaccgtcctggcactcaaactcagagatctgtgtgcctatgcttcctgagttctgggattaaaggtgtgagtctctaccatgcccagcctccaaaggtctgtgtatcccaccacagtgatccatgtacatccgtgtacaaccaaggatctgtgcatcctaccacagtgatccgtgtacatccatgtacacgaatgctcttttcacagtacaaagcagatggaatcagcttacatgtccatcaatggaagaatggataatgggaatatagtacatacacacaataggattttactcacatagcaactcgatatgacgtgtgggagctggagacttagctcaatagctaaaagcactcgctgttcttgcagaggaatagcaagtgggcttggtttggttccaccaaaatgggtttggttcccagcccccatgcggcagctcacaactctctgtaactccagttccagggcatccgattcgttcttttggcctctgcagcgccaggtgaatttatgcatgtacacttacatacctggaggcagaacactcatatacatgcggttcaaataaatgaagatcttttacagaaggaaattacaagaaaatggttggaactagaaaacattatgctaaagggggtgaaggctcagaaaggcagatgcagtggaccagttgttctcttgtatgtggctcctagctgctagttgttaagtatgtatgcctgttggagagtaaatgtgggtagaggccaaggaactagaaaaaggtccacaagatgggaaagacaagacactttaagggagggtgtggggagccaccctcacatttgccattataagatggcgctgacagctgtgttctaagtggtaaacataatctgcacatgtgcaggggcagttttcccgccatgtgttctgccttctcatgatgactactgggccgatgggctgcagccaatcagggagtaatacgtcctaggcggaggataattctccttaaaagggacggggttttgccattctttttctctctcttgttcttgctttctctctctcttgctcttgctttcttgttcttgttctttttcttgctttctttctctctcttgctctggctcttgctctcttgcgctcttgctctggctcctaaagatgtaagcaatagagctcttgctctcttgcactcttgctcctgaagatgtaagcaataaagcttttgccgcagaagattccggtttgttgcgtctttcctggccggtcgcgagaaagcgtgtaagaggagggtgttggagggtgttgttgaagacaacggaatgcatgagattctaaaagagaaggtgtttctggtggggatgtgaacagcagcagccaggaaacagggagtgggggaggagtggagtgtgggctgaggaccaatcaaagcaaagcttatatgtaaatgatgcaagcttacaagctacctcaaaacaaccgtaggaataaaaagaaatccttcttaacaaaaataaattctcaaagatttaacttttaatgagggacgtagcgaagctgtcactgaaagctaaggttcctgaaattccgaataacaaggctaggcttattctgtactaaaataaccgcaacagattccacggtgtctagaccatacccttatctatgaactattgctacaggattataaccacagtataggcagtatctattgttatcacccccaaattataagtatttgttcttgattgcaaaactacatcttaatgacttttgcagttgctgtgatcaaacacccgtcaccacactagtgtctagaatgaagactctatttgaggcttactctccccagaggataaacccatcaccgttatggcgggaagcatggcagcaggcaaaatgactggaacagtaactgagggctcaccacacgaaccacaaactggaagcagaaagagtgtattaaaaaccacaccgggctcggaaaaccccaaaggccgcttgctcccagtgatgtacttcctcctccagcaagaccacaccccctaaacctacccaagcagcagtcaccaactggtgaccaaatactcagatgctcgagagtatggggaccgcctcattcagaccaacgtagtggaggatggacaaagttcaccctgttctgtaggactatgagggcgtgtctagagaagaaaatcgaagttctcattctttcagcctgcttctcccacactttgccttgcgaggtccatttcaccttggctttaaagtgttagagacgctgaagctccgccccttgtccccactctgcacctggcctcattctttcattctattcgtcatcacctggctctttcacctcgtgagccgtgttctcaaatattagcttagaccgctttctctttacccagtcaacataaccggcaacagaagttacttaggaggagtgggggccactgactgtgaagcagtttcttggtgtggttacagggtcacaagcatggagctacggaacaatcctttattacggagagcagcctgttgggtgcttacggaagcccctggcttgatttccagaatgcaggaggctgggcggggcggcacatgcttgcaatcctaaccctcagggagcagaagcaggaaggtcagaagttcaaagtgacccttggctagggcctttgaggtcagagttgcgtgagatcccatcttacaacaaaacaccccccccccccccacacacacacacacacaaaacaaagagcaaaattattatattatgggcttggttttttgtttgtttgtttgtttgttttgctttgttctggttttgtctctcggtgagagtagatcataaagagcctttctgctcactttgtaaatcttttcaaaactaaagcagctggagtgatggctctgcggttaagagcactgactgctctttcagggatcctgagttcaaatcccagcaaccacacagtggctcacaaccatctgtaatgggatctgatgccctcttcttgtctgaagacagctacagtgtactaatacataaaataaaaataaatctgtaaaaacaaacctaaagcagctggggggggggcgggggcgggcgggacatctctgagtgaatttccagctcagaacacaagaacaataccctcatggaccactgaccacttcatgcttcgctgagagaaaaggacatagaatgacgccctcctgtccttgctggcaagaacaatggaggtgaggctcttgggcccctagttcagaaagtaccatcccccctcactgttagcatttcttctaggctccgccccacagttacctggcaacagccaggagtgcctgactcactataaaagggactgttttctcctctctctctctctctctctctctctctctctctctctcacacacacacacacacacacacacacacacacacacacacaccccttctctgtcccttctctccccattcccctcccccactctctctccacgtgttcatggtctcctctgtctctttccctctcccttcccctcccccccccctccctctccctttctctgtctctaccaccccctcaactcccctcctcatgacctgaataaactctattccatactatatctgacacttggctggtccctcagcaggaaggaatgcctcagcaagggcctgcgcctcaccataccaaaaatatccctggcctttctgtctttctgggtagtggtcggggtggaaagggaaccggttcactgggggtgctccaccagtattatcactcacttgtctgaaatcttttacctatggtcagctccattattgtgtctcctccagcacgaccacacacagaggcccctctctggctctcctggaaaaaaaaaaaacaaaaacaaaaacaaaaaaacttatttttcacagtcatggttcctgggttccaaatgttttgacttactgaagtttcccaggcgtgctcaggagacacttggaacgaaattgctcatgacattcaggtcccggttctaattcaagctttatggcgggcccctctagaaaaaatagaacctctcctaagatcaaagggattggagttccccacaccctcggggtttaagatgaggtctcagccctgctatagatgggctaactcatggctgaaatctaatgttttcttgaggcagaactaagtttatcaaatctggacaagtctctgttgctttagaggtaggcgaatttctatacatgtggcaccaggtgtgctctctccctctccctctttc

SEQ ID NO: 175 - DNA, 10033 bp, Mus musculus
ggggtttccccgtcccaacggtaactgccgcgacccatgcgccccggtcgctcggtgaccccaatgtcagtcagacgcctccgttcccacagccgccgtgacgtggtaggtcacagccgctgccgacacgtctttatgtcacacccactacacctagatcacgcccacacggctttaatgctgttcccactacactcaagccacacccattacactcaggccaagcctacacagcttcatgccctgcccaatactctcaggccactactacaggactttaggccccgcccacaacactcaggctatgcccacagggctttatgcctcttccacacatccttaggcaactcacacacatctttaggacactcacatcttttggacacttccactatactcaggcccctcccacacaacgttaggccctcccagtacactcagccccctcccacacatctttaggccctcccactacactcaggcccctaccacacttttttaggccactcctacacatctttaggaccctctcactacactcaggcccctcccacacgtctttatgacactcccacacatctttaggacccgcccactatactcaggcccctcccacacattttaggacactcccacacatctttaggaccttcccactacattcaggcccctcccacacatccttaggatcctcccactacactcaggctcctctcacacatctttaggacacttacatagtcagaacacgcccccaaatttacatatacatttacatagacagttagaacacgcccccaaatttacagagacagaacacacctcaaattaggcccgcccagacacttttaggccactccataacatctttgggcccgcccagacatctttaggccactcccacacatctttaggcctgcccacacattggtaggcccgcccacatagacatttacatagacactgagaacatgcccacaaatttacagagatatttatgtagacatttacatagttactcagaacacaaccacaaatacacatagacatttacatagacagcgaggacacatccacaaatttacatagacatttacatagtcactgagaaggactggctgacttctgaatcttttttttgtttcttcatgttaggtttgaggaggacaccctacccacgtggctatcctcagttgcgagtcactgtgggaattatcccagttgtcttttggtcttttcatatatgtaaatgtatttataaatgcacatacaaatgatatgtaattgtatatgcaatgtgcacgcaagtgtacatgtaaatgcatatgtgaataagcaaatatgcaaatgatattcatgcccatgctttcaaatgccacgcccaccctcatttaggccatgcccatgcagcttcagaacatgcccaccctcctttaggccaagcacactactctgagaccacgcccatcctccttcagggcacacccactactctcagaccatgcccatactcctttaggacacttccactacagaaaacacccacagatcttcagtctactcccactattcaacaacaatgccctcaattggtcaggacacacccatacttcctaatgccacaccaatcctatccagaccacgcccacccataattctttaggccagtttcaccacactcaggccacaccctctgcacccagccatgcccattccttctaatgccatgcccaccagaattaggcaccgcccacacatctaaatctcatttgaatatttgcaaatttattcatatgtgcatttacatacacatatcagttgcatatacaattacatatcatttacatatacatttatacatacatttacatatatataaaaaggccaaaaggaaaagaaaaagaaggaaaaaaaagaaaaagaataaaaataagaaaagaagggacaactgggattggaattcaactgtcctctgtcacgggatctgcgtacagtgccctcctcacacctaaaataaatttaaaaaaaaaaaaaaagaaggaaggaaggatggaagcagggaaggaaggaaggaagccagtcagtgcagaagagtttgggcttccttcctccctccctccctccctccctccctcccagcagggatagaaaccacagcaaaccagctagagagagagagtgagtgagtgagtgaccagagcaagagagagctgggaaaaaataatttttaaaaaaggccctcccttaaccctaaccctaagccctaaaccctaaacccaaccctattccctaacccctaaccctaaccactaaccctgacctaaccttagccctaaccctaaccctaaccccaaccctaacccctatcctatctcttcatgaggcatttgggagaaagagaacaaaagagagagcaagagaatagcgcgcgcgtctgtgtgtgtgtgtgtgtgtgtgtgagagagagagagagagagagagagagagagagagagagcgagggggggcagggggagggagggaggggaggagagggagagagagaaaggagagacagagacagatagaaagagaaccattgacatagcagtggtcttttaaaaagatgtcttactcttgcgcgcgttcgactggccaggaagaacgaccgctgcaacaggatccttctgcacacgtttattgggagagcttgattgtagaggcgaaaagacttcgagcccagaactggtgctgcttttataggcctaggaggggcgtgtctcacacccggattggttatgcactaagcctcatttgcatgttcctcatctgattggctactctctctcagtaccttatagaacctcattatcatacctcatttgcatgtctcacatctgattggttatactctcagtaccttacagaacctcattatcatacctgggccaggcagtgtctttgcaaaaaactttactgcatatgtacacattgcttgtttgtccaatcttatgcgtggtggccagcagtagtcagtgccactcagcaacggcacatgtggcttcccacatctccccctgtttgttttaataaaatgaggctggactaggcctgtgcaattatgcccatccgccgtggctcctgttttaggtcgttcctctaatatcacagccttacctgtcatagggtaaccctatcgccaccgggccccatgtcttaggttggactgtgcacgaggaaagttgcccgtctctggataccgcagtgctgtgtgacaataactgctaaatgacctagggcgaactctgcaaaagaggccagccaaaaaatgaattagtggtgaaatcatgatcaccctattgatgagcaagggctgatcaatgatcgttgagtctctctcatcccatctcatgctgactaattcttgagcatagataaccaaatttcaggggaggagccattttcaatagctaaaagtgcctgagttataatcaccttgtcatgtttttgttgggttctgaatttgcataccaaccagagcatgaacaccagtccacagcatatggcagcaccaaacaaaatcactcccacccattccttaaagtaagaaaaagcagaggtaaaccaagaggtaaagtctccgagggtcactggttccactctggtcccattaaggttcaggatctgtatctgcagtctcgtctgcaacctttccagctcctgcgaccagttccccttcaggtaattcgataggtctgtacttttaataaaagaattattaatatacctattgggagtaatgcacacatgcgatgtagatgccacacaactcatttgtatgacatccatcatctgttccatgtcgtgttgtaaaatatccactctctgattcactaacattaaccctgaggtgatatgagaatccaccctttgcagggtaagcaatgcctcagacgttttttctgctatctgacttatagtgtcagcagtattaatttgatctgcccaattagagataatatttttcttaaaaaatatacagggtgtaaaaggtttatccacattatacacaaagcataatgtataatttaaatgaaaactagtactcttatacacccgtggctcttgaggagtttgtcgtgcataaggcacatccaaaaaacattcctttgcaaaaaacaaaggctaggtagaagaattggaatgtaccagtaaaggtactggccatgatcttactatggcccataaaggtatacttatcctggtttcaatcatcaggagcaggagaatcatcttggggttcatcttgctctttcacggtccttgtcagtcgcgtcgggacccaaagtggattttcttcaccctgtggaaaagcacaaatagctccctgggacctgattaagataggatccgggccataccatttattatcaaggacatttttccatttgaccatttcattgggcgattgaggccattgtccatgcctttcatctggtgatcttccagcatcatctaattttagaaaattaagagtaaatattgcaagggatagagccatctttggcgtcatagcctctatttcccctttctgtttttgcaaatattgtttcagagtgcggtgggctctctcaatgatgccttggccctgtggattatagggcaatccagtaatatgttttacttgcattagtttgcaaaattggctaaatttagaagaagtatatgcaggaccattatctgtctttaacactaggggcttgccccatgcagcccaagcctctaagcagtgagatgaactgctttttcccctgtcaagggagaggcatgtaggacaccagaactggtatcaatggatacatgtacatattgtaatttcccaaaagatgggatatgcgtgacgtccatttgccaaacatctaggggtcgcaatccgtgaggattaacacccacggaaggtgcattaataaattctacacatttaccacactgtaggacaatatctcaggcttctgttcgtgtgagcttaaatttttgtcgtaatgtagaagcagggacatgataaagctgatgaaaattcttagcactttctatagaactttgtgataggaaaaccatgtctctggtggctgagtcagcaattgcatttcccttaaccataggtccaggtaatgatgtatgtgctctaatatgttaaaagggatgctcacgcatcaaaatacaattttgtattttcctcaaaatttcagatactggactagactgcttaacatttctggcagtctctaatgctagaaccgcattaactacataaacagaatcagagataatatttatgggcataggaaatcttttaaaaacttctaaaaccaccaaacattctaccaattgaggggctcctggtgtaaattgcaaccttacagccttttcattgattacataacttccaattcctgtttttgatccatctgtataaatatcaatggctccctttataggggtattagccgttacctttggaaatattactggatgtaataacataaaatgtaataacggatgtttaggataatgattatcaattaaaccagaaaaactgcatctaagaatggcccattcatttatagtagcacacaatatttgcatttgtgcgacagtataagggacaactatgctatcaggtatttttccaaagtgcataattgaagtttttatccctttgtgggccatatttgctaccatggtgggataatgctctatagtcttattaggggatatatgtggatgtatccatactaaaggaccatcttgccataacacagcagttggcaaatttatggttcttaatatgcataggtacaaaggttcttgctcatttatacgagttaactgtgctgtttggatcgccttttccactttcctaagaacatcagaagcctcaggtgttaattgtctcaatgaggtaatatgtgagtctcctcctaaaatttgaaataaaggttttaattccaaagtagggatccttaaataaggtctaatccaatttatatctcctaataatttttgaagatcatttaatgtctttagatgatcttttcttatactaatcttttgtggggtgacacatcgtatagtaatagtggctcctaaaaaatgactaacattagactgctgtactttttctggtgcaataatcaagccattattttttaaagtttcattaagcaagccataagcttgctgtatactttcttcttcaggtccacaaatcacaatatcgtccatataatgacaaatttttaaggaggggaaaccatccctaaccggttgcaaagcttttcctacatataactgacatattgtagggctatttgccattccttggggtaatacccaccattggtaccttttatcaggctccatatgattaatagaaggcaaggtgaatgcaaatctaggtttatctttcttatttaatggaatggaaaagaaacaatccttaatatctactactataattctccaatccttagttagagctgagagtagggggagtcctctttgtacaggacccataacttgcatttgtgcattaatggctcttaggtcatgtaacaatctccatttacctgacttcttctttacaacgaaaataggggtgttccagggtgattgagtgggttccacatgtcccaggtctaattgtttttgtactaattctttagctgcttttaacttctcagagggtaaaggccactgaggcacccacaccgtgtcctccgtacgccatggaatgggcaaaggctcctcagtggcccctagaaaaaactcagccctttcttatctactttttctgtggctttaactggtgaaattctaccttgtaagttttttccaagacctagtccaggtatatatcccattcctttcatcatttccttgcttttctgagagtaatcattagtcaatataaagttcatggctgacaacacatctcttccccataagtttacaggtaaagggagtacataaggttgaaaaagccctgttcttccttctttatctttccattgtaaggattttgcacttatagttggggtagcctcatatcctaatccttgtaagctatgtgacgattgattaacaggccaagaagcgggccaccaattactggatataatgcttttatctgctcctgtatccattataccttgaaaggtttttccttctatttgtaattgtaaagtgggacgattatccaaatctaaagatatgtaggccacattagttcctgtagaaccaagtcccttatctcctcgggaatcctggctactagggaacatgttatgcaaactaggaagaatcagtaattgagcaatgcgatctccaggagaaatggctacaatacctcggggtgcagaacacataatcttaacttgtccctcataatctgagtctataactccgggatgtatcatcaatcctttcaaagcagaagaggacctacccaacagtaggcccactgtatcctttggtaagggacctctaaagtctgatgaaatagacccatttgaggtgtaagaattactctggaggtggcacaaatgtccaatcctgctgaacccggagtggctctcctcggtctctgggtggcctcatggacactgtggtctgaaatgccccatacatttgggggccctggggacgggggcccctcaccccgttttttggctgttgcactttaaactgaggtattggccttccttttatatctctgactgatctacattcatttgcccaatgtcttcctttcccacattttgggcaagtacctggttctgtcttttcaaacctactctttctaccctttgtacactgcttttgcatatgacctgtttgtccacaattatagcaggttatttcttttgcttgcgccatcaaaactgcggcagccagccctgcatttgaaagaggtcctcctatttctctacaggctttcatccatgcttgtagccctttccctttccatggtgtgatagaatttctacattctttggtacattgctcataaactaattgttcaattaatggcattgtggcctcagcatcaccaaatatacgtcctgccgcttccatcatgcgagccacaaattcagagaatggctcattagttccctgaataatttttgtcaagttaccagatacctctcctcgattaggcaatgctttccaagctttcactgctgcctgattaatttgatcatagatctgcactgggtatcctaattgattgtttgtccatataccctgacctgtaagcatttcaaagctccatgcttgttgccctgcagtagcattagcacgggcctgactcaaacacagatcatgccatatagacttccaatctagatactgtcccatcgtaagacatgcctttaccacagtcatccagtcaaaaggagtcatggcattgtgagccaatctatcaatttgggactgagtaaatgaggcattaactccataggtccttactgactctgctagctcttttacttgtttatgcgatattggctcataatatcgctgttgagcatgatcctgaaaaacaggaaaagcctgacatattttttgcaaccctttaggagtgcaaaaagagtgaccattatcaattgcttttttatctgcataaggtggagtaggtgggggagcactgaaactcctccctattggaccagatctttctgcttcatactccgcagcagcctccttcaaatcttcctcctctcctgttgataattcggaatcctctgagctagacaattctaacgactcagagtcctcgagaggagggtaaattgacttaattttctgctttttattattttttatactattttttgtatctttacattttgggagttgacaattaaagccatgatataagatcaaggcaagaaagatagcaaccccagcaacaattatcagatctatttcgtaggagagcatgcctctcacattaatttctttctacttaccggtaccaccgttcctcagctgaagagttctgaatccactccggatccttctcagcagtctgttttgcaggaacacttcattaccaccgttccccagctgaagagttctgaatccacgccggatccttctcagcagtctgttttgcgggaacctttattaactgctccttccccgtgatgcagttctgaatcctccctgtagcagggggtcttcgctcgtgcctgaagacgtttcttgtcccgggttttcggcaccacttcttgcgcgcgctcaactggccaggaagaacgacgctgcaacaggatccttctgcacacgtttattgggagagcttgattgtagaggcgaaaagacttcgagcccagaactggtgctgcttttataggcctaggaggggcgtgtctcacacccggattggttatgcactaagcctcatttgcatgttcctcatctgattggctactctcagtaccttacagaacctcattatcatacctcatttgcatgtctcacatctgattggttatactctcagtaccttacagaacctcattatcatacctgggccaggcagtgtctttgcaaaaaactttactgcatatgtacacattggttgtttgtccaatcttatgcgtggtggccagcagtagtcagtgccactcagcaacggcacatgtggcttcccacatcttactgatgctcaggcaccaagagaagagggttagcatctcccttaccatatcactgctgcatgcacttttagtatccttgttcctgcatcttatttctcttaaaatgtatgtttaatgacagcatactgctgcttttctgtggctctctgtctttgtaggacctgtctgtctgtctgtctgtttgtctgtgtctattcatctatcacttttctgagaaccctccccaggcccacagcccactctgggaccaactgtacattttttaacacagttctatttttgtaatctttcccattttactctactattaaatatagctagacatc

SEQ ID NO: 176 - DNA, 36805 bp, Mus musculus
agactgtaagcaatttttattctcactgtatttgagaggcaagcacaatttgagtattttcagcataaaaacatttaaacattatttttttaaaatatgtttaaattttagaatttcactggggttttggcaaaattttatacatacaacttgtgtttcccgcaatatcgagcgcagatttccacctgtgtttttctgagactctgaagagaaactaaaagataagtttgagcagacactgggcttgccagcatcctgctggcctcaggagatgtcacaagggccagagcacatacgcatgactgagctgtggctgagcatatgaaccacatgtgacaagagacagtgtgagcaccccttctgacgactgcttggggaagttgtcttcaagaaccaccccagggtagaaaagtcatgtgtagggagtgcaagggtcctttcccaaaacacaaaaacttttgttcaatgttctcagaatgaagagtctttagagtgtcatccccaggtgactgcgacatagtggaagtgactctgtgagggctgttgggaaagcatgaaggccctgagggacagttcaaagccagttcaaccagagcttttattttctgactgagcatctgagtgacagggtaaggcactggaccatctcagcaacatccttctgtttcaagggtatatggggtccacccactccccggggcgtattacattctatcttgtgatttgaatccccgacagctatgtgtcatgaagagtacaaaacgttgtattagatatgtttcacactgggggggttcaaagaaaactagagaaatatacatcacaagctgggaaagttgtatcaaaactgagattgcatacagttgtatgtccaatgaagggagacgggctccaaggaattcaaaacagaagggagctcgtgatcagaagtaaggtaagaagcagcgaggaacggagaagtgcgctgagcctggatgctttccggtgacgtgtggagaacaagaatcgagacttgctctccaggattgggactccaaaatccacccagctgtccaaccactccccgggccactcaggatggtcactggcataaattccagagaagcgcctcagatatgccttgctgaagcaagagtttctcttgtagttgtagattgtgagggcttctgagggaccctgaagacaactcccagggcgcagtcagggcagcaagagccactcagggtccttggggaagtaggcattttcccatcaattccgtctgttacagtggtgcagtcaccgcccgcggtacttgctggaactcaggcctgagtgctgaagaagaacaatgtaaacttgcaagagttcgaggccagcctggtctacaaagtgtgttccaggacagccagggctatacagagaaaccatgtctcgaaaaaccaaaaccaaacaaaaaaaccacgtggtgttttatttgacctgcctttcttatcatctgccagtatgagtatccatccacttgtccatagcaagacaaaaatcagataaggtacagaagagagacttaggggatggggtgggacgatgcctctctctccctctctctctctctctctctctctctctctctctctctctctctctctctcagccctttaggaaactaggtgcctgccttttatctgcttgtgacagggttagtgaaggaccaaggtgaaattatgagcttggcttttgaggcactagccagggactaggatagggagggcataaatgcttcaaataaccctcttcgggaagactcaggcagtatggggtgggggggaagtggctgcatgtaaacaagacaggaaatatactcactcgtcctggccttcccctctgcacacacttccctgaccctctgtctttctgcctcgtcattctctgtggagatctaggttttaagaagttcctacgctctattccttaactccactaggttagtagcatatgaggacttggggaccgcaccatttttttttttttttttaccgacttagacatctgtgctattccagggaattgccagcatgagggcatcagcctgttttccttgttcttttacccagccattcactggtgctaaagaaagtcctgagcatcgtggatccagagagtaagctgcaactctgtcgtgaggggctggtgtttgctgctgagtgtttccagaccagtgaaactcagactcgagtttcaggacggagactgtagggaaagaggaaagagggcttcatttcaacacacagggtccagctgtatcagcaagaaaaagatgacactcatccgtgtcacgttcctgtgccccaactctgtgtgcgtgctttagtcaccgagaagaatggctagaaacaggaatttatctcgagttctatcatttctggagatcatttacagaattaactaggagttactggtgcaacgctggctacattttctcagaactcttgtttttgttttttgtttgtttgtttgtttgctaagcttgggcagaggaagagagaggagaggagagatatatcgcagacatttctgaaaaggtggtcttcagacatgtctcacttcagagctctggaggagaatgtccttccatcagtaacaacagctgactttgatgaacactcacagccactacaagttttacatcagagggtcgtggaacggagatgtgaggatcaacttcatggatcttgccaatcagatctccaggatccttgaccacctggctggaggctggagttagtgtatagcaactcttaatgtggcatctagaaactagtataatttttttattagaaaatcaactatgggataacagatcttgttcagccagccttgatacaaaagtaaaaaaaaaaaaaaataatggaattttcagaaatatgctgtcattagtataaaaccctgtataaggagacacaccaggttagcctgaggtcaaatagctcatgaaaatttaaattctaaaattcagaacgttaagtacaaaggtggggaaaaaagctgatatttccaagatggcagattattgaagttatctaaaatggagacaacttttaagtctcaacagaagggaaaatttttaaactgacattggagatcgattatggggggggggatttaaaaataagcatttgaattacataaatgtaaaactaaggtcctaagctggaacaggaatgttacaatgtcattcagtcattggacaaacattctttgagcacctgctctattcataaaaggcagtgattaggtggggatggttctacagtaagtagagtttatgccttgaaactctgtcctccggcttctgagacagggaggtgcagtccataaactggatgtttggaagaggatccccaccacacagcagaggggcgggcatgaagggcgatccaaagtttgtctcagctggatatttttttctctgctattttttgtttcattatgcccacatcttcttcaatacagttttgttaagtatcacagttggttctgtgtttggagaaattacaacattacaacagtggttagcggtggctgacaataagcaagcacccttgggaactctctgaaatccttggggaaaagtcagagtgaccttaccagggttggattgagggggctcaaggctatttgaacattgattacattgtggcaacttgaaaaccggtgacctctggcaggtgttacaggtctttgtgggcgacttgggcaatcatcacagagcagcagggcacagttccatgacctcaggtcactgggcactaaaatccagatgactttatttgtggggattcaacttcctgactatgtggatttgaaaggtggtttttcattgctttttttttcctttaaaagaactttaattacatgagcatgtgtgtctatatgttggtattatgtacatgtgaacgcaggtccttgtagagcccagaagagcatatcagatctcctggtgctagagtcacaggcggttgtgagctgcctgatgtgggtgctgggaacccatcttgtgctgtctgcaagggtatgtcacactcttagctattgtcacaatctctccagcagttctgcttcccttcattctcagttctctcctacgcaccctttgtgccctgacaccaccaccaccacccccaagcagtgaggacattaacccctatgaacatttgctctgctgaacactggttagaggctctgcatgaatgatttcgttttatctctgcatcaacaaggcaaaacaggtggaaacagccttattttcctaagagaaaggggtgttaagggtgctatggatgtcatgtaacccaagcaacctgtagctaaccgtcctgagtccaaacataggctaaagcaaagtccagagctctccacacaatcacataaaggattttaggattcacctaagcaaaacataattaagaggaaaagtgtatttggagaaatgcttactgtttctaagcaaagggagatttctgccttccacggacactgcccttcatgaagagacaggtctggatgctcgacctccacttaggaaactgcaaaaaggtacaagaagcaaggatgcgcagtttcagccagatcatgtatgacaaagcccagtgaatctccttgaatgataggcaaagagaaatggtatctattggagcggggcgactagtttcttagaagaataataaaaatgtgaggtttcaaacacaaattgctttatgtatctggggtccaagagtttgtgcttgcaataactcttggccattccaatcctagctacaaagaatggtgcatctgtggcccgtagatagtacacagtaaacatgatgtggagtcagggccactggatacaagaaggtgtgctttggtatgtcctgaaagcaatggctaacgcctctaacagactctaatagagagtgtgtgttctatgttgaggcagggtcctccctatctggttcaggccctgtggaattcacgatcgatcctccttcctcacctctcagatgacgaaaggcacagcttggacaagaaggcccaggtacacgccaagagctttataaaccacgataaaaattagagaagaaaggaaaaaaagtgaagaggtttcaaatggtagtctggatcatttttttttaaccagtaggttcaaaagacctaaaattactctaccatgtctctctgaaagtctctgagcactctctgtctgacctcagacctctgtagatcagtaagtggtgcctgagaagaagacacgaaggtcatgcaggtcacgcaggtcacgcttgctcaccggtcacacctctttcaacttcttcctttgtaccgcttcccctaagaaacactaaccgcttggccccgtgtggtcttcacctactaattaattacgtgtgatttcttgtttttctttagtcttcagtttttgctttttagatataaaacccgagctgtatgtagccccagccaagtcagtctttactccctagagactttctaaagttaatggagatttggggagtctgttattttgctgagggttgatgtatcactaaaactgttatatttttatcatcacaaagaaaatgaaatgtgcctgaggacaaggtggggtttaaaaacagatacttgcatatatatatctcttctctgattttcccctctcccgggatgggcaatcacatttttagatgaacaagatagctaagaggataggagagaatgtgcaatcagagctatcaacttgtgagcactcaagctgacctttgtatagtttccttgcagaatttgatttttaaacctaaccagactcttccacagacgcctgtgccttcccttgtgtccctctttcatactgccatcagttgttgatacatttgtagccttgtgggttttctctgctgagttcgcaggaactgtttaaggtagcggtgtgacttttcttttgagcctccttccccagagggacagcgcacctcgaactgacccttccatgtgtaaggagcttctttattttatgttttcagcctgaaacttgctacacagctgaggatcaccttgactttctgaccctcctgcctccacccacaggtactgggattagctgctgtgggccaccatgccctgcccaagaacttctgagataaaatggtgcttttcagagagggatacacctagctttgacctcagtgagttatcaaatcagaaccaacacctcccatgactccaaccatgggattatcccggtgttaaaacccctcactagatcctggatattttgtcctttagtatctcccatggagaaaaatgatgagggatgtctacctgcagaaggcaaagcctcctaaggtcaattagttttagtattctgcgtggcctgggcccaggaaggaaggtcaaacctcaatggtggggaggttagggctttgaagaagggctgggctctctgacgaagtctagaatgagtggaggtgattttaaaaaaaaaaaagcaggtctgaaccggataaatagaatgcagaatgtatacacacacacacacacacacattcgtgagacagagagaatgtctcagggaagctggggggtggggggggggagagaatcatgtttcttcctagcatctactttagagttgttactgctttttctttcctgtgttttagatcaccacaccaccactacccccaagtcagaagccccagcgtgatgccttcaggctgagtggttgtcaatcattcctctttccaacctcaacagtcgctagagtaagagtgtaatgcctcctgggtggagatccaggtaaacaagcctgagggccaagaacaaagtgagagagcaaagaaagtttgtgttttctcccttctgttttaactccatggcaagttaaatccttcacctgtcttccccagctggggactttggtaaatgtcacgcagacaccctgaagacagatccacgtataggaggcctggggaagcctaaggaaaacacagagctgccagtgcctaaggaacagatcgtgctaagaagcaaaccttgacttcttctcctcgttggctctctccaaagccagtgctactcagcctttaatgagcacatcaactgctgagcatcttacaatgcacagggtgattcagtgggtcttgggctgatcacaggacctacagtcctggtccttgatcacagctacagtgtcacagctacagtgtcctccagctttactccctgcctcatctctctcactttcatttttccactctacataccaatgacttgaaaagccccacgcacaccataccgttttacagctgtgtggttttgtatatcttccctctgcccttctctttagctccttcgcatctccgttcatgtgcaacccctgccattaaacctcctcaggctctctgtccacccaggaagtctctttcctttgcattcaccacactgtgattctatgcagtttgcttatcgggaggcatagcatagagttgctcactctgtgccctacacgaagtctcctagctaaagaggcaagaagggctggatcacacactactcttcacttgccaaacctgtcttattgcagatccagccaacaggatggcagtatctcatacacaccgacgcgaatgtgtgctggcgggctgtgtttctaccagatgtgaagcctttgaagaaagctcaagactcatctttctgtatcctagaacggtgtctagcaccatgaatttcactgacaaaatgttcagtgaataaatgaatgaatgagtaatgagagaaagagctggaaaggtactgagaggatgcacagaggacaattccatttcatcctaaaggtaaaaacagcggagctgtgagtgagaccgagggatgcattaacatgcctctgagaaggcgagattgctctgtttcgctaaaaggactgactatactggggaaatcagagagaagaagtaaaaaagacttgtcagaatcttaggtggactccaaactaacatagaaaccatatcaaccgcatctcttttgtttggatccaaggaaagatgagggagatgggatttcagcttggttgttagaatccactgaaagcaatttctacagtagaaaatgtgcagtgaatgggaagctatttgtaacagagcccttaatttcttcattacacgcagctttcatttacttaattcacttcttaatgtgcagtgtaagaagaagcagacagctggtttctgctctcagttcccgattctgaggtctcaacacccttgacatttcctgaatgacggagatggcaggtgcaccgtaaacagatcccaaatctcctgggatttcctgagcacaggatcatcttttgttctttttaaattagatactttgtgtatggaatccacctgtgtgtgtgtgtgtgtgtgtgtgtgtgtggtaccccagtgggctagaagaaggtgtctgatcccctgggactggagtgacaggtgcctgtaagctaccacgtgggtgctaggaattaaaactgggtcctctggaagaacagacagtgctctttaactgctgagccctctctccagctctgaatcctttattctaataagatggcttttggtggccacctagatacgtcatagtaagagctggttgagccacgacttggaagtttagaatttctggcagcaccccaatctctgagaaggggacatgactagggagtatagtattactccgatcataccctagactgtggagtttggaggtctctgggtgacaaacgcacccatgaaccagccggttggtgctgctcagttccacagatcagaaggctctgtggtattcttggagcctttctctttctgtttatctctacgctttagcacactccataaaagaagccggtggaagcactgaacagttcctctcggttctgtgagcctctgtagcaagttattgaaccttaggggcaggcaggattgtaggagtccctgtttgatgcccgacgttggtacagagtgacagaggcctgagtgtacctttggcagcagcaggcaggcaagccttacgtgggtgccagagcccagggaatgtcaggagtgagctgcattttaaaacacccagggggtatctgcagagttggccaggtgatagctgatgaaagacatcatatgtggttgtgagacacattatcagagaagcaataccgcttttattttaaggttaaatttggaagcaacacaaagaatgtgttgaattataattataattgctgaggttcttaacctttttcaagaggcacacaaaccaaatgaataagtacatatatacatatatatatacatatatacatatacacacacacatatattattttatttatttgtttgtttgtttatttatttattatatgtaagtacactgtagctgtcttcagacacaccagaagagggcatcagatctcattacaggtggttgtgagccaccatgtggttgctgggatttgaacttcagaccttcggaagagcagtcgggtgctcttacccactgagccatctcaccagccctattttatttttttttaaaagagaggctctctcagtgtagcccagactggcttgtagttcataatcccactacctcagacttctagggttacaagtgtaccccaccatgcctggcttaatacagtcttctaaaggtttctaagatctgctttgatgatctcctctgtcttagccaagcaggtctctctaacaaggctacaagctcttacacgtttggacccagatctaggtactgtctgtacctgggactcgtgttgccaaggtactagatctgcagggagtttacagctgtcaatgccgtgttgaaaattgagacgtgtaatgcccttcaggcaaaatatccagaatttgactctggggctgtgagagagagtcctctgtgaagtgagctgacatttgcaaagccccagcctgggcttggctttctgacagctccttgctccccttcaggcctgctgctgatgactgtgtttttgcagcaaggagaaccgagagtgttgtatactgtactctgtcatgtgacttcaggatgaaatgtattcaaatcagaaccgtaaatgagcacacccacttacagagaaaagaaagtggggtaaaaatgtaagaattacctgttttcccccttaaaagtttaatcccaggcctccacactctttgaccagtggagcagccagtcaggaaggtgcccactcgtcctttgtacctcgtgctctcccttagattcctgtagatctcttacagcttggcacctcaaggactttgtctacatttctaggactagatgtgtgatgggagtgatgtaaaattattgagaagaaaagacatatagtctccaaggtgtcatacatttcgatactatgacctccaagagcccatttatgcaaaggccaaaaccgggggaattgcagtttcctctttaaaaggtaatacagtatgctgactttttgtgttttattctctggaatatttatagacggcaatgaactagtcaattcctttttgctttatgaaaataagtgaagggacgagaatgcttcagcagtttagaagacttgctgctcgcgtgcagagaccttgagttcagctcccagcacccatgtcagacagtacacagctgcctgtaagtccagccccaagtgttacaaaaccacccgacctctgtcctctgtgagcaccaactctctctctctctctctctctctctctctctctctctctctctctctctcacacacacacacacacagacaccaaaatccagaaaagttaaattctaggatgttattttttaattagttgtttaaattagcatatataacagtgagcttcatccatacatttttggtcctaccaacccctacccacctaccctgcccctgcccttgccctgcccatgttccccctgtgatctggcccctgcccctgccctgcccatgttccccctgttatctggcccctgccccttgcctgcccccaccccactgccccgcccctcaccccaccatcctgccctggtccttttcttatccagtttccctccagctctgttttcacaccacattatcttctctcatctcctcattagctcttccttacaacctctcctcctcctcctcctcctcctcttcctcttctttctcctcctcccctccctcctcctcctcttcatcctcctcctcttcgtcctcctcctcctcttcttaatgttcctctctactttcatgagctttctcccaacacacatatacaaatacacaaaaaaaattaaaagctagggcctggagagatggctctgtggttaggagcagtggctgctctttgagaggacttgggttcaatttccagcttccgtatagtagcttacagttgtctgtaattctagtcccaggagctctgaccctctctgctggcctcttctcacactaggctcacacacggtacataaacatatgtccagacaaaacactcatgcacataaaataaaattttattttatgtgcattttttcctgaaagtgttatgatttcataaataaataaaatcctgttgtatacatctgtcacagcaggatagttctccttatccactcatctgactggttctgtttctcagctactgtaagcagtgcgataagaagcatagacatgcaagctctaggaagtgctgtcttggagtccttccggtgtacacggagaaacagcacacccagtcactgtggttccgttttaatttcccatccgacgtgtataaggctcctctttccctacaccctcgctccatttgttgtcattggcttccttggtattagccatcccagaatgtcatctaacaagcaattctgattcattatttataaagatgtggctggaaattatttgtcaaaccaggtcagaccttgctctgaggtccaggacctcagaagacagcagaaggtcttcttttgaatgaccacatagcaacaggtagccaaatttcttactgtatgtcatgaaactgcttcagagctcagttttaaaactttaattaaacaccaaaaacgctaacatacggcttgtgtgtaagaacggcagcagccataaaaaaacagtcttaagttctcaccgtgtatcaggcacgagtctacatatggattttttttctccataacaatcctcctcctgtttgtcatataccactgttgtcctcatttttaaatgcatttttattatttttacttcaggtgatcctgaaggcaggagggggctgctagtgttcctgaactagaatcagaggcagttgtgagttgatcagcatggacactggcagtcgatctggacccccaccaagaacagtgtgctcctaactgtggagccattgctccagcccctttgtttccatttaatgttcgaggcacagagaatcacgtgctcagagtcacagctaactagtaggcctggcacaccatatccagattccacacacatttgatttcttgtctggcaattgatttccccagttggaaaaatcatatctctagctactctccttcaatatatctgcttgagtaattgagtgttaaattcaatagtgttttttcagacagctcccttttccaaagtccatggagaagctggctatcagcccatgaagccttgtgcacttccgacatgaaggaaccagatgagaccagctcttgtgtattggcagggagaagggggtctttccattcacttagcatgaagcatcttgaggctgtggccttccctgtccccccagcctccacagcagccagcctctatcgaggaggtctgagtatcaagttcacacgatcagcctcaaagacatgtcatgtgctcctgatgcaggaagatctggcctcagccttgctgaaactcacatgcttcatgggtaggcatttaaggaaacaactgaccataaatcttaagaaagaacatgcgtgcggatgcagataaactatcagtttcctttccttttgctgaaagtgtgagcaatattataaaaacgaaaaaagaaggcttcaagtcattctattgataatcctgtcctgtggatgagaaaacaccgaaccttgggatagtatagctgtggcagaaatctaaacccaccccccacaaagcaagaaaaccactttgaaataccatgctcatgatgcgcaactaatctgtgacttgaaaaaaaatagttttagctcattttcttggaagaacaaagagggagatagagaaagagagaagaaggatgaggatgagaagaagaggaagaggaagaaaaggaagagaagggaaagaaaacaaaacaaacaaacaaagaagtttgtgtggtagaaatggctcctaggataagacacatggctcagagtgaacattttcatttacttaaagtttaattactcacccactccataattctagggcatcaggctcacacagtagcttaaaaacggaggcatgtctggtctttggcctcttcgctgctgtgctgctatctgcttgtccttcgatgtctgatgggacccttttatcttggcagaattctgagacactctcaggagagtccttcttttgttcgcaggcctacataaggaatcttgctgctgtgtttgggtccacagcactcagggccaggcccccacaggctctgttctcctcctggaggtctcaacctgtgtatggaactgtgacaagtgagaccagttctccgactcttacagaatccatttcaaatccgctgcccctaccctgacttgctctgcacagaatgcttgcctgctctttctcttctcagggacaggccacctttctcctcttcccctccaaaaccccagtcttccactctctgtccttgcttgctttttctgtcgctgcgataaatcaatctaatcaatattactaaagcaatttggagaaaaggctgaggcagaaagatcacctgggttcataggttcaagactaaactggacaacagagccagaaccttttttttttttaaaagaggaaaagaaagctggaggagaagaagaatgggggagggaggaatggtggaaatagacagtatatgttgtggggtaatatcctgtagaatataggtcacgggtgtcagcctcctacttctaatgattgtgacatgggctttgccaagaagaaacctgaggcaatttactcaatctgatatatttcctcagaccaataaaggtcagaggacaaatggcctttatacaatgttattccttatgacaacacttataatagaagccacctgaaaataatctacacttctactgataagtagctggttaaaaggtaattgtattcttcttaagtcgaatacaattcagccataaattggcataaggaagatctctgtgaactgctgtagagagatctttagggtattttatgtggaaataaaatcatggtgcaggactcaagtatgccatagtttgagtaaatcgttgaaaggagcatgtctttatctatacggttgcatgtttataagtatgggaacccaaaagagtcggttacttagagagaagaactgggtggatgtggaacagggaagtgagaaaggagacagaaccccggagcatcccggcaggagatccatgccatattcaagaggcataaccacaggattctttccaagggtgtggacagggctaagagcaaaagacagggacatagcgagcaagcttcggaggagaagcgctgcggtccgaggtcctgaggaacaagggaggcaggggagggaattagcgaaccggcactcaaagaaagcttttgttggtgagaaagaacaagaaacccagccactgtggcctcactcctccagctgagaagatagtgggctagagggtcccactcaaccctctcctgactgtgaatcgcttattagtgcctcctagtgggcaaattgctgatgtcgccgaacagaaagggttgtctcagcctcctttccgctaagcccctggagctgaccctgcagctgcagcactgttctggagggcatacagggaacagtcgccattgctttctctgtagctctgaggagtttctctgagtttaaccacacaaatatgaaacatatgaaaaggagacaactttcgtccacacacagtaatagtaataacaataatgataatcattaaatattaacaattaataataactaatataataataaaatttaaaaccctccaaatgaagggttggagaaataagtttccaagacctttctcccagtctaacttgtctctgaagctcgtttcaccaagtctcagtccacggcgccacctagcgtccaggaggagcttcacatgctagccctactgcctccaagcctcctggcaggtaagcggttttcactgtcaatcagactcaattgggaatgatcttccataaaagggggatatattttgaaacttaaaatatttggagtttttttttcttttagaacaatagtgggaaattatctacattcatttttagattgattcattattatgatttttctgggagaatatctttcaaactgcttctaaggtaaataccgcctgtgacaccccccacccctaccccactaaagattctgtgagcggcttctgagtttgtccctccccacttacgtgttcttaatacagagcatctcaatcctggctgcaaaacactcacgcggacaagcttctgccagagatgtcgttctcactgatttgtggaggggctgtttaaagcattaatgggcacagcgaccaggagcccttgcttgtgctactgagggccctgaggtgaggtacgcacctgcgactaggaggtgcaactaggcccgtgtaaaggatgttcgagctccgtgttcctgctcctgattgcacactttgcaccctgcctcctcttctgccatcacaggtctacccatattccagggcctgactcagagttatctcctctaagacttgctccattctcattcccaacgttagagtctctgataactttaacaatgacttctataattctttttttataatagaaaaaaaaaattttttttttgtttttacataggggctcactatgtagcccaagctagcctgaaagtcattcttgcctcagatatcttgagttctgggattacagaaccattatcataatggtaataattaccatataatatcatataatattaatgcttataatatattatctagaatatattatgccaagtttaaactattcattttaacctaccaatttttagcagttaaaagtataatatttatgtgagatataaattaaactcttcaaaataggaagtgtgaccaacataaggaaacagcttgaaaaatggggggaaatctttgccagctataaatgtaaatctagaatacacaaaaacagcaaaaattaaacacctcataagactaattgcaaattagtaaatgggctgatgaactgaacaagcagttcatggaaaaaggaaaatagccaaaagatattttattaatatatcgagctatatattacagagatatagaaataaaaacaatatggtactggcacaaaaacagacatgtagactaatgggggggaaaaagacccaaatacaatacaaacgcacataataacagccatctcatattcggccaagatgccaaaaatgcacactggagaaaaaaaacagctcattcaacaaaaagtgtgggaagaactggatgtccacacgtagaagaatgaaattcgagccgtatttataaacctgcaccaaaggcaggctgcaactctaaatggattgaagatcttattgtggagcctggaatgccgaaactgttcaaagaaaacatgggcagtggcaccgcaggcacaagaaatgacttttgttttgtttcctttgttttgttttgtttttcaaaaaacagggtttctctgtgtagccttggctatcctggaacttcctctgtagaccaggtgggcttcaaactcatagagatccacctgcctctgcctcccaactgctgtgtttaaaggtgtgtgccaccatcacctggctaagaaatgactttctgaattcaactccgtttgcacagaatttaaggccaacaattgacaaacagaacctcgtaaaactaaagagcttcagtgcatcaaaggaaataatcaaccaagtaaaaagaaagaccatgcccccaaaaggattagtattaatgtctagaatatacaaagaacaaaaaacaaaaacaaacaaaaaaccctgaacatcgaagaacaaagaacccaagttttaaaatgggctacggagctgaacagtacattctcaaaacacaagtggccacaaaacatttgaaaacatgttcaacatccttagctatcagggaagtgcagatttaagctactttgagattccattttaccccagtccgtgactatgattaggaaaacaaatgacaacaaacgccggtgtcgatgtggaggactggggacagtcgtgtgctgttggtgggcgggtaaacggtgcagtcactttagaacttgggctgaaagttcctctaaagactttaagtagaatgaccacatgaccctgcaatgtcccttttgggcacatatccaaaggacttgacatcctctcagagacactcttacatccatgttcactagtgctctgttcatggtgatgaagacctaggatcaagcagacattcgccagctgatgaagggatacggaaagagtagcacatttatactagggaatactcagctgcaaagatgtgcagagctttggggggccgcttggcaggaatttgacactggaccataacaaggaagggagctcaggcaggaatctgatttgaaggtagaacaaagaagtaggcttcaggcaagaatatgactttggtctaaaacagggaagtaggctcagataccttggtcatcctgataagcccctagaaacagtgaccaagggagtaatcacaggacttcatttattgccttacttgttccttgactatttgtgtttattgtcttgcttgttcctcaatctagaactgaccttattattcgcatgtaattaaaatgatataaaagcagagtaggaaagaataaacccacctcagtctcaggactggctggggtcatgctacagtgttgtctaattgtctttttttttctctctctctctttttaatcctcactcctgccctggagcacctgttgactgcctaagctgacttggtcaaaagaaaaatgtcatgaaaatttcagctaaatggatggaaccaggaaatatatatttactaaatgaggtcacccaggcccagaaagacaaatgctgcctttctgtcccacaagaggatcctgccttcaaatactttgtcttgggtgtttaacttgaagaacaaacagatctagaaaactagaaatgggccactgaggctgggcattaagggagggaagacaataaaatacagttacgatataagcagagagggaggccagaccaaccgaaggttaagcatggggaagtgtaagcaagagaagggttaacggaaatgaagggcgtctggaaaaggtccatggaaacctatgatcttcaagtcccattaaaaaatataattagaggggacagtagaacacatgcgacacaaaagaacagggagggaatactgggggttgaagggttaagtgtagatggaggcagtggggtgggaaggagggggtgggtacgatgtgagctaaccaagacttaggacatatgaaaacgatttatggaaaaccacaagtacgtatgctaatttaacttgtttttgtttttgtttttcaaagaaacagtctaaacagaggtgctctgcattagtggaggaagctgctcccaacagacataggttattaaataaaagtctcagtgccaagtatgaataaggtagcaatcaggaagccctaaaataacacgagcgcttgccattgttctgggtgagccagcagaactagatggtcagatcatattggtgagaagactccacatactttgtttgcaggacataaagaaattaacggtgccttgactaggagactaggagactgtctatccactggctagcttctcatcatgatgggaggagctgtagaggctgctggggtctttccctccactggatcccgcatgctgcaatactaacctgccagatcagacaggcaaaattaatcagacttttacgggagggtagggttttgaatacgaaatatcctatataaagcacaggcatttaaactcttcattgcccacttgagagtgctctctgggaagacttaggaggtgtggcctgctggaagaagtatgtcactgggggcaggctttgggagggtttgacttggttccacttccggttctctctccgccctgccccccagcttcctgcttaggctgccacgcccacgtgctgccacacctcctaaccatggtgggctcttttttcctctggaaccataagcccaaataaacgcttccttctgtgcgttgccttggtcatgtgctttatgatagcaacagaaaagtaactaatacagtgataaattctaaattgatttgaggcctccttcccaggagggatttcatgcctggtaccgtgaacctaatgaaaagctcaagcccgagcctgtagctggggagggcataggccttagaagtaaatcgaattgttgttgtttttctaaatggtcatgttccctaggtggggcagtctctggatgaccttcccttcagtctctgctccattttttgtccctgtcttttctttagacaggttaaaatttttgaaatgggtgggtgacccccatccctcaactggggggccatgcctatctattggaggtggtctttacagttctatctcccctgtgttgggtatttctgctcatgtcatctccgttgggtcctgggaacctctcacttccctggcgtctaggactttctagtggctacccccagttccccgtcccccactgctacatatttcgattcaatttcctgaccctctatacttctctcctgtcccttctcacacttgatcctgccccccttttttcccctccccctcttctctctccctcctaggtccctccctctgcctcctgtgactattttgttcccccttctatgtaggattgaagcatccacactttggtcttccttcttcttgagctaaatggtcttgttcatctgccttctaaatatttatgtttatacccatagactggtgctgctctcaggctgggtgagagaaacttctctttgcattgggcagtgatcaatgcagacaatcaagcctggtcaaagagatgagaataactgactctgaatggtcagccacggatggaccactgacctcagcctccctgacccaaggcttagcgaacaccaaggaagagggagcaggaagaacagagagctgggggctggggggtgtggagggcagggcatcaggctatgaacggttttcttgggatataactggcctttggcactcatgaacttgtaacagttgtggagacccacacaagattgagcaagtcaaaatgctagcatgagggggcttctgagcccccaacccaattgcaagcattattggcagtctacggacaagggagagaatgtcacttttctttgggaaatggtcactggtaggttggccatgcctcagctgacggccctgtgcccatgagtatatgggcagcagtaactgtgctcagtgagttcttaaactaaaaataagtgctcgcttcagcagcacatatattaaactaaaaagaaaaagaggacatgaagttaggaggtaaatatgttgcaggttcattaaaaagaactgaaaggggcagtaggggtgggcataatcgaaatacattgtacatccacaatgttaaagaataaataaaaatagtattttaatcaatgtcacaatatgagtttgaggtgacttcactgtctagaagcctaagaatctaatcaaagttcctagtacacgcttttctgtggtgttgattttcagaaaaaatgctttataccaaagcatgtcagtgagaaaaattagtttcataaaaaaattagaaagctattgtttaaacttgcaatttttttttcacagcaaacattatttgccacaaaaattgttaaaagattggttctgctttcaattgaggaattcaaaagggacttgttcattgaaagggtggtgatgttccgagttggcctgttccagaggatgaagcacacctgcttccttccttttctctttctcacaaaacattaaaaacggtttgagtggagaggaaagtcagctcagcgaatggggctacccaagagcctctccatcctgcaagacctaggtactgtagagtctcacagggccactgtccatcctgctcctgttaactcaagggctacttctagccacatattgagactacttacatggaccgagatgcacaaatgctctcagttttgggcactgatgccagcgtgaatactgtgccagcagcaggactcgatccccaagggcagtgtggcctcgtctatctgctttatgtctctgtgatgtggcctgttaaaataatatgaagtctagcagctgcgggggtttgtagggtacgattcacaattccacatacctttatgtgaattgcattgcttaatcctcacaaaaagttctttatggaactttgaaccttagattaggactctggggttttgttgttgtcttgccttttgttttcttgtttatcaggctagggaatcaaacgcaggacttcccacaggctagccaattgttctgccactgagcaattggtccaagaacctaggttatggaacacatcggtatgtccctagagcctttggtattcagatttcatggtccctggcttttgataatgggtgttagataccagtgtggtatttggttgagttggcgcctttcccatgcttccttgggcgtttccaactgcagcagcagcagcagcagcagcggggccttccctcacgggttggtatcttaagtagagctccagctgtgagcatgggtgtatggagatacagaggcttctcaggcaccctcgaaccaatgagggggatccgttcccagggtgattgggcatcagttagccatagcaggaacatgctttttaacttcttttttctgggctacatacattagccacaagaggggactgcatgagcaataacgggctgctttgagaaagtcctcagagtccccatcgctccaccccatttctggagtctagaagattccccgtctgcttgccacattttatgcagtgttttcccctgagagaaaattgggtaaccacttactgattttaagcaatcatgaaaaggtgaactggttttatctgcttgatgacttaatgatgaagtgtatactggcaatggccaatctccctttctaactcatacatggcaggtctgaacttacgtttccccttcttggtaaaggtaagaccgtggaaggagtcctgccatccttgctgggttgtttgttggtctcctccactacagaagaatcctgaggaaactgtaaccactgtacttgcacagagttaagaatgggtaggatgtagaagctggaacactatccttcctgcctccgggtcctgccaaagatgaccttctgattgggaagtaaaagccagtggtggcacaagacctgaccaggaaagtggggcagaaagagagagcttgtcctgggttgcactggcatctcaggctgtgtctacaacaggggacactccagtgatgtgtcatatgttaaatgactcccatgagcgaaagttaaagggattctactgctaagtgctttcattccttgatttcatgtgtagctttcaacatcgagtctgggtgacgtatttgcttttccctctcgtcgttccagatccatggacgctcaccacaggaagatctagagaaattgcttatttccaataatccgcaagatcttttgctttgcttaagatacacaaatttaatattttccaagtaaatgtaaaaaaaaaatgtggtctcatatgtttccttattggaagaattaagagaaaaacaatttttaggaattgaataaaactagtaagtcaattggatataaactattatgagtacttagcaaaaacaaaaacaaaaaaaagctcagtttgttaaattattaaaaatctggaccctgtattcagcttttaatcttcctctgtatgtaaaccctgatctgttttaagcctcagtttccttatctgtaaaatgggctataacatttatctcctattataaagaggataaaaattaaagagcatacagtggaacttaacacagatgtaatgaatgctagtcattatttgtgcctctagaccaagcataaaacacaagtttttttgtgattttgttcacaagagtgcactactgtttccaagtgtactgttaaaggcacagattaactcagctcttggtttttagtatttgaaaagagtaacaacctgggtagcattatcaccctcacggcacaaaggaggaacaagagctgagtgatcagagtgagtcaggcacccaccgcatccaccacacccactgcagtcaccatgtccactgcagccaccccagtcaccgcatccaccgcagttactgcagtcactgcatccagcgcacccactgcagtcaccacatgcattcaccacagccaccatactcaccacagccactgcagccaccgtatctactgcagccactggagcctctgcctcctgtggcatggctgatgcacactccagacaaggctctcgttgggagatgaggcaagtttcaggcatgggggttcatgcctctcagaatcccagtgcacttggttttcagccagcagggagaattgggaggctgggcgtagagagtagagcacacacaaagagaataaatgggatgctttctctattttactcctgatgagctacctatcagctatcttgatatacaggagatcatctaaggttcaaaatcctaattctctgatcacactactaaaacactaagtttggaggtctggaatttagccaagggaacctgcacataaacatatctacaggcaatgcagaggcagatgacctgtgaccactccttgaacatgatccccttgacaggagatggaaatcatctttaaataatactatccttctgatttagaaacacacagaagatactccaaatataaaattaaaaatcacagtaacactttgtagtagtatgattatacttttggtaattgtgtccttaatcttttcaaataaatgataactatgtcttttgggggcattgtcagctatttggtcacattttcttttaagtacttatacttaaatatactgggcattcagttttagagatatattccacttaggccaattcttttggttttatagatgattcttttatgtctgaagtgcatgtaaattgattctaacattcaagactgctctaagaagtcaaatttgtaagatcctttcaactcttggattataaagagtaactatctttgggacatgcctttagtcccattgcttcaaaggcagactgggagatctctgtgagttggagccagcctggtctacataccaagttccaggctagccaggttgctacatggtgagaccctggtttaggaaataaggtggacgacaactgtaagattatttgtcacataacttatattatcttcaaccttgatgagcctctgaaattgtatctttcagaactcagagattaactcttgaactgtgacattttgtgcaggtctcctgatgtcactgcctatgaaaggtaatagccttggtccacattgttgtgggaacactgtagcgtgtgcttacataaacctagatggtacaggtcactctgttcatgtggccttttgataagattaaatgacatggtaaacaaaagacatgtgaggctggtgctggtagaacacagcatactgttttatagaatctttttaataagcaggagggatagactctaataaaataagaaagcatagcaaataataaacaaggaatattgttgctataattaccaagaccatgcttggtacataatatatgtcctatacttatatgggagcacatttgtttacagcaagtccacagacacacacacacacacacacacactatacatacatacatatatatacacatactatacatacattataatatattaccatatcactctttgataggaacttcccagctctaccatagtcctgtaggaccactgtggcttatttttttaataaagcattatttatcccatacctctaataacatttctttgaagtggccaacaagtacacgaaaagatattcaatatcagtaagcataaagacatacaaataaaatccacaagggtaatattttataactagcaggaaggccactattaaaaccaaatctgggggctaggaagatggcgcaagggtaaagtgcctgctgagctgtgtgaggatctgccctctgatccccactgccacatgacagctgggtgtggtagtatggtgagttccaggttcagcgagagactgtgccagaaaataagagcaatagagcatgaccctgactctggcctctaccagcacatgcacacatacacacagaaagacacagacacacatggtggaggaggggggagagagagagagagggagagggagaggaagaggaagaggaggagggagagggagagggagagggagagggagagggagagggagagggagagggagagggagagggagagggaggagacactaaaagcaaaacatgctgatgagaatggaaaattgtaacctccctcccgacactgctgatgggattgcaaaacagtgcaagattatgaaaaacaggaatggtagttccttaaaaatattaaaggtagaactatcacatgatcggggtatatgtgcaaagaatatcaatcagaatctcggtgatacttatgcatggcactcctcacagtagccagaggtgggagaaatgcaagcatccaggatggatggatatgttaacaatatgtgcacacacacacacacacacacacacacacacacacagaatggtatactatcaggtctttaaaacaagaacaacaaacaacaaaaataacttgtcacagactacatggctgggacactatgttaaatgaaataagctattgtggaattctatttatatgaagtatctcaggtagacaaagtcatggaaacagaaaatagaatgatgtttgccaaagtcttgggggggaggaaacgagatctctgctaagcaagcgtggggttttgtttttgtaagatgaaaaggttcttgagatgtaaacatgcttgcactaccaagttgtacacttaaaatataagcttgtgaatttatttattcctatcattatttttttgaagacaggatcttgctacacagcacaggcttgtctggaatttctggtcctcttgctgagttacaggtatgcatcactaagttcactttcttaagtagtttttagattgttgataataaaaatgtaagtaactaaaagtggtaatgataaaaagagaacacagtggtcactttataatagtttggatgttataaaacgtggcataaaattaatattatgagttggtctattttttatgagaactgtatatttctagaattgtactccttggaatttataattcctaattatattaaacctagtgatgaggataagagaaagaaacttgctaggcagttaagggaaagaaacgttgcaaacaagcccttctgctgtggccaaaagtatccttggctccaatgacagttctggtctggccagagggcagaacatactggtttgtgttcttagatgtttacttgtcttttttctttagtacagtaatctaatgagcatagctgcctggaagctagacatactctaatacttcattggtccttggaggtgtttacaagaacctcagtccagctactgcaatagagaggcacatagacacctcagagggatctatgattaggtaagctaggctaaccaggtcacctccctccagctcagccctgtcatttcaaaagccaatttacatcctctgtgacaagccatattaacctctagacaaagcctcttagcagctaacgttctcttgggacccatttcaccacataggggctctgcccacttcctctgtacaataattctctttaagctttctctctgtaataatatccccttttcaaaattcacccagtgaaagtcaatctttgagttcccaagacaaaggacactgagtcactgactcatggggggctttggtgtaaaaaccaagcaccctagtcccagaattaagcacacctgagacaagaatgtctctaattctcaaaggccagattcctcacatttcactcctagaaaatataaaaataactggtaagagcaggacagaagccaacccataatattccagaatggcttgttacaagtagatattatatttaccttaagtgatacagggataacaaaacagataaaaaaaatttttttttggctaaataggcagagaggagattgagagagagagagagagagaggtgtgtcagaattacagtgaacttttctgttctagggatgtggtggtttgaatgagaatggcccccataggactatatgtttaaatgcttggttcccagttagtggaactacttgggaaggtttcatcaggaggtgtggccttgtagaaaggtgtgtcccttttggtacctcaaagtccacaccactccagtttgctgtctgcctcaggattgcagttgtggtctcaacatggaagtactcggctcctagtgctgtgtctgcctgtctgcctgctgtcatgttccccaccgtgatggtcatggattcaccctctgagattgtaagcaagccccgaatcaaatgctttcttttctaagttgccttggccatggtgtctctgcacagcaacagaagtgactaagacaagggttaacaatgtgcccttttattccttttttaaataaagaatatacatggtattcaagtccaacgctttgttagactggaaagttggttgagaccaaatagactaattgctgctgttggctaacaaatctgttactggctcgtttttctttcctaaagataaagctgggtgtagctggctgaatctggtagtccatagcatttgggaggtggacgtgggaatagaatcagtttggggttagcccaggctacatagcaagaccctgtcacaagtaaacaaatgcgcaaaagtgaggggctctctctttcacttggttaggataaatactaacttctttacttatcttttcctttgtgcttatgtcccttcccaacaatctcatttgcttattaattaagagcctaattatatgcctcattaaggctcaataatatgtttccttgcctttatggtgccaagtaatatttaactgtggtttgtgagtagtcatgtggacaaggtgttagtagcatgtacattggtactatatacatatatatttgtattattgtttcccactgatattttcactttcacaatgaatctgccaatattccctacatttgcatcctggaggagaagcctgggtgatcactgggaacgtggcttgcacctggacatggcttccacccgaacaggagtgcacgtgaggaaatcaccacttggacccagcagaaagcttcctgacgcggcaggattgtgctacgtatctaatggagcaggttgagagacaccaggtgagggggatcattaggcctgataaactgtaagaaggggagagctatgctcctggtgcctcctccctggccaatgaccaaagcagtcttctttccatatgtatgagtgttttgcctacaggtctgtctgtgcaccatgagcatgtttgtgcccatgatggccagataatggtgtttgatcccctggaaatggatggagttacagatggttgtgaaccaccatgtggatgctgggaacgcaagaacagcaagtgttcttaactactgagtcatctttcaagccccctctgaaatagatttcaacacaaggctactgagaagtgttggaacacagcccccgttctgtgagaattctgagagcttgtgagaaaactgcaagaagacaagagttttgtgacctcagtttcttcaaaacacagaattgttcttggaatgtgttttcatgctcctcccaggcatagcagataggagtttcttcagctgttgtcattcgtatgcctctataggaaaagttgggttttgccacatgtggcttgtccttgtaactgaacacctttctccgtttgtcttcctaactctcagagtacaaattgcccgatgctctgaataaagttggcttttgcatgagattttagtcttcctcgtgaatggaatgagtatcagctccattctcttaagtccccgttgcctctagagcgataaacaaggggttccccaagtcagggacctgaagtcagctataagagtgggtacgctcacaggagaaggtgagcgagaatagtggggcagaagccagggaaggctctgctctgtcttgtgtcaagcttgtgcagcgttcctaacaaaggaagagcacacgtataatctctggtttccagaaggaggggttttagatgaagaagggcggggctgaatgaagaaaggcggggctgaatgaagaagggcgtggctgaatgaagaaaggcggggctgaatgaagaaaggcggggctgaagatcgaggaggtgacaacagcaaggggaaaagatccctgttcaattctgggtgagttgggcattgatttgaactgttattaacatacttaagcaaggtgaggatattaatcatgaaaaagacctggctaactctcggaatgaatataaactggatggtcaaaccttaacatggataaaagaggcgacaaaggaggttttctctgtgcaggcaagatcaaaggtagaaataaatggcaccacctatgcctgcgacggtttctctgctcccttactggagcagggaaatacttatcctccattgcttgaacaagacgctgaagcatgggctgaggaatttgatattccatctaatactgaattccctcatttgatgggagcctaggaaaaagctaactttacctaggcaagcaggggcatggcagggaaaagagactccatgaccagttcctcccgggcctcagatgtgcttggtatctccagggcaatttcagcaaaatcaaaatgcttatatgcactaaacaatctactttgaactctaggagggatggtgttgaacagctcttgcatactaccttaagaggcaaggaaagaactacagctattaggctgtggatcctgcactgcctctgagcctctgttctcatttgtctcccacaggtattttagcacaagacgacaaacctttggaacgtacctatttacaccagaaggtcataaatactagctgtttaccttacgctgcttactcgattagtaaacctggggaggacccaatgtcaacaattatatacgtttgatccttgctgcattatattacccttaacactcaatttttataaagcattacagaactctatggattttcaaacgtcatttgaaggttactatggaaggataagaaattattctccagctgggaaactatgggattttcctcataggaactgaatttgtaaccacaaagatggtccaaccttctcccatcccatgggcagatacttagtttattgatggctcatctaatggtataagacagatccatggcccagatactcatcagtttagtaacatgtcctttttttcggcccaacaggtggaactgactgttctgattcatctactttggttaatccagcagtatataagttatataagtataacctcagattctgcttatgttgtagggttatttccagcattctcctgcacacgttaaccttactgcttttactgtagattatttctatctatttctgtcctatttttacttctacctaagtagtaaaaataccctgggaaggggtctacatctgtcactgcagacggagtcactgagacgctatggactcctcttccacttctccagccccgggcccttgacttctagagtgcagggtgaggagacagcggaaaccatcagaaagatagcaaacccccagctaaagggcaaagggagatatcaaccacaccatcagagatcaagtctgcccacttggggccaacttaagatcctatgcactaagggagacattacttttcactaaggacttgatttattcttggaccctgggaccataatagaccataatagacccactcatccatctgatgaaggggctatatttaattctcttcgcgaggtttaaataaactttccatttgcacaggacatcataactaatatgtattcctatttaaaggcaaatatgggcttacattccataagatactagaactactaatcgtatgggtctcgtttcaagctattctctagatttttctgatcaatataatagcgtgatatactggacatagtttggatctcggttcctggtggcagagactcacacacaatgctttcgttgttctaacataatctgctggcttaggggacagtcagggatcaaaggacatttagctttatctacatctcaaatcagaactactctggataacctgctattagaaaatgagaaaaaaacggaggtgccggaacacagtcccagactgtgagcttgccctgtgcttatgagaaaacgagatctgggacctattccttcacaacacagaactgttcttggaatgtgtctgcatgccccgcccaggtgtagcagactggagtgtttacttccactgttgttattcgaatgcctctatggaaaaaaaaaatatatatatatatatatatatattgccacatgtggcttgtccttgtgattgaaccttactcatgtgagtctccctaaccctcaagagtatcaactacctgatgctctaaataaagttggctaatgcacgagactttagtcccctcagttttaggttccactctcccagatacacgctgccaactagagcagtgaacagggaagctttcggcctttggcagtctgtccagaccacaaatcactcagcctacagcgggaattcattccaaagcttcgggttgaatctgaatatttccgctacgctgtaatattttcaattaaatctctggcaaaaattgaaagttaaagtggagggaataacacaatgaattcccaagaatccctcattcagcttgaaatcttagtaacctgagagcaatcctgtctcatgcatattacttatcttttcatgtgcctggttacttccacattgctttaaagcaaaacagagctcagctatcagtttgcagaaagtacaagtgattaggagtccatccagaagcaaatgcacgccatacaagtgtaataaatcagatgctgaaagcataaggaagagccacaaaccccagcagtgcctagcatcacaggctcttaggggggtccccagacattacaagtgggacgcttagaaccaaaatccatttgtggctttgtctcagaaacctgtgactatatgcaaatacacagagcctagttttagtctggtgactaattattttctactaatccttctctcgatactcttgagacagtgcctgaaactctacattactgcattactgtctttgatttgccagtgatgcacagccctacctgaagcaggtcaagtggaacattcgactgttaacaaggttactgttttatagttttagtacaaaaataacatacattctttaaacataatttagaaagatacaaaaaagcccaaaggaaacatattaaatgcccatacttaaagggatttttaaaacatcaacattttggtacaattttttttccttttgtgaaaacgtgtttcttcataagcatggaatattttataaaatatgtgtagaccatttgtattacttcataatacaattaatatacttttatagcatattctccaacatagtttttttatttttataaaatatgccattataagtaaagacaattctatttttggaggacaactatatttttcttctgtggtatatcaagtgtgtgtgtgtgtttaacttatttaacggagagcctcattaggtcagactggcttggaattcataattcctgtgtctatctttcacatacaggaattacaggtttattagtcaaggttctctagaggcacagaacttatagaatgaatctctatctatctatctatctatctatctatctatctatctaccatctatcagtgattcattagaatagcttacaggctgtgatccagcaagcccaacaattgctgtctaccaatgcaagatctaagaatccagtagtagttcagaccataaggctggatgtctcagctggtcttcggtattcaccagagtcccaaagaagtaggctttaattccaagaagaaatggatgtgccagcgaaagcaagaacaaacaggaagggggcaaaagctgctttcttcctgcatacaggttgccagcagaagctgtggcccagagtctcacctcagaacattgagattagaagtgtgtcttcttcccactgccaatgacttaattcataaacaaaaccaaaatccctcacatgtgtacctagccactttggttcccgatgtagtcaagccggctaccaagaatagccaaatacaataggtatccatcatgcctggcttatgaggtatgatttaaggctaaaactctgtgtctccttacaaaataatataggagggtctggatatctgtctctttctccatgcatagaccacataatggcactagtctttatagaaattgtatcaacttatcctccaatacatggtttatagaggtacttgtttccatgcaccctgatcaagagtactcttgtaataaaaaagttaagtctgatagaaccaaatatgtacctacttttaccagtttacgtgaggttcaaagtcatccagagagtttggctggagtggtgatggagggagaaagtggtgatggggggggggtacggggggacagaagatttgagcactggaattgttagcacatttcacaatgttaaagtatgatctttgaacctcaggtcggtctatattatataacgtttcagtcacagtgggtaacacttagggagatttacagtgagatattttacccatcactcccaagtgagaaaggaccagagggtctcctcctcctgtccatgttcaggccactctcacacttcaccttgagctggtctaaagactgctgggtccttggaagggagagcagtttttcttaggccatgtgaccttgggcatatccagcactttaactagcgatgatccagcaccatcatctgtggttttctgtggaattaaatcaaagcatcctcttaatttttttgtagaccttagctgctacaaaagatcacaggaggagaatcccacccagaagctcaccagtaagtgaggtcaaaaaaaaaaacaattaaaaattacttagaaacatctacactgcccatgattgcagacacactggtgaggcacatgaacacactgaagtagaggtagagcaaacattctcaatggaattgcagcacattttcacttcctctgccacgtgtacaactctgtctgaaaagtactagacaacgaagttcttctatgattttatattggcaaggcagagacctctctggacctcttgatttatccagcgggtgtaactcggatcatcaagattccgtccacacagatgaaaatctgaaaaatagttttcaggtctgctctgcttaaaatatcccaggaatgctgtgttggcctgtgggacacaccaggacagagattctaggagatcctctggaaacaaaaggctagtgagctgggactttagtcaacgtcttcgaaaagcaagcgttagaacaattacggaaagttacattgttattaaaatccggattgttactttgttgttacttttaaactttgaaagagttacaaaaagctgcagctatttttaaggttccaggtccaaaagttgagcaccccttcattcctcccaacccccaaattaaaaacatcaatacggtatctccagtctggatcaacacaaaacctaagtccatttcttttcctgaacagtttactggggctgcaaaagaccccatctggcttcgcctagcattaataactaaacaggcagacaagactgaagcactttagtgactgaataaagagcctgcctagaatgtaagctctgtacggccagggacatcaccagctctcactttaaaccgcagcacacaaaggatttgtgggtacagactcgaaccccaagccttggagtcgcagagacccagctccaagcgcagcccgggagtcacgtgacgcgcgctccgctcgccccgcccccttcaaccccggaggtcgcgccaatccagggatcgtgcaagtgggcccggccgctccgattgtcactgactgagcctgtcgcctcatcccggtccccagctccacgcgccaggtcgccagccagcaaggcgtcccgagccctcgacgtcctgccccgcggcctgcgttctgacgcggggcggtccgagggagccgggcggagcctccccgcgccgtgcggcgtgctgacgcgagcggcgagcggggcgggccggcctcggctcctcccgccgcgggcccactggccgcccgcctcccccaccctcggccggtcagcgtcccagactgcgtcgcgcagcatcgcgtcggcccggcccggcccggcccccgggcagatgccccgagttgccgctgtcgccgccgccgactcggccggtggcggtgtgggaggtgggcgcctggcccggggccgccgagcgtgacagacacggccggggccgccggggggctgtcggggccgcgcgcggaccatgtatttcctgagcggctggcccaagaggctgctctgcgcgccgcggagcccggccgaggcgccgctccacgtccagtctgaccctcggagagcgttcttcgccgtgctggccccggcccgcctcagcatctggtacagccgagtaagtaggcgccggcgtcccgacttcccccgagcggcccctgtccggtcccgacttccccagagaggcccggatctagtcccgattctccccgagcgaccctggccccgtcccgactccctccgaacgaccaccgtccggtcccaactaaccccgggcgaacccagaaccatcctgatcaccctccctatagtgaccctggaactggcgcgactgccgccgagcgaccccggaccggtcccgacttcccccgagcgaccccggccagtcccgactccctccgagggagcgacggcggtcccgtcccaactaactacccccgagcgaccccagccggtcccgacttaccccgagcgaccctcgctctcgagttggagccgcgcgcggacagtctccactgcaccccagtccccgcgtggcacccacagccgcgcgccaggcctggagctccctggcggagcccagacttgcctgcctctctgcccccattgcc

SEQ ID NO: 177 - DNA, 48126 bp, Mus musculus
aggagccatggcttgggagggccccaggttaggggcacactctcatccaggctaaccccactctccgggcctggcgaggatggagaagaggtgcaggtccacagccagaggcagtagcagaggtggtgttggggaggggatggacgccagaaagagggggaggggtggagggagagagaggctggcctgatagccgtgtcccaggttttagatccgggttgagaagggtggctcagagcatccaaggggggtcctgaagcgagacgaaggtacagtggacctgctggaaggaattcctggcccgggaatcaccccgcttcacacaaatccagattccgtgatgcgggaaacacctagcttggatagggtctcagtgaggagtcctggccccttagctagaccctgtgtagcctgttggtcctcccctctcctcgatttgcacagtccctgcccgaggggcgggtggaggagggagggaaggagggagagcaagggagggaagaagggaggctgagcagccgggagactcccagccaccagcaaggtcctccctggggcggggcggctggggttgggggagggggctggcgagaccgggagaacttggctgcctggcttactgaatggggatgcttggtgtggtgtggtggttgttcttgccaggacaatagctgactgacaaaatcaggctcaggcctttctgacttgagagaggcctgtgtggaggtgaggggaagtagccaagaggttgctgagatagcaacttgcttaggatactcgtgcaatgagggcagagcttgtaaaggtctggggtccggttttggacaaagattcaggggaaatttcttaggtttggtatggaaggtttggaagataaggtagatagccttatttaggatggggttttatgggtaggctctggaagttggcttggagagaggtggaggaggagtcagacacccaactcggagcccctgtgaggatacccacaatgataaatctactttctctgggccaggaggcaagcatgaacacatacttaaggctgtgttccaggacagcatgaagcaaaagatgagaagaatgcctgggaaacagacatgggaagaccagggaatacagttctgttttgaattggtttaaatagggaccaaatgatgctgtggtggttcctctaatttgtagcagtcaacaattccagttctcttgatataaaacttgtattttatttgttttcttaccccacttgttggttcattcattaactagctttatgtaggtccagtgctggactcagctgagttgggtaaatcagacttgctgcctgcccttatgaaaaccatgatctgctaccaacctgtgggccaggaagtcatgcacctgcctctggatccctctggtacctgtgaaatctagatccccaggcctgctctctggaaatataaatctggtaggtgggagaggtgtgaaacatttttagaaaatctttagatggttatttttataatctctaaatttgggcacgatgctttggaaagggataaaaccctatggactgaacataaattcgaagtggaaattagaaaggactttgggttgatctagaatggaaatctttacctgaaatcttgtgaaatgtgtctaaggctatgtggcaggacaattttgtagctttaaatttacacacacacacacacacacacacacacacacacacacaaaaggaagagtcggatttctgtctaaagttggaaaaagaggacacattagacttaaaggaaggtgtaaatagtagaattgatagtagagagcaatgggatagaaaatagagagaagatatagcagagaagatccacaaagttgaagaaggctctttgacagatccttgagacatcatgattctggaaataagaaagcatgtcaaaaggataaggagcagagagggcatgacactactgaacattaagttagatgagaagctattagaattataattttatgcttgcaattttgaacaatttgatacaatggaaatttgctaaaagtcacagaaaataacagaatatctgagcaatcttataatttttaaacaaactgaatttatgcctttaaaagctttagagagagagaggtctccaggagatactgcaagcgtgaaaacctgagttcaaatctgtagcaaccatgtaaaagcctggcatgactctgcctgcctgtaaccccatcattggtgggcaagggcaaacagatccatagaacttgcaggctacccagcctagccaaaacacagtgagcttccagtacagtgggggactcttttttaaggcatttctttttgtagagggcaataaggaaaaacatctggcattctgttctggcttctgtttgcatgtacatacctacacgctccccagacccagacactgtccaatagtcaattctgcaaaaaatattcagagaaaaccctccactaattttctaacttttacaaattctttaagggagtaaagaaaaattatgattgttcaacaggcgcaaaagaaaagtacccaaacaaacaaacaaaaaactcatagcaaacttaagttttctaagaattaaaagaagtttattaaaatactgtactttcaaacatcatacctaatggggagatattgaatgcttcctgtgctgggtagctgctgtcaacttgatgcaaactgagttacctgcaaagagggaacttcagttaaagaattgtctctagcacattggtctgaggaaatgtttgtgggacattttcttgattaatgattgatctgaaagggcccagaccactttgggcagtgctacttctgggcaggtggtcctggtttgtattagaaagcaagttgagcaagccatggcaagcaggctaggaagtggcattcctctatgttcctaacctgacatcccttggtaatggacctggaagcctaagacaaaataatcttgttctttctcaagttgctcttggccagagtttattacagccacagaaaagcaatgtaggacacttcctaagattgggaacaagactaatgtgtcgactataatcccttctattcaaattgtactgcaggtcttggtcagtgttaagaaaaaaaatataaaaggctcaagagaggggctggagagatggtgtagtggttaagaacactgactgctcttccagaggacctgggttcaatttttttaaaaaaagatttatttattgttatgaataagtatgctgtagttgtcttcagacgcaccagaagagagcatcagatctcattacggatggttgtgagccaccatgtggttgctgggatttgaactcaggacctctggaagagcagtcagtgctcttacctgctgagccatctcaccagccccctgggttcaatttttaacacccatattgtggctcacaactgtttgtaacttcagttttgagggatccaacccctcacacatatgcagacaaggcatcaaagcacagaaaataaaaataaaaaaatataaaaaaggctcaagataaaaatttcagtacagggcatggaatacttccctatgagtttttggtcaaagaagccacaggtgtctctaaaataacacagcctattgctcttgtcaatggctacccaccataactatatagtaaggctctaccacacactttggttgtagggcatagagaaatcaatctcaaactgaatagataacttcttcctttctggatagctttcatagtgccagaaggagcttggcacatagctgagggaggaaaaaaagtatcaatgtgctggaccttgaatgctacaattatgacctgccaggtaagaaataagcactggtacaagactggcacaactattatggggtaactaagcactttctgactggacttgaggcctgctccttagaaggaattttcattccaagtactgtaattctggtcaaaagaccatggctaggaagatacctgttattgttattttgctaaatggtcatgctgtcaaattgatttcttttctttctttctttctttctttctttctttctttctttctttctttctttctttctttttttttttttttttttttgagacagggtttctctgtgtagccctggctgtcctggaactcactttgtagaccaggctggcctcgaactcagaaatctgcctgcctctgcctcccgagtgctgggattaaaggcatgcaccaccacacctggctaaattgatttctaaatacaatcattctattgcacatgtatatggaattctcaaaaacaaagaaaaataaaaagttatatactttaagcatactaattttttgtatatcagttataaaaataaaggtgtatgataaatagaagagaaagacatgagaaaaataagcatgcaaatattgtaatatgcaaatattacagatatgaccgtatagaaaattgaaatgtatttaaaactatcagaattagaaaatttatcatggttatgagatagggctaatataaaaagtaggtctttctcctttttaaatgctctcaataatgaattagaaaaacgaagaagacattattaaaagatcttttattctttgaggatttcatatacatatacaatgaaatatgaccacagtgaacccctcccaactgtttccctccaattctccctgcatcccacccaacacctctccctagcaatgttagatgttctagcaatctaaatgggaagtgttccaaataggcttaggtacttgaacatttggttcccctgttggtggctctgttttgggagattgggtgatacaaccttgctggaggagggatgtcactggagatgagctttgagatgaaaagtctcttgccgttatcagttcttctgtttaactgttttgtttgttttttttttttttttttttgtatttttttttcgagacagggtttctctgtatagccctggctgtcctggaactctctctgtagaccaggttgtcctcgaactttgagttcggcttgcttctccctcccaagtgctgggattaaaggcaggcgccaccactgcctggcccgttttcagttctttatctctgcttcattgttatgattcaaggtgtgagctctcagcttcctgcttctgccactctgtctgctctttgccatcatacctctaccttatcattatggactcttgtatctctggaactataagtcaaaaataagttctctcttccttatgttgcctttggtcatggtgctttatcatgataatagaaaagtaacacacatgttaatatatatattagataatattatatattatctaagtgcatgggtgtgaagtaatccactggaacatgtgaatcatactaatggccacaatttcagagaagggttctccttccctcagcagctatcaactatcagtatcttcttagtaaagggcggggactggagagcttctgtcccatgtattcagggattttggctggtttgctcttgcgtaggtcttgtgaactcacagctgatgtgagttcatgaatgcgtgtcatgtccacaagtcagcatctcacaacactcttccccatctctagctcttatactctttctgtctcctcttctatgatgctccttgagcctcggctggaacaggatggaatacgtgggcatgtgcatctgataaagatatgtgatttagggctgaacactaagtctttctcagcactcagaccagttatgcatttctgcagtgactgcagtcctctgcaaaaggaaccttctctgaccaaggttgagagcagtgtaggcctataagtatctataaataagtatatatatttagaacactaattgtcagcataatgattagcaaaataacaatagaagattctaagactggtccagccatggacttaacttttttttattagttctttgagaatttcatatgacatgttttgattatattcacccccatccccaactattcccagatccaccactccttccctatctacccaactttgtactcctttaaaaaacattcctcaagaccaatctgttctacccagttattcttggaatgtgtagtctttccctggagcgtagtcgactaactaggggcaacactcttagagaaaactgtttcttcttccagaagctagtaagtgccaatcgctgcatggctagaaatggaattttgtactgaaatccaatctccatgttgagatttagtctctgtttcagcttgcacaggtcttgtgcatgctgttacaacattcatattcaacattcatatatgcaactgtcctgctgtgtccagaagacagtttccttgtagatatctctaatctctggctcttacattctttctgttccctcttccacaatgctcaactgggaggagagggtgaagtatacacgttcaatttaggactgatcattctacagtcttggaccttggccagctgtgggtctctcttggatgccggacatggggaaataaaggggtgggagagacctgcatctcgccagagcttagggagactgcagcgtgaccccatggaaccgctgtgggacaggtgtcataggcctcagaaccctgctccctgggtggggaaggcacggtcttggctccaactctcgggcaccacagactgctgggtaccgtggaagagccggttttggggtccctgggccacatggaggccagggacgacaggttcttgcttttggacatcccagatgctgctgtacgttgcgtaagagttgagaacagacccttaggcggactctgacccagggccggaagggagaaggtattagctctagcaggttacctaggggatgagagagtctggctagctcaggtggctggctcagcaggctgtttggtttggctggagcgcagggaggctagagggaaacctgctccattgctccagcacgggtcctgatgagcagagatggtccatggttttagagcattattgaagaaaagcagagagagagagagagagagagagagagagagagagagagagagagagagagagagaagctggccatgagcacgtgaagagagaggggggaagggaatggggagagaggggggaatagagcaagagcaagagagcaagagtttgaggagagggcaagcagccccttttatagtgggtcaggcatacctggctattgccagataactgtgggtcagagcttagacagaatgctaacagtatacatagagtcttccatcactatgaaagctagccagtagggatgaagcttctgggtcagtaacaacttgatttctttatgttcaatgacacaggtatgtggtgtcttgatcagcaacaggattttgctgtccagttctggagggtaacctagagcaatggcaataacctatattgtttgtttttctggttgagggaagtctatgagacctcattggctaacaactctgaattgattcctgacactgaacacctttctcttttttttttaattttttattaggtatttagctcatttacatttccaatgctatgccaaaagtcccccatacccacccacccccactcccctacccacccacttcccctttttggccctggcgttcccctgtactggggcatataaagtttgcaagtccaatgggcctctctttccagtgatggccgactaggccatcttctgatacatatgcagctagagtcaagagctccggggtactggttagttcataatgttgatccacctatagggttgcagatccctttagctccttgggtactttctctagctcctccattgggagccctgtgatccatccattagctgactgtgagcatccacttctgtgtttgctaggccccggcatagtctcacaagagacagctacatctgggtcctttccataaaatcttgctagtgtatgcaatggtgtcagcgtttggaagctgattatggggtggatccctggatatggcagtctctacatggtccatcctttcatctcagctccaaactttttctctgtaactccttccaagagtgttttgttcccacttctaaggaggggcatagtgtccacacttcagtcttcatttttcttgagtcctttctctttttttagtttgcgtatatgtgtgtttatttttaattcttctttaaaaattatttttgtatagtatattctggtgatgttcttccccctccccagctcctcctatattgtccatacctccttaaccacacaacttcatgtgcttgcgctatctctctctttctctaaagcaaaaaacccccacaggaaaagcaaaaaaccaaaaataaatacagactaaaatgaagaaaatcagtaagagaaaacccaacccaacccaaaacaaaaccccaaacaaaaaatgcatacaaaaatggagtccattttgtgttggccagcaactccttggcatagggcctgccctgcagtgtgctctgtattcccagtgaccctctgttgaataatactgtttttttcctttctcagcatgtattgactgcaaatagcttcttggttaagggtgtgattttgtgtccacttctcagtgctgagattttgtctggtttgaacttgtgtaggtcttttgcatgctgtcccagtctctgtgagctcatatgtgtatcaattctgttgtggctgtttcctaggaatcatccctggctcatatagtattccctccttttctactctagagatcactgatccttgagaggaggggtttgataaagacatcccattcagggctgagtgctccaaaggctctctctgcacattgccttactgtagatctctttgttaattgctatctactgcaagaagaagcttctctgatgagggctgagtgatatgtgtcccatgactatagcaacatgtcattaggagtcatttgattgctatttccctttagcagaatgatagtagtaggcttttccctaggcacatgatctatgtagtctcaggttattggccactttatcaatgtcagatatgggtctcgtcatatggaatgggtcttaaatccaatttcaaaaatttcttgactactcctataactttgtgccactactataccattgtatcttggaggcagatctatgttgtaggcctcagggtttttagctgggtgaaactgatgagtacttttctcctccagtagtgttcagagtaccttttagcactgtgaatactaatcagtagcggtgaagcttctagttaggcaccagctcagtttctccatgttaaatgacataagtacatgttttcttcagctataaggactttccatcaggttatgaagaacaaccaataaccttggcaatagtcagtgataatgcggggggggggggcgggcagggagtctataggatccatttggccaatgacttagcaagatataaccaattcctggcactggaggttttacttggtggcatgagacatctagttgggggcactgtctcctccattatatggtgactccatttaaattcctcccatatatgtatatatcttaggaagtttcttcagtagtatgtttccatatggctttcaagtggcctttaggatcagttgtcaatcctcattttccttccttcaccctgcagtcccacttacctctccatttaatcctattttagtttcttctttatctctttataacactatactgtatttcacattccttagaagatcccttactcccctccatccatggttatttgctagatacataatctctgtggttatttggaaagaagcacacatataaaaaggttaaaagctaacatcctcatgtaagagaaaagttggcaatatttgtttttttcagtctgggttacctcggtcaggatgattgtttctagcgctatccatttacctgcaaattttataatttcatttttcttaatggatgaatattattctgttgtgtaactgtaccacattttcattatccattcatcagttgatgggcatctaggttgttttcaatttctggctattatgaatagagtggcaatgaacatgcatgagcaattatctctgtagtaggatgtagagtcctttgggtatctgcccaagagtgctatagctgagcttgtggtagattgattttcagctttttgagaaacctccatactcatttccatagtggctgtaccagcttgcactctcaccagtaatggagaagtgctcccttttccctgcattcaaactagcatgtgctgtcaattgttttattgatcttggccattctgacttgggtgagataaaatcgctaagtacttttaatttgcatttccctgacagcaaagaatgttgaacatttctttaagtgtttctcagccatttgggtttcatgttttaagaactctgtgtttagttctatatcccttttaaaaattgggttatttgttttcttgttcaggttctttttagccctttgtttactctgatattaaccttataccaaatgtaaaattggcgaagatcctttcccattctataggctgccacattgatggaatgatagtgtcctttgctgtacagaagctttttagcttcatgcaatcccatgtgttaattgttgagcttaaagcttgtgctatcaatatcctgttcagaaattcctttcctgtgccattaagttcaagctgatttcctgttcttttctatcaggttcaaggtatctgatgttgaggtcttctatccatttagggttgagttttatgcagagtgagaagtatggatctatttggattcttctacatgtagccagctggtttgactagtaccatttgttgaagatgctgtcttttctctcctgtgtattttttgcttctttctaaataatcaagtgtctgtaggtgtgtggaattatgtctgggtcttcaattttattccatttaccaatgtgtctgttttataacattaaaatgatgtttttattactgtagttctatagtttgaaatctgggatggtgatacatcttttattattcaggattattttatctatcctattttgttgtgtttctgtaagaagttgaagatttttcaacttctgtgaataatgtgttgaaatattaatgagaattgtattgaatctatagattatttttgttaggatgaccattttcatggtatcaatcctatagatccatgagcatgggggatctttccatattttgatatcttcttcaatttcattcttcaatgtcttaaagtttttattatataagtcttttacttgtttaataagagttacaacaaaatattcttgaggctattgtgaaaggtaccatttctcttatttaattctcagtatgtgtttaatttgcatgaaaagaggctactgatttttatgtattaattttgtattgtactatttttctgaaagtgtttatcagctgtagaagtttcctgagtggagtctttttgggtcatttatgtataaaattccatcatctgcaactaaagatactttgacttcttcttttccagtttgtatccccttgatctatttcagctgtccaactactctaagagtccaaatattctatctaacgggtatggagagagtggatatccttgttttatttatgattttggcagagatgtctttgggtgtccattcaggatgatgttgagtgtaagcatactgtaaattgcctttgttctgttgaggtaggtttcttatatccttagtctctccaagatttatcataaagggatgttaaattttgccaaaggccttttctccatccaatgaaatgatcatgtggtttttgcttttcagtctgtttatatggtgggttgttgcagtaaatctccaacctcaataagccagtgcaaagaacacacaactcagttatagtatttataagctgcatgcttagattgggcagatatatcactacactgctctagtccccagctatgagatcccttgctacttgtggcttctctaggacacgtggttctgatctatcttccttccacctccttttcctcagtctccctgtctccttgtctcttcttccacctctcttcatcctctctttcccctctctaaaacgtccagccccacctttcccttccactgcccaatcacatgatctagcttttatttgaccagttaaaatagggagaaggttcccatggaatcacctgagtatgtgatccactcctcatctgggcagtcccccttgaggaaatggaattaacatcaaaatacaaacagcaccagagcaatccacaatagtggattacatttattgacttatgcatgttgaaacatcttcgcatctttggtataaagctaacttgatgatggtagataattattttcccttttattaaaaatagatttttttctcacataatacaacatgattaaggtttaccctttctctactcctcccagttcctcctcacctctgctcccagctagattcactccctttttgtttctaattggaaaagatacgggtttctaagggataataataatataaaataaaacagaaaactaacacattggaattgagcagagtgtacaaacagtagaaaaggagttctggagaaggtacaagattcagggatccacttatttatatacccaggaatcccattaagacacaaaactggaaaccattacacacacatacagacacacacacacacacacatacacacacacacacacacacacacacacacacacacacacacacactgcaaaagactcagtgtaaacttgtgtgcatgttgcctcagcctccatgagtttacacgagctttgatcatgttgattttgagggtcttgtttccttggtgtcttccatcccctctggctcgtacagtctttctgctacagtctttctgcctcctcttccacagggttccctgagttctgaggggagggatttgatggatacatcccatttagggctgagtgttccatgggcttccactctctgtgtaatgtctggctatgggtctctttatttgttcccatctgcccatgccatatatgtacatattcaaggaagcttctattgtattaggtttccatactatccaaatagctcttaattttatgtatctccctgcattttcttctttattccactctcccctgcccctgacaacttgtctctccagtttcagccctttcacttggttggttagagttacctcaacaattttatatttgaggctattgtgaaacatgttatttccctgatttctttctcagtccatatgttatttgtatgtaggagggttactgatttttgttagttaattttgtatttaactaaccagctaccttgatgtgtttatcagcgatgagtctcctgataggcttttagggtcacttatgtaaattctcatagtatctactaataaagatactttgacttctttcttttctatttgaatctccctgatttccttcagttggacaaccttgtattgttcctgattttagtagaattgttttgagcttctctccatttatgttgatgttggctacaggcttcctgtaaattgcctgtattatgtttatgtgtatctcttgtattcctaatctttccagacttttattatgaaggggtgttagatttctttgtttgtttgtttgtttttcgagacaaggtttctctgtgtagcctggctgtcctggaactcactctgtagaccaggctggcctctgcttcccaagtgctgggattaaaggcgtgtgccaccaccgtctggcctgggtttcttctttcagtttgtttatatagtgggctatactgacagatttttgtatgttgaccagccctgcatttctgggatgaagcctacatgatcatggtggatggtctttgtgatatgttcttggattcagtttgtaagtatttttattgagtatttttgcatcaatgttcataaggaaaattggcctgtaattctgtttctttgttgagagtctttgtgtggtttgggtatcagggtgactgtgggctcatagatgaatttggaactgttccttctgtttctattttgaagagtattggtattagctcttctttgaaaatctggtagaattctgtgctaaaactgtctagccctgggctttttttgttgttgtttgtttaattgggagacttctaagactgcctctaattccattaggggttataggtctatttaaattgtctatttgctcttgatttaactttggtaagtggtatccagcaaaggaaattgttcatttcttttatattttccaattttgtggagtacagagttttgaagtaagacctaataattctttggatttccttggtgtctgttgttgtgtccccctttttatttctggttttgttaatctagatattctttctctgtattctagttagtttgaataagggattggctatcttgtttattttctcaaagaaccaactctttgcttcattgattatattatttttgtttctattttgatgattttagctctctgattctttcttgcagtatactcttgggtgtgttttttgcttttttgcgttttctagaactttcatgtgtgctattaagttactagtatgagatctcactaatttctttatgaaggtacttaatgctatgaactttcctcttagcaatactttcattgtgtcccataagtttagatgttgtgccttcactttcattgaattctacgaagtctttaatttctttatttctgccttgatccaatagtcattcagtagagagttgttcagtttccatgagtttgtagattttctgttgtttctgttgttgttgaaatctagctttagtttgcggtggtctgataggatacagaggcttattttcattttcttgtatctattgaaacttgctttgtgaccaagtctatagtcaattttgaggaaggattcatgaagtgctgggaagaaggtatattcttttgtgtttgggtgaaatattctgtagatatgttatgaccttttgaatcataacctctattagttttattatatctctgtttagtttttgtctggatgacctgtcaattagtgagagtgtggtgttgaagtctcctactattaatgtgtggggttgtgggtgtgtgatttaagctttagtaatgtttcttttacaaatgtggctaccctggtgtttagagcacagatgttcagaattgagatgccatcttggtggatttttcctttgatgagtataaagtatccttccctgtctgttttgattaaatttggttggaagtctattttgttatatattagaatgtccacagcagcttgattcttgggtccatttgcttggaaaatctttttctaactctgatctttgaggtaatgtttatctttgatgttgaggtatatttttttgtttgcagcataaggatagatcctgtttttacatctattctgttagcccatttattgggaaattgagcccattgatatggagatatcaatgaccaatgattgttaattcctgatatttggttgttggcagtagtgtgtgcatgtgtgtgtgtgtgtgtgtgataattctcctctttgtctgtgtttttgtaggtgtagttaactttcatgggttggagttttccttccagtaccttctgcaggacttctatttccattttcacgtcttgaaaagttttagttgtttccttcaattgtttgttttttttcttggctttctttaagggatatattcattccttccaattatgtgttttccttgattttcttaaaaaatattcatttcctctttaaggacctcatcttcataaagttggttttaaggtcttttcttgtgcttctgttgtgttggaatattgaggggttgctgtagtattttctgggttccagtggtgacatactgccttggctgttgctgattgtgtttctatgctggtttctagtcaactggatttgggataattataggtctaagtatcaatttctgagtttatctttgttggatgggtgttttcttcctagatttctgtttcctctctgtcttctggttctgtgtagcctaggtttcttgaagtctgtatggtcttaggtagagcagggagcctctgcactagttggaggctggggcaaggcaattaggagggtataggactggggaaaagttggggggacaccaagacagtgaaagaatgggggagtttggtgggagggcagcctacaagaacttctcccagtctgtgtggtctctggtagcgtggtgagtctctgccccagctgtagtaggctagggcacagcaagtaggagggcacaggactggtgataaggtggaggaacactgagataatgggagagtggggacatttggcaggtgggcagcctgcctggacttctctcagtttgtccccccctttaagatttaacattttcttgtcttacctattcatttcttcaaccttgttttcaaggcataaaaattttctgtgtcttataatctgttgctggagattacctctgaattttttatttgacattctaaatctattatttccagttttatttcagattggctttatttctttagtgttttatttatttgttaatttctaccttgatgtcttgatatattttggttatttcgttcaatgtttttgtctttcctgtcttcattaaggcatttattcacattcttttcaagttcctaggacatattcataattgatattttgaaatctttgtctcgtatttcagctaaattgctgctcttaaggcctaccgcagtagtgttgctagcttctggaggaggctattgtcttggctgtttatgtttttgtactgaatcgaggtatctggaatttatgatgctgggggtgtttcttagtcacatatctggctgtgtctttgttgagtgggtgttctgttcttttgttgctgttgcctactctggatctttgccaagtgtagtggctgtggattcttggtcaagaacgtttctctgggttggcaggtgacataaagaaatgaagatggactaggaggaattgctgaggagagtgagaaagagcaggggagatcctgggttcacaccaagggacagagtctccagagaataaaggtgagtgggaagaagggctcctgaaagcagactgcagcaggaccgagaggatttctagagagatgggagtgcatgacaagaaagagagtgaaaattgccttcctgaggcccagtccactgggaccactgatagtctttggtacaaagtggttttttgtgggttaaggggtgatccaaaataatggaattgagatagagggaaggctgagagggtgataggaaatacctaggagatccctgggtctgcaccaagaggtagaatccccagagaatggaggtgaggtcttaagaaggactcctgcaggtatattgcagcaggaataagagtcaatcaggtgaccagaatgaaagagctctttttttttttttttttccccaagacggggtttctctgtgtaaccctggctgtcctggaactcactctgtagaccaggctggcctcgaactcagaaatccgcctcttctgcctcccgaatgctgggattaaaggtgtgcaccaccatgcccggcactcttcttatttttttaaaacattatttatttaatgtatatgagtacactgtagctgtcttcagacacatcagaagaaggcatcagatcccattacagatgattgtgagccaccaagtggttgctgggaattgaactcaggacctgtggaagaacagtcagtgctcttaaccgctgagccatctctccagccgcctataaaaatgtaaacttatttactttacatccctcttcctgctcccttcccagtcccacctcccacaatctttctgctctccccctccccttctccaccaaccagagaacatacatgggctgggccgaaccttcttgcacatatgtagcagatgtgcatctggtgtgggtcctgaacaactggagcaggggctatctcaaaaactgttccctgttcatgggatatgttcttctagttgggctgccttgtctggcctcagtgggaaaggaagcacctatccttacagagacttgaagagacttgaagtaccagggttggggggatactcagagagggggccccaggggatagaaacttcacaggaagaacaacagagtcaactaacctggacccctgggggagtgtcttaattttttaattaaaataccactacatcctttccctctccctttcctccttccagccctaccagctctccttgcatcctttcaaatttatgacctattttgatttaattctctctctctctctctctctctctctctctctctctctctctctctctgtgtgtgtgttgagtctgtttagtgttacctgtatgtatatttcagagatgagcgcttggtattggataatcaattagggcttccaagggtagggatcaagtctgagacagacgaatcccacctgggactgtgggccctaggtctgagcaagcccaaaacagatgacccttgcatggggtcactcgggtgggcccggttgaggagcagacctgagatgaccactagagctgctccatagggcccagacagggtgctagcctgatatgatcaccagcctaagatcatgcctgagatgacctgcctggtgccataatgcacaagctgagcatatcatttttgagatgaactcagacactcagagacccgggataccactaagtggagcaagtaagtagtggggaagtggaagagagcgagaaacagaaggatgtgggcacaatgaaaagaggcagaactggagactcaaagatagtgaggaacaggctgatgtgagtagctggagatgccacctgggaccatggtggggtcctggtctgtgctgccactggggatcatgtttgggtttgtggtcctgcagcaacaggggtctgttaggtggccatttttggtctgggctgctgcctggagacacattaatgtctgagggtgaggccccacaactcacctggacattgtggaagatatttccctggaggtgtgagaacaggagagctgaccccatccctagcaagctacagtactcaggagagaaagcactgcactttgcaggagttgtaggtaagcctgccctcagggtatgagtgtggagagctggccctaccactcatcttccatgcagtggcatggatgagggggagataccctcctccctacttgcctcttgccacctactgcaggtggaagatctgaccgtgggctcatgagagagtgagagctgtcctggctcttcatcagcacttgggagagtgggccctgcccctgcctggacagcacagtagagttgatcctggtggaggagtgcaggctagccgaccctgagggtgtgagtatggaagagctggctctacttatctgcagtgccttgacatgggagagggagaaatgacccggcattccccttgtcatctatgatggacaggagagctggccctgaggtcatcagaccctgctcctcacctactgcaactggcctcagcaacatagtactggatgtggggggttgtggatgagccagcctcaacagcatgagtgcaggagagccggccctgcctcttgtttgctgtgcagtggctttggggagggagagatgccctcccctcccttttgccacctgtggcaaggctggccctgataaaatcatgagagcaggaatgatgactctgcccctcacctgctatagcacttggggtagcgggccctgcgtgtcacttgggtagcatagtcaagctgtttctggacatgggagttgcaggtgagtcagtcccaagggagtgagggcaggagagctggtcatgcctcttgtctgctggaaggtggtgctgatgagagaaagatgccctcctcccttctgtcatccctcaccacctatgacaaatgggagagctgcccctgggatcacaagaatgggagaactggccatatccttcaccagctgcaacacttgggagagcaggccctgcacctttcttggtcagcaggtagagcaggccctggctgctgaagttgcgggtgaacaagagtgggagagcaggagaggtgactaggtcagatacctctcaggcccagatccaaggctttgaattgggccaccccaatataccccattgatgaagctggaatgcacgaaggggcttttcctccagatccaaaactacagaatctccatgacgcaaaaaacccactgaggtcccagtattgatagagtagcagaagccagaacactcataccagaccagtgactcattgcaatgaacgtttgcaagcgaagaagtatagacaaagggtatacgtgggacacactgtgacacactacagcttccacaattgagatttttctgtgtttggaggaggctgcaagggtggagggcaggtccaaggatagaggaagatgagtggggttggggtgcttgttgtgaaagtcacaaagaaccaataaaaatttgaaaaaattgcttcattttcctttacctaaggtttgcaaaactttacatatgagtcttatatatattttgttaagctaaattaggcatcactacatatctgcagtgctcatgtgacttttgtgcatatagtacatgatattagtttttatttaaattttaactgtggctgagataaatagaactgacttttcctatatgcagtgaatgttactagtttttatttaaattttaattgtcagtggctgggatagagaaattgaactgactttccccataagtatcatatactgtgttatcagctcatgtagttttcattatttttacagaatcacatcttttctgtcaaagaaagctgctttgatttttcttgtgagcagcccataaaacactgaatagaagtggtaaaagcacacatctttgcattgtcctcagtctgaagatagaaagtatttactctcagttttactaattttttaaaatcggcatacaaagtagtgggtttcagtagggcactttcacaatactttcctcactccctcgcccccatctgtctgcccctctcatgctgatcccattctcacccctttagcctctttctgcattcatgtcacatgtattctcttactttctccccccccagccctcctttaagagctcttctcttgcctcccgcctttacggtgcttttttctagtttcatgacctagtttcatgcaaagatgagtacccttgcaaactatactttaaacaggcagttgatatctagaatatataaaagaactataaacactaatcacctccaaacctgaatagtctagccaataaatgagctattaatggaacagctttcaaaaggagaaacacaaatggctaataaacatttttttaaagtgttcgttcaccctcctcagccatcagggaattgcaaattaaaaataactgtgagatttcatctctccctagtcagaatggttagcactcagtcttttacaattaaaggttatgttaactttagatattttgtagatcacatttaccagtataaagatgttcctttcaattcctagtttgctggtactttatataccaggttgaattttatcaattttttaattttttgttttcttgagatagggtttctctgtgtagtcctggctgtcctggaacctgctttgtaaaccaggctagcctcaaacttacagatatctgtcaaatgtattgattgagatgctcaggatataaaatttaaccttaaattatctatctatgtatctatctatgtatctatgtatctatgtatctatgtatctatctatgtatctatgtatctatctatgtatctatctatatatctatttatgtatctatctatgtatctatgtatgtatctatgtatgtatctatctatgtatctatctatgtatctatgtatctatctttgtatctatctatgtatctatctatgtatctatctatgtatctatgtatctatgtatgtatgtatgtatgtatctatctatctatctatctatctatctatctatctatctatctatctatgtatctatctatgtatgtatgtatgtatctatctatctatctatctatctatgtatctatctatgtatctatctatgtatctatgtatctatgtatctatgtatctatgtatctatgtatctatgtatctatgtatctatgtatctatctatctatctatctatctatctatctatctatctatctctttgagacagggtttctctgtgtagtcctgcctgtcttggaactctcactgtggaccaagttgtcctcgaactcacagagatccacctgcctttgccttccaactgctgggattaaaagcataccccaccacttcctgacctttcctctttcctattattattattattattattattattattattatcatcatcatcatcataatcattattatttgttgctaacaaactgctaacattttattttggattatcatgtcagtgctcataagttgtattggtctataattttattttcttaaaatgttatgcactgggtgtcataaggtaatactgaccctctgatgctttgggaaggtttgtcttttcagttagctcaaaggtttatatacagttgggattatttctttttttttttaaagatttatttattatttatgtgagtacactgtagctgacctcagacacaccagaagagggcatcagatctcattatgggtggttgtgagccaccatgtggttgctgggatttgaactcaggaccttcagaagagcagtcagtgctcttatccattgagccatctcgccagcccgggattatttctttcatacatggttggtacttttttaaacacttgaattcaatctcatcaataaatacagactattgatgtctaattcttcctgactgagggttattgctttccaaagaattttctcatttcctctaagtattattttctggataatattttatataatatcttctttttaaaatgaatttattttttatactccatattccatcccccagccccccatccaccctctgactgccccatatcccacactcccttcccaacccccctgtctccacatggagatgcccccaccccacctgacctctaaactccctgggcctccagtctcttgagagttaggtgcatcatctctgaatgaaatataatatcttcttatggttaatttaataactgaagaatctgtacttttggggtttctggtattgctcctctctctctctctctctctctctctctctctctctctctctctctcacacacacacacacaccagttcttttttttaaacctgacactgttaaatgaactgatctttttaaaaaaacttacttttgattttattgtttattctatcaatctttgtcatttctgtttagatggttatctgaaaaatacttacttttgtccttatgcttctcttggatttattctgattttttctagatttaaaattttatttgtttttttttaattgtttgctttattataatttgccgtccaggccaggctggcttaaaattcactatatagcccaggatagactcaaattcatagtcctctcccttcagcttctcacatgctaggattatagatgaggcccattgttttctattatcttaaggtggagacttagctaattgtgttgaggccattgttttataatcattataaacatttaatgacagaaatttccctctctacactgattttatttcacttcagaaattctcatacgttgttttcattttctaaccttataaaatattcctttgatcctagcattattttaaaaacaacgtttaatgtgaacatattttgtaattttttcaggtgtcttgctttgactaatttctgtttttaattatttgtggttagagaacttatggttctggtcctttgaccttgttgagacctttatggcccagcacatggtctacagatgtcagtggcccatgttaccaccaaaggccatgcggatgttcctggtcttggctgacacctggggctgtgttgacatctgtaggctgtgtagaactggctcttccccctcaccagctgccctgcacctcacacagaaaacaaaatagagctgtccctggttggggagagagggttgcaggtgaaatagccctgagaatatgaacaaggtagaaactgcttgttgtctcattactgcctgtggcatgtggaagagatgaccactccgcttgcctgggcattgctggagaacaaaattggtgaacattttatttttataatagaatatgcattcttctgttattactatacaaataacaattatttcaaaacaatccacagtgttaagtcatatgtatgtatgtatgtatgtatgtatgtatgtatgtgtgtgtgtgtgtatatatatatatatatatatatatatataatttttaattgattctttgtgaatttcacatcatgtaccccaatcccattcatctccccgtatgtcagccctctgcccttgcaacctccccgtgaaaagaaaacaaatgaacaaacaaaaatctcacaatggaggctgccgtgtgtcatggtggttcatacagtagtaaacccttttacccaaacagcttttcttgcaaatgtccattgcagtgagtatttggtctggttcaaggactctgccttctgctaaactatcaatattgaatcatctgtaggactcctctgggatatcctgttgtcctgtgccagggagattttgcagcttttgttctggagaccagccccttcacactctccaacagttcacagatggggtagatgttgggatgggctaactcagagccttgaatctggccttgggtaatagttgagttggccagtttgacagtccctttccccgctcctgctcactcaacctggtccagctctccagcaatgcccaggcaaggggagtggtcatctcttccacatgccataggcagtaatgagacaacaagcagtttctaccttgttcatattctcagggctatttcacctgcaaccctctctccccaaccagggccagctctattttgttttctgtgtgagatgcagggcagctggtgagggggaagagccagttctacacagcctacagatgtcaacaaggctctaggtgtcagccaagaccagggacatccgcatggcctttggtagtaacatgggccactgacattgacacagagccctgatgctccagggccacagacccagacatggcccatcacccactatggcctgagggaacattgctggctactcacaacaggctgttcctctccatgcttgcatctccagctctgtctctctttgtgcacaccattctgcttccctttctcttctatctctcaccacttacttgttcatcttagtgccctccccctcccagcagggcttgtctctgctgtgctctgcttcgatcatgctgggaggcaccgggccaggcaagtcttttatatatttcttcattggtttttcttttttgtcttctcttcatggaaggatattggtgtttccaaatatataactgtggaattgtttgtctctcccttcagttctatcagtttttagctcttgtatttggaagatgcacatatattcatttagtttcattttattttttattttcatttaaatcaattcattttaaagtactcatacaaatatattttgtatgttgatcatgctcatctctataacctcccgctccccctttcctcatgtttccccactgcctgataatcttctctgtcttcttagacagttttacttctactttcatgtcacatgtgtacaaatgattttacgtatctatataaattcaatctatgagccacatatgagagaaagacacactctttatcttcctcagactggtttgattcacttaatacaactatatctggttggattcatttttctataaatgatataactttttttgttttttgtttttgtttttttaatagcaaactcaagtttttattccccaattttcttttagctttacttgctatttctttttttttcagaacagaagtattttttaaattaggtattttcttcatttacatttcagatgctatcccaaaagtcccccacaccctcccccctactcccctacccacccactcccacttcttgaccctggcgttcccttgtactgaggcatataaagtttgcaagaccaatgggcctctctttccagtgatggccgactaggccatcttctgatacatatgcagctagagacacgagctctgggggtactggttagttcatattgttgttccacctatagggttgcagacccctttagctccttggttactttctctagctcctccattgggggccctgtgatccatccaatagctgactgtgagcatccacttctgtgtttgccaggcaccggcatagcctcacaagagacagctatatcagggtcctttcagcaaaatcttgctagtgtatgcaatggtgtcagcatttggaggctgattataggatggatccctgggtgtggcagtctctagatggttcatcctttcatctcagctccaaactttgtctctgtaactccttccatgggtgttttgttcccaatttgaagaagggacaaagtgtccacactttggtctttgtttttcttgagtttcctgtgttttgcaaattgtatcttatatcttgggtattctaagtttctgggctaatatccatttatcagtgagtacatatcatgtgagttcttttgtgattgggttacctcactcggaatgatgccctccaggttcatccatttccctaggaatttcataaattcattcttttaaatgtattttgtttgttttttgagatagtgtctcactatgcagccctggctatcctggaactcacattgtagactgggttggacctgaactcagagatctgcctgcctctgcctcctgagtgctgcaattaaagacgtggatcatcattaccacttatagtaatttagttctgtgtgattgtttgaatgagactgacctccataggctcatgcatttgaatgcttgggcacccacttggtgaaagtgtttaggaaggattaggaggaatatagccttgttgaagaggtttgttattggaggtgagctttggggtttcttttttcttttttttttaaaatattttttattaggtactttcctcatttacatttccaatgctatcccaaaagtcccccataccccccccccaaccccctacccacccactcccacttcttggccctggcgttcccctgtactggggcatataaagtttgcaagtccaatgggcctctctttccagtgatggccgactaggccatcttctgatacatatgcagctagagtcaagagctccggggtactggttagttcataatgttgttccacctatagggttgcagatctctttagctccttgggtactttctctagctcctccattgggggccctgtcatccatccaatagctgactgtgagcatccacttctgtgtttgctaggccccggcatagtctcacaagagacagctatatcagggtcctttcagcaaaatcttgctagtgtatgcaatggtgtcagcgtttggaagctgattatgggatggatccctggatatggcagtctctagatggtccatccttttgtcacagctccaaactttgtatctgtaactccttccatgggtgttttgttcccaattctaagaaggggcaaagtttctatctccagagttgtctccctttgtgctttctttattgtttctacttccatttttagatcctggatggttttgttcaattctctcccatgtttggtagtgttttcctgtaaatctttaagggattttttgtgtttcctctttaagggcttctaacggtttacctgtgttttcctgtattttcttcttcaagtcctccatcatcatcatgagaaatgactttagatccatgtcttgctttcctggtgtgatggtgtatctaggacttcctatggtgggagagtttggttctgattatgccaagtaagctcatgtcacaccagttagctctctctccaccttatgtctgtggatcagatgtaaactctcagctattgctctagcaccatacctgtctgcttgccaccatgatggtcatgaactaaccctccaaaactgtaagcaatccgccatttaattggtttcttttgtaagacattcacttacttattgtgtatgtatttgtgggcatgtaggtatatacctgtggatgttacaagacaacttttggaagagcaggaagttattcaagtgcctgagtcagggtcctgaggttgagcctaactcaatggagacagcaggttttcagtatgtttcccctagttctcattctcccctcctacctctacttcacctagtctttctctatgtcctactcaggattctagcaatacctcactgtggctctctatctggcataaatctccctttgtgtgtgtctctatggaatcatgtttgacttctttcatggtctgcatagatacatcttagacacatttggaggtccttgcttcaggttgctggaggcttgagttatctgggagcctggaattcagatgtgaggtttttgaggaatggagggcttttgtccagagttctagagtttctgttccaatagagaaaatatctgatctgcattatgcattttgtctagatgtacacacggtgtcattctgttgtgattgtgcatttcaggaatgagcatttgagcaacatgagggttttgtgtgcgatacaacaccattaaatccatgagactacaagcatctgatgcttgggagattttgtatcctacctgtgccttctatgacctatatgtgtgtgtgtgtgtgtatatatatatatatatatatatatatatatatatatatatacatatatggcagaggagtccactatatttgtgctataaacttttggcttccacaggtagcagtggtgcatgcctttaatcacagtactcagaagccagaggcagatagatctctgtgagctcaaggccaacctggccacagagacagttccaggacaactaggacaacacagagaaaccctatcttgaacctgttccccattctcccccaaccccccaaaccctgaagaactttggccttaaagaaatttgtgcatcataatctgccgtttctgagatatttgttgcgacagagatctttgtccttgggacctgtccttttggttgttttatgtgtctttctccaaatgggtgggcatcatggttttatggatgtctgtgaaaagggtatgagatatttgagctatgtaatgtaagtctctgaatcacaagttaggaatttgcaaaaatatatataggctggtaacttggaatttgatgtccctaggccagtcagtcttttttattttctttcccctccctccctccctccctccctccctccctccctccctccctccctccctcccttctttctttctttctttctttctttcattcgttcttttcagttttgtgagccattcaatattgcaggtctaaagtttggaggccaggctgcaaataaatatgatccggattcgatctccagaaaccacttaaataaaggtggaaaaagataactgactttataagatagacttgtctacacaccctgtggcatgtgtgtgcccatgtataactaacacacacacacacacacacacacacacacacacacacacacacacacgcatatcaccataataatacataatgttatttaattcaaagtttggaggcctctaatttgtactttcctgtgttggtatatggttgctatagaccactaggattttggggggtttatgaccaatagccgggagtctctgcgttatatttgagagtctcagtctatagtatgacctttctgagttgatggagatcaacatcccagagtgaagtctggcctgtctttggatctgtaccttccatcctgaaaggcctgagctggttggtgatcacatcatcaagaccaggcatgaaggtgtctgagattctccagatgttttggtctgacaactgtccagaaacacagaaaattggcccgactatgtttattacatcattctcctaaggctttcataaaccactgcaatttgtttgcaatttaacacatcaggaagtaacttgagggcctaaaataaaatttacatttcttgaaagtaagtgcctgtggttggaaacaaagccaggtggcctcaacaggttcctagaagctgtcactgccagaggctgaggcagaagaagacaaacagactgaggcagacacaggacaaaaagactgtcaccagggtcttagtctcatggggacactgacaggcacatatgtttattgcctgtcttctctgagaaaagcactgctctagttgttggggcacatctgtaagtaccctgatgaagaaatccctgagctggcaacctgcacaggtataagccagccagagtcccagtgctggggggatggatatgagactccaaccccaactgagaagctgtcaccaattgcaaaggaaaagattagttttttccaatggagtatcactgggtatattagccacacttaagggtaggcttaagggttggccatcctattaatggccaacacaaaatgaactcaatgatatttttgtagcattttgtttttatctcatatcactttatttgggtattgttttttgtcttactgaccttttgcttgtacaatatgggttctaattttgtgtttttatgggtgtatatgtttcttgtgttttctctgttactttttaaaaattctggcttgtttgcttttgttgttttcctgagagagagagagagagagagagagagagagagagagagagagacagagagacagagagagacagagagacagagagagacagagagacagagagagagagacagagagagagagacagagagagacagagagacagagagacagagagacagagagacagagagagaaggcatggagttgggtgagtggggagggcctaggaggagttgggggaggggaaaccatgaccagaatatactgtataaacattgttttcagtttaaaaaagtaaaaaaattatccttatagcaaacaaacaaaagaaaatatttcaagaaagctttcactgggcctacagaaaaagagacatgcctatggctttttgttaaagtattattacttgttaaaaatatctgcttgctgctatctagatgcaatctgagagattaaaaaaaaacccatcaatatgccttgtgaaagaaaacaagctcatgctttaaaatattttcagcaggctaattcaaatgttaataaaaaggaaaactggggagaaaaagagaaatccctgagcatccagttcctgtatgagaagtggaaggtggcagatgacaaactctcagcataacggtctggcaagtgcacagtgcagttgatagcaagggatgctggaactgaagccagaaaaagggccagcaagatggctcagccaagtctgatgacctgagtttgatgctcaggatccaaacggtagaaggagagaattaggatagttgtcttctgatctccatgcccaacacatggcatgggtgtgagcaaccccacataaatacagacacacccacacacccacacccccccccacacccacacacacactcaaaacaagtttaaaaatgtaatttaaagaggaagaaagaaggaaaaggaaaagctgtaccaattgtggtaacaggatcaaaagcttgggaagtaagggagtggcagcttggaatttgaagccaagtgaccagaataagcagcatggagaacatgatttcctgactggggctttccagacaaaggaaacatctgagaaggagagagtgaagcagagaccactagcacatggaaaacaccatggcagccagtagaggacagaggtgaagggaaggtggtaggtgctcagggtgctgtctggtggagacacttccgcttggtcatcctgacagaaaaggacaattgaggattgtagatactgccagcaaatatgtacaggactgcaaaggtcaggaaaaagagggacatatggaaagagtagtcagcaaattggagggcttgggcaatgagctagtatttcaatcaggtgaggttctgtgttcctgtcattgtctcgggaggcatctgcattgtagtcacagaaccacatgttccattagccagcctgatttacccaccagcctcccaattgaacccatgtttgaggggctgactttgtgcactggaccctgggcacatggacaatttagtgaccaatggaagcaatttctctgtgagtccagatgtgaacttgacaggctataagagattagctgacttgtactacagaaatttgcatcctcttttgaaaaatcatttttccaattctaagaaggggcaaagtgtccacactttggtcttcgttcttcttcaattgggagcaaaacagccatggaaggagttacagagacaaagtttggagctgagacaaaaggatggaccatctagagactgccataccagggattccatcccataatcagcctccaaacgctgacaccattgaatacactagcaagattttgctgaaaagacccagatatagctgtcttttgtgaggctatgctggggcttagcaaacacagaagtggatgctcacagtcagctattggatggatcacagggcccccaatggaggaactagagaaagtacccaaggagctgaagggatctgcaaccctatgggtggaacaacaatatgaactaaccagtaccctccagagctcgtgtctctagctgcatatgtagcagaagatggcctagtcagccatcagtggaaagagaggctcattggtcttgcaaactttagatgcttcagtacaggggaacgccagggccaagaagtgggagtgggtgggtaggggagtaggggggagggtatgggggacttttgggatagcatctgaaatgtaaatgaggaaaatacctaataaaaattaaaaaaatcaaatcatttttatcttatgtgtatgccttttttgctggtatgtatgtctaatatatgtgcaccacatacaagcagtgctcacagaggccagaagaggacatcagattccttagaaatggacacacagataggtgtgaactgggaactgaatctgcttccactgcaaaagcagctggtgctcttaaccgaaccagctctccagctcccatatcttcttttagtaggggctccaggattagggatgggatgaaagatgaaattctcacaggagacagctatatcaggctcctgtcagcaagctcttgttggcatctgccatagtgtctgggtttgctggttgtttatgggatggatccccaggtgaggcagtctctggatggtccttccttcagtctctgccccgaactttggtggaactctagttgcatatgtagcagaggatggcctagttggccatcaatgggaggagtggcccttggtcttgtgaagatcatatgccccagtacaggggattgccagggccaggaagcaggagtgagtgggttggggagcagggagagggggaggggataggggattttcaaaggggaaactaggaaataggataacatttgaaatgtaaataaagaaaattatctaataataataataaattagaatccatctttaaaaaatgcaattctcctctcagtccagttgaaagaatctgattacagagactgtactcctcctcctgtctgcaccatcttcctgttccattcctaccacagaagtaattgcaacaattaacagccatttgctattactattggccatgtaccttgatctttgatcactgaataagcaagcaattttgaagctccaggtgagcagctcttttttgtttgtttgtttgtttgttttgttttgtttttttggctgtcctggaactcactttgtagactaggctggcctcgaactcagaaatccgcctgcctctccctcccgagtgctgggattaaaggtgtgcaccaccacgcccggctgagcagctcattttaaagtagaggacctggtgaggaatttgggatgatttagactgcatctttgcaggaagatgcttccattttggtgtactgtgaggcgagtgatcctagagttaaatagcactaacctggagatagaagatagctcctgacccttcccagctgaggagaatctggaagggtttgcaaaagagagacatgtgagctggaaggtttatgaagtgaagatctacatatgtagctaaactacggagtcaagataggtgaagaaaattgtctccattgctaggcttctgtctttggccaggtgagtcccatgccacctcttggaactccataactctacagatgcactattgccaatagaaggaccccctatggttctgttggcccctactttcttatgtttcaggtaaagactgaaattgaaaggtctcacatatcttgggcttggtgatgaactattcaagtacctccgaatggcagtgtctccacaagggaaactagaagataaagcctttctcagcagttatctctggggccagctttacccaccaaaggactccagggctgttgggtaagtgcaacattggggaaggctgacatagtagtgtcctagaaccttacaggggtggctttgccagaatggatacctgcctttcacatgtggacatggtgttgcaacaatgaaaattttactggtgcacagtgtcacagtctcaccaagtagagtctaagcaaagggtgtcatcatgacgggaaacacagcctagcatgtctttcctgagcaaatcctatagtccccatagatgtgaagggtaaagtgctctccttggtgatcctctttgggtggagtcaggcagacctgggatatgacttctcaaccctttcctgcatgagatatcaaacatctcccactttgcttcttctcttcacacttggccccaaacatttagtgatctttatgcctgtctctcaagtgctaccattacaggcatcttccacctagccaggctcttttcatgttttgttttcttggggttttgaatacttacttctttgggatttcaggtttgttgttttgcttgtttacttgcttgtttttgcatgagagggaattgaactaaaggtctcacatatactaaacaagtgttctatcactgacccatattcccagtctctctggacctttgtacattaaaaaccatccatagtcacaacagctaggctccagaaagagtcatcctaatgtgtctaatgtgttcctcccactgggatacttaaaagtaacatgttaatatgagagcctgatacagcagtctcagggaagctagccaaccctcacatcacacttgagtgtgacctgtggtggtgggactagtaacactcacatctcttctttttgttgtttacttgttcaaaatactctggttgttgtgtttcatttttttatgacttcatttgtttctcagtgatgtctagtagtcgcagataggggatttttcttggatggccaaaagaatgtatctagaacacattctgacattcaaaaaaaaaaaaagactattctttaattttttttttaacagtccagactttattcccctcctggtccaccctgtgactgttccacatcccatatcccaccccctgccatcttcaagaggatgacctcaccacccacccccactccaccagacttccacattccctggggtctcaagtctcttgagggttaggtgcatcttctctcactgaggccagaccagacagtcctcttctgtatatgtgttgggggcctcatatcagctaatgtatgctgcctggttggtggctcagtgtctgaaagatcctgggggtccaagttagttgagactgctggtcttcccatgaggtcgcccttctcatattttctaagaacaaggttaaatttttgcagagaaacatgtgtgcttgcatatgcatatgcctgtaggggtgcacatgacacatgtatggtcaatgtcaggtttctttctgagtcactctccatcttaatttgtgagataggatctgtctctaaatctgatttggctaggtgaggctggttggctatggagcttcagcaatcagcttgtctctgcctctccaactctgagattgcagatatgtgcctctgtgtccagatttttgtatataggtgctggggattaaagttacatcctcatgcttgtgtggcaagaaatttacggactaaacccactctccagttgtctgagcacagactacatttcatatttaggtatgtaagaggagccagaatgtgctacagtgaatggggctaaatctcacatgtgtctcagttaatattttcttttgttctaatgaaacactgtaaccaaaagcaacttgaggaggaaagtttatttaatgttacagcttgtagtccattatccatggaagttagggcaggaacagatgaagagaccatggagttcttgttattggcttgctcagcttgcttttttataccactcaggagcatcaggcctgggtgataccacagtgagctgggcattctcatattagtcatcaatgaggaaaatgcaccacacacagactttttcacaggctaatgtgatagaggcattttttccccaattgaggatcctttaaagatgatttctgcttgtgtcaagttgacataaaatagccagcacaatatggtatgaggtcacttgaaagcaagtagaaccagtttctggtttgatctttgctctagatatgtaggaactgactgagtggcctctcactgtctgtagcacctattgagggcaactgaggagttgcattaagaaacactgcagagtcccttctagattccctgactagtaaaaatggagatcttgaagccctagaagatctacagtgacctgtccctatgcaaaaagattacaagtcagtacaacttgtcagtgtcactaatcttggagtaaacaagtatttcacaccaaaatgcattcagcaatgatgaccactcctgtttattccttggttcaaggatgccatgagttgacacattctatctatatttattttactttttgtagaacatgattttaatattttcaatggttaatattcaacagagtaattatttttaaaaatatatttcattgttatgtctcccttttcatttctgattttattaatttggatactgtctctgtgccctctggttagtttggttaagggtttatctatcttgttgattttctcaaagaaccagctcctggttttgttgattctttgtatagttcgttttgtttctttttggttgatttcagccctgaacttgattatttcctcccatctactcctcttgggtgaatttgcttccttttgttctagagctttcaggtgtgatgttaaactgctagtgtaagctctcaccagtttctttgtggaggcacttagagctcagagttttcctcttaccactgcttttattgtgcctgttaagttttggtatgctgtatcttcattttcattaaattctaaaaagtctttaatttctttcttgacaaagttatcattgagtagagtgttggtcagcttccatgtgtatgtgaactttctgctctatttgttgctattgaacagccttagtctatggtgatctgataggaggcatgggattatttcaatcttcttgtatctgttgaggcctgttttgtggccaattatatggtcagttttggagaaggtaccatgaggtgctgagaagaaggtatattcttttgctttaggatgaaatggtttataaatatctgttagatccatttggtccataacttcttttagtttcactgtgtctctgtttagtttccatgatctgttcattgctgagagtggggtattgaaccccactattattgtgtggggttcgatgtgtgctttgactttagtaaagtttcttttatgaatgtgggtgcccttacatttggagcatagatgttcagaattgagagttcatcttggttgatttctcctttgaccagtatgaagtatctttccttatcctttttgataacttttggttgaaagtcaattttatttgatattagattgctacttctgcttgtttcttgggaccatttgcttggaaaattgtacttcaaccttttactctgaggtagtgtctgtctttgtcactgaggtgcatttcccgtatgcagcaaaatactgggtcctgtttacgtattcagtctgttagtctatgtctttttattggggagttgagtccattgatgttaaaagatattaaggaaaaccgagtgttactctctgttatttttgttgttagaagtggaataaggtttgtgtggctatcttcttttgggtttgttgaaagattactttcttgtttttcctagggtatagttttcctccttttccatttattatcctttgtagggctggatttatgtaaagatattgtgtgaatttggttttgtcatggaatatcttgttttctttgtctatgataattgagagttttgcttggtatagtagtctgggctggcatttatgttcacttagggtttgtatgacatttgcccaggatcttctagctttcatagtctttggtgagaagtctggtgtaattctgataggtctgcctttatatgttacttgacctttttcccttactgcttttaatattctatctttatttaatgcatttggtgttttgactattatgtgacaggaggaatttcttttctggtccaatctatttggagttctgtagggttcctgtatgtttatgggcatctctttctttaggtttgagaatttttcttctataattttgttgaagatatttactggccctttaagttgggaatctttgctctcttctatacctattatccttaagtcttctccttatgtcctggatttcctggatgttttgggttaggaggctttttgctctttacattttctttgactgttgtttcaatttttttaaagatttatttatttattatatgtaagtacattgtagctgtcttcagacattccagaagagagagtcagatctcgttacggatggttgtgagccaccatgtggttgctgggatttgaactctggaccttcggaagagcagtcgggtgctcttacccactgagccatctcaccagcccctcaattttttttctaaggtatcttctgcccctgagattctctcttctatctcttgcattctgttggtgatgcttgcatctatgactcctgatctctttcctaggttttctaactctagggttgtcttttttttgtgatttccttattgcttcaatttctatttttagatcttggatggttttgttccctgtctggttgtgttttcctgtaattttttaagggatttttgtgtttcctttttaagggcttctagctgtttatctgtgtccacctgtgtttctttaagggagttatttatatccttcttaaagtcttctataatcatcatgagaagtgactttagatctgagtcttgcttttccagtgtgatggtgtacccggacttgttatggtgggagaattgggttctgatgatgccgagtaaccttggtttctgtttttcatgttcttatgcttgcctaccaccatctgattatctctagtgctccctgccctggctatatctgactggagtctgtccttataattttgaatgagtcagaactcctcagagtccagctgtctctgcgatcctgtgattctgggatcttgtgatcctgagattctgggtgtgtcagatttcctgggaatcaagctgcctctgggaccctgagatcctggtgtgatcaagctcctggaatcctgtgatcctgtgatcctgggtatgttagagcacctgggagtggagcctctgggggctgtgggactggctgccaattttgctcccaaggtaaaccagggcagaccggaaggaacccaagccactggttgggcagagttcctgtgtccctggatcctgctagtctcagttactggtggtgttgcaacaggtgttgtgttctactcacccctgatcctgagatcctgggaatgctggagtgcctgggagtggagccgcctctggtggctgtggggctgggagcagagttctcacccaaggtaaaccggtgcagatcagaaggagcccaagcccatggctttattttatttgtcattattttggtacttattttatagtataaaatacaaaaacaaatgttcttttcaagatagagtgtaaaatgttggctccattcaagaaaattagcttttcatcttccacagttagctctatgaattctaccgtcctttaagcatttcccagaaaactttgcttttagattctgctgtaattagtcactccatttagggatctttaacaaatcactatcacttgtccatcagtcaaaatatcaaagcttctgagcttgtctttttatccagctacactgtatgtaagatggaaatagctttacttagcctagctaaggagaattgagaggttaattgggagtcaggcagaagaaaaaaagacatgcatgacaaacaaaggaaagtcatcagtgaggctgtagaaatcagagagagaaatacagagccagtgtggatcacatgaacgattaaaaaaataaaaacctgtgcagtggttggaacttggaccagagttcagcaacaggaagaatatgctgcagattaggtgttctgcattaggcatggacagatgggccttgtgaaggatgtggggccgctatcctaaatgtaggaagcagcccctccagaatatggaaggggtaatgaccttattagtaggtagagaggtcccttgtgtcactggatttgagaatgagtggcaaggtgccaataatgctggcaggaagagtagctataaattgatggttgtggtgatctgaataagaatgatcccatagactcatgtgtttgaatacttagtcagcagggaatggcattacttgaaagggttagcaggattaggaggggtggccttgttagagaaagtgtgtcacaggggatcagctttgatatacatctaaagcccatatcaggactagttctcccccaccccatctcccgtccctctcagtctttctctctctttgcctgtggaacagtatataaagctgtcagctccaggacgacgcctgcctgcactctgccatgctgctcaccatgaggtaatagactaagcctctgaaactgtaagcaagaccccctattaaatgccttcctccagaagagttgtcttggttatggtgtctcttcacaccaatagaacattgattaagacagtggtggttttcaaggacagacaggagggtgagtagacaagggggtagagacaaggaccctcaacctttgttcactactgattccaattacctgaagctttatgtgacgctgggtatagaggtatatacaagtccaacatgtattgctggtaaatcgtaaagagatttaatttaaaaaaaccctttggtatatactagagaataggcatacagttgtgttggctacagaaaggagctgacataaagactatccttatcaggagtgagccttatcagaaaaaatccccataagaccatgcttatgtcttaaagtgggaggagagtgttaaaaaagcatgttccatgatgtcagagccacaatgagtggggccttaaaggtaaagagagtcttcccttcaaagcctggagggaagacccttgaaagggatagctaaaaataaacctaagagaaagatgcatcctagataaaaaagaaggtggtggctgggtcttcagagaagtctcctcatcaaggagaactgtctgacttttataccctctcagaaggtggcagaatgttctgcaccaaatgctttagttcaatatagcccattgacaaagagcatggtaggaacaaataggagcataaattaggagctttaaaactagagggtggggtggaaggtctctgcaaacaccatggtgggtgtcagtctgagtgaggcaaactggaagtctggtccaacgtgtcccagtaacctgtgttggtctttgagagtctgacaccaggcagtttattgtaggcatagtgcagtacagtgcaattgggaaagaggcctggtgtaacagaatcctctatgcacaatgaagttaaggcagaattacttgaaactcttttcaaagtacatgtcacttcttccacaacatgggatctgcatgtattatcttaagtgtctgagggaggatctggtgtggactcagtcatacacatagtgtagcgatcacataggctattaactaactcagtcctaactgtaaagtctgggggagccagatgtggcctggccctagagatagcacagaaatcaccaggctattattagccacaaccattcctaggattctgagcagaatacctattatatacaccttgctttcaacaccatgcttaacatttctggtttgcccagtgctgacctctgagcacaagaagctctgtgccacaccataaaacagaaatcacaactggcttcttgacccttgcttacagagagtagtggtgaagggcatggggtgatttcttcagcatgtgagatctagccaacttacagcaaccaggaccttagaaggacaggcccatgatctgacagtatacaggtaattttaccatctattaaagatgggagcaaattcacacaataatgaggtggaagtgcttgtttattttttttccaagatcagctgtttattgagttttgttgttgttgttctaaaatactatacaatttaaggagtttctaaacattaaggacttgacagcttttggtcattctgtagcttaggaacaaggatttctgctggtaagttctcatgacacacagccacagcaagacagcgctcgtgccaaacaccaaagaaatacaagttgctgatgtgcaccactgcaccgtccgagctaacaaaataaaagtcctctttgtgcccatccctggggctcacaacagtcccactgcacctgaggacaagggcaactggaggaacttatgtgtgtatgtgtggtggggggtgtcaaaccactccctctaactctccagtgagtgacacagggactgtgaagtctaagattactaccaagtcctaggagctttttcagtgctcggtcatgagcttggagccctggccaatgagaatcagtcttcccagcagctccactcagaggccagagccacatcctaactgggtgggcaccgttaaccagtcgtgcctgtgcttcaatgccatgggcttcaagcagttgaccagatctgctgtcagaagccaccagctctcattcaacagtgggtgaactctatagattttctgattatcaaataatatatgcagatatacatcgagacacaacggtctaatgtaaagcatcttaatctacagatgcaactgttttgaaaagttagtcttcttactgttaactttccaaatcacaacatacaaaaataaatcttgatcttcaaatattagaacattcttaacatttctgagagttgactgacagcttgatttttataatcatgctgagaatgcaacttcacctaaatatatagtataaaaacacataacagaattatgtgtagatgaacttcagaaactgttggaaattctgtcctaatatcaagtaaaaattcgttaatccattttaaaaaatataacacaagtcaggaattcagtcatattttaaatatgaagcatttaacacagtgtaatccaaatatatttggcactttaatactgagtgatgatggtaggagagacatgtctctgttttctgtaattaatcctttatatttctctgagatcagagaactctctatgggcagtaaaggactgaaattcataacattatgacttatgggagtggtgaatctgacccgaggtgtttgaagtgtttctgatggtgcagcacaatctatgggttgacaccttgtgtaaaaaccacattgaatgttctgatggtgcacctgggaaaagctgccagaaataccttagatatgttacacaattgactttgaattaagttggctgttgaatgatcaaccttttctttgttgccaggttctctgcagcccccactttaagaaaatgtgtcctagggagttaattgtggtgagaggtaaaaagacttgtgaagattataggcagataaatatgggctatggaacgggctgggcttgggccttgagacgctggtggagaggagcagctatgaaggatggtttcaaacctctaggctaagcaagaaggaagttggcacctcacaagcagcactgggggggggcagttgtgcagaaggtgtgggctgatgattcttttggagttcatcttgagggactcaaacgctccattttaaaatttcttttacttacttattgaggctttcacacatgtagatttgactatggtcatagctactccaactttcagagaaatctcagttcccctagatacacactgacatagcttcttcccaaattcattcctcttattctttcttagaggaaaaactgcacaattttttaattagtgatgtccatctgcacatgaaatctatgtgccaaacaatggaacaacagacccacataaaaatgactccccctctccagccaccatcaccagcagttcctccaccaggattaaggcctagtgatccccttacccacccatgctagacttttgactagcttcactctgtgcagatcaccatggcccctgccctgagtgacacagacacaccatgacgtgaggatggcgattcctacacgactccccatcccctagttcttacattcttccacctccacagcccttccacaatattccttgatcccactggggtaggggattgttaaatatttccttgagggcagcggaaacagtcactttacccagctctttgaacagttatgaatgtgtgcatcaacctctgtccattgcaaaaagcagtgtctctgactgagcccaagggcaggcagctcaggcatatgagtataaatgtgaagactgattttcctatgtccatctgacaaactccaagagttcctggagttgacctaggatgcctacctgctgtatgacacggataacagtaactagaagaaggcagaattgtttcatttgtgtctcagagttctctgttcctttctctggctgtggagatccttctgagcaggtattcatccagtcaaaagggtgcgtctttgctcacctatatatctgcatcgacttacagaacatgttgggaattttgcccccatatgctggtatttacaatgtgaaaattagcaaaaataaagagggggacaatctcagattagtgccaacctgagctaaattatcatacaaccttttctgaaataacagtagcaaagtaataaactgaaaagagtcagggtgtatgatacgttcatggactattaaaacccatccgactgactctgagagacaacacctgtgggcataaatgttttgcaacctacacttaataagggctcaacttctcctctagcccaccacccagcagaagtagtggaagagaaaaattattaggatctgggaaaatggacctgttcagcaatagttctctgggggtgagccccattttcatggggagcagttcagtcccgtagcaaacaccaagcagaacgtagcatctgcagaccagccctctaagaaggcagataacaggcatgaaccagcagctatagtccaggcttttcagcaagcagacatcagacagctgtagttcaattgtgaagaaactgccaggctcgccaacctgcctgaggtgaggccacagaggctataagaggccacaggaaccccatgagcagttcttgggtgagtttctctcaatggtagaattatcacagttgagctcaacaatgctatgtaaggggaaccagtacatgcagttctttagcaaagaacagtgaggcagaacaaaccaaagctcagtgctcctctcccactgtctctgggctcatatttatactccttcatcatgagtcctttcatgtgtctgctatagcaaaactttccttcacctgtgtctgctttgggaaatcagtctttcatgtgtgtgctttagcaagacatcctttcacctgggttccccggaaatacatcatttggcataactaactttccaaagaactacaaggttccacttgaaaccccaccatccttaaagctgctaagcacatttctgtagctggtattgccccttcggggccggacatggcttttgggacccctgttcctatcactggatgccctctgaagtcataggcatagccatgttgctttctgagtggaacatgacttgaaggtggtcagttgtctcaaaatgtctgcagcttaggagaggactgagcaggatgggagaattggaaagcagcaataggtgacttccagagggaggccatcaagcacagacacctggatttgaatcaagcatgaaccaattgtttcttgtgtaactctactcattggttacaggaccaccaggccattgtgcatgactctgatcacattgatcttagttacttgatctctctaaggctgtcatcatagtttcttttctccttttccgtgtaaaaggactgtgctagctatcaaacccaggatctcacacctgctagctaaccaagccttctaccacacagtcacatcccaacaaggaaaaactaccttgtcttaatctgtgaatgctcctgggttgatcaattactggctagccggtgtgaggtccagggttcaccactcactagcacaaagagtgacatcacttgtaagaatgaggatggtgatgattgatattcaggataatatacagttttgacttctctatatagaccaggaaaagactagcttttcaaaagtgtaaggagttatacatgagttagttactcccaggggaaatagagaagacttggacttagaggtagagtctctgcctaatctgaaccaggcactgggttcattccctagcaatcagtaagcacagagtgatgagggtaactggagtgccagaagttggatgttggaagcaggaggatcaggagttgagggcatccttgagtacatatcaagattgaggccagcccacattatgtaaggaggctgtgtaaagaaacacacagcaagaaaggtcccggtgtctgcttggacaggtatgaaacacgtccctcatcattcttcagtgtgatggagaaggttgcattccacctgcttccctgaattacgtcttggtaacgaagtccattcacactcttcccttcaggtaaatggctgccataaaggatcacacttcaccatgtcgcttggattgaggctgctgtggataaaaattcctggaaaaaaagctgtgtgaaaaaaagcagaccgacagacttaagcttcaaggactggggagagttcagaatattacagggtcatttcctaatgaaaactcttctagtgctatctttagcccctaaagagacattcttgtccacctctcttttgtatttatcatccatacaaacagataaaaactctttggaatgtattaacaacacccccttctcagcctgccaaggtgctaagaagaatgctgtcacatagaatctgaggttgggtctggtgttcctctacttttaagactcctctctgaggtttccaccaatatatattaaacatccattcatgc

SEQ ID NO: 178 - DNA, 51444 bp, Mus musculus
ggattattttgattttcatgtattttgttttattctatttctagtagtggagaaagggatagtgaatgtgggaaacagtcagctttagtgctcatacttaatctagagtatctgaagtttgtttgcacttagggtgaatctgagagaagttggagaaaagaaatgatgacacccatggtaaaattataaaataatattaatactaggtcttttctttcttaagtatgtgatgcttaatgcaaagaaaacgattttgtaatgttttttaaaaacataatcttatgtatagaaaacaaggaattatgaatatgaccaagtctaatcctaactcagcaaaccgatactacatgagaaaaatctaaatttctattgattttatacacatacaatcaaaattcaaaaatgaaagtcagagaccatgtagttttacaataccatcagcagcaagtggcggtctgtgtctgttgtgagcttcgcatgatgctgggtggaatcatggcttctgtgatgagtttgaacgcggtgagcagcatggtggcattcagaatcagaagcacacattacatgctaaaggcacaatactgaaatataatgtaatgtatgtatgtaatgaatgtaacttatattttctataagcacaagagtgaaatgtatcttaatattcaggattatgatataacaataactgctcataaattttgtaaagacagaaacacgattcttcccccaaaaatataaagagacattagagaacaaattaaatcaaatgtcaatgcaaatcattctagattatgaggtccctgtaattctatacgaagattgtaaaattacaaacaagtccttaacttttgatgtaacataaaattagtcagatatgtgctctttaaaaattatttaagcatattttattaaatattccaatattgtaataaagtgatgttacatgctaagaacatattttttgaatatctgtttgtgatttatttgcttcttactagagttgtaatgctttagtttcagttattaagatggaaaatcagttaattacatgcattaacttaagagaccagagactcctttctatttttttaacttattctttaatctttttttacactccagactttatccccctcctggtacacaatccaaatgttccataccccacaccacctccccgaccccatctccaaaagtatgtccccacaccatccccactccctggtgttccaattctcttgaggcttatttctaccttctctgtctgagtccagacctggcagttctgtgctgtgtatgtgttggaggcctcatatcagctgctgtatgatgcctgcttgctggctccgtgtctgagagatctcaatggtccaggatagttgagattggtggtcttcctatagggtcatcttcctcatcaccttaatccagcttttcctaatgcaaccactggggtaactgtcttctgtctactggttaggtgtaaaaatctgcatctgactctatatgctgttccttggacatttaagggcagtcctgataggctgctctttataagcacaccatagcatcagcaatagtgtcaggtcttggggcctcccgttgagctggatccaattttgggtttgtcactggaactccttttcctcaggctcttcatttttgcctcaaactgcagttttttttcagacagaaacaaatctgggtcagaaattttggctataggatgacaatcccatccctccacttgatgccttttctttctactggaggtaaactctacaagttcacactctgcttggtcttttgctttgagatttgagagtatctcaccttccaggttcaagagactcattccaaattctagactatgctgtgaaatactgttttcaataacgaaagcacaataataaacgtttttcacaaaggcttttaagcagatgaattttttaaaattctctttaatttttgttttacagttcagttgttatgccctcccagaccaccctccaatagttcctcatcccattcctcccccctttctccaataggatgcccccacttccctacccccaccccaccagacttcaagtttttcaagggttaggtgtatcttctttcattgaggccagaccaggcagtcctctgctgtatatgtgcctgggtcggggctcatatcagctagtgtatgctgcctggttgggggctcctatctgaaagatcccaagtgtccaggttagttgagacagctggtcttcctaaggggttgccctcctcctcagcttcttcaagtatttccacagggatccttggcttctgtccactgattggatttatataggaagtttgagaccattctaaaacctataaagtttcctttgctcatgcaaagttaatattattgaatatcctataatattatatgcacaacctatgataataggttgggatattggtgtgtatttatttattcatatgtgcacgaatgttaaatgtgtaaaaaaagcatgtaggaatgaaaagccaactgctttatcttctttatttgatctccaatttattttgctacagagtctgtcattaaacatatatcacaattttatagaaagtttatattacatacttagataacaaatagacaatctcaagttgattgatagttttttattaaattattttatttacattccaaaacttgttcccctttcaagtcccccctccctgatatattcaccccatcctcccccacccacctctgagagggtgctccctctcctgcatctctacccacatcagcattactcctccctggggcattacaattccacaggataaagtgcatcctctcccactatagccatacaaggtacacatgtgcctggggccagaaaccagtccatgtattgtccttgatgtttggcttagtctttgggagctcttagtggtctgcgttagatgaaactgttattcttcttctgagggataacagaagacactgtccagtcaaatgccagggtccacaaaatattagaaacttcattatcacatggtttctaaaagctactttaaaattaacagaagtgatttatttcagaagaaaccctttatctatacaaaagggtgacttctgtttctagtcactgtcaaaaagtttcatgaacaaggaaaatatgttaacacatgtagaatcaagccatactgaacagaattaaggactttcaattcctcgaattcttaattctactaacattcaaaaccgagcctaaggagtagactcatgccaattacttgttgttgttgttgttgttgttgttgttgttgttgttgttgttgtttttgttgtcgttgtgttatgttttattttttgtgaattttaaatgaataaaccatccataaatgtgtagactcctcgtcatatgtacaaaccataaagggttttcttataattaatgttttatgacaatttaccttatgcattattatctcagtttatatgagaaggaaattaactattcaatatcatcatatgaaatttctaatcatatgaattctttaaatgattacaaaattgtctatattaataagtatttgtaaatgagtcttcgcatgtgtaaagatgctgcacatatgaacacaggcttggggaggacaaaaatcatcatgtagccttatcctgaatccaatcccaccatatttttgtgattggcacctagagatcagcagcttgtcagggaagaccatcgcatatggtttaattgttcatttgtttgttttctatgcagtagttagagattcaagcacatatctacatgttccataacaaataatttacaactcaatttcattaaaaaatttatttttttaaattttttattaatcattccatttgtttacatctcaaataatatcccccttccaggtttcccctccacaaatccccatccatatctgccctctcctccctcccatttgcctctatgagggatcttccccaccaacccactcccatccctccacttcagcatccgcttacactattgtacatattgttcacaaatataataaaattatcttttgtcaattcaaattcatctctatgaattgatttttccatctccctatccaacatttcatatactgtcatcttctgtgtaacgcttatgacatgatgatgcagtatttctctagaaatttcacatgactccttgggtaagtgtaggcctgcataccagagactatctgagtagatctccagccaaggaagggaaattgtctctgtcacctctgctgctgctgctgctgctgctgctgctgctgatgatgatgatgatgatgatgatgatgttgatgatgatgctccaagaaacctgctcacattggctgtgctgagcctaaccagcaatagtaatgcagaggagcttctggtggctaaggtttcaggagagcagttctcttctctggtatattatagcttttatgacaaatactctcagacaacagagtaattttcacacacctttattccttctggataggatcttatatacagttttggggtggtgcagggtctgttagtaggtgcttcctacacatctacatgtggaagggcttagggcgttgtatttacatgactcatggccacgaatctctttatgggggtttgcagctatgtgacagggtctggggactggagcaggcaaagctcctactcttccttcaggatctctggattgtctaaccttagcttgatcttaccaggcttcctctcatggttaacaatactgcagtgtacggttgtaggcctgtgcccattccgccacagggcagggcctcttggggaggcagaactcatggagtttgattgtgcttatctcatgccaagggcagttgccaggatgtagggaagcactgagactcaactctgggagtaggaaagcacagtctgggatgtgggaaagctggagctggcttggggatccccgggcctgtgacaaggctcgtgaaaacccaggcactgctgggagctacaacaaagcagagaatgaagttgagggccatggtctgtgtctagcccatgtccaggggatgggttggggaaggggagctccaatgagtcccagcagcgatagtccttggcttgacagcagcaggcttggtggtggttgtggctaggagtgcagagaggccttctatgagagactagactgaagctctgtatgtgaaggcattttctctgccttgcaacagtgtgtctcaatgaaaagaagaagtccatatttcaaataatttattatcatggaggaaagtagatgcattaaaccatacaccacttcttttttcacacttttattagatattttcttcatttacatttcaaatgttattcccaaagtcccctataccctccccctgccctgctccccaacccacccactcccgcttcctggccctggcattcccctgtattggggcatatgatcttcacaagaccaagggcctcttctcccattgatggcaaactagaccatcatctactacatatgcaactagagacacagttctgtggggtacgggttagttcatattgttgatcctcctatagggttgctgacccctttagctccttggttacttactctagctccttctttaggcaacctttgttccatccaatagatgactgtgagcatccacttctgtatttgccaggcactggcatagcctcagaagagagagctatatcagcgtcctgtcagcaaaatcttcctggaacatgcagtagtgtctgcatttggtggctgtttatgggatggatccccaggtgaggcagtctctggatggtcctttcaactgcctcagctctgaactttgtctctgtaactccttctgtgggtattttgttccccattctaagaaggaacaaagtatccacattttggtcttcctacttcttgactttcatgtgttttgtaattatcttggttagtctaagtttctgggctactatccagttatcagtgagtgcatatcatgtgtgctcttttgtgattgggttatctcactcatgatgatatcctccagatgcatccatttgtctaagaatttcatatatttattgcttttaatagctgagtagtattccattgtgtaaatgtaccacattttctgtatccattcctctgttgagggacatctgggttttttccagcttctgtctattatcaataagactgctatgaacatagtggagtatgtgtccttattacaagttgtagcatcttctgggtatatgcccaggagtggtattgctggatcttccagtagtactatgtcaaattttctgaggaaacaccagactgatttccagagtagttgcaccagtttgcaatcccaccagcaatggaggagtgtttctctttctccacatcttcaccagtattttctgtctcctgaatttttgatcttagccattcttactggtcatacgccaattcttagcgtggatctgagattaaatgtcttttgcagggaggaatgtctgggaagggaagattattagcttgccctctgggcttcttcttacctcattagcatggagaactcagttttaggcctaattgactgcagtcacatccccttttactattattttcatctgagttgttaggaatgcctcatctacatgtggaagtgctaggggcattgcccttacatcactgatggccacaataatatagagggctgtagatatatgacaggagccttttgctgggagcaggcaaagctcttaccactcttttagagtcttgagctttcaagcctttagctcaaccttactaggcttcctctcatggtccacagccccacactgcaggtaattgttttctaagttaaaacagtcattcttcatattggatgtgatcactttaaagagatgaagggatatttttaagcaaacacatctgtaattaagtaagaatagtcgcattaagtctgatatttggctactgcaccatcagtactaagaacaacgacaaaaaaaaaaaaatcaaacacgcacacaagtaaatgtagactagaacttttttgtgttattgtttatttctcctttaaaattatgaagacccaggtattatatggggcagtacaatgaaacatgattcataaaagtatcctcaattaacaaaatcatattttagctacccagtgtttagaactatgacagttagcagggggcaggaatctagttgctggctctgagtcaaggaggcctctatggaagtgaatcaatccatcaggaaactaagccatgtgagctgccatgatgactgtgaacaatagcaacaagatggtgcagcacattaactacaggatgagaggcatcctgcaaaatggctagatctttactggaccttcaaagcatttgacaagcatatgaatttatcttctgtgtctgtgatgagttcaggaagattaagctaaagaactccaaacaagcagaaatagaagagaagtgagtcattgttctggtgttgctttatgggggagaacctggtctacacgacagtagaaggacctcctcctcctaaagatactggcattgcccgagtgccaattgttgaagctgctggatggccaggtattctcaaggctgctagaagaggaatcccatctggtgttcccatgccccaagttcctgtaggtttttctgggctagtatgagatattggagggtcatcccagaaggtgatgaccccacaaggaagagttactgttgcagctgcagccagagccagtaatgcaggagtctcaactcagtacacacctggtaatgggtgtcctcctccacctatgggtaaaggggtctcctccaggtataatgggcccatgtcctggcaagaggtctcccattcgtgccccaatgggatccctcctggctgaggaactccaatgggtatgaccccttcctgggatgtaaactccttctccaggaatgcaggtatgctctgatcttcacacagcattatgtcagtagcttcatagaggtgcggcccctattttccagagccagattaacagagacatctttgctttttatgctgtgagtagagtcttactggattgtgtggtttccctttcagggcccctccttgagaaatttgccctccaagactcatcttggatctcctcagatacttttctgttttttaaaaggctatatgtaatctaatttcctgtgtggcctatgaagctaataataaactgtgagaatgttaaaaaattattatagtcattatcaggcttgataatgagcaacacaaagcactttaatttcataaacacaagggatgtatcacagagaagtgattggtgaaaaggtaatgctaatgagatgctggccagtcaatggatattcattttcaaatagtgacaaagaaatttgctgagtacatttatttaagtgagagtataaaacagaaatctgattccactgagagataagtgattttcaaatattcatgtgccttgctggagttcataggatgaatggtacaggcagatagggtatgtgtttgcaaaagcaaaatgacagttaaaccttactccaaaaccctgatcttaatgcaattttgctatgccaagtgccattgatatcactgggaggcctgctcatttctgaagtgaaatggacatgcagaggagaagggggcagaggggtccagagcaaggggcaggagcagactctgtggctgggaagagagaacaacaaataaacaaaacaaaacaaaacaaaacaaaacaaaacaaaacaaaacaaaacaaaaacagttgaacctctgaaaccctgaaacgcagcatgtccccaagaaaatgtaaggaacagatttcaaactgtatcacgttccttgcctttttcttcaggactacaggactgggacagggatgctagatattaagcagaactagtggcttcagaagcagattcacatttcctacacagaagcaggagcctgtgactaaagcagaagtgtgaggaatcccagaaaaaatctctgcctgtgccatttattggctctgtcgcctgcaaggttcaggagcagtcctccttttcttttgcagcttacagtcaggctttggctagatcaggtaccagttggtacctggaatctagccaggagcctgactggtaaaaaccctggctgcagagatttttattacctctgattgcctctgattggaggagtacgtacattcaaatagagaatggactgagaaccaatcaggagagagatctcaaacccaggcatgaaaagcaaaagcctgcaagcctgcggtaaccttggagatcttcacaagagcagctgattcatttatctctccacccaacccccgcctttgtgttgcagcagaagcagggaaaatgaaagagaaaagctagaaaaaaaataaaatttaaccctgagtactactggctctaatcaacaatccacaaacctgcccgttgtacttagagctaatcatggatccgggtgcctgggaatggatgctggctatctagatgaaagcctccatttctgtctgtatctttctgattttgagtctagaatgctatgtgcagtgtgctgctgactctttgtgatatgcttgtgtcagtttccccaatggctatgattatatgcttgaattataacagtacatgttatatttgtgtctattagagtgccttatcaaaagctgttttggtttgaaaaggaaatcttgcctttaagccctacttaaaatgtatccaactagggtatttttcacaatgtcataatgataaggaaatagcttaataggtatttattttattaaagatttttaaataaatgtatattctgaacaatgttgtgtaagtgtagggaaggtttttatgtgtggttgtccatgtgtctgctggaaagcagcaatcattatttctcaggggcaattgatattcttaacatttttatccaaaactaatatatgaaataatgcatttgaaagaagtattttctctctttaataacaaatgaattaatttaagacatctgtgtgtgcatggacctgagatcatctactggcacatggatttcctctccaggcaagcatcccgagaaaatctgactatcttctatcgatcattgaatacaaagagccagtctgacaggagatgggattcatgtgttctgcctctagccatggcaaatttagactgacaggatatagtatatgaattatgcatacaattacatatgatggcaactcatgaatgatattatgcttagatatcaatcaactaatgatccaatgcattggcacttgatgatttgaaatagtgtttttacaagaaatggaatttgccaaatagcttcacctaattggctagtgaaccactgagctcttcctgtcaccactcccccgagatatgccaggattgcatgctaatcattcctacatgcctgcatttcaatatgtgtgtgctagaaacaaaccccaaaagcatgttttctcatacatatgtttctgactatgccatctacctagctgtacatagtataaccttaaaagcaaaaaaatgaattaatgaatgtagctcaaaaaccacacaaatgttcacatttaggtagacatcgattattcttctctaattctgactatatacttagcataattccagtttcaactttagtgtggtgagcacactgaactaaaatcttaagatatgagcaagtgtctgtaaagttcctctgtgattccccacgcataaaatggaacaagaacagcacataggattctcccatatttttcatctcagattttagtagaaatcctcaactttattggctttcgtttacaataagcttcatttatgaatttattacgatatgaaacccttatagacagtccctatgtcattcagactgcttgctctttatttatctactcttcacaactgtgctgtgttaatgtaaacactgcagctaagagtgtgacaaaatttcaaagtaaactgcctgactttaccacctttttctagtgatataatttgctaaattttacccatagaatgttattagtgtcttggtgctcaaaggcatatctgaatttttaggtatatctttgttcagcaatgcagccctctatcatgttcaataagaaatgttatgcctaatacaataaacatggcctactacataaggctagtagtattggtgatacttaagacatctttcagctgctaattttcctgaaatagtatagtatgattttaaaatgtgttttaaatatctgtccttatactcatagacataattagttataaccttcagggaaaccttcatttagcatcacacaatgaccactacagaattccacagctgtataaacttcaaagaaccactgacagggatgcgtctgacgcaaatgatgatagaacaaacttcacaattattccaacacagacataacactgcctaagtgaagcaaacagattgtaatatcctgaggaataggatgcctactgtgaaggacgtgttttctatgtagaataagcaagctacacacatcaaatcttaaaaatatgtgcatctacaaaagataaaaagaatgacactacaaattggtattccctcaaggtgagaaagtatcatatcacatacttggctgaaaaaccacaggcaaatcatggatgcttagagggagaatagatttctccaagaacgtatcttatgatcatatatgtaatgttcagaatataatatacacatcaaggagtacttatgtatacatttttacatgaaataaacaatggtgatttatagaatataataagcatttagataatgtagcaggcattgcatggataatggtaggagaagaaatgttataaataaagcaaatacaaaactcaggtaggaaacacaaataaatcaaagaagtttataccatatatacacacatatacatatggaattggaatgaaatcactttgtatttggatagatattgctctcacaactataaatcttataatatgaaatcaaatcactggttacactaatgagtttttgagtgattggacataggggccgtttagtctattactcaaacatcgaataccattcacaaaactataattaaatatctacatcatgatttagagttccagttgctgaagattctacttatttatgttattgaaaatgtgaaatacatctactgcccaattagaagcttcaaagttatggactgcattttataaggctgaacattaagctatatactactggaggagaaaagaaatcatcggtggaacaacaatatgaactaacaagcacccccagagcttgtgtctctgcataggaagcagaagatggcctagttggtcatcattgggaagagaagccccttggtattgcaaactttatatgccccagtacaggggaatgccagggccaagaagtaggagtgggtggataggggaacagggggtgggggagggtataggggactcttgagatagcatttgaaatgtaaatgaagaaaatatctaataaaaaatggaaaaaaagaaatcatcaacataacaacctacaaacctacagcagacatcagtgagaagtatcagagacattgacataaacattataggagtaatcaactactttgctttgtattaagaccaacttcatgatatagaaaaccctcctcagaatgctaatgtggccaagaacctgagtctaaatatgtgataggcctatgacaaaagctatttctctatttctgggaaaggaatatcaaaataaaatgagccctaatgacatgcatcaactccccttgccaagccacacaggtctctgtggaaaagaattccaaaagacagtaacatgcccaggggttgatcactgagttttaaaaacaacaacaaaaacaaaaaacaagaaacagaaaactcaaggaatgttttgcaaaaacaagtttactgtcagacataggtaggcactgagactggcagcccaaacatggtctgaacaagctcaaatcagacaaaaataccagcatgggaagggaaagtagacataaagaaggacccttgcccaagaaggtatttgcaactgatatctgtggagaaggaaacaaattaggattttgttttgtttgttttgttttaaacaattaaatatcagcagttatattgttatattaatcacacttctgaacagccctcatttacagagacagcaaaattgatctcttcttgtttcatttttcttttgggaaatttgcttcttctttttttattattactgccttgttttttgatgttgagatggctcagtctttagtttttcttccttccttatttccttactttcttttatttcatttcatttcttcatttttagttattgtttaagagggagagaaagacagacataagaaaaagagaccttgcatatgaacaaggatacatgaaattatgttggtaaagaggtagggagtatctgagtcaagttttataatgagaaagaatgtgatcaaaatatattatttgtaaatattatatgtaaactatattaattaattaatggagtccaaacacttaatatatagtcagaatttttatgatgttgaagaaattttatctaaatatacaggtttaagatatgcaaagatttcaattaacaagctgcattaaaacaaggaatgataaaatcctcgtgatcatcttaaactacaaaataaaaaatctttgagaatccctagctaccttcatgattagaaggaaaccactcaaatattaattgcaagaacactatcttaaggggaaataatgcattagctggtcttaaatgcctcagtatatttgcaattttaaaagtatttaatgatgacaattgttgacacctctattggacattgttctagaaggcttcgtgaggccatttattttggaaagtaaatacttagaactttcattttttaaatattcaaagcttaaaggaaatacaaccatttctaagttttgcaaaggcaataattcttgtgtatggaaaatattaagcactaaaatcatatttatatataaacataatttcagcaaagcctgacttttaaaaaatacacattttctatttttttacaccagcactcaaatctcaaaattgcatgttagaaaggaggtattttacaatacccatcagctgagtgttgtggtttgcatctgtatattagcttctcatgatgtgaagaggcagcatggtttcagagatgagtttgagactacggtgagcagcacagtaagagcctattaaaaaaaaaagcacaggtcatacatcaaaagaccaacactggaataaatgcaatctgtttatattccaaactacaagcacaaaagtaatacacatgtaaatattccagaattatactaagcatgcaaagaaaacagttcaattcatacattgaggtccaaataactctcttgaaaggatttgtgaatgctatcatctgctgatatgaagccccaacatgtacacagcagaagacagctgggtgtgaactcagtcagagaagatgctcgagagacttggggccccagggtgtggagaggtctagtgaggtgagggtggaaatggggccacttcctcttggaggtagggggataggagatgtgggatgtggaacagttggagtgtgaactgggagtgggataaagtctggactgtaaaaaagattaaagaattaataaaaaaataaaacaataaaaatgcccccatatagatcatgtaaaaacataataaaagttcgaaaaaagccttaaatatcattattagttaatgactatcataattgactattaacaaatcttgcatgttttcaaatatgtaactaaatattctttttttttaagtttccatttttttttttttgtatatttaaatcaccagtccactgtgtctttgcccttcttttaatagcagtgtcccccactgagcagtaagtcacaactttggaaatgaacaagtcatcatattctttctcaaaacaaagaagggttgaaaggctctcctgtcacttttaggggacttttctagactcttggtaggaaaaaaactatgttgaaaaaggacgatgactcttggatatcaagatcattttaaaaagattgataaaacaacccagtaaaaaattgatctctaaatctgagcgtgatggcactagcctgtaaccatcacacccaggaggcaggctcaagcagcacatctgagcccaactttccctgtctcagaacaaacacaatcaacaaaaggcttgtgagtgctgacacgagaaatgatttataaactgttgaagattcccactcaaagggcagagaaagaaactttcatttagcatttataagtcctggtctttgtttggaatgatcattttgcttactgtgatttaatgggaggaaataaacctcccttttttccccacatttttattagatattttcttcatttacatttcaaatgatatcccaaaagtcctctatgccctccccctgtcctgctcccttacccactcactctcacttcttggccctggtgttcctgtgtactggggcatataaagtttgctaaaaacaaagggcctatcttcccaatgatggccgactaggccatcttctgctacataggcagctagagacacgagctctggggggtactggttagtttatattgttgttccacctttagggttgtagaccccttcagctcttgggtactttctctagctcctatattgggggccctgtattccaacctatagatgactgtgagcatccacttctgtatttgccaggctctggcaaagccttacaggagacagctatatcagggtcccttcagcaaaaacttggtatattcattattgtctgcatttgatggctgattatgggatggacccccgggtggggcagtctctggatggtcggtccaacctttcattttagctccaaacttcgaaaaaattggtttatgtgctaaaagcataatttttaaatgcctcttcatgatatcctttcgttttatgagaattatattgcctgagattgagttccaaataaatttgtacgacttgcactgatcactgtaagtattgatcatctatgtaaacatgattattatttgaaattgcaaaccaatttaattccatgtgttaatctcattcatatagcatagattagcttgagattctatgctgtaaacactagttttcagtattgacagaacaatgattaagtaacattttacatcatgtttatagcaggggattattagctggcaggaacttgatataatggtagtcattacttttcaatgttttcactgtaaaatccacatatatatattaacagaataaagtatatcaaataatctaaagtaataagcaccaatgcatttttcaaactatctaatgatgataactaaaagcacattaaatgttcagatttattgattttattgatttgaatcttactattgtgaagaatcagaaagtcaccaaaactattagatattaaaaccattcccttgtaaagcctccatactttgcttttgatctgatggcaaaatgcatcctaaattgataggagatatcaaattagtcaatactaacccatcatatagacaccaagtgtagagacatagactttaattcacattttctgtatttaaagaaattatagccaaaatattctctaaatgtttaatggttaaattgtacatggttgaaataaaacatagtgctaaaaaacaagaacttaatctaggcttagtgtttcatgcatttgatcctagccgaggaagggtagactaaagtaaatctctgttggactaaagcaagccaagcctctctaaaaattgtcaggccattgaagcatagatagtaggtccttgtctcaaaaacccagaaatgacttactatgtaccatgtagtaaaggtagttatgtacgtatttttctttttgcaagaagatgaggtgtgtacacaggcatgcagggttgagagactcacatatcttcttcaaccaataaccaatgaatattttgagatagggtttatgataaagctcagagagcaccaatctttatagactggctagcacatgatgtgactctagttagaaaaacacaatgctgacttattacacattcatatgcagactcaaggggctagaataaaagtccttctactccactgtgtgcaaattacagaacaaggtatctcctctgtctagaacacttacatatgaggtaaaatgactttacacactgattaatattccaacagtaataatatttcaaaaaactggcctgagatacattgaagttaatgcaaggtaagaatttattgaaatatgtatgctacagcccaaacttctttagttctgagaaagaaaacagagctctaagatatgtatgaaaaaagtggaggaaatctgtgaaacctttcaaaggaacaatggggcaaagaatgaagaagtacaaagtcacagtagaatgtacacagaactttgagttagtaacatactaaagattttctgataagatcaaattatcttattaaatttttatgtatgtatactatatttggatcatttctacctctcccttagctccttcaaactattcccattgggtgtcagtatcattctaactcatgacctcttctgactcaggttttaaaggatggaaatatttaataataataataataataataataataataataataataatagtattggatctgaatattttaactctatgttcagaaatcacaaaaggggccaataaatgatgtctacctctaaggtcatatgactatgtctccataggggctcttgtggtgattttgaggactaactcaatgcttaatagaagtttacttttttttttcatttttatgaaaatgataacattcatctacaaggtctttcaggaaaatgaaggaaacaaattataggtcctggaataaactataaaaaagttatcaaatagtgcaggtaaataatatgagattataggaatatgagttttcttaagtgttgaccaaattctttaacccacgacttttattgcttaccaaattatataagtgtgttcaaatatatcagtacttataaaggattttttatgattatttataatgaaaatataatatattcattaaaatgtgaattctttgaagatgctggttaccttgaacactcatagggccacaatgtcactctgaggagcctaccagacacacagatattctatagggagacatgacaaaaaaggatgagcttggcaagcagacagtatctgtatctgtggaataagcaaaaaaggcaggacttatgtgaagaggcttttaaaaagtgatatactggagtgatgcaaaaagatgattaaatatagctggtctcgaggcagagagaagatatactagagactcagtggaggagacagatatgaaagtatgtcagtgacagacaaaggaacatgttcttgatgagtaggggaaatcctcaaggcactagtaagcttgggccaacactagatctggctttctccattacttcctgatatgccagactgctgtttagatgacaggccaggcccttgtcattgagccgccactgttgctgattgccctgctcagggcagaagattatggggccacagcattgcatgcatgctgccagcatgatagtcatgtcccaagtgctggtatggtagcaggcagcagagcaggattgtgtgcagcagcctgaaacccatgcaggtaatgcccccagtcaaaacctgtgcaactacatgatctttttgagcaacaaaaaggcatctaagatgaaaaatggttcattttctggattaagtctcgtcaaaagatattcatgactcatactaatgcaagcagacatgttaatgttcttgattcctgccacagataacattttactaaataaataagattggtgagttcactctctgatgattgattttctaagacaattataaacaataagaatgtaaatggtatgatgatttcttgccattctatgcagtgttaatatgcatttagatatcagtttaacagttattaagaacagtgcactcaacctttacatgtttctgcctcctacaaagagatccccttagttaataagtgtattcaactgcacttcatgataagacacctcagaaatgactaaaaatgatgtatgagttatttcttgtcacttccttccatgaggaaaaaaaaacatatatacaacatcaccttcttagatacaacgtgtcctcctgaaaccttcatttttcatacaaggctatgcccaaagttagggacaagcaaaatcaacaaaaattttgcaaccatctcatgtacatatatattctcttttttaggttcattatgaggtaaattgtattagtattatcaatgtaaaatctagattaaacagaaatgtaaggaatatagtttaaataatataaataaaggaataatgtgtataatgggttaaaatatataaatctacattatggaaagtcatgtccttctgccaaactgttatcccctcaccatatcaagttagctgccaaaatgcctctgctatctctgagtgataaaatgtttaagatgctgattctttgttaagatgattgttttcttcccatataaccagcaacttagacctacattccttctctctccatgctccccttgataattaaaacttgttgagaataaaatatataccagagtattaaaatcacaggtttgccattacaaaaatgaaaatgtgatttcaaacagcaatcataccattcaccgacacaaagaaatatctcacaagtaatcttatgagactggtttttgtgttgctactgtggcaatgatacagtcaaaattagagggtacaagtgtatagatatctcatgtcagaaagctgtaattcaaaaagtctaaattcagcaaagaattatgagtgtacaaaatttggatttcctcataaaatgtagcaaaataatatcattttctattggccatttatgttctcagaatttttttatctccaaaactatgtaaattggcctatgtaagctacagaagtgtgagatcttgccattagatgtgctatcaccttgcatgactccaatgttttatatctttgcattttagaatacagctaatatcagtgaaatctcacagatgttttactagatagcagcaaatcaatgattctatatactcagtaaaaagactacatggggattagatagtattcagtcttctgtgcccatggtatcatactaacacaagtatattctatctctattatttttatagagaacatgatttgtgcctcaaaaatcatgatttgtcccagacatattctcactccttggtcttgtttctatgtgggccagttttgacatcccacctaagtatgcttccttgtgaagtaacttgtactggctagttttgtgtcaaattgacacagctggagttatcacagaagacggagcttgagttgaggaaatgcctccatgagattcaactgtaaggtattttctcaattagtgatcaagggggaaaggccctctgtgggtcagaccatctctgggctggtaatcttggttttataagagagcaggctgagcaagccagggcaagcaagccagtaaagaacatccctccatggctctgcatcagcttctgcttcctgacctgcttgagttccagtcctgacttccttggtgatgaacaacagtattgaagtataagccaattaaaccctttcctccccaacttgcttcttggtcatgatgtttgtgcagaaatagaaaccctcactaagacataactcatgtaagaatactttcaggttatacagcataataatcataggagaattattaataaaaataagaagacaaacaatatggtaacactctcgtaagaattcactaaaataagaagagattaatggaataatatacattttacaagatatcacatacttgttagatggtataattctgttgttcctttatatgcactgatatatctccatctatgtaaaatattcttacattttgtcttcatatgttaaaaatctgagacctaaatggttatttgtatgtgtatttgtttatgtatatacatagtaatatatatatatatatatatatatatatatatatatatataattggtattgaactaatcacaaaataattttgaagaatttgtaattatgtatgaaatttaagaggatgctatatacttatataatagttattgttatttctaggtcactgagtttattccctgttggactgttgaatatttagtaaagacagaaaaatgaaccttagagatcattttcttggttcctgtatatatttctgtttcccttattgattgtgtttaatatgagccccatgcatttcttcactttcttcttgaaaatatttccaatacaaaaggacacattctaaaatgctacatacctatcagtccttcatttcttctcagatattagctaaaagaactgtcaagagttggaataatgtttgctctgggtaaattgtgattagagtgggcagagtacaggagttatccacccaagagaatagatgccctgatgtggtggacttcttgtgtcatttaaggggaggagatttagaaacagaaactagagatcttctactgtgtccactcagtgtcagaacatcagctctgcatttctcctctaatataacctccagtttcacaattagcattgttaagcatttcaatagaaacttttaattttgttacttctaaaaagaaacaagaatgaggagagactgagttcccttagagaatctgctctagggcagaatatatcatacatgcgttgatacacatttatttgagagatttaccaatataaaagtactgggttacaagagttgaaataaatgaaaattacctctaaatcattagggtgaaacattccaatgactggttggaccttaaatcaaggaattgttcggtttattcttttcttttgttttcttctggttttttttcccctgtcttttaagtaaggtcatttctgttcttgggggcactagagttgggatttctatttagaatatttgatagctgctgtgtttgatagaggcatagtgtaatgttttctgatatagaatctcttaaagaaacaaaagagaattttaaccagcatttaatatttagcgtaaaacagtagtggtactccctactttgacttaaagtacacactttggtattgtattgatccactgtgatgatgtccaatgtttgaatgtgaggcattccacatacaaaataaaaatgcaacatgatatctctgtttttatatccaagcgcaaaattttagacagaagtacataacctgaactatccacaggagccaggatttttaaaagaataatgagctcttggaaaaaaatcctagagagtatgattagaagaatacatgtcaaaggatggaagtgtgaaatatgagtaattttctggaattaaaaattcaattgtgaggatataggggagagagaaaacaggatcatgtagtgtgaggcagtggaccatgaaaggaagcctggtaaggttatgctaaggctagaatctcggagacattgtaggagctttgtctgctttctataccaggaacttgtcacatagctacagtgcccctttagagagattcgtggccatgagtcacataagggcaacaccccaagcccttccacatgctggtgaggcatctctaacatctcaaaccaagctaataggaagcaagtactgtcagatctcaacccaccccaaaactgtatataagctcctatccagaaagaataaaggtgtgtgagaattactccatcttcatctaagagagtctgtcataaaaattgtaacaccaccatggaaaagaaccgctctcctgaaatgtttgccactttcactcccttgttggctagccagccttccactggctcagcctggctcagctcatccagtccagcatccagcggtgattgcatcagtggctgtagctgcagcagagaggcagtggaggcaactgccccttcctgcacacaccctttccccttcacttgaactgtcccatcttgactggccagagatataaaattatatatagtataaaataataaaaaatatgaaaagaggtaaacacaatgaagaagacaaagttatagtaagttatgatgatttatatatgcttggcacagggagtgtcacaattagaaagtgtggccctgttgtagtagatgtgtcactgtggatgtgggttagaagactcattctagcttctgaaaagtaagtcttccattagaaccttttagatgaagatgtagaactctcatctctgcttgcaccatacctgtctagatgctgccttgctcctaccttgatgatactggactgaacctctgaatctgtaacccagctccaactaaatgctgttctttgtaagacttgccttggtcatggtgtctgatcctagcagtaaaactcaaactaagacataaggatatctgaaaacatctaaagtgatcatttagttatctatctaaaatacctatgacaaatataagtcatcatatagatcaacatatattacaaatgaatctttctcatctaggctaaaaacattcccttaaacaaaaaaaatttatctgatcaaaatttcagaaaagaacatctaatcaaaacataatgtgaaacccaggtaatgaatattctataagaagtcactatacaaggactaaccgactaaagtaagtgactgtacatagagccactataaatgaggattaaggaacaatgtaagagccaaggaatctaaatctttactgtaattccagaacttacattcatactacctcacccaaatcaaatatatgctaataatagagaacaatagacatactaaatggacctaaagaattaacctgtcataattttgaaaaaaaaaagaggaaagttataatggagggaggtaggaatgaatggaaaggatgaaatgtaactatagtaaaatattataaactaaagtaataaaactacatatttacactaagtagaggtgaaagtatctgatgtcctaaatggaaacaatcatagaatcccaccaatgttctctttaaaatcctatgactttacttactaacttacagagcactagtgattggctcattaccgtgatatgttcactatgatccaagtactgcactagtctagaatgtctttccaaagccaggattatgaggctcaccagactccactgatggagataaccccccacatcaaatttccatggtctggatattacagactctcacaagttcacattgagttaggggaaatatgcacactagttatagggcacatggatcctcaagtaatggtctcctgacctgtcctgtcatttagggagggatataaataatcaacaagcaaagttaggatatctggtttcaagctggcccagatgattgccctaagattttaggtattgctctttgaggacaggaatatttaatgcattcctctattccttaagataccccatactttctacccccctcttcctctggagtaccttttgaaggtattgcataaatgtctgccaattacccagctccagcagttttctgaacaatgaagcattttgatcaaaactctgtttctggagcctgggcttttgaaaatattaggcatttctttactaatgagtgccacaaggaaatgaaatgatgaaaaataagaaatggaaaactataaatatacatgtaatagtggcccgtgaaataaacacaaacgtggggagaattttaggtgtcactatatatattcaaccaatatgggatgcttcctcactggagttcataacttttattgccacgggtatttatatttatatatgttacatatatatatgaaaatcaatttatatatgttaccaataccatatgtgattttttcctactggaatggactcttaagccaataataacattgatttcatacaaaatctcccatggcattattgcacaaggtaacatatataaattgattttccaattgtaatgttagatatagaatatccacaagtaagtctggctttggcatttaactttccacaacatccttagtgggacttactggtattataaaactagttcacaaagtggagatatatctggccggtcctaagattacttattcatgtctcatgctctaagcaatttctcagccataggaacatttcattccatccttgcataaaagcaacaaatataatagcctttattaatatagaaacctcaggattatgtagctaacaacataattgtaacccactcctagcattgccacccaaaatttacaatattagggattctacaagtatctgcttttatcttttatttattttctaaagaacacaattgtacccttttacatcaccttggtgcaggtcacatgtgccttaggcaacaataaaactccccaaaaactaaagcaacacctcccctttgcacccttcattagctaaccttcagtgcttgattctttgcatatgcatgtgaaatgagtagtccaaatgaaaatactcagattagcaatatgtgatctacaaacaacaacaccaacaaaacgttatacaatgtatgggcagaacaataaggaaaattcctgagccaccatcctaaaagtaaatggtaaaacagctgaaatggtatacatgggaagtcattttgaaagcccattgttatgtgttctgagcaaatgttagaaagctcacaacgaaatactatcctcaaatataagacacatgttctagagcatgggtagattcaaaatatcaccataaattgtttatttcatgtgttagtggtagatgcacttggaacactagcatcattaggtattggatgataaaaccatgccagaaagtttggcaatataaagcaagttgagatccagagacttggtgggcacacacctgaggcttaagtgattcccagctccctggcagtctctaggcatggaacacatgccatactcctcacataaggaaacatgccctaaggtcacataggcctaaaacagttctccatgctaatgaggtacctagaggaatggagggcttagctaatatgctttctttcccagacattccttcctgcaaaaggtatttaatctcaggcctaccttgaaaagagaatatggtacattatgcatccatttttcaccatgaacaaccaataaactttttagaaacatgaactgtctttttcaacaagatccactgtggggagccatgaagaacacattcacctagaaagatgcaacttaattctcctgtacaaggcatctctgtactcccagccccaacagccaccaagcctgtctctgtgaagctaaggacaacaatcacagctggggcaagcaggaggcccctttccttcatggtcccaggctagacgctggctgttgactctattctctgctcttctgtgacctccagcagcactgaatatctaagagtttgagaacactatggcccagcccagaagcatgcccagagacctttaaaccagctttgatgttcttacaactcagactgcactttcccaccctgggaatagtgcctatggacttccctacactcctaccacggcagcagattgggataagtgcattgcagtcaaactcaagttctgcctcatcaagtggctatgccctatggccctgagctaattttctttcatctcccagaaagctttcatagaactctccttaattttctcaccaatgagtaaattgatcaagctttttcttttatacttttcccttgccttcattctatcttcagatttatctgtacaatttggcttttttgtaaaattgagttatcaatattattctaatacagagaggttatgtataagcatgttttatagacctgtcagcctggacaaattttaaactactagtagtttctcttcccactagttacctgacccacctagagatagctttaagcctttccttgttgagcatccaccaactctctatatagttgctccttgtccaaaccttgaacccttgatacagtaaatgtaacaggaaagaagtatgtgaataggtagtttatgcagaaatattgccaggatatgaagcaaaaaaatagcaatggataatcacccacaccagagattgacttattgttctctatattgctttactgtggatgccttttatgaatttttttcagtctttatatcctcctacaataacataagcaaagagttaagctttctttcaactcttccccctaggaactcataaacaacctaaatcttgccactttcactttcagttccccaagtttacttgttcctgtttgtcttttgtcttattttctccgtattttatttcctcaatagaaatatacttatcatgcttgtctcagtcaattttatgtctcaatttatttcaaacgttaaaaatatactgccccgtaaatagcctacaaaaactaccatactttcttgatagtcaagaaatcatgaatgaatttaattctttctttgacctctgctgcaaactatacctcagctacatggacctaggaatcatacattcctttcctgatacctggttacctaatgcccaccttggtaacctcacaacagtgtttatcactacccaacatagtaagtatgcctttgcaattcatgaccttaaacaggataaaagaagaattatgtgaatgtcttctaagcaaactttcattcaacattatttcaatagcctgctcatttatcatctcaaggataccatcaatttcatttccaaatgctacccttgatttttctttataaacaaaatacccctagtgttgtcaatattcctttacttggtgagagatgtacataatgcccaaaactgcacccaggggtaaactaatttacaatttgaccaaatgtgctctgaggaaaaagtaagattcttgggcctatttccaatgtacaagtgataaaccacttactggattgtgagaactccaaaagtaagcttgtccaggaagtctttttccagatgggatgatggcttttaagaaccatcctcctctaaaatttagacatatggttttcaagaaaaatttaattttaatttactcagatatgtatataacatgttggagagaagctggaatgccaagtaaaaatcctgctactcttctttctcttctacattgacatggaaaccaacaacaatcaaagtttatatgatctttcataacctggtacaattatactcccaaagacgttgtatggcttacaggttagttcttttaaggccatcatttgtagaacccaatggaatctatttgaaatatcagccacatctgactggcagggttgattgatcttccctcataagtttccatttgttgttcatcaccatttctgtctggtatccacatgtgcacattgctggtcgttctgggagacagctgctaactttttgagcttcacatctgtgtccaagcactgagtatcaaacaagacaacaggaagtagctacaaggagaccactggtcctttcaaatttagtgactaaattttcatttacatggttggttagctttcagccaactgatatttgtttacaactgtccaagtttcaacctcctattaataatcacaatccctaatatattttactatacaaccatgagtatagtgttcaaggttggatagagtagcagctatacagaaagcaatcacttttaagatgaatggtaacaatgacatgcatgcagctacacagagagggtttatgaaagtgtatatgtgtgtggaagaggtaacaatcacaaggattatcagaatagagggaaccatggcatggcatgacctgtagatatttgcgaggattctatataccattactataacactgattactcactacctgagacactaaacagacaacaaaagaggcaatattaaggacactgaataagttagaaaagtattgtaagacatgacagcgataagaataaaaaaaattatgaaaagaatctgccaaggggctcagacaagtaaaatattacttcacagccccaatgtttagccccttatgattcttctgatactccatgactgagtggctatttctacaactgatgtgcttatctggtatgtatagaacatcttcagaaaatgctttcattatccaagttcaatgacgttaaataactcttaactgtcccttgcttgtttaagtaagataaaccatgaatgagaaaaagaaagaaagacaggaagaaagaaagaaaagaaaacaaacctaagaatcaggaagtatgtgtcaccgtgtgccctaattttcatattcataatctgtaaacaaataagtgatgactcagtgacttagttcctttacctgaattctattaatgctagaatattcaacttgtttacctcacagaaactgaaaaataaaaacaaaagtgcaaggccttaggttctgacttgctagaattcaaagcaagcagcatagagaaaaggaatattacattatatttctaattttaaaatgttcattgtttggagatgttagtgaaagaaagatgaaatttcaaaacctgaaagtcatataaagtactcagaaattgttgggtttttgtgagcctagaggctgcctggggctgagaaagaagaaaaactaacctgggtatgcccggtaattaaatcattcctaggaacagcttaaccttaaagataaagaggaaagtgagggcataacagggctatcttaactgagtcaacaacttagagaactctgacaccctgcatgtacatgtaatatttctgctgatgtttgaataagccaatagtgtgttgctatggtgaattccacaccccctaagccccttaccccataaaaacccctagctttcgagcctcgtggcctacatctgttatctcctgtgtgaaatgcatgtcggtccataactcctccgtaattaaactacctcatgtaattacatcaagatggtccttccggaattttttgggtgcacagcaaatcaggaattgaatgggggtttccccactaggttctatcattttgaggttccactgagatctgtgtgacaaccaggaaccccgaaggaccccttggaggtatgtttgtttgtgtgagtcttgcatgttgtctgttgtctaagtgtggcaccgctgaatttgtatcttggtttttcagttctgagattgttgtaccttggtttttcagttctgagattgtgggtttgagttccaccttgtgtcttggctttccagttctgatattctgtattctggtagctgccactgtggaccgtaatgacctagtggctgcgggaggaagactttctaaggccccgctggctgcaaccttggaagatgttccagttccaagggtgaccctggaggaagtgcccagggtaagggacagtcagagaggtctgattgtcatctggcagagtgagaaaaataaggtgctttttctgccagaatgggagtcaatatggaatctgacccctgtcaggaagtagcatttggctggttgtacaagtccaggagcagacgagtatgcttagatatactggtgtcttattctctgttgctgtcttgtttttgtttgtggtttttgtcatgggacacggacattgtacatcagaagtaaagtggaatccctccttgcctgtctgtctgtctgtgtgtctgtcttgttcacttgtatgtcctccattagaccaccttctgattctgttttgctttttgtttgtctggtttcaggtctggttttggtcccaaggggttgactggttatctctgtttggttttaggcccgtcacaggttctgggggccttcccatggagagaggttcatttgggttggtcacagtggcagtgagacgtgccaaaatgttgcaggtgacaatgttggaggatgttctcctgtcaagctgggaagttggatctgaaacagtccttctcaacccagcagcagctaggtttcagtatatgcctggaacagatagtgtcgggcttctctggaaattgcgtgtaagatgtcctgtatttctcttgcttgtgtttgtcatttctgtggtactgtgattctatggtggttgcctgaaaatgatttctgtgtgtgtcttgtgtgtctctttgtgttccgacttggactaatgactgacaactgtttttgagttattccctctggaataagcctaagaatcctgtcagatccctatgctgaccacttcttttcagatcctcagctgccctgcctcccactccaactccagggagcagccagctagtcacagtggtcctgcccatggacctggagcctagggagaaatgagctcgggaaaccagagcaaaagagaggtggtccctgataagtcagtggccctggatgttttggctgctgaagagaaaaagaagaggaggctgtgggagtggctggccaagtgtgccacaggatccctggctgcttctcattcccctgtcccctgcatctcgtatcttgttaacagaaaacgtgctttcttaaaaaagtgttttcactttaacatatcagtggcctggtgcagccagctgtgagagctgcactcccttccctgcctagtgttttctcttctcaggcgacctggccctgagctgctggcagtgagtctgttccaagctccagtgagggaggcatctgcccacttggagcttcagtccaaggtaaggagcaactgtgagtctaacttccaggctctgatgggggtctcatctctgtgggactagaaagtgccctaacaatctgaccgaggtaataagaagttacagaagttaagagaaggacagggtaagtcggaaagaaagttagcataagttgataaaaaagtgcagaggaggagaaacaaaggaaggatagaagtctgcaaagaagagctaagagcaaagcttcagcagactcaggagagaaagatgacagtggcaaatagagaggttaacagtgaggagaagtaaaaatagagatgaaggagattagagaggtctgagatgagagagatactctgaatgagaaatatttagaggagtaactagtaagactcagacaggaagaagagttaaagaaacatgaggctgacaatgtcagagaccagaatcagaatcagagatgtgctgtgagactgaaagataaaccagggcagaggtgaactataagagaagataagtgacaggatggagacctgatatttaaatagcatccaaaggaagcaaagacaaggaaggggaagaaaagatatatatatagagagagaacactatatgagatcactattacagttaggaaacaggagcaaagagaggtaaataacaaagtctagaacctgagaaggtagcacttgctaataatgctagcacttagtaatgatctgtaagaaacaggaagccatggaaataaaaagagatgagacaagagaaatgaaatgaaatgctggccacaagagtcagtaaaattagagaacttaaatagtacctggcaacaaaagaaagcttttggctaaagatcaatgtgtttactgtaaagaaaatggacactgggtgagagattgccccaacaaaaagaagaggagcccccctcatgaccaaacccttcatgtgttcatggctaaaagtaaagagataataaaagggtgctaacacagaagctgagtccttagaagaggctggtggcctacctgttaaagaagctagaaaagagacagtgtttcatattcccccaccaaccagtgcaaaacaagtgagaaaagttcctgggcactgtgagcttttgcagattgtggatttcagattttgataaattaaagagataaacagcccttcatatagagaaataaagaacaacaggccttggatgctattaagactgccctaatgtcacccccagttttgggactcctagatgtgactgaaaacaaaggtattgccaaagaggttcttactcagagattgggaccctggaaaagacctgtggcatacttgtaagaaactacacctggtggctctaagatggcctgcttgtctgcacatagtggcttctggtcaaggacgcagataaattgactctgagacaaaacttggcacatgccctagaaagtgtggttcagtacccccgcccctgactgatggctgactaatgctcttgaaaacatttacacaatggagtgccactccactatttaaaagaatgaatttatgaatttcctaggcaaatgaatggacctggagggcatcatcctgagtgaggtaacccaatcacaaaagaactcacatgatatgtattcactgattagtggatattagcccagaaacttagaatacccaagatacaagatacaatttgcaaaacacatgaaactcaagaagaacaaaaaccaaagtgtggatactctgccccttcttagaattgggaacaaaacacccatggaaggagttacagagacaaagtttggagctgagacaaaaggatggaccatctagagactggcatatccagggaaacatcctataatcagcctcaaaacactgataccattgcatacactagcaagactttgctgaaaggaccctgatatagctgtctcttgtgagactatgctgggacctagcaaacacataagtggatgctcacagtcagctattgaatggatcacagggcccccaatggaggagctagagaaagtacctaaggagctaaagggatctgcaaccctatagtggaacatcattatgatctaaccagtaccccggagctcttgactctagctgcatatgtatcaaaagatggcctagttggccatcactggaaagagaggcccattggacttgcaaatatgccccattacaggggaatgccagggccaaaaagtgggagtggttggggaggggagtgtggggggggtatgggggacttttgggatagcattggaaatgtaaatgaagaaaatacctaataaaaaaagaaaacattttccaactgttcccctgactgatggacacattatcagagctttttgttgactgaacgagtgaccttcactaatctactgcctgagacttcacctattcatctctctgctgacattctggcagaagaaactgatactcaaaatgatctaacggatcagatcagccttggcctgagagttcgagctggtacatggatggcagtagccttgtggttgaaggtaagtaaaaggtggggacagtagtgcagtggtagacagaaagctaaacttgtggctttgctacaagctctataaatggtaaaagagaagtctacactgacatcaggtatgcctttgccactgtacggagcaatatacagacaaagatctgttgacatctgcagagaaagacctaagatgctgtgtctaaaagaatggatacagaaaatgtggtacatctacacaatggagtactactcagctattaaaaagaatgaatttatgaaattcctagccaaatggatggacctggagggcatcatcctgagtgaggtaacacattcacaaaggaactcacacaatatgtactcactgataagtggatattagccccaaacctaggatacccaagatataagatataatttgctaaacacatgaaactcaagaagaatgaagactgaagtgtggacactatgcccctccttagatttgggaacaaaacacaaatggaaggagttacagagacaaagtttggagctgaggtgaaagtttggaccatgtagagactgccatatccagggatccaccccataatcagcatccaaacgctgacaccattgcatacactagcaagattttattgaaaggacccagatgtagctgtctcttgtgagactatgccggggcctagcaaacacagaagtggatgctcacagtcagctaatggatggatcatagggctcccaatggaggagctagagaaagtagccaaggagctaaagggatctgcaaccctataggtggaacaacattatgaactaaccagtaccccggagctcttgactctagctgcatatatatcaaaagatgccctagtcggccatcactgaaaagagaggcccattggacttgcaaactttatatgccccagtacaggggaacaccagggccaaaaagggggagtgggtgggcaggggagtgggggtgggtgggtatgggggacttttggtatagcattggaaatgtaaatgagctaaatacctaataaaaaatggaaaaaaaaaaaaagaaatcagatggcagacctaactgccaaacaggcatcacaaagagcaatgatcctggcagtctgaagactatcaagttatagacaaaataagactagtaaaagaaaccctttataaaatagtagaaactgaagaaagaaaactagtcctcccatgggaagacagacctggtgtctactgggaaatagactttactaaaaaaaaaatatgtgtatgaataccttctgatttttgtgaacattctcaagatgaatagaagctttttcctgtaaaaatgagactgttcagatagtcatcaagaagattattaaagaaaaattttccaaggtttggagtgtcaaaagcaatagtgtcagataatggccctgcctttgttgcccaggaaagtcagggtgtggcccagtatttagaggtcaaatgaaaattatattgtgtgtacagacctcagagctcaggacagttagaaagaataaatagaactctaaaacagaccttgacaaaattaaccatggaaactggagtagacttggtgctcctttcccttgccctatttgaaactggaaatactccctcttgattcattcttactctttttgagatcatttatggggcacccatgcccataactgtcttaaatgatgtgtttaaacctatgttgttataataataatctgtatgctaagttaaaaggtttgcaggtggtacagaaagaaatctggtcacaactggctacagtgaacaagccgggtaacccaaagacatctcaccagttccagccagagatctgatctacatgcacctacctcatgcccagaccctcaagcctcgctagaagggtccctgcctaattctgtttactatcccttcttattcgttttttgttcccatgttaaagatacagtacagcttatggtcttccagcgttaataccaacctatatagttaagatagaaaaagaatatgatttctattctccatatagagatatagacttctgaaattctaagattagaattacttagtagaagaagaggggaatgaaagaaagatgaaatttcaaaacctgtaagtcatataaagtactcagaaattgctggttgtttgtgagcctagaggctgcctggggctgagaaaaaaggaaaacaaacctggttatgcccggtagttaaaacgttcctgggaacagcttaaccttaaagataaaaagaaatgtgagggcataacagggctatcttaactgagtcaacaactcacagaactctgacaccctgcacatgtaatttttctgctgatgtttgaataagccaattgtgtgtcgctttgctgaattccacacccctaagccccttatcccataaaaacccctagctttcgagcctcatggccaacatctcttatctcctatgtgggatgcatgtcagtcaggagctccgtaattaaatgacctcatgtaattacatcaagatggtccttcatgattttttgtgtgcacgccgaatcgggagttgagtggggatttctccactaggttctatcattaggaagaaagaataagcattaagacacagggaggtcctaaaaggcccccagtccccccgcaagcatgcagaaccctttatttcctgtttgttactgcaaagagattatctatcagggttttctgagctggttaaaatcaacatgggcttctatgatttagccatcatagagataaagtgactaaaccaggggatctcttaagtatcctaaaaaggagaacatctgtttcttctgggactgacagaagtttagtttcagaaagaacatagggcttcctctcaagttttctaccactgagcttcacattttgctctagagttatttttcttagcattatctttacttctcgaaaatcttcatggaaatttatagaatagagtgtctttggaaagagaaacaaatctctttatacatgaaatagaggatagaacttgttgtggataacagggattactgttatatgccagacaatccaggcaaatacaccctgctctgctgtaacaagtacatctctcaaagggcatactttacttcctctatagaatccatagaaaataagtgatacaggtccatgaatatgttttcaccaccattatcataagccattggggcagtatgatcatgctgattttcctcatatccctaagaaattaaagaactagattttaatatcccagtgacttctcaacaaatacttacatttcaggcataaaagtcacctaggaaagtttcctacaagaaacaaaaccttccttcttacctcactcaagcttccacctcttgaatttcaggacctgcacaccttgaaattaaagcaaacttagtaaaatttatttttattacatgagaaatactctagactaaactaggttgaaggaacagagaagaggttcatccatcaaaatatgaaaaaaaaaatggctaggatagtattggtagttctcctttgaatgttaggtagcctaaacttgaagacttacactcagctattcacatcttatgcttgaagaactgattgtaccaggaactgactttggagtatggaattaagcataagagttattgcccaatttgacaattaccagttgtatcaaggaagggggtatgccctctctgactcaaaaatactgcttctgagtcatccattccccagtatataacctcctctcttaattacttagtagaaatcttcaaacagacatagaatatcaaacctcacaactacttgagagcacattactcctctttacttctgtaagaatttgaaattgaataggggttccaagtgtactagtcatggtagtattgttggccctctcattaaaagcagctctcaagaagctggacagtcattgtcataaacaagtattttctcacgtttgccattcaggtacattagcttgagtagaggtcttctaacatctaggatgagaatttccaacaaaagtaacttgaagaagtttggtcatctggataaaacgtgatactatttcctgggaataacaacggagtaagccttggagacagacaaatttgaaaggttttctaggattagttagagatggaatgacccaaatctagtattctgcaaagtgatcttggattaaatgtttcaaaagacccctgggtctttctattattgtcccatttagacatcaactactcatcttcatttctcttcaaaatatcttctaggaatattaatctcatatgtcagtaaaatcacttttatacctatgtctctgcaagtctccttaacttgccattgttgatatattgatattaatcagtaaaacagagtgatttataattataatggaaacattgggaagatgtccagatataatcataaaggttttatccagcagcacataagaatggatgctgagacctaagccagactttaggaagagagggagtctccattgtaggtctccatcagttcactctctttggagcttaggtaaacccatggaagagaaattagaatgattgtaggagtctgaaggaatggatgttattagcagagcactgtctaataaaacaactaagcagtacacataaaggctcagcaagactgaagtggcaagtgagtagactccaggattcttcccttggttgtctgtatatgttgggtttattagcttggtgttttgtaggactcttaactatggtagtgtgtgtgtatgcctttgactgttttttttttttttctgctcttaggaaatttatccttattgtccagcctcagtgtgaagatttgccccttgtcctattgtattttatgatgcttggttgttctctcttagaaagctctcttttatgaaaatatacacaggcagagtggctctgggatagaggggaggtcagggggtgctggaaggagtaggagtggaaactatggttggtatgtattgtatgagaaaaaactatttaaatttttttaaaaattaaaaagaaatatatatgtatatgtgtatatatgcatatatatgtatatatacacacaaatatgcacacatatatatacatacaaaaatgcatgttataacaattaatgaaaaatgaaaaactaggtcattaatatgaaaagacaaatacaattatatgtgatggatggagcaaggaagggaagagaagggtagatgtcttagttagaattccattgctttgactaggcaccacaaaaataatttcattggggctgaattataaattttgtgaactattatcatattaggaaacattgaatcatacaggcaaatatggttatgtagaaggagtttagtgttttatggccatctccatatggcagtacaaagagggaattatactgagccttccttgagtatttgaaacatcaaagcctaatctcaatgacaaacttcctctaacaaggtcacatttccaataatggcattccatatgagtccatggggtcaattttatttgaaccaccacaatgggaaaataaattctgttaaatctcataaaataaagcaaacaattaaacaataattttctccttaggagcaatgtaaggaaactctgcccttccacttaatacactcaaaacaagtctacattgtattacaccaaagttatctctggggcaccaataagtttattgggtgaacttctataacacaaaacatactgttgtatgtatgtctgtgatctgacacaatggacaagaaagtttttacccagcaaacataatggttctcccataactccaataataaggccactgcacctggacttctttggcctacatacttcagccttttcccaatgtctgaaattagaaatgagatgcatacaagttgttgaaacatatgttctcctgactcttcctttcattaaatgaggggttgcaaatagccaactactcaagataatctttccccagggaacacaaataaatgctcaagattgccatagttgggcttagaggatggaaatatacaacacttccagttatctctccagttcttttattctttccacatctttgatcatcaagaattgctgagctttgaagagcattatatcgctgtttgataactctccttgagttccagcagggtatagaatcctaaagaacttttgatatagtcaaaatgtccctggaacattaatgctagaaactgctagggatttttctgaccacgagaaaactgatgaaaaatgagaaataaacatgatacaaatacacatggaatattttagtgtcatagactgtaaacacagattacaggaatacttagctggcattgttatgaaccagtcaatagaagaaagttcttcactatagcctaggagttccctggtcacaggtatttccaatttttttttcatactaggttttttgtttctaatacagaatgaatcttaagtctaatagaaatgttgatatctaccaccatataaagccaacattgtaaaagctaatacatcttgattaacacttctactgggaaatgcttaggattcaaagtgaattagggtttggaggcttaattctcaacaacattgttagtggccctggctgaggctataggacctaactccccagggactggacacttaggggcaattttagctatattgctcctactcatccaaagcaattatcccttcaacaactagacctggtccttcaatcctagaatgcaaccagcagaggtaacaacacgctttgtaattgtataatcttgattcttcagattctcatgcatgtctcctaaattagtccagaaattaaaccagtcaaatattagcaaggtatagtagagcataggtagattacaaacatcaatgtcaagtgtttctccatgtttcaatgttgtatataacagaattcatgagaggcactaaatttggttaagtattcagtatcagtagttattttctttgaatcattccacttccattctcctatactcttcaacacagctcccttcatttcccaaccttatagatttggtttgccatacatagacaaagcgggatgaaatcttgcttttcccatgctttgtctggtattcaggcatgttatcagaggggcaatgggttcacactgtgctgtagttgacaatgttgccactatatcaatcatgtctgactgctagtggaggctcaaaattgactactggagagcaagacaaggatcattctgtagaatagggtggttaactgtttgatctttaaaaattattgcacataccagaggcagccttgattgccattatctttattgataatggccataacccacataagtttctgtcatttgtttgtttgttttcttctgtctcttccaacttgctcgcctgtttacaggaacattttacatggtggtttaagtcacttttgtctgcctatagatattcaacattattaagaactcaacttaccaaatgtatggttctcaaacgctataaccacgccccatatcatcctcaatatccctgttgatttcaagtctttttttttttttttaagattctggtgagcacagagctatcagccccagtcaactgcacatcagcatagactgctttcctcatacctaatgttctcagtagcacttatctcatctatattgcactttagctgctgcttcatatgggtagcttctctaatgatcatccaagtatctcattctctaatggcccatgtgggatcaccctaatggcatgtctcattgcacttaaacattttctaaactttctactgacctcttaagtccagttggaagcaaattctatgtaaaattgtcttctgaaaactccactacacgatgcaattttgcttcacctatgtgtctcactataccatgcaattttgttttagctatgtgtctcacatcatcatgtcaagagcatcactgttcttcttaaatctataatgttttgttgtaaaccttaactaccccatatactaccataatcccttcccataggaagagatgtaaacaatgtctacaggtcctactatgttcctcttgacaaatcaatttcaaactaaacaaaaattggggaatcattgaagttttggttttacctacaaagcacagaatgcatgtccttatgtggagtgtgaatggtactcccactcaaatcctctacctagaagttctactcagcatagatgatatattttccatagatgcataaatggatcctgcttacactgataacctacctcatatacatttattcattttggagagcaagtgtaatgttgcagtaatgggtagtagtaaaggggtgaatacttagatcatgttttctttatgtctgctctttactctggagatagaaacagtccacctgaatgtcttttacaaattggcacagctaatgtttccaaggtataattatatgatgtagaagataaccctgtgcaacacggtaattcaaagatatcccagagaaacaattactgttatgatcccaccatcagccacaatagggttggtaatgcctcacagatttgtatttggtactcattacattccagtctagtccttagatatgtaggtttgacgtctttcccagagacaccagctgactttgtggacttgatacctctaaaatggtattgagtgtggggcctaccaacaaaaaccagttacaggaagatgacagtcctttcaaactcatccaacaagtattcaaatgatagaactgcattcatgctactgccatttgatcactttgacaatttacaaataccaactgcctattagtatcaatcacctatattatattttattacacaaccacacatgcaaggattctgcatagcaacaattcatgaatatatagaagtagccacaaaaggtcagaggctctacaacaagaaattagctaaagccatgatgaatgggatgggtttgtgggcatctgattagagaaaatgtggacaaagtctccatattagtcaagattcgtaacataacataagcatttgcaagaattctctttacagccaggacaagagaaatttctcacttctgagaagtcctatctgtatatactatgatgaggagatgatatctaaagtgtagtaataaaatgaggaactggagttcagtgaaactagaccatactcatacatatttatcatagaaagcaagtacctagtaggagaatatccgcaggtgcacagaacagaggaatctgacttatgagccctagtgttttacctctattgtctttcctgaatattcaagaatgaatggatgcaccaaaatataatgcagacccctgttgtttatgggtgctactctgcaaaatgcttcttttatcctattacaagctatattttacttagttcagttcactgttgtgttcctttatataaaacctgtggatccaaaacaccctaactggaaaatacaaaacctaatggagccattactgatgactcttaatctatattgtaaaatctaaatttcaatagtgtatatgggctaactacattatctaatggaggaaaaactatttagattgttgtcttttctgtatgttacccttcaataaccactcaccttagaaatacacagtcttgtcttgccttcataaaatacaccattaaaaaatcctttgtagttaatattctcttcatttttctcaaatgtgtaatctgcaagcaagcaagataagcaaggaatcaataacttaactcatgtacctagattctagagaatgttggatgcaaagattgttcatttcacagtaattggaaactgcaaattggaaaacaagacaggcaacatgtagagaataaatatatactctctattagaaaaaaaatgggacgttgttggtaaactggaaaatcagctattacgacttagtatggccacatcaacaccctcacatccaagaagatgaattctttgcttctcactggtactggaggcagcttgtctagcacctggcctatggatatcccaggagtatgcacaggcaccaggtatctctcgataggcagcaatgagggggtgtgtcagcaattctcagggtgaaaaacttggttgtgccaaactaaaagttgcttactaatatagattaagacacatttgttaaacagaaggaaataaattacatggttaattgttagtgttctcttctcttttgcccaaaagctttgcctctagctggccaggtgagaacgaaaataggcaatattaacttttagtgaaccaggaaaagaaagtcatgttcatagaagcaaaatcttttacacaagcaaatatccatagacatatacacattcataaacacatttatacacagacagacatggcagaccataccatctgtctcattcattccacaaattctcatgcatacttacatagtcacccctatacttatatgtaacacatacttatatctccaacctttattgctcaaagaaagaaaaggtttctataatttttttctgttagtataaaagccctttaagaaaaagctccaccgggcatggtagaaacatgttctttcccatactagcttttgatcacatatgccatagaagatttgccccttgtcctattgtattttatggtgcttggttgttctctcttagaaagctctcttttatgaaaatatacagaggcagagtggctctgggatagaggggaggtcagggggtgctggaaggagtaggagtggaaactatggttggtatgtattgtatgagaaaaaattatttaaaatttttttaaaattaaaaagaaatatatatgtatatgtgtatatatgtatatatatgtatatatatacacacaaatatgtacacatatacatacatacaaaaatgcatgttataacaattaatgaaaaatgaaaaactaggtcattaatatgaaaagacaaatacaattatatgtgatggatggagcaagggagggaagagaagggtagatgtcttagttagaattccattgctttgactaggcaccaccccgccccgccccacctggggatccatcctgtccacacacaccaagcccagcactgttgccattgccaagaggtacttgctgacaggaacctggtgtggctgttccttgggaggtctggccagcaactgagcaatgcagatgtggatgcttgtagccagcactcagactaagctcagggaccctagtgggtgagtgagcagaaggaatggagaagcagagggtgattgcaatccaataggaagaacaacataggctggcttgaccacccagtgctctcagaggctagactaccaagcacagagtgtacagggaaggatccatggctccacatacatatgtagcagaggatgtccttatctgacatcaatgggagaagaggcccttggtcctgtggaggtttgatgccccagagtagaggatgctggagtggtggggtgggagagggtgggtagttgagggttcaccctcatggggcaaaggagatgaagaaggggttaaatagaggattgggggtttgtggaggtgtaactgggaattgggatatcatttgagatgtaaacaaatagaatgattaataataataaaaaatagtcttctctgatagctttctgtttagattattatgtttggggaagggggtttgggtgtgggtattggttgtcacataagccttctatgttcctcctcacagaccttacttctgttgaaaattatcttattagtttattcattgtttgtgttctgcaaatttaatttttcaaaacatattatagaatttttactccagtgtaatcctttgaaaattaagaaattgaccttgtaaattgttgatattgataatgtggaacaaactttgaaaaaaatatttaacagtggtatcctctattctatgtataaatatgtactagtattctagaatggtccatggacaagaaaaataaaacaaaccaattcaaaatattcacattgatatctgctttaataattctggtcaaaaataaataaacatatttaatatatttagatgctattcctgaacagaacaccaatggcttgtgctataagatcgagaattgacaaatgggacctaatgaaactccaaagtttctgcaaggcaaaagacaacgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagttcaaaaattcaggtgacagcagatgctggcgtggatgtggagaaagaggaacactcttccattgttggtgggattgcaggcttgtacaaccactctggaaatcagtctggcggttcctcagaaaactggatatagtactaccggaggatccagcaatacctctcctgggcatatatccagaagatgccccaactggtaagaaggacacatgctccactatgttcatagcagccttatttataatagccagaagatggaaggaacccagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaaggaactcacacaatatgtactcactgataagtgaatattagcccaaaacctaggatatccaagatataagatacaatttcctaaacacatgaaactcaagaaaaatgaagactgaagtgtggacactatgcccctccttagaagtgggaacaaaacacccttggaaagaggtacagagacaaagtttggagctgatataaaaagatggaccatgtagagactgccatatccggggatccatcccattatcagcttccaaatgctgacaccattgcatacactagcaagattatgctgaaaggaccctgatatagctgtctcttgtcagagtatgcctgggcctagcaaacatagaagtggatgctcacagtcggctattagatggatcacatggcccccaatgacggagctagagaaagtacccaagaagctaaagggatctgcaaccctataggtgaaacaacattatgaactaaccagtaccccggagctcttgactctagctgcatatgtatcaaaagatggcctaggcggccatcactggaaagagagtcccattggacacgcaaactttatatgccccagtacaggggaacgccagggccaaaaaaggggagtgggtgggtaggggagtgggggtgggtggctatgggggacttttggtatagcattggaaatgtaaatgagctaaatacctaataaaaaatggaaaaaaaaagttgaggaggacagcaacatcattggaagactagctgtctcaaccaacctgcgtgcctgagacctgtcaaacacggaaccaccatatcagccagcatacactagctgatatgaggcctcgacacatatacagaaaagaactgcctactctggcctcagtgagagaatatatgcctaacactctagagacttgagactccagggagtggggaggagtgtgtgggggtggtggtggtggtggtggagggagtgttggggacatcctcttagggataaggtgaggaggaatgggatgaggagcagtcaaaaagggaaccaggagagagataacgactgggctgtaaaaaagatttaatataataataataataataataataataataataataataatagtagtagtagtagtagtagtagtagtaatagtaatagtaataataataatgatatgaaaacttaaaatatctaggcatatttgaaagtgccattaagagaagatgaccaaatgggaaataaggttcccttaaactatgttagatgatttgatttcaatttaaaaacctcatagtagaaggaagtaacatagtctgattctgtaacatggtcctctgaaacaaacacacaatatgaaaattttaaaagcccattctgaacgtacatataaatgtctaagattttttttaaatggtaataactgtggtaacaattctatagagactgcaggttgtttttcacaccaaaaaatgtaatttgaaagccattttacatgctgaaaacattagctatattctgctgaagctgtactatctactcaaccatgcaaacaaaatcaattctttgtctgacatcacctcctttcctgatgatctttgtagccacctgggtacaatcatttaaacagcattttaattcagcctaaaatgagttaatacattcaatggcaagtgcttatcaaagatgctttgctcatgcattctttagatgctctattctattcacattagtatactaagagggtggtggcttgtcaatcaacctgttttcattattggatgttcaaaacagcttatttccttaatttttgatggacagacaaccctctctggtggattctcacatgagctttatttagttgtgttcaatcacatctttcattttatcagagtgtaatttatagggactgaacactcagcacctcttcctgagctcctctaacacctatatcttgaatttctatcttctgaacaaattggcaacaatccatagtaagaggttttctttctgtgcacatctacatgacatctttgttggattttctgcttatttatatttctgtatgattatatgcctggctttatttcttctctattgccgtgatgaacacgaggactaaaagcaaattattgatgcaatggtttgtttttcttacaggttgtaataagggaatcagggcaacatctcacagcagcaacatggatgctgggactaagaggagaccacagtgtagagcttattgacttagtcatcatggctcaaattatttgcggtcttacataatctgggaccatctgcccagaatagaaatttctccaagtgaactgggccctctcacatcaatcattaattttgaaaacactccaaagtaaattccacaaaagacaaattggtaaacaaatttcttcattttatattcactttcccaaatatgtctgtgttgtatcaagttaacaaaaggtaaccagcacagagaataagtatgtggatcaccagacttatagaagaatatatactggataacatgctagattgtaatgaacccatgtacattaagaattatgtgtatataaagaattattaccaatgaaaaacaactaattgaggtgtattttgggtttggttgcctattacccaggaatcatttatgaaatgaaatgtgtaagaaacagagtgaattccgcgtatacaattttgaagagactaaatatgtgttaccatgatcttggcagtaagacctgtgagccaggacagctgtcattgcccttgcattaagtctctaggtgatgttactttcctaactctataatggattacaactgagtaagagttgtaacactgctcagtatgcactcacagtgtgctgggatatttttattacttcatgaacacttgtgagtgtcagacatgttgcattctttctgggtatttcactggtatattcccacacaagtgtgacattctgttatactaactgcttttgcctgacaattccttggtctttgtgatccattagttgagactgcaaatcatactctgttccattcagcagtacacaatatgatataattctaatatgcagatgataactgaacatctgatgtgcttcactgaatataatgtattctgatataaagtacccaaatctggaccttattattagtagaataaattggttttttttctccattagttcctatttctcaggaataagcatggagaatcaggcagtataatcagcatgtttcttaaaggaaaatgattaaatgaaatttcagcaatttaaaaaagtaatgtatccactattcatgataattatgattataatcagtactgtatgcaataacaaatgttcgcaatttcatgtcgcatagtcatgtgaaaaaagtctcaacgttatcgttaaaaaaaattgaactacactcacccttcagattattattccagagtcatttctaatgtcatcagtataatacttctagatatccacaaggaacaaatctccctcctgaccagattctaaggaaaacagaggcataatcattaagtgacaccactgagcctgtctcattctacagactatgcaaaaatgaagaaaaataaacacaagaactactactcagttactgctgaactgcactaaatttcttggctgtcagatgtcaatggttctattaaaatgaatggtagcagatgtcatagcttaaagctctcagagtggctcactatgacatatgagtactgaccgtgatatagaagttcttcacagttcttcacgggaacgacagaagtctcaggtttctgtcagtttctgaaggctgaagtgaatcacccttgctgcaactgaagtcggactctaatcttgcctcagaaataatcagtcttaacgccaaagcaggattaaataattccaagcagagataacaggaacaggtgagtatgattgtggggattcccacaacatccctgcaaatgctgtgtgtcttgtggctctgtctactgcaggtctcaggagcatccatccttctcgatgagcagcttgcagtcaagcccctggctagagcctggaaccagctgagagcaggactcctgccaggagcctgactg

SEQ ID NO: 179 - DNA, 5006 bp, Mus musculus
cgctgatcacaagaaaagtttatttctcatctatgctctgtgaacagtacaggtgtgacagtggcagtgcctcccaaagcttcactttttattggttcaagtcacatggtccctcactatcagaggagtaaggacatgtagtcctgagccctgtgctggaaaggcagagttcgggaaatacaggaacagcacactaatgactactaccctagccaagtgacctttgaacctgtttcctcttttgaaaaacagtcacgataatggtgtaccccagagatgattgtgagggttaggtgaaaacgtgtgtgacacatccagcgtggttacagggtgagtgagaactctcccctttcaggggcccagcccccagggaggcaggccatggttacctgtgtaggaaagggtgcacaaggctaaggcctcctcctggaaagcccaaggtgctgccatgtcatcagcagagggcagctaagttcctgcagatctgccgatccacccagcagatctcacgccaaaggcttagctgacgaacctagaattccactcatgcagggcaagccttctaccactgaattccaccccggcccctcactaatgacacctcatcttcacaaccttgttcttgctcactcctgagagtccctctccatctttttttgtaaacctacccctctggccagacagaggtagagtctattggagaaaagatggagaacccgcaaacaatgtgaaggactgaaatctactttgaggcaagcactgggtggaattcttgatgtgcatcctccctccccccattgcaactccatgatggtcctgagatgaggacgtgctccgtctcgctttgggatgtgggagctgatgctgggctcggttacatcaccgacttggggttacacagctcatcatgtggatgtgagttctggatgtgagcccagacctccgtgactcagaagatcacaactcagcctctggactgcctttcgttatttcactcagaccaaagttttgtcaggactataaacgcatgacaggctgatttcagatgtttagccttggggtcttatcatgctgccaggggcagcacagcaaccgaacttccagtcttgcagctcagcccctgctttaccatcctatgcaacttcggacaaatctctttccctcttggggcctcagtttcttcattcaaaaataagatggctgaataatgtgacctggggggttctttttgagtctagatgttgatatggagactggtgaccatgagaatggccacatcgatactgttagcaggcacagcagagtagaagggtgggtaaagttaccatgtttaagaaccatgtacagtcaggtggtggtgctgcatgcttttaaccacaggcttcaggaggcagaggcaggtagatctttgagttcaaccccagcctggtatacagagagactttcagagtagccagggcaaaacagagagatcctgtttcaaaaaaccaaaacaatcaaacaaaaagaaacatgtacaatgggtgtgcctatgatcccagttctctggatgctgaggcaggaggatcatgagttttagtggtagcatgtgcttcacagaaagactctgctttaagaagaaaaaaatagaatgaaggagagagagagagagagagagagagagagagagagagagagagagagagagagagagagagagagagagagaatgtttgaggttacatagagtattaattaaatcctaattattatttgaagccaaaaatagagtttgttttaggagtgatggatgtttgaaatccatgggcagctctctgccttccttgctatttataacagtctctggtttcctctgtggccaagtctgtctccttctaaacacaggaagtgaggctcagttcacgtctgcactcagatctcctgagtctgcagctcaatggatctttttttggggtcctgagcttcttgcgggtgggaagcgctgggccctgcttctggctggacattggaggttggagctggacatctgctaaaggacactgttataggatagactgaggcctgctcccacagatccaagcgcagatgctggggtgggcctggggttagaactcgaggtcttgagctctgtatccaccaccaccattttacactaaggcttatttagattttgcaatgctgttcctgaaggagggggtaggggacacagaaagaagacacaagttcagacctcctttggggacattcctggtacctataggaatcccttccatgtttttatctgttcccatagcactgctgttaaaaaagtggaatgtgtctaagagagctcaggccagatggctgccccaagtcactgctggagtattttaactacagttgcgtgggagcttcctgatttggagggggctccccacacctccccgaggttcccatctgcccagacgcccacagctcctgtcaggaaaaatgatggaggacccaagatgcctgggggaaggaactcaactcagaatagaagttgagacttatagtcgagtccagttaggggcttagccttttccccacccgtgtgtgtgtgtgtgtgtgtgtgtgtgtgtgtgtgtgtgtgtgtatgcatgtgcagcattgagggctgcaggcagtagctgatcctgagaaaaatgggtgtgagcctctgtgtgtgtgtatgtgtgtgtgtgtgtgtgtgtgtgagagagagtgtgtaaaacattgagggctacatgcagtagctgatcctgagaaattgtgtgtgtgtgtgtgtgtgtgtgtgtgtgtgtgtgtgtgtgtgtgtagcactgagggctccatgcagtagctgatcctgagaaacatcaaggttcattaagaagagcagctgggcagaggtgggaacacagcaaagaagcagtggttattgacgctggagagagctcagagagggcagagactgtcttagtctttccctgaactaatctaaatctctccaaatggcagcttaagcctccttctcagcttggatccccacatgacctcagccccgttagtccctcactcctgaacagaagagcccaggagtcagggtctggacctcagccacccagctcctgcttgctaaccccagagggagctgctggggtggctggggcaactggaaccttgaaaccctaatggctaggaggcctgagtccgcagccatgggcctccttgcttaccctagctgcacaccctggatgtcaggagacacagagaggaaagctctggtggcatttcccagcagcggagctctgagtcagaaggtcacctactgctggaagtctgagcagacctatggcaaacaggaagctagagttaagtaccaaagaagtccagggatgggagggagggggaacagtttaggtaaaaacacattatctttcaggagagctaagcctgttgcttgtggcacccccgggcaaagctgggccaatccagctcccttccccacaggcacgcccttagaggaatcccttagaggaatcgggacgcctagaaccacttgcagaagtccagatcttctgtgtgttgcttatgagactatttccccacttgcaaaattgggggtaggggagaaggctagaacctggctcataaggttaggagaacaaacaagaacaaaagcaccaagtacctccccgtgtaagcaccgctcagctctccacatcctccttttgttagaagacagggagcagcgtcccaatttcccaacactgtctcttgctctaaggaatttgattcactggctttgggtttcagatgctaatattaataaaatatataggatcccaccaggaccccttacacaccaccatcaccactacctctctggggctctggctctcctcctgtttgctacgagggtaggaagaatgagctgacctaactttcacattttcccttaaaactattccaaacaggcacctgggttcccgagtggagcagtcacagatgggggtggggagtggggaatgatggcaccaagaagtggatcctcaggaccctaacgtacatcccagccaagacgtctcacagggtttcatcatctgaggctgatgcaagaagcttggagccagactcccctgcctcccctcccccagaggtctccatccacatcttgagctgcagctgggtcctcctcttgggccttttccagaggaaggagctgggtgaagcctgggaagggagggcagctggtgaggggccctgtgaatggtcctaatgttggttgttggggggcagggagaagagtggggctgggagggtgcaggggtgaactggaatgggacttgacttcacattactggtctcctttctcatagccctgtgttgaaaagtctcctgggctaatcctttatatacatttctgatggcagcgctggcctcctttgccttctagcttctcccaggtatctggagtcaagtgcttctttgttcctactacttcccaggcagatctggcctcccacatcgactcccccacacacaacccgccccccccccccactgtcacaaagagtgtgaaccaggccctgtgggtcataaaggttagtgggaccctggtttagtgaggagaacctgagccagtcagccatcaaagcaaactatgagcttaaagatgttgcagagtggaggtggggaaatttacttccacatcaacaagaatccccttcaataaaggttggcggatttaccgaaataaatgcagaagggacacttcgctgactctttcaaattgcaaattgctcatctctatgagatgctttgaggtgcagcacaccgcccagcccagagaccaggttcttacccatgcctagccacagactcgctgtatgaccttggggtgttcctctttgagtcccgttcctcatttaggaaaggaagatcccactgagactgaggtaccatgacttcgagggccgtggttcccgaatggtcaacttcccagggacgagtccatcatgccactc

SEQ ID NO: 180 - DNA, 4073 bp, Mus musculus
atttatttatttaatgcatataagtacacactgtagctgcacggatggttgtgagccttcatctggttgttgggaattgaatttaggacctctgtttgctcaggccaaccccgcttgctccggtctgccccactcgctccagtcaaccctgctccctccgacccaaagatttatttattattaaaataagtacaccgtagctgtcttcagatgcaccagaagagggtgtcagatctcattgcagatggttgtgagccaccatgtggttgctgggaattgaactcaggacctttagaagagcagtcagtgctcttacccactgagccatctcacctgccccctcatatgagcactctttatgagcactgtgatacactatgtgcctgcttaatccacccagtgtgacttcccaagcctagggtagcctgggacaggtgggcaggtggatgctggtgcaaccagtaacccatgcagctgggtacctgcccagtgggacagtatcattctcagaggcagggatgaagctcattggaaagtttctgccgggcctggctgtgctaccatgtcccatcaccaagaggcatggaggtctgactcaaagctgccagacaggaccaaagcagccaccctgtcaccctgctgccagagttaatgattggttctcagggctttgatgttgtccttttattcagttctgcccctgggtgttactttgcacaactccagggacattacaagctaactcagggattctcaacctgtgggtcccgaccccttccacaaaggtatcagatatcctgcgtatcaggtatttgcatcgtgcttcattacaattatgaagaagcaactaaaatgatgttatggttgggggggtcaccacaacacaaggaactgcgttgggaagaataagaaccgctgaaaaatgaacgaacgggaggcagaccagtgccttgcccagcctgcaggggtgtgccccgggggaggggtcttgctcctctgcctgtttttctgtttccagctcactccgtgtcttggctcctccccagaaccagtcttctggccaggttcccaggaaccataaaggaactggagaaacccctagtggctgccaccaatagcttccagaaacatttgctccagattgtacagcaagacatgcaggtgaactggacacttctgtgcgcccccctccctgccccccgcaaccccggtacccatctgtgctctaaagtccaggcctaggtcacaccattcttttgccctctgtgagttctcccagagcaagggtgggtgggaagcactcaccaacccactgctgctccttctgttcagtggggtggtgggccaagaaataaggccttaaagctccttgaccagacagacactcaaggtgcacccagcacacaccctaagcagggcctgacaagactcttagacttttccatacccattggaggaagcattatgggaaggacctagtgataaaacctgtgcctagaaaagagggctgcaccagggagcccagcacggaagggggttagaaacggtgaacagagctcacttcccatgcccttctgtccccagcctctatttaaggtgctatataccaagagctggctcacacaggacacacttcgtcccctcatggacaaagtggtggactttgcacatcatcttgagcatgtgaccccaccactggcacaggtaccaggaagtgggtggctggcatgggtgtgcagagcccatggctttgatcctgaccactaccatctccctctcccaggagacactgcaggaggtgcaccgttttgtggtccgcgaatacctggggcaggtgctgaggccccacgagaggttcagtggccaggatcgactgaagggctctaataagatgaacctggatgcccaggccattagcaacaccttccagggcttggtaggagcagcgtctgactgtcaatcgggctcagtctctggccagcaaacccagccaggaaccccctattctgttgttttcatcctgtaaagagccctcacggcgggtgaagcaggagaaaagagcttccactaggcggttcttcagactccacagggaaaatggcagtggggctagactctaaaggggcgggcacaggagggggtttcactttacattgtatttgcatacatttgtgggtgaaggcaaagaaggaatgaaggttatgatgggcaaggtctgtgggagatctttcccctctcgggagcactttgagcccaaaccccttatctgggctgctggcctcctactggtgacaggttccaatcagcactttcctggtcagggctcggatttcccgtctgtgcagacaggaagaaaactctccagagtcaccgcagatgtggtctgtggaatcttattccctgactccgtggaatcttcttatgggcaagccacccgcggcagacacacgggaagggtgtttctgggcactacaggagaggtttgtaggcagagactccttgggggagatgaaccacgcacatatctccctgtttccttagggctctgaagccaagtggctggaccaagccatcctgtctgtggctgagatcctgggcgagacatacaaagacgacatccggcggcacctggaaacacttatacggagctacccggacatcaggttagcagatcctccttccctcctagagtcaggggtcactggaacctggcactcgcgcctttagcaaagtgagtgcaggcgtggaacggagggaagagcgagcttgtcagggccgagagaactgtggcttagtcgggaagcgaaccgcgacggacccgtgtgcgcatgcccgcgaggaaggcgcacagggaccgcaggcaagaggaccatcccctccctcgtgttctccaccatctgtggacggcgtggctccactctcgggctcaaaccctctctggaagctctctgaggcctcggcagccatgaggaggctcgtgtggggcagtgaatcatcagagcccttggaaatcccggcttggctctctccagtgctctcggagattccgggatggaaagatcactgaaagcccctggtccagccccttctctggctccttgctgctcgcagcttgtttgttctggtagattttgaatacggacaacaacgacccgaccccgttagttccttctaagttttcagtttccctaccgctcctcgggggttccccaactggtgtttggcccttcctccctggctccaaaagtggtcttggatggctgcggggaagcagtggggacgcagtgactcagggtgcccctttgtacctattccacccacgtccacccctccaccacttcacctgtcaccctacacccccaccacgctctgtcttgcacactgtgaggacattccccaacctgccgcctggcctggcctggcctggcctctacctccctagcattctgccagtttctggagccttccctagatcagagttcttgcgttgcctctgcacagagcttctttccgctgtgcgcatgccccctcccctgtctcatgtctgtgtgttctaggtccagttactgtgcacctccaggcccacactcccgcctccttgcctccttttagagccccatcccctcgcagcctgggatagtcccagcctttcagcctccctaatccagctccaggaatgctgaatcatacttcctcccaagcctgggttcctgccctcccgggggtgggggcggggcaagagctgaagggtaccagggggcaccgctctgcagtggggaacctatgtctctacaggcgagaccacattctggccattctggcactacgcagactcggccgccgccggaaccagaatctcttgcaacacacccaagacttgctgagggctgcccacgagaccaggctcccctcacaccacgtgctcttcgaggagatcgaagtgcccacctctgtggacgtgctaatcacctgcatctagggctgaagggcgagcaggagcctcgttggccgaggatctgtcaccctctccatgactgaccccaagttgggagcccagtgagtcactctggccc

SEQ ID NO: 181 - DNA, 33730 bp, Mus musculus
gggacttcttttcggacgatctgtgagagcaaagcagacaagatgtaggcaggggactgatagttctggtggcggaatccaccactggaagatttcgaacatagaatagttgatgaatttaggatgatagagtccgtgcccagcgattgtgtgatctgttgattctaaactaagattgtcgggtgtattccattctgcaacgattcaactgagcgccagtgaaaggtaaccgtagcagagcatgggtttgagagagtgtgccccctcccgaccccgcaccagctagttgtggacatttgagattgcggggcgagcttggcagcagccagctgcagaggttagataactgggaatgtgagcgaactgtgagaagttgggcggatgctgcatgcggttagccatgggggtggggagaccccaggggccagagagtagccagtgaaatagcgtgggttggttattttaattattgcatgaaacaggagacggcatttgaatctacacatttgacaaaactcaaaatagttagcaaaaaggtaagttttactatgtgcacttttaaacttttaagcccaggaagtggaaagatggctcagctgttaaaagtagatactgttcttgcagggggcccaactttagtttccagcactctgtaggtaacacagcttcagggactcagattctctcctcaggacacatcactcatgtgcggagacccacagatgccccctcacacacacagttaaaattaaaaataacacccggcgtggtggcacacacctttaatcccagcactcgggaggcagaggcaggcgaatttcagagttcgagggcagcctggtctacaaagtgagttccaggacagccagggctacacagagaaaccctgtctcgaaaaaccaaaaaaaaaaaaaaattaaaaataacatataacaaccaaatggtacaaaacaagatacaataagacaaggccttgtcatataaagttaggacaagccaaaccaataggaggaaaggagtcccaagatcaagcaagagtcagaaacacatccatgcctactgttcagagtcccacaaggacaccaagaggacccggcatagacccatgcagggccattgctggctacttcagtctctgtgagccctgccagttcatttggtgggctatattctgctcgtgtcttccatcccttctgactccattttaaacaaggaacataacgttctgaggtgtctttcctcctttgcataatagaaataaccctccttaatcattccaggatcttttggttccaagtgatcatcaattcaaataagtccaagaacaaaacgcttctgttgacttaagtgacaagttgtttaggtgctgctgtctgggaagtctccccccacaaccccccatagtatggaactctgacatgctggtccagtgtcaggactcagcagtgataacaatttcaagcccagaacctcctcatttctgatgtaaagaagcagagctccctctttctggtttagcacgcctatcattcctgcttgaggattccaccagaaggttggtgtgttttcgttaagccatcctggttctcctgaccacagttctgtgtggctgtccagttgcaaaacactacaactgaaatccctcctccaggttcacatggaatggagaaagagtggttttagctaaagtcatgcaggtggcacctttggccttgagataccctcccaccagcaccaaattttaagtaaggagtaagaaatactgctatggcaccactacctttcaggggacttcagaacttcactgtgaagcactatcagcatggacagtgccccagctagttacagggaaatgaattgttgaaatgttgagggcatgcacaccatttcatagggctatgttaactgcttccttaatacaaccaggagatatcagtagcatgtaggaatagatatcaactgctcgcatagtgatttctctatgcttgatccttgcctgtctgctgttagagttgcctgctgatgggagagaaaactgaccctgctccactgtttccccatcctccatatgggaagttccagtgaagtcctggtgtgtcttcaaggcaatgctaatagtacaagtggacacatgtatgtcctctgtcaagcctttgtttgctgaaaagatgccaatgtcccactgactaaatggagtcatgttatagccccagggtccagagggaggcacacacatggatagatgggtgctttaaaactgtgagcaagggaaagaataggagccatagcaaagaactgaagtcaggtggtctaaattacagaagacaccatattgccattgaaatagaaacaaacaaacaaaaaccctccaacttatactccaactatagtacaatgcttaccatgtggattttttttttttatttcttggaacatttatttggtcatagattctgtattgtttattattgatattcgtaggcaaagtggaaacactatacacaattgtgggagctgaaaggatgcctgagtgataaagactacacgttgcttttatagtggatggtacccttctggcctctgtaagcacccacactcagatatccatacctacgcagacacacaaaatacatgcacacgcatgcatgtgcacacatatccatacacacacagacgcgcacacacacacaatctgtgtttgaataaagtacatttcatattaaaaatacaaaacaagatagaaataaattatgtaaattcgttctaaaacttctccgtattcagactataactcacctctgagtagtcgacgtttgggttttttttctcaaaaggtaatgctttggaagtaccaatgcatcttttttgggaaaggatgttttgacagctttctaagactgatatccacttctgacagtgttcactcagccttaccaggcctgaaattaaagtaactatggccattcaagaacctgtctatggaagtttgtcccatcctcggtgaaacctaatgctgttccctccaggacaggctggatttagttctttagaagtggagaccgctgaaaagtagccatcaaaagccaacctgcgcccctccccaccttttagaactacacctctgtgagaagcaggctgctctgttgtgagatagtcaggtatcccatgcagacggctgcactctgatttacgaggctctggctaggtttgctatgagtaaatagagatgcttgcatttctccagggaccacaccctgactcagacttgactggaatctaaggaaagaccttgagaaacagaaaaagtcgttacaggaaagcagtcctagattcatgaccctcagcagttttgttagataagaagtctttgttactttaaacctttatgtttggaagtaattaacatataaggacaactgcttggctaacaagtgaagacacttaacaactcctttaaaaggattttaaggagtttgaaccagaggctttggaaatagggtggagggaaaggaaagataaatttctatttcctctctctgcaataaatttccatttttggaaattagggtatttcccctttcccattatatcacaaatagaaggatagaagggcggttggggccaccctgaccccagtaaccagtatctgcttcttctcccatgcacagagaaagtggaccctattgcagccattgctatggtgacagcacaccctattcctgctgttgctgtggagacagtggatcctattaccacggtctctgtggagacagacagctctatcattgctgcttccttgctccagtgacagagggcacgaacccaattcccatgcaacaggaatccatgaactccttagagccaaggagaaaaacaggtgttataggcttgaaattagtaagatgtcagtcattgtttaatttcatgagaaggctggctttggaggcaaagcggcttcttccctgaaatctaaacatgttatacttatgctgctctcaaagagcccttgttcagagaggatgcggcccttctgtccctgtgagaaaaagagagaaaggtcacagaacagaccaagagtatgcacaccttgtccctaaaaacagaaagaaaacaaattgttaagagtagacatttgtactggctggttttgtgtgtcaacttgacacaggctggagttatcacagagaagggagcctcccttaagaaaatgcctccatgagatccagctgtaaggcattttctcaattagtgatcaagggtggaagggcccattgagggtggggccatccacaggctggtagtcctgggtttgataagcaagcaagctgagcaagccaggggaagcaagccagtaagtgacatccctccatgacctctgcatcagctcctgcttcctgacctgcttgagttccagtcttgacttcctttggtgatgaacagcaatgtggaaaatgtaagctgagtaaaccctttcctccccaacttgcttcttggtcatgatgttttgtgcaggaataaaaccctgactgagacaaaattgtatccataagaaagatgagatggggaggttttctcaacaaccttccgcaaaacaagtctctgccattgctctccgcatggaataagaatggttgtgggaggaactgctaattggtcccctgggctgggaccagggctttcccagtcctttgctctgactaggatatgagtctgatctgatacccactgtcttcctgctgctgggtgttttgttcttttatcccacctttctgtatatttaatatactcatttgaaactaaaagcatggctgtggtggggcattctccctccacaacatacttggctcagtgtgcagaattcatgaggtatctttcctgttttgaaaggagcaaatgtctcagggttttacgagttgcctctggaacatagagaatgatcaggtgaagacctgtgagctgtgttccacaagccgaacagctttgggacagcaccaggtagcttacgcactgcaagcagcaaggagagatgctgtggtcccctgaggctcagctgatcccttagcggaaggtaactgagcactgaggcaagaaaatggccatttggcaaaagggggttaggtagacttgcagagccagctgccaccgttgcatttgtcaagcctgtatccttggtgaccaagcacatacttaaaagaatgtatcagagaactcctaggtctctgaagtccatacaagagagcaaaggagaccatcaaggccgtgaacatttattctgcagtaatggggccaacttgagactgagacctgggatagggatgaaaccatcaaggaacagagggatgagagtgaagctcccttcattgagggtcagcctcttgtgcaaagaaccatagagcagcaagggaatgtcagagctcagagggcatgatagagggctttatgctggctatccagagctctgcagaggccttgactaccaggttgggtcaattatctaatgtaaacaacaccagtattacactagatgcagagcagtcttctacatatgttactgtctccatggaccctgcatctgacaataggatccagaactgaagcagcatccctgatagtgtgagtgcacaagttaggccaatcaatatcgttatgttgaaactatctgtgtaagggtgctaggacacacaccctactgatgatccacagtcagttgcccgtagcagtactgaaatgattgtgtgcataaaattaaaaccgaagtcagtaattatacagtgcttattggggtggctgatgactcaatgtgcatccctttagaggcacaaatctgaaataggttaattaaatgtaagtattcctcctgcttacaggcaacttcttagcactctgttaatgactgagacagaaaacccagctgctgactggatgattgacagatgacacaacctggggagctgggcaagtggattgtgggaagcctacctctgcatgagcattgtgggaaaagaactcacttcccagaaaccgacattcactgcctttcttaggcaggagcaccatgtaaataatggatggattagtcaatcctacaggaactgtggcagatgcttgtgtatatagaaagcatgcttgccctctagaagaacctggttggtgcctctcctgttgtctctagtgatccaatagcctcctttgtcttgtttgctgacttactgtcatgatggaaaggccaagccagaggcattatggtggtagagtgaccacaccctcactgagctgaatactatggtatggtggatactagagaagaggatagctagagttatagtaatccaaaatcatctaaacatacttcaggacttaggttttaatattgtgtgtatgaatatgtatatttgtgtatatatttatgtgtgtgtgtgttgtgtgtgagtgtgtttgtatatcctcatgtgtgtataggtgctcaaggaggccaaaagaaagcatcaatctcctggagaaagttaagaacttctcaatgtgggggccaggaaacaaactcaagttctctaaaaactcagttcatactcttaaaccatgacctgtttccagcctaggagttgtttcttattagcttctacatgcccctgagttgccaggaaaattacatattctacccatgaagttatctacatacagctaacaaggatatccaaataaagctatattacatgccaagtggccaagaaaaaaattccaaaattagataaaattacttcacaaagttttaatctctaccaccactaagtgaaacaatctattatagcatgtttaaaaaaaaaaaaaagtgatgggtcatgaaaatgactattgactaccagaaactaaataaagaaacttctttactctcggtggctttcctagtggctgtcacctcggtagagaaatgcagcagcacacgggcacccatggtgctagcatagatctggcaaatgctttccttatcacaccttcctccatgaatgatggaaccagttttgcctttatctggtgtactggctagttttgtttcaacttgacacagctggagttaccacagagaaaggagcttcagttgaggaaatgcctccatgagatccagctgtaaggcattttctcaattagtgatcaagggggaaaggccccttgtgggtgggaccatctctgggctggtagtcttggttctataagagagcaggctgagcaagccagaggaggcaagccagcaaagaacatccctccatggcctctgcatcagctcctgcttcctgacctgcttgagttccagtcctgacttctttggtgatgaacagcagtatggaagtgtaagctgaataaaccctttcctccccaacttgcttcttggtcatgatgtttgtgcaggaatagaaaccctgactaagacaaattggtaccagcagagtggggtattcctgtgacaacctgaccatgttttggggaggactgtggaaggactttggaactttgggcttgaagatccattcgttgttaagagctctgtcagatgttaataactgtgttcatctccttacagatgttacaagtggtcatgagtttggtgccttaaagtaatacacatttattcactgacagttttggagtgcagaaatcttaaatcattatcactgaattacttctaggttcaaggcatgttgttctctttttggaatctcaataatctaactctcacaaaggatttaatttttttcatgattaattaaacctatgtgaacattctgttgtataaattacttgctaaaatcttcaatcttggtacaatgtttcctggaggtgtgagtttacaaatggcttgtgcctctgtacctatttccttctaattgaaatattcttgtctgcttaggaccataagactcaaaaactaagtcaagtccagaaagcccttaaactttgtaagactcacaatgctgttccctacagttatgtagatagcagcaacttgtagggagacaggagaaccttggcacctggttgagttgctttaaagccattgcagtgcccagggacgtagctcacacaactcatcagtgctgaggtgggctgtttggcgtttgttttggttggtttcaatgacagcatgtcacagatgagaaacacctaagtagggatgtttacctgaagaactggactgattgccctcatctgattcaggagaactcatccatattgtgggcagcacctcctagtagtggcccagataaaaagagtgtatgagcaggaaggttaggctttatcccctcttgttgctgatttaatttatgctgctgttgctggccgccgccgccgccgccgccgccgccgccgccgccgccgctgccgccaccaccatgacaaccactttcatagccatcagaaccagcattccctggcttccttcacagactcatgtttcaggcactagatcagaattacagaggcacccaatcttgggggtgcaaaaattaccaggtagtcagctgtccagtgagagacagcgaccctgctgtgtggggcttactatgactgttgatgcgctcagcctcaagactcacacaaagtctggtttctcggcgctcaggtgtggacagcgagtgttactatttaacacaggttgacctaatagttccttataactcttctttctctcctttcctccttctcctctaccccttcttctccctctgttctccatctcagtctgttttggtctctgcttctctctctctctctctctctctctctctctctctctctctctcacacacacacacataccacacacacacacaggggttcattgattcactacaagtctcctcagggaaaaaacattgtcttagggctattaagtaaattgggaaggaaagtgtctatttggcttaaacttccactttacactccatcattgaaaagaatcatggcaggaactcaaacagagcaggaacctgggggcaggagctaataattcatagcccatggaggggtgcttctcactgacttgctaatcatagcttaaggagcctgatttctaatagatgccaggaccaccaatccaggaatgatggcatcacctacaaatggctggaccctcccacatcaatcactaattatgaaaatggactctaggcttgcagacagcatggccttatggaggcttttttttttttttttttttgtagtcgaggttcccatctctcaaatgactctatcctgtgtcaagctgacataaaactagctagcagacccacacaatagttgggtaccatttctatttcgcagcagaatcagtgtgtttagcacacaaatatcccagcataatcaaggaatatcaaataataaaaacattagatttgcttttcttatcttcaacttctcccaaacataaatgaaatgagctacaaaatcttgtcctttaatatcgttgcaatggaataattctatttacagtgaaagctaatcattacatttgtgccttctgaccctgactttcctagggatctgatcaacctttagtctctcctgcactccccgtcccttcaccagtatggagaatctggaaggaactagttggtgtattgacacttcaattattttgatatcattgtatgacatattaaaaaccatttctagattcataacaagtggcttcttttcagtaggtgcctcatctgttcgctgggaggatacaaggttgcagtctaaagccactatagatactttctccgatttgttccaccttgactttcccaccaatgcttgccatatcatccagttccttgtactataccttggtttataacataactccctgtccatcttttggttatacttctgtgagcaatttgtttagaataatccattggcatctttctaaagcacctgtgccattggcttttggttatcttcagcatcccttttcccccctcttaaaattaaatccatcatcttacagtaggttcttattgatttaaacttgttctaccttgatggcattgagatttgaccagaaatggtacacaatttaggatgcttatgatggtaagcaatgaaaaacacattccaagaaacatttacaacctcattaaaagcccagatcttgacattatcgttggtagctgctcagcagtatcattggttgcagagacttccaacattcttactgctcaaagtataattcccttagaattttcgggtttgagctgtgtggtcaaaccataaaccagcaaggagaaaaaggacatcaactttaaatgtcaaaataatcaacaaaggtcagaagcagatggctcaccactcaggttataagagacatctttgaaataggaggactggaagatagctttgtttgtgtggtgaaataagaaatatgggaaaaggtggcagttcttggagatgaggttatggtagggcgaaattaaatctccctcagaaaccaaaacaaaacacccagcttgcctgactcacaaaacggccaagagacaagctataacattgttcataaataaataggaacgttagcgaaagcaagcacggccaaataaaagttcacgaatttttccaacacacgtgtcatggcctcatagaagtacatgaataagccaatgcttgccatagcatttctgctgttgcaatcctgccctgccagcagcactctgagcctgttctactcatatgctaattttccaacattaagccagtgttgtactggtttctactgctagataacctattttcatatatagtccatttgcttgagtaatatgctaatacggatttcatgttgatatcaagaagggtagtcatgtctaattgcctttcctttttatacctatagtttcagtggcatgccaatctttgctgcttcaattttctcagagaattgcatagttccctttgattactgtagtctttggacaatccaaaataatcctaaacagtatggatttggcaccttctttttcatataaagatttaaaaatcgtcattttgaccaatattctagttgtattgcaatgtctttggtattatttaggttaaatatttctttttagtttctaatttttgacatgtcattcatgtatatgatgtattatggtcaaagtcgcctcatttccttctcccaccccctcttactctcatgaattttaattgtcacacggggctcttgtttgtccttcagctcttatcatcttttgtgttctcctctgtgatgtgttctgggtcatggagtagttgactgtcttctatagggttttccactcactcttcattctgtacaattttgtcagtatatatgtgccttattatcactccttcatggaaccctttttcacaatctaaaagtttccatgtctaagaactttttttggcaagatgtttatctttcaataaattatcaatgcatttatgtaacaatgtcactttaatgaagcattaaaaatttgcactgtcatgcattcatatgtaattaggatgattacaagagtaatcatcttatgagggtgctaatgcagctcacttcagccatgtggccatacaaaacaaaagcagagttatctagatatatttgtcttgtgcagaaattagactcttatacaatcagtttggctatggttgctgccttgcaggggactacaatacaagcaatgcttttacagcactaaggttataaagaatgttttaagtataagtcatctttaaaaagagagagagagagagagagagactgtccaaaaagttagaggcatagacaagtagtcgaattttccccctagaatctttccttgctgcaggagagataatctttgggccaggactcaggcagtatgctcagaataagaaatttttacatttgagttaatacaaagctcagagcagcctcagtgaggcttatgtggcttttcttttgtcttgcaaccctacctaaagaagttcttgggacctcacctctccttgcctctggagaattactttttttaagctataacaacattattacagatctatccaggtgttgttcaaaataaagtttaaatttagtatttataaaaggtcaatgaggctgtaaaacttatagaggcattataatatggcttgcctaatccatatagaattattatagatttagaaggttgatttttcctttacatcctgataattgtaaagagtttacttccagtgagcttgtgatcattgcctctaagtatggctaatagccttacattatgtaagaaaaaaacttttttttgtctctgcttcaatacaagaagctagaacttttaatctttcagtgtacattatttcttaaatagaaagtattttattagctaatgcctctgaagaggaagtttacttcaaatctttgctctttcacaatgagctttaaagttctggggagtagctgttgctccaaaaaagattcaaaggcaatatctttttaatatttaggattttagttatcctaaaaaaaattgcggtaaaaaaatttaagaaagaaaagatgagttgcttacttcaaattattttaacaagcttccagaagatgttcattggctaagacctcaccttaagctcaccactagaggacttaagcctttgttagatgttatcaagggagcagaaaattacacacacacacacacacacacacacacacacacacacacacacatatacacacacatacacacccacacatacacacacacacactgcattttgaaaaataaggaaaatcaactgaatattttgacatattgccttatctctcaatataatgtgatttcaaattttgtatcttctgatttttgttgttattgttgttatggtttattttgtctttattggtttacttgagtctgtaaacaaatgttgagactgataagaaaattcacaagtccaggaatacaatttagaaagcagattttcaatgatacaatgtaaaaattaaatcatatctttactgtttagacttcatattagacacttctttctgaaagtatattttgaaaatatacttctaaaactaataaaaactaaaataaatataaactaatattatatatataatataaactaaaactaaaatatacttctaaaactaaatacaagtaatgattcagatgacagggataagtccaaactaaaatatgctgagcttattcagaacatccatgagttcacagagtgttcaaaagcaactgcaaggccacacataatctatcttgagtgctggtgaacatgatttgtgtgtcgtgctgcaagctgcaaatgctattatcttggaaaaagcaattggcataaatcacaggtattaagtgggtgccatcagagttacccactagtcttaatgcttattcacatttggggagagacactgtttattcttagacaaagaaaattaaattaattctgctatctagggccatgccattttgcttcgtaagcaacataaatcttaaagtaatccgtaaaacatagattattcagctgactgcagtcattagctttggttctcttatgacagtggggaaagctcattctaaggaaaagtcaggtcccacggaagcttgaaaggggctaaggcagttaccatttcaatctaagggacagggaattaagtaatggttctgaagggctggcaacatgcctcgtgaaatctggagaatactggaaacatttatatactttctgaatcttgagttagatgactcttgctatcaggttaatgttggactttaatggttaaggattgtgggttcaaaagctaatgcgtagagattggtccagaaccttgtcagccttgatacatggcactctgcaccttgaaaccaccttttgattaaacctaatttcctaagcataaggaagccttagattttttgatatttatctaaggtccctcactttaagtgctgagagtctctcacctcccagatctctggtactttctagagcatcccccgaggttgcatatcttcattcattctgccggccttcagggttttgcaccggtctcctctgctccagccccatacctgatcgtgttccccattttcccttttccctttcctctcccacccagatccctccctctgcctcctgtgattgtgtaaagggatggggttgccatcccacagtcaaaaattctgacccagaattgttcctatctaagagagctgcagggccaaaatggagaagagactgagggaaaggcccaaagtgggattcatttcaagaggaggctccaaggcttgatgccattgctgatgctacagtgtgtttacagacaggagcctagcatggctgctctctaagaggatcaacacgcagctgaccgagacagatgcagacgcttatgcccaaccatcagattgaagccggggacccctgtggttgaattagggaaaggctggaaaaagttgaggagcagggtgaccccatagaaagatcagcagtctcacctaacctggacccccaagatctctcaggcaccgagtcaccaaccaggcagcgtacactagttggtccgaggccccaaacacatagacagcagaggaccgcctggtctggcctcagtgagagaagatgcacctaatcctggagagacttgaggtcctaggaagtggggaggttgggtggggaggacatcctcttggaaaaagggggtaggagggatgggatgaggaactgtgggaggggaggctaggagctggacaatggctggattgtaagaaaatttaaaaaaacattttaaatttttaagaaatttgatatttagttccaaattcttaaacttgttaaatcatgtaatactatgtagaatagcttgctttttttctttcttttcttttcttttttttttttttttgaagaacattttctcaggaactgacccagacacaagataacatatttttaaaaagctactacaaaacagtatctctgagggggcaagctggcatgagacgtgccgtcttctaacatattctgagaagatagaaatgtccattgcacatactgtcaagtggcctggagggtgaaatgcatcatgggtgataagaagctgattttaagttttacttaactttaatcacttactagttcagtatacttggatgactagtggctaccacattgaccaagctatagactacaactacttattaatatagtcagtgggccaccaataacttggtaatcatagaaaagagaaaatgatgaaattgaaacagttcagctcctctggtctcaaccagttctaattaatgaattcattatttttctcattactatgacaaaacagacaacagaagtaacttaaatgaggaaagaggtttggctcacatttcaaatagcacccagtcagcaagggaaggggctagctgctcagtttgtaatgagggaacttgcaggatggcttgttcacatttccccacagccgtgagtgttcaggtaaatttatgatgatgctcagctatggtcctaaggctgttcacctgggatggggggttcacaggtggtccttcatcagtgtcatcattatctgattctgccacataggaccttggatgtggtgagctaatgccatactgatcttgttttgcttttgtgtgagagtgaaatgcctgtttctgtttggggctgatgtatgcttcctaaccacagaattggcaaagtggcgagccacagctgttgctatgggaatgcttgaatacctggtggggtattcttaaatgccagccaagaagcaaatcctgcttcaaattatgacaggggccaacaaaatacttgtatatttctaaagactgaaaactcaggactaagaacttactgctcttatgttaaggaagacaccaatatctgatgctggtatatatctatgttctctacatcaataagtaacttgttggaaaaccgaagcctcatatccactccaatgagtgggttctgtctcccgaggcatgaggtctatgcagagaaccttccacctcgggacattcagcagtctgtgtgttctatgcaagcccaccacaccagcccattctgggatatccagaaatacatatcaacacatggcaataccatttttgcagtgctttaaagttgtatttatttatttttaattagtacagacaataacaggtttttcttgtaccatattcatgtgttctgtatcttggccaaccctcctctgttcctcttccacttgccattcccctgtctgcacccacctcacccccagtattcccattcccactttcctggcactcatgtcctatcgctctcccttacaaccactcacctctttttcaggcctctttctagctttataatctgtacccactcgttctcattaatgcatagatgtaaaaattagaggttagatctgcatagcaacaagaatatatttgttttcctgagtgacctcactcatttctttcaattccaaccatttgcctacagatttttttctttcttttctttcttttttttttttttacagctagtaaaattctgttatgtacctctttatatatcctacatattcaccatctattcatttgttgatagatgtctaggataattctttttctgttttgaatatagcagcaatgactatgaatatatgcatatctgtcatagatatagaatcctttgtgtatacgccaggagaagtatagttgggatatatggtggttctgctttatttctttgaggatcctctacactcagttacaccatggtttcatcagttatcatcccatcaacagtgagtaaggcttactcatttttcattattcttatctgtgttttttgtttccctaataatagacattcagattgggataagatagagtctcaaagtagtcttagtttgaatttctctgatatgtaaggatgtcaaaacagcttttaaaatattgttggccaattatgcctcatcttttgagaattatttgtttggtacattgacccatttattaattggcatatttcatttctttctttcttttttatatatcatattattatatattacgatacaatgttgttatatagtaatatatatttatatatcttaaatattcattctctgtctgagtttagtgggcaagaattgtctcccagtaggctacctgtgtgctttgttgatagcctcattgctctgcagaagtttttatcttcacctaatcccatttgtcaattctttttttttcttttttgagttataattctttttaaatttatttttattagatattttccttatttacatttcaagtgttatcctctttcctgatttcccctctgaaaatgccctatcccatcccctctccccctgcttccgtgagggtattcccacacccatcctcaccaccctggtgttcccctacaatggggcattgagccttcaaaggaccaagggcctctcctctcattgatgtctgacaaggccatcagagccatgtgtccctccatatcccgagcttttgttcccaccggaaagaacacgctcaggacaaccggaatcttctgcggcaaaagctttattgcttacttcttcaggagcaagagcgaaaatggcaaaaccccgtcccttttaaggagaattatcctccacctaggacgtgtcactccctgattggctgcagcccattggccgagttgtcctcacggggaaggcagagcacatggagtggagaactaccctggcacatgcgcagattatttgtttactacttagaacacaggatatcagcgccatcttgtaatggcgaatgtgagggcggctccccacacctccatgtgtattctttggttggtggtttagtgcctgggagatcaggggtgtctggttggttgatattattgttcctcctatgggactacaaaccccttcagttccttcagacctttatctaactcttccattggggacccgatggctgtcagcatctgcctctataattgtcaggctctggcagtgtctctcgggtgacagctgtatcttgctcctgtcagcaagcacttcctggcatccacaatagtgcctgggtttggtaactgtatataggatggatccccaggtggggcagtctctggctggcctttcattcagtctctgttccacactttgtctctgtatctcctcacgtgggtttttgttctcccttctaagaaggactgaagtatctacactgtggtcttccttcttcctgagcttcatgtgatctgtgaattgtatcttgggtattccaagttttgggactaatatgtacttatcagtgagtgggtaccatgtgtgttctctgtgactgggctaccttacttaggatgatatcttctagttccatccatttgcctaagaatttcataaagtcattgtttgtaatagctgagtagtactccattgtgtaaatgaacatcatttcctgtatccattactcggttgaaggacatctgggttcttggttccaacttctggctattataaataaggctgctataaacatagtgtctttgttatatgttggagcatcttttgggtatatgcccaggggtgttatagctgggtcctcacgcagtactgtgtccaattttctgaggaaccgccagactgatttccagagtagttttaccagtgtgcaatcccaccaacaatggaggagtgtcttctttctccttatccttgccagcatctgctgtcacctgagtttttgatcttagccattctaattggtttcaggtggaatctcggggttattttaatctgcatttccctggtggctcaggatgttgaacatttctttaggtgcttctcagccattcagtattcctcagttgagaactgtttgtttagctctgtactccattttttttaaataatctcccatgctcatagattgacagaattaatatagtaaaaatggtcatcttgctaaaagcaatctatagattcaatgcaattcccatcaaaattccaactcaattcttcatagagttagaaagagcaatttgcaaattcatctggaatcacagacacacacaaaaaaagcaaaacaggatggcaaaaactattctcaacaataaaagaacttctgggggaatcaccatttctgacctcaaagctgtattatagagcaatggtgattaaaaactgcatggtattggtacagacacaggcaggtagatcaatggaacagaattgaagacccagaaatgaactcacacacttgtggtcacttgatctttgacaaaggagctaaagtcatccagtgggagtgcggggtgaggaaaggcagctttttcaacaaatggtgctggttcaattgtcaatcagcatgtagaagaatgcaaatctatccattcttatttccttgtacaaagctcaagtccaagtggatcaaggacttccacataaaaccagagacatggaaactaatagaagagagagtggtaaggacctcgagcacatgggcacagggggaaagggaacgttcctgaacagaacaccaatggctaatagtcaggtacatggttagagctagcaacagtcatgcttaagtgggccaacccagacccagaaagatgcacattgcatattttctcttttctgtgggtgttagacattaagcttcaggtatgtgtgtttttatttctaatgttgccagaggttaagcagccagtaggagactaggtaagaggacaggatcttccaaagtaggaaaaatagaatacactgttacaaatgggtgaagagaaaggtagaataaatgcattaaatggatagtattttttaaataaatcccaagccaaaataatcatatcctcacagaagacagctgaagagcatgtggaacgttaaagaaataaacaaaaatgtaaatgagcctgggcactatgccaggaaggcagagcctaggttcaaacagggcagctgtgccagatctcagagcctgggacgtgcttggcttcaggtctcaaaggctggaaggtgtaaagatttgcacctcattctaggaatagctccatcccaggcagcacggcaacagccaccatcactgataacaagcaccgcgaactgtgcgagagctgagctccatattttaaaatttcttatgatccatcagaaaccttttcagtatacatggataagagccctcgaaggctagatttactaagatgggggcatgagtcttgttctagttttcatgcttgaacaaatctccttctcctgatcccatctataaaacagagctaacctttccaggaagtcaaaagtataacaaatgcttctaaataaagagttctgttgtggtggttgccaacaaaaaaaaaaaaaaaaatggagtgcaattgggtaaaaatagtgctcagtcctcagctggcaacaggacatagataacaagaaacactgtggcagagggtgcatgcctgtcagagagaggtaacagttttacagatgtcttgagtgcatccaatatactctctttttcaagtcagatttgtgttttctaaaaaaaaaaaaaaaaaaaaaagaaagaaagaaagagggaagagaagagaagagaagagaagagaagagaagagaagagaagagaagagaagaacagtgatatctttgatagaggcttggtatcagtgaggtggaaggagatgcctctgcagacccatgctgaggcattccttcctcctgaggtaccagccacacaagaggtatagtatagaatagactttatttagaacatggggagggaagttggaagggagagggagggagggagggagggagagagagagagagagagagagagagagagagagagagagaagaagaagaagaagaagaaggaggaggaggaggaggaggaggaggaggaggaggacggccatgaacacgtggagagaaagcggaggggaatgaggaaagaagggacagagaaggaagagaataagagagcaagagggtaagagagagagagagagagagaaggggggaagcagccccttttatagtgagtcaggcatacctggctgttgccaggtaattgttgggtggagcctagaaggaatgctaatgagagtcactctttgcttctaggattttcatgacttttcccagttattttcgttatacttaattcctcagtattaaccactctctgggacttcggaggagccatcttctgcctgattgtgacacctgccccgtgattcctccttctgtccattccaacccagcaggtccagagttttcacagacatatacttgctagacatcattaatgcaagcagctcaccatgctctgaccactcagtatgaggagtataaagtcctttcatatctgctatcacccagaaagactgcagttatttcccgttaatctctatcaagagcaaacctgtttccgaagcacattctcaacctggctccttgctcctcagggttattctctcgttctggctgaaatgtcattgtcttgcgggtagtcttgatgtctttttgcacaaatgtgaattttcccttcctgagtatcacgtaattttgattgtatttcaccaggtatgtattttacttcaaaatgatccaaacttatattttaaccaaacacgggggaatttcattgctgccacatctagcagacggcacaaaatagcacctggttggaggaactaattagggatgtttctgcacaacgaatcagaagaatgaaaagacgtggaaacctctcctgtctgaaattcaagctcacactcctgtcctctgttcctttccttaaagctccactggatgcgggactatttttcaaaattaaagtgaccaacactggagataaagtagttgggattaaacctgaaggcttatttcaccacactaaaggaaagaaagaccactgtattgtgtcttacgaaggccatggtaggaggatggagtgtctgctgatctatatgaacaaggagcggctggaaaaccagaaacgtaacttctggaagttggagctatccatctggcttacttactgagaactgtaggcacccgcactgcaagcattatttatatactaagtaatgcatttaagatttatgaggaatgagaagtcacaccacacctagaagggtgtgaacacggaatgcctgcactcagggagagatctgcgtcagctgtatttttgatcaaaagttgttcccatagtgacaacactctcccccttatcagtatttcttcttgttacttggttaccaaaatatgaaatgaatactgaatgcaggtcatgagcatgagagcgaatataaagctaactagttatctaggtctaactctgtcatgatttttctttatatttttggtggtggttaaatacataaatatattcagtggtctaagtatagaacccaatatgaagcccacagcctccaaatgcctattgtaacttcccagaagttcactgaggtatacaaaccttaggtctaataaattcactgtgtaatttttttatttacataattgttaaaataaaatttattaaaatgtattctgtgtgtttatttacaaggaacaaacacagacactgtgagttttgtgttattgaagagtcatattacattaaagacttatttaatttattcctatgaaaataggtataactggatatgttttaagataaattatctcttgtgaagattatatgcaggactatgcttatcagtaatattttatttcacttaagtcattaaataacactttgatgtagaaaaatgagtcactctacattttcagaattctacttcctgatgtaaagatgattgtcgcttgcaaaacacggaaagtctgaattcatggtgaaactctagaggtgatgaagaacaacatataaggagtgtccggccacactttctggtgagtctcaacttcccagatttagtctgatacattgtaagcatccagagagtaaaggcagactagagtgaagtcctatgcgaataaaacacgacttggtgggtccttccgactgaagagcagctctcctgtgtaaagccatcccagcggcaattcagtgcagcgcaattgcctgagattcggcacgtgaactatgaaagatcaaaaagttatcctaaatgacggaaagggcgaaggtgaagaggtggggtggttgggaggatgtgatctccctaaaccacagcgtggcctggtgaacatgtccatggggaaccagctccccatcaataatgacagcagtaagcagtgccccaaagaagtctccacaactttgtccccccatgaagacattatcagtactgcacagacaaaatcagacatatatccaccaatttctactactcaaattgcctcatgttatatctaactacatatttgcattcaaaatgactgttgtgaatatcaacaagtacttataaagcatatataaattaataatataacgtaaggtagcaataacttttaccgcacacctatccatgtcgagaaccaaatcaattatggtttcaacctcttcccctaaattctgctgactacttgtagaaacctcactctagtaccaaaactatggagcgaagccctgctaaagcactgcagagagtcaggtgagtggctccagtgttaagatgatatattataaatgtgcaaagtgattacactgctatgtttactctccacctactcgcatccaactgttaggcccacaccattttcccaaaggaaacgtcagtttctctgaggagaattatgagagttgtgggaccctttaatcccaggtgaagttatgcttttgatttattgatttgggtaagttgtctaatgtacactgcctgagctgagctggatacgatccagagtaataaagtacacatctcctcatctttctacataatccttgcattcatagctaccaggaacattattttattagcatgttaaaataggatctgaaacacttaaaagtctgtcagcacttactgttaaaatctttttttaattgtttttatcagttattttatttatttacatttcaaatgtccctcttcctggtttcctctccacaaaacccctaccccttccccctctccctgactctatgagggtgctcccctacccacccacccactcccacctcatgtctttagcatccccctatactgggccatcaattgtccacaggaccaagggcctctcctcccattgatgccagataaggccatcctctgctatacatgcagctggagccatggatccctccatgtgtactctttggttggtccctagaagctcttgggggaggtctagttggttgatactgttgttcttcctatagggttgcaatccccttcaggtcattcagtctttcccctaactcttccattaaggaccctgtactcagtcagtgagcatccacatctgtatttctcaggctctggcaaagcctctaggctcctgtcagcaagcacttattggcatcagcaacagtgtcttggtttggtgtctgaaaatctttcaattgaatgtctctaccaaattcaacttgtctgcctccttttgaatggtatatctttatgtatacacacacacacacacacacacaccgcctgtgtgcatgtcagtgagacagaatgagagagcaagagagcacctttatctttcttaattttgagatgacgttgcttttgtaaatttgagtactcaaagaaatacgtagacttttttctcatatttcgtttcactgtttgttttttttaaatcctttaatgaacaagcaatccatctatgatttatttctactacaactcggttttcccacttcaagaagagagtacagtatactagtcatgtattctgacatctctggtgtcctgagggactttatacacttattttatataatccacgtagctgttccagtacattaaatcattttcttcctgtatatagtcaaacatcatcctgaccaaaaaatctttgaaatgaaccttattttcctaagttacttttgttcatataacttattatcatctgacatatttagattttgttggattatatatctcatctctattccaaaaaatgcatggttaaactattcctggcttctgtaactatgtctagtttcgttgctagagagagcggttgacactcaataaaggaaaataaatacatacacagtgaatgatttgataagtgactgacctgtgggtgatgagcaatgtctgtggtctctatggcccctagagagaactttagtttactgttgagtgcgtagctttggggtcaccatctgttgatgatgtggccttggatagggaggttaacatccctgggctcctgttccaccacttgaaagatggagttaatgattctaaccacctcttgaggcctgcatgctgacaaatgctatctttcttggaaaactcccgacactccctctgaagcactttcaccttggagagcaaggtgcagagaggcacacaatggttgtagtgcctgtcaaaagacaggcttctgctaccagatatagtttttttttcaactctgcttactaatttttttcctctataattttatcgaatagcactggatatgctattattgaaatcaacaattgaatgctgacgtattgctgaatatcagtatcagacttagcaaatgaaacgcacttctctttgtagagaaatgattgtgagaaaagataaattagatatagctttacatttgggggatatacaattcactgtcacacctttgaatactgaatcttgtaccaacagataatttcccactggttactcaaaactattactgatgaagcgccatcctgtgagagcaactggcgtaccaagggtctggcagtgctcacgagcagtgaccactggctttattaacatcctctctgttccgttgtctgacagatttttctcctttgcagattttaaacgtgctttaacatctacacttcgttctgcatgaggatcataacgatcatttctcggcttccctggagcattatcaacaccgttaggtttgtgttgttgagagaacttctgcttcagagaacaaccttttacaaggttcagtacacgttatactcaagtgggcatctgcacattgtgctgtccccctgatgagcagcagcctgactacctgcttcccccattcctccagtcttctcaggagcctgcctaaatggggcaaagaaacatggtaacacagtctcttgtgtcacagagtagactctacttaaaagatactgttacaaacaaaagcagttttaacctgatgatcaattttagaaatttacatttatttcagcccagacaattcagagatatcacctgtggcactctttgtcacagacatctttctgaaggaaagatttttctggccaagagagaaaaactatgcaaagccaatatgaaacattttttaaaaaatcctaagacagaataattagtatacatttaagagattcttatttgtgaacatatcatttattaggaacagatatacacagtatggtattgactcctagggctttgatgctaagaactcccacgctctgccatctgtacttaagagaccatgggaagcagtgtgtatttcagaagcctgagaaagcaatgatatcggctccagtacaagtctgcagtctgagagaatgtggtggtttgaatgaaaatggctcccataggctcataaggagtggcactattgggagatgtggcctggttggaagaagtgtgtctctggggatgggctttgaggtttcaagtgctcaagccaggctcagtgtcccttgaggatctgcatgtagaactcttaaattatgtcttcagcaccatgtgtgactgcatgccatcctggttcctgccatgataataatgggataaacctctgtactgcaagccaaaggaaatgctttccttcctaagaattgccttgatcatggtgtttcttaacagcaatagaaaccctaagacatggagtattaggatcctgggaataaaatagaggacaagcaccacgctcagttgctcaggagacaggattcccacttcccttcctctttgtgcttcgggcccacatcatggtgactatatgcttgttacacagctcagaagctggtctcttccacaaagcccctatagacaaactcagaaatcacacttactaaactagccctctgggcaccctgagacctggtggccatggcacagacatgtaagcctcacacttgaagtaagctttgactcaactctccttttctacaatcgtctcctctcatggctgatttgctactatttgccttggtacagctaatgaattccagttgtaaaatgctctgtcccaaacatgtcattaccgtcttctgagctacttgtaagtgctaggaaaacagctgaagcatcaacctaggtttattctcccttggtgtttcttatgtgcttgctcccaccaagcccaaagtactactaccatcttcccaccaagcccagagtactactaccatcttcccaccaagcccagagtactaccaccatcttccacatttcaaggtggagcctaactacagtctctttgttttgtttttttttttcaagaaaacaatttttattggttattttatttatttacacttcaaatgttgtccccctttcctgggttcccttctgaaaagcccctattccatctcccatccaccctgcttctatgagggagcttgcccacccacccacccacccactctggcctcactgccctagcatttcctcccctggggcatcaagcctgcacaggaccaagggcctcccctctcattgatgccccacaaggccatcctctgctatatatgcagctgagccatgggtccctctatgtgtactctttggttggcggttaagtccctgggagctctggggatctggttggttgatactgttgttcttcctatgggattgcaaaccccttcagctccttcagcccttcccccaactcctccattgaggtccctgtgctcagtctgatggttggctgtgagtatcttcctctatattggtcaggctctggcagagcctctcaggggactcctatcagcaagtggaagagagtatagaagaaacgtaaaatattcagcctggagtcaagttcttctattcttaggacaatgatttagactcctgagtgaggtgagaactggagccacacacacacacacacacacacctgtcaactgacagacactgaaggaagtgttggtggcccaggtctgatcccatttcatttctatcactcagaataggacaaagtcaccacaaagcaattgactgctggggaagagggtttaatgcagacctcttttccctcgaggagacatgtcaatctagaagactaagcatgcatgcttttccacaggctcagtaatatggcagctacttaaacaagtcaagaagtggagaccttttgctctttttgtggctggtggctggtttaaagtagtttatctctgctgcaaattatttacagtattcactttaacagtagaatgtatttctgacaacaccttaggtatacaattgtctcttgatgtgtaagtgtacagttctgcatgtgagtttccctgtggggaattattaatgtggtgagcttggctaattaatcatcttttcaagcaccgccaaggattgtaaggtaggtactgaatagatggtgaatgctggttaagtatctgtcaactagatacaagctaggaacatgaaaagtaagaaccccttttggaaagtgctctcaatcagattggccaatggggaagcctgttggatgttttcctaattaatagttgatctgggagatggcttccattactttaaaacatttaactagtttagacatatacccaagagtgttcattagtggacattccaagaagaatagctacacccttcccctctctttgccatccatactacatccagcttctctcatcggctcaggctagcctcctccacagctgttgctgcacttggtacccatcccacagtcttgccacctccaaaacactggggtctctacaggctacaccttcaccagtggcctctctgtggctctcatctagtcctccaaccttgttacatggttacaaggtaacataaggctctttcgatgaccccttaaatccgggggctttttcttgcaacagccatcattagccatgacctattctgacctctcacagaaccaagtctcagcttttctctaaggccccccatctttaaaatcagtaaaatggaaatttccttttgctggtggtccctgctggtccctgctggttcctgctggtctctacttgttgctgttgttgtgtttgcagttgcatttgctggattgttggtttgctattgttggattgctggattgctggatattctgacaatgaagagtgtagttgcccctaggaacctgatgctcccaataagcaagaagtagtcctaaagaggtctacatcccctaaagaggtctgcatctcctaaagaggtctgcatccccttttccctgtaaccttctttctctcctatctagtgttggggaattggaagggattgggtggaataaggattggaaggaaggtagagacataagaacccaacaacctaactaaacgaaaatgccaatagtttatctccttggtgactctacgtcccgtaaatttaaaaataaatattaaacatccaacatctaatgatgaatttctttgaagtcataagtctagtgtttagcatctctgaaaaattatcctctttcctcgtctttaataactcacagctgaatggttttctaggtcataaagttctttcaaatgtatgcacactttcagttgcatggtgatcatggtaggtactccaggttggtactgatctcattttgcaaatgaagacacagagataaagtaagtggcttgtccaatggtactgtctagtgttgaagcctgaacagatctttggctcatgggagccagccactcatttggtagattaaaaacaccactgggaacatgtctatactagctcaggactgaagtaacagaagccagctctaacatttcatggctcccagtttaatacatttcaagttaaccaaaattatttatcattgtttatatcatatgctattaaatcattttcatttttctttgtaattccattgataatatctctgtattaaaatgttacacttcataatcttgttcctggaaggtattggctacagaaagcctgatctgccaggtttctacaactagatttcttcttgcctagtttgggagagacagggatgggattctgtgcttattttgcctctttggctaaaccagaataacttggcaaaagttgcatataaaaagaaagttgtgatcatattatttgtgtcctctgcacaagcctgccctgtggctgtggtaattaaccttattgaggagcaggtaacagtgatgattatatccactcttttatatcactctcttaattatattcaaatatagatatatgcttgggctacatcagcctaatacaggcacacttatatatgcattcatgattagaataacttctgctcatcagcttctattataacctctaaatattttaagaaacaccttgctgattattcaaagtagctatgtctatatctaatagagaggataataccatacctaatgacttaactccattgttacatttgtttagtgatggtatatatattataaatgactaaaagtgatagaaacaatttactttgaatctgggaaaaatgtcgacctctctggaggtagaaaaagaagaaaaatcaaggagagaaccttctttaaaggactgttgtaaacgggttgatgtttataacatttgttaattgatagataatctatcttaaaatgtaccctgccagaaaaacatcagatgttacagcatagctctattttacagccataaaaggctagttgagtgtgtgtgtgtgtgtgtgtgtgtgtgtgtgtgtgtgtgtgtgtgtaaaactgaaaaggcactggtccgttcatgagttcttccaccaatcctttcaagctagaacaaagcttcaagatatcaagctgagttcaaacagggtgcaacttggatagtagtgagatcaaggcctccatacatttgtctctactgttttaagtggaagggtttgatttaatgtttgcaacctaggggtggcatcaaggctggatggttataaagaacaccttggtttctgtgagtattgttcattatacttggttcctttggtttctacacctcagattctttttgttgaatgacaatgcaccacaaaagtaacagtatttgatttatgggatatgcaggtagatatgttgggtgggaagttgtatcttcaaacctagagtccagacaagtagtctgtgataatgatcaatatctcaccataataattgtgtgggtggtatctaaagccttaattgaaggatgttacccagacaagaggtttaaacaacagagaaagtcccagccctttaaagattaagtcaaggagcaaaaagcattgaaaatgggtagcggtgggcagtaaggaacaagcaggctagacatttctttctgcactctttctgagacacaagggacatcaaaataaacaaacacagaacataatagccccatcctctcagagttcccccatgagtggtgtacatcatttttatctgaaacacttaactgtactaaactccttttaaccagtagcctcaagaaggttctgagtgtctgctgtaccaggaatgagatattgaggtcttcttgagtttctgaagtaaatttaggcccaggaattagcagcaagctgacatttcataatgaatgaaatactggttgtgtaacactgctctttggcaatgctaaattgtttctccatgttccttctttatagactgaggagaaagcattattgagctttgctgtatctacacaaatggttaaatttatataagtttatatgcagaatcaaaacaatgtccaaatcatgagaataaagtaatattccgtagcagtaaaatgggaaaatccttttaaaataaccttcgtactacagtgctttgacatgacctgcctgcaagacatgcttgtgcaataatgtcacaatgcatgtggcagtaaccaataaatatttttatttgacttaaggcccactccatgagaagaaacccaaaatgatgctgcttgggtgaccaggaacctgagactagatagttcaggaacctggacgaaaaatcaaatattatcgttctgctaaaggagcaagctgataaaatgactcttaataacattccactattgacatggataaaaagttccttattaatcatcatcagagaatcttctctctgaaaaagatgagaatagagacccagagccagacaatgtgggaaggatgagggaccttgaaaaactggtctctaaatggaacattttcattcattccctcccctcagggctccacccactctatggaagaagagactggggtaaaatggaaggtccacacaggagcgacagaagcatagacacaaagccttctcaacacatcctttcctctttaccccaacaaacccactcagttttgcctttgttcacttcttccagatgtttttgcatctgtagtaatctattccctgttgctatgggaataatatacctgacagaggcgtcttgaggcagaaaaaggtttattttggttcatggttccatggagcagagtccatcataccaatgaaggcatacatacagcagaagcataatagcaaggcatacagcagatgcataatagcagcttgtcagattgcatcagccataaggaagaagcctcagtgataaacgtcctccactaaagaacccttctgaaagtttctataattttcccaaactaccaactggaaccaagtgttcaaacccatatgcctcaggaagacatctcacattcaaagcacaatgatgttgaacaacccagtatgtctccttatgtcactaaagctgccttgatgacgtcagcttgcttcctgttcagcgaacaaaatgaatattatctactctagtcacggctccagcctggtgttctgcctctaaacttcctcaagttgttcaagtttgggtatatctctaattcagcgtccgtgagagtgccatgaaatgcacaccactaggtgatgtcatacctcattatgcctttgcatcctaaaccactgtcaggatagccagtgctgttctgtgtgcacggaagccatcttaacacagaaaggaaactgtaaaaggtcttccccttacatgtcctcttttgcttgctatcatggaagtgatattttctgatcataactctcaaggtccaccttatcctcaaacctctgcattgtttgaggagtcaccatagagtttctggtttttactttaaacctcacattctctttatgtaatatgctggataatttcacaggcatcaggaattgaatccccttctaccaagtctcatgggtggctgcccttcactgggcaagcataggtattcattaaatattcatcgaaagattttttttattaacttgttgtggctttccccacactttggatccaactcaaataccagttaatacataatccttttttt

SEQ ID NO: 182 - DNA, 1784 bp, Mus musculus
tgaagtagcaacgaaaatagttttatggttgagggtcactacaacatgaggaactgtattaaagggtcgcagcattcggaagggtgagaagcactgctctagaaaggaccctgatcctcacgccatgttcttctaaaatgaaaaacatttgttagttttggatagcaggaagtcaaggaggaaaccaggatggtttgctccaagcagatagcgagcccagccagacatgcccgggcccgcccgggaggccgagccctgtgagaggaacacgggagcttattttggtcttgtggaactgccgggggctgtgcgcccgcgctgggcagctgccagcctctggcggcatccagaggcgcgtcggcagctatttgctgtaacaactattttgaaacagtattgagcgaaggaggaaaaaggccactagacttaagtgaatactgaggttagagaggacgcagaggtgggagcgagacagcaaggagccgaggcctttcacactctgggagcctttcggggatgtgagacgacacagaacggggttggggtggacacagaacatggcggggttggagacaaatcctcctgcccagcttttagggatccggcggtgctgatccccaagattctaaaccggcttgaggaggaaagaaacctcgcgttctcgtgtctagcagcaggcctgtgtgcagatggattaccggtgtgcccttctgaccatctccacccgccctggagggatagatcccacacttggagatcttcccggtccagcctagaggacccgggttacgcaaaatcaaagagtgggtgcaagctgtctaggcgcgcccctcccccacactggcttcccgggtcccctcgaggttgcagcagctcggaggattgccacgctgtgtccttgtagcatccaattatttctctctctctctttttttaaaatccttttccctttttctttttctttttgaagggacggatggggtaagggagaatactttaaacggggagatagatataaagattcctggatcggtaaacaaaatcagtgaaagaaaatagcgaggaactcgaattccaagcactcagaaaatctgcggcttgcaagagatgcttacaccaaccgagaacaggggcgctcgcgttccggggcctcccgttgccagcagcggtttctcccgagccgggaatcttctctccgtgcgtgcgaagcgggaaacggctgcccgccgctggagggaccagaacaacggagctcacctcaggccaagcccggccggcgttcgccgtcgggtcaccaccgagccaccgggagccggaattcgcgcccatccctcacaggatggcctgattcaatcgcgtactggatctgcaggagatgtgcctcaccgcagctcgtgcgccccggcgcgcagcaatcaccgcgctggagagggcgcaatcccgggctggcctcgcgcctccaccccgcagtcaggcttgtgttccccgtccggcggcctgcggagaccccggcttacctagagcgggcggcggccgaagcccagtcgcttgcgagggggaaatcccggagtccccgcccgccgcccccatcctcccaggtcagcgtggcccgcagggggccaggccggcccggcagtgcgcccgcttcccctttctcttcagatgcctttgatccccaagctctccgccgcacctcggctcccgagctgcctgggtcggcccgcggggatcctggaaaccgtccccggtttatctcctttcatcaagcggccttgggcagcctt

SEQ ID NO: 183 - DNA, 6887 bp, Mus musculus
ggatgttaacataatatttaattagaacataattgatagctattcactgctgtaaatgttaattttaaaatctaagatcatcttgtcttggactgtgtactgtcagaaaaaggaagaacatattctgaagtcactaattgggggcagcaggaggaaggtggtgttcatgattctgttctgaatcgtgctctgtttctttaggttcttgattgtctacaatgggtgaaccacagcaagtgagtgcacttccaccgcctccaatgcagtacatcaaggaatatacagatgaaaatattcaggaaggcttggctcccaagcctcctcctccaattaaagacagctacatgatgtttggcaaccagttccaatgtgatgatcttatcattcgccctttagaaagtcagggcattgaacggcttcatcctatgcaatttgatcataagaaagagctgagaaaactcaatatgtctatactgattaatttcttagaccttttagacatcttaataagaagtcctgggagtataaaacgagaagaaaagctagaagatcttaagctactttttgtacatgtacatcatcttataaatgaatatcgaccccaccaagcaagagagactttgagagtcatgatggaggtccagaaacgccagcgccttgaaacagctgagaggtttcagaaacatctggaacgagtcattgaaatgattcagaattgcttggcttctttgcccgatgatttgccccattcagaagcagggatgagagttaaagctgagccgatggatactgatgataacagcaattgtcctggacagaatgaacaacaaagagaaagttcaggtcacagaagggaccagattatagaaaaagatgctgccttatgtgtgctaattgatgaaatgaatgaaaggccatgaagaatattcctttttttccttttagtaagtagcatcatatattagtttatttcctctcagacagtcttaagaggtataactaaagatactaagagactttttttcaattgaaatgctgtaggtggtaatttaacactaaacataggccagcaagtatatttgagtaattgccataaaaaagctgaatgtttgctattgtttgagatagtcctattttttggagttggaataaaaacttgaagtaataacgaattgtcattcttggaaaaaaagttatttgcttcgagactaataaagggcatcaagtgtacatgtgaaattataaaatgtttagatttattccaaaataatatagaaagtttatttttctgattactgttccagcaaactcagtatcacagcttttctcctccttattctccatagaatatttgttagggactctttttttgccccagtcaggtaatgatgtggttatgatccaattctatgagaaatgtacatacttcaccttcacagatggatacaggcttcccccaaaagataactctattgagtagctattcagtctcaacatagcttcttttctggtttgtgtttgctaagactatcctagtctcttagccatcataccaccctcagaagagtcttgcttccaaagtaatctaatcagaacaccttgtccagtttatatccttttcaaacacatgtatatgttggtagcacagttctaatcacaaagctacccacaactcaatccgtctttagtcattacagatgaggaagtagaggttcagagaagttgacttaaccaactaataagtggcagaatcaagttagaaagtaggtattcagtttcatagccaaagtactgaacttcattctctatcctctagtctgtcatactggaaatcataactagagctactccagttttctaatcttgaaatccaccctagtaaatacctcatgacactagactcaagaggatacatttgttgattggaagaatgacttctctttaaacatactcaggaggcagggtttgttggttaagacttccatatcttaagatggtgcttgtaattctacctaaaaacccttcttagtaggtaatgttcctaactaagactcataagaattaaaacttcacatttatggtttggttgggcaagagtctatgtgggataagaaatcggcaaagatttttcttgttttgcccccttctcccttttttggttccttgtcatcttcatctggtggtaaacttactgtacagccatttaataggcattgaaaggtatacaatttctctttcataatactcatctatggcttgacagcagtcatagacaataggtaaatgaaagcactgctctaatccaactctcatatatgaacaattggaataaaatatggacgctgaaaattgaaactcaattatccaggaattttgtgagatattttgagtttttgggccacctaaatgtaaatttctacactcttgggagttgaaaatcagatcacggagtagatttggctgatggcctacatggtttaaatcctgaaacatcactgagatactaatggaggggcagtaggtaagggtgctagcttagaattcatggttgaaggaaagaatggactcttgagagttacagtgaatacactacagaaataaaaacagcaaaatctccgtagaattgttttaaggattgaaagagataacagctaatattcttaccacttgttaaaagttttacttatttttggcatttgtagccctggctggcatgaaactatatagaccaatctggcctcaatccaaatcctgctaccttagctgcagtgttggagttctaggcaggtgtcaccacactcagcttctggttttacttttcatttggaagtaactgggaacaattatggggctccgtgtgatgtttctatgcaagtatactccactgagttttaactttagcaaaccattgacattgagcattacaattttaaaaactggcttcatattgtaatgtgatgctgctgtcaataagtggcagtcttgcttaagtgtgtggtaatatagccagttgcacagaggactgaaatgaaacccagaggcactgcttatgaactgctcactccacctctttcagaactgaattaggcttcacttacctggttggtacctgttgaatcagggatggctgttaaaacacacccataatgcaactggaaatggtgcctaacacctggagtctcagcattctgaagcatgtaatcggggagctctcaaggctaaagtgggctaccttgaaagacattaaaaagcaaaggacaacacaacagaaactaccttcaacaaataaagcaaccttgagtcttagaatttgggctctactattagctgggtagctttgatttggtttattagtatccatggatgctcattttctttaacccaggcagttacagtagtcaccccagagtaattctgtcagtgaaagacaacacccaccctaactccttctgaaacccattcagccccaaacagtatattcaggttccaggctaactagtcatatgctcagaaatatctgatctgagttgttttgtgggtgccccagaggctaggtggtgcttgagcttggggccttaaggcattactccttttgggaataggggacaaaagaaaaggtagaggcagtaagtaacaaaacatggacaaccttctaatgcctttgaagatttggggaaagtgggcagattcttaggaaattatcagcactgataagaaactccaaggatattgcaatcggggacctggaggtggggacaacatttgggatgtaaataagtaaaataataaaaacaaaaaagaaaacaacgagaagtggaagtggagctctcactaagaacgtttgaagttcagatagcttctgtggcaagtaagcctgataaacggtgcccaccccacacaggcttgtgcacatacgcaaagagtaaaaagtaatcttttgcaactctgtcaatgaatagacaagcaaaacatttcctaagtcttataaagttagtataagcaaaatattaaactgaaaccagtaataattttttaaaaaaggttttttatggccaatttgcacttacttcaagaatgtggaatagtaaaataatatgctacataatgggtttaggaataaaaatcactttctcaataggtgtaaaatttgtgagaattaggatccattcataaaaaagaaaaacaactctttagcaagaatagaagggaatttccttaaaataaacagcagctcttaaaaaaaaaaaatcaaccaaggatgcctgctatcaaagcttcaagtatgtactagattcactaaccagcaaagcacaaaaaataaaatattgaaaaggaagaaactaagagatcaccgctgaacagaaaataaccctcagcataaataatttcatataatctaaagataatggattagtaaacagctacgagttgttgcaccaaccaaaataaaaaaaatgtaaacttgatactatgtaaaatagcttcaataatatagaaggcctagaaaaaaaaatctagaaacaattgaatattatacagaatacattttattaacacaatatttttaaaagcctaaaaagaaatagaaacaaaatgtgtttgtagattgtaaagaggccaaatttatcctgaattcatttgtagctccaatgcaagttattagttttctaccatattctaaaacttgataaactggttctacagttcataggttttgttaaaaggacccagagagccatactgcccttgaaagagaataaaggaaaggatttccgctgcatgattatcagtatttatcatgctactgtaactaaagcaaaatgttgcagaaaataggcagaaaaataggcagatagacaataggaacactactgaaagccaggaaatggatgtatataattttgaaacatcagagatgacattacaaagggaaaatgctggaattttcagtaggtggagttaaaataaagcctgcaaaactcagctccaggcgaattaaagacttcaccacaaaatagctatcactttttactgaagcaaaacttgtttgtgcttttattaaaagaagtggaatcagccgggcgcggtggcgcacacctttaatcccagcactcaggaggcagaggcaggcggatttctgagttcgaggccagcctggtttacaaagtgagtgccaggacagccaggactacacagagaaaccctgtctcaaaacatcaaaggaaaaaaaaaaaagtggaatcacagctaggagggaagactcaccatgtggaggagcttccaactaagcccgactacctgaagtcaatatttgggacccaagtacggaaggagaacttactcctagaaattgtcctcagactttcacatggaggctggggcctgtcagcccagctggaccaagaagccagctggctttaggatattcagtccaccgtctttgctcctcttatcagccaaatttttatataggcaaataccttttaaacctctaaataagagatgaaatgctaaaataaaatacaaaattactattcataaaaaagattggtttattccattacgataaaattacattgtgttcaggagctggagagatgtctcagcaggtagcaacacttgttgcttttctaaagagacctggttcagttcccaatatggtggctggcaactctcaattccagggggtctgatacagtaaaacagtgaaatgctatagtgtgggggaaaatatttgcaacagatgaaatcagtagaggactaacatccaaaatatataaattatttgtattaatatgaaacacaaactcggcagactgcgtataggacttgaacaagtatttccccgaaatttaaaatcaaatgctgtataaacaacagtttcttgtagtaactaggaatatataggttaaaaccacatgccatgtttccacatccttaccagtttgagaaaaaacataaaaaaccaaaaccacaaacagaaaaaccaatcctggcaataccatgcctcaaaacgattttttttttcttgagacagggtattgctttgtaacccatcatgtcctcaaattgtgttctttccttagtctccctgtttgaaccacaggtgggcactatgccatccagcaaaataatagtctatatgctgtcggtgagactcttggaaactctccggtcattatttaacaagatttcagatatttatgccatctgatccattaactctacttttggaaagacatttcaaagactcatgaatagcagcatttatgcatgagaatgtccagagcggtgttatatgtagctgaaatgaaaaagaaacatctaaataggacaactcttttcagaagtccacacccttgttcagggatgtgccttcattttcttcctgaacacctttcttatcttaaacccagtacttcaaacctattaaactcttaaactaccaacaatgcttaaaaaaaaacaaaaaacaagcaaacaaacaaaaaaacagaatggctcccattggcctagcctaggtcctggtgccaacagacccacgctgctcttaaccagagaaacatcttacagtgcgcagcagtcaaaaggagagctgtgtaaccaggtttactgggtactggggataaaacccaagacttcttcatccacgctttgcatgcactttatcaacctagctatatctgtaatccaacatctatacttacttgaaaagacagggtggtgattttcattgttggtgcaatggctttagctcagtttgactgtacagcccatcgctcattccattcacaggaagcagagagaagggaatgctggtgttcaccgtgtgctcttctttttgttcagtatgggatcccagcccatggagtggttcttgtctacat

SEQ ID NO: 184 - DNA, 17715 bp, Mus musculus
attccctccatgtctcctctgtctgaaccttggtgactccacaaaatagtacggtaagaaaattgtagccactgtgggcactgtggactctctgctttcatagagttagagatgactcccacggtagatggtaagctgtaggtgacgcacatcttggaccctgcctgcctctgtgtggaccacactctcctgtggttagaaaggagcccgcactccttccttaacaatagtcacctcagaccgtggcggccaggcggagagagaggagcagactgaggtggttctgctggcagggcacttgttcccatggctttccaagtagagagacctcataccatgctgcttgcctctgtttcaactctttatacctacaataaaaatgccaaagtaaaaacattttttcatgtaattgataaatactaatcacaaaaatcccttatttttctataaattgattcaatctctgacagtctagaccaaaaacattttagattagggaagagagaattaaaatttggaccatatagaaaatatgcattacagggctggagagatagctcagagggtaagagcactcactggctgctcttccaggggtcccaagttcagttcccagcaactgcatggttgccttacaactaggatccgatcgatgccctcttctggcatgcagttgtacatgcagatagagtactcatgcgtgaaataaatctgataaaagaaagaaagaaagaaaagatgcattataagctttcttttttgaaatagtttctgcctcatgtgtgtttgttgataacagagactgactatgtagaccaggttgacttactatttatctgtttgtttacccagtcagtcatttgagacagggttggtcttggctggtctggacctctgacatccctcccagccccccgccacttgcctctgcctcccaaagccaggactaagtgtgcatggccatacctggctcattaacttgaattcaccatctttctgctgtagatgccagagcgcttggatttagaggcgcataccatcacacctagcaccctttgtgtttttatggagtgtgtttaaatgtagctccatgataaaagttctctgtgtgtttcttagctttcagaattccaattaaataatcatgtaactgaaaacttattatttttaaatttgccatcatttaagtagaaacccttcaggcttccaggtggcttcagatctatgccattgtctgtccttcctttggcataagtcaggttatacctggtggtaggtagtcagggctggtaagtccctcttagttactctccacaggttttgttacagacttcaccatctgtgcgtggtaaagtggacatcaagcccagcatacagtgcagtgatggaaagattaacaggcaagatagaaatagaccagtggagaaagagaggaggaaagttgggcagaacttgttgtgcgtgagcctcagaacttacgtttaatttaagcatgctagattacctttcagcatagtttcatatcacactaaatgtagccctaaattattttccttgtattgccctttttcctagttcctgcaggattattaagactgtaaatgtatttcacagttcgtatccatcacaatctatggcagcagggaggccagtgaaggccagtctatttagtgtgttcaaagtctatgcaaacaattttaattctgttgaaaaaacccactgatttaatacatttttccctcagaaatgaaaataaattagacattgctgctattaaatggcttaattttgtttactttagatgtggatagttttagaacagaaaattatctactttttaaaaaaaaaatatttacttcaaaagtattttcaaacagtcttaatttcttagtgtgttggaccttagctgtagatttccaagttcatgtataggctaaaatataattctttacttgggctgtagagatggctcagcacttaaaaacaagtgttattcttgcacaggacccgtttggttcccagtgtccatggtgtgtagcccacaaccacttgtaactagtttccagggtgtctgatgtcctcttctgaactctggggcacctgtgcttagctctatagatactcccccccacacgcacacacacaaatacatatgcacaaaaattttaaaacatcttttaagtcaggcatggtggtgtgtgcctttaatcccagcaggagcagggagatctctgtgagttggtgctagcctagtctacatagtaagttctagactatccagtgctacataatgagaccatgtctcaaataataaaatcaagccacatcatgttggtgtagcatgcctttgatcccagcacttaggaggccgaggcaggtggatttctgagttggagaccagtctggtttatagattgattgcaggacagctagggctacacagagaaaccctggctcttgaaaaagaaaacaacaataataaaaaaattaatcaatctttaaaagtgtatcctttaaaaatatatattgtttccttagacaaagtgtccaggactgtgagatgactcagtgttaagaagagcactgtttgctcttccagtggtgctaagttcatttcccagcaaccacatggtggctcacaaccatctaaaatgggatctgatgccctcttctggcatgcaggcatgtattcaggtagagcattcagatgtataaaataaataaataaaatctaatttaaaaaaggaaagaaaaaggtgtccaattttagctctgcattttactaataatgaaaatttggggaaaaacattttaataggtagaaacattatagacagtagttataacaagaattatgtaaggatagatgatgtaagaagttggtatcatttttcaattctctaagtggataaatgagaggctgctgatttataatgtggaaattagtaaggagcttgaataaacagccgatccttcgtagctctgggctcaccctaaaagaacaggctcacagggaaatgtgagcaaccgtggaactgtaagtcggttaacttgaagacatgagggtgaggatttctttcacacgtctgtgttgtttaaagtggtaggatgcagatgtttctggtttctgtctaacttccccacccttcttcccctctccttactgcagcacttctggggcccagttgccaactggggtctccccattgctgctatcaatgacatgaagaaatctccagagattatcagtgggcggatgactttcggtaagaacacgttaaggaaggggaggggggcattgcacatgacagctcctgcacacaactcagccctgttatggctgctaaggggtgcagaggtgggaaggttctttttcactatggcatcaggtgtactgacttttgtttccttcggcctggtgttctagatattcatggtgtttgttttgatgttttcagccctctgttgctattctctgacattcatgagatttgcctacaaggtacaacctcgaaactggcttttgtttgcatgccatgtaacaaacgaagtagctcagctcattcagggaggacgacttatcaactacgagtaagcacattttaatgtattgttttgaggaattggtgaaaaaaaactcaattttagaaaaacatattgtaccattgttacaaaaccatgttatagaaacttgtcttctaaagccatgcagagcctctgggactggcggtagactttgtgtctcattgaaattgtctccaattatttccaggatgagtaagcggccatctgcatagcggtacaaggaccagctcttgaaagagacagtgctccagccactgctgcagccacagatcatgtcagcatgagtagtcgtgctgaagggaaaacacagaatgctatcttaatgaccatgccaacattattgaatagccgagagtccctaaacccactctctgctgccttatcaatgctaaaccttatttgtcttcatcaagagtagttcaaaatatgcaactaatttaataattttgaatgatggttttatctatagcaatctgtagtaatatgtatattatctattgggatttgtgtaataaaaaatctaagggaacaaaattttataactacaagcacttaagtactcaaaattcttgactttttctttaatgacaatagtaaaccctcagttggtcacatgtctacacataatttccagtgataacaagtatcggtgttttccatatgtaactcagatctgtaacttaatggcaataaatggtttaaatatttgctatttgagtgtgactatatatcttgctgtgttggttaggaaactgcagaagcaaatgtctgaaaggatagtttcaggagaaaacaggactcctagaatctattcctgtgacctgagacgtggaggggctgttcctttgcagagtactccagacctggctgtcacatgcacttgctgagtccctgttctctcttagagcctctcagctctgaagcaagtaacctttttgggtggtggtggtggggtggggctctccctgccaaactgcatctgcagccacagcccagacagccccactgggaatggtgctagtccacggctctcatggagtcctagcacagacacccaatgacatgagtcagcactgggagccatgggctatctcatgcagcttatcgatttcttctgctgtttataaggtgcagttacaggaaacaaatgttgctttcttaggcttctctgaccctcggggttagcccttcgcaaaatttatggatttgcatcttgttctttcaacctttggggaaagttctgacttaatagtcttgaacactgaggaaagagcctaaggttgttcacacttccatcaggaagactggccagcttaccaaggctactcatggagaggggtccagctgataatgcagaactagacaggcacagcagcagcagggcatatgagatctggaagggtccttcagcacaagtcagtagtcagtagttcagtgaaggcttctcacagaacagttcttcatgaaacccagatgaagaaataaagatttctttgccagggagaagctaagcacataaagacacttactgccaagtctggagacctttgcttccctgtccccacaggcgaagagaactgattcctgccaattttgttctgtacatccaaactcaagccatagtgtgcatgagcgtgcatagccatactccttaatcctgggaacttccaagctttgtcttggagacctgtggaggacagtatcacacattggattgatttctggtttgttgatcagagagtatgtctcaaggtttagaatctagatccgaccttttcaggagagcttatggcttcagccctgtggctactgtctttgcccaggacagctgcctttgccccaggctggctgccctaccagcccctcctggctcccttttgttccacccagcttagctccaggatcagctgccacccgccccaactcagcctctctctctacccatctctgctcgggggtggggtggggtggggtggggatcctgccaccaactcccaccagagacccttgaatccacaaataaaagacacagagacagctctgttatttgactaactgggcacaattgctgggcgcaaatttctcctgcctggaaaaatttctcccttaccaatttattatttccacctctctttctgccctaaatttagtggcttgttgcaattagcctctgccaaacatctttggccacccgcatatagtgggggctgcaggtcctagctctccctgcggccttacatgattgcagcgttctctttcttccaaagcatggcagaaaagccccttctctcctttcctgtgtcccccttttcctcttgggaccaggaagtcccacctattataccttccacccagcaattggctcccatcctctttattgacaaatcaaaaatcagttagggaaccagacttagtatcagaacctccccttacagaatggctgtggaatacattgcaaactgagctgggctgacggacagcctgaccgaatgtccaacagtgtataaacaaacttaaaatcatgttactttattccatctctaaaattaagggctacaaatattttcatttccaataacaaaataaaagttgtgactcacttctaaaaggatactgattccagttgacaaaactcaagtgccatgttggtctcacctccactggcagttttcttgttgtgagttctggggcagaggtgacagttgtgaaaccatcctgtacaactgagaatctcctgcccacacagtgggagtcttgccccatgggtggttggagggaaatggcacaggctgcctactggagggaaatcaatggccttcttgtttcataattctctgacctcagctggctctttgttcacactcctcagggctgcttctgccccttgtcacactgtactcaggctagttgtcattcataagctcaagttgaacagttactttcctgtgactgtttctacctgagatgtcttaggtcttgtctagatcactgcgcagaatttacagacagtaatgaccatgtgaacacaagccaacataaaaatctggggacattgacactacattggattactaaagacatttgaaagcctcactacaagtcccatgcatagaagacacatgccacgactgtagcatcttagctgaggaccaaggagctacaacaggctcgacacattagaggtctatggagaggagccatcaaggttagaaatcagacctggctttaccctaagagctgttggaagagaagactcactgcctgtcttcttggggcgcctgtaacaataacggattagctgttccctgacccttttataatgaaacctagaccattcacagtccccttacctcagacagtttagccaacattccatggcctacaggcaccagacctcactggtctcctggcagggctggtcattccccagtgctctgagaggatcacccatcggacacatgacagctttcagccactgctgaaaattcttccctaaaccaccggttccattagggcagtggttctcaacctgtgggtcgagacccatttggggccacatcctgcatatcaaataatttagattgcaattcataacagtagcagaagtccttgcgtttcctggctggcttgaatttaacaagaatctgtccttccaggcaatcctggggcacagaacatctctccaggctaggcatggcgcctgggactctctgtttccgtcattacatggattcttgtacatcaagccctgagcagacttacaaggccacggacaaaagtagcagtggagatggaaagaggagagagaagagagaagaacggaggcagggacagatgcgttgactagtctggctgagtaactgggtgcgtgtgtgcttgtgcacacgtgcctgcctctgaatagcctcatctgtatacagctttcctttggaggacttgcgtacacatcatcacctattcttccaaaatccaccgcctcgattttttttcaaaacttttgggttctcagcattgaaccgagggctttgctcaggctagatggggctctaccattgaataattattttgagcttgccatgaaacatatcagtaaagcttgcagctatcctggcaaaagaagaaccttgtggtatcacaaaatttgaacttcgaggtgaccaacaatagatcattgtatactctgatagttgtggtacagaacaaaaatcttcaacaatagtttccttctagaatgtccttccttcctacatgacagcctgggacaaaaccctcaccttagtcaatctcaactcttagagtaaggtaagagttcaagtagactagagcaaagagggaggggcagaggacgtcattcttgctttcagccagctctgaccatgattaacaagtggcctcgtgttcttaatgcttaaagtgggtggggcagtgcactccttgtctcttgtctccattagtgtttacaatgagacttgtggggagtatgaaggaggcatgtgtatcttgtcctccagacacctcccacacacatccatgaagaaaaggctggttaatctaagggtcttctgcttagggttctagcccactgaacaattttgagaaaggcattagtaaagcccttgggcctttagcttgttcagagggataatgtgagatgcaatataatttcagtgaacttttgggattagaggcctttgcttgtttgttcacacaccaaaaaaaaaaaaaaaaaaaaaaaaaattgtaggacacctacatcacatgactgtgctggaagatacgaagagaaaatgaagggaaggacaccatctaaaggtcggcttaagaaatgcgtagcacagtacaggatcactgggctggcagtccagaaaactgcgcagagcccttgattcatccaagcatacaattaccataaaccatctcatgttaaaagaaatgtgacattcatgtgccactaggtcagatggttttctttcttttcttttttttttaattaatttagttagttaattagttttaattaggtattttcttcatttacatttcaaatgctatcccaagagtcccccataccctcccccccccactcccacttcttggccctggtgttcccccatattgaggcatataaagtttacaagaccaaggggtctctcttcccaatgatggccaactaggccatcttctgctacatatgctgctagagacacgagctccgggggtactggttagttcatattgttgttccacctatagggttgcagacccctttagctccttgggtactttctctagctcctccattgggggccctgtgatccatccaatagctgactgtgagcatccacttctgtgtttgccaggccccggcatagcctcacaagagacagctatatcagggtcctttcaacaaaatcttgctggtgtatgcaatggtgtcagtgtttggaggctgattatgggatggatccccaggtgtggcagtctctagatgttccatcctttcatcacaactccaaactttgtctctgtaaccccttccatgggtgttttgttcccaattctaagaaggggcaaagtatccacttttttttgttgttgttgttgggtttttttttgtttgtttttcgagacagggtttctctgtgtagccctggctgtcctggaactcactctgtagaccaggctggccttgaactcagaaatccgcctgcctctgcctcccaagtgctgggattaaaggtgtgtgccaccaccacccagcagatggttttctttaactttaaacgtgtgtgtgtgtgtgtgtgtgtgtacgattgtgtgcatgtgggccacacatgccattgtgtatgtggatgttggttccatcttatgtgagaagtgtctcttagtgttcaccaccacctccgtcatgctagttatcctgtgagcttccaacgattctcctgcctctcctcccatcttgtgccttggctttatgtagttgtcatagcttttctgcctgtgctttgacaatgagtgctaaatgagagagcagcaagagcccagaaaggaaagattttctcagtggtggaggaggcttggggagaggagaggaaactcagcaaggcacagacatgtctgaaccttggcaaccatgtcctttttcttccttttttttatagtatagaataaagtttattttaggcatggggaggggagttaagagagtagtagaggcagataaagacagagagaaggaaagagtagagaagtggagaccggccatgaccacgtggagagagggagacgggaaccatgtctttttttttttttttttttttcttgttcaagcacccttccgggactacctcttgaataaaaagaggttttagttccccttctagctttctgtgagtaccctggaactccagctgggatcgtgggtcccttgttgagacagtgggttagcaggacctggggctgcattttgagccaggctcagggccagctggtggtctgcaggccactgtcatagtgggtgatggatgcagaagcaggcttgcttttgttcatttttttcatcagatctttaaagtcaatacacgcttgaagagcaatgacagctttctttccccctctaagttcaaccctgaacacacaagtatatgttaatcaattaatttctgaaagacaagacctgttactctttttgttgtttgtttgagtctgggtgtagtgagaatttatttagtcccaggtgtggcatgtggggctgcttcagtttgtccacggatactaactatgattgtcttgtgcgctaggaggaacaatttttgccatttgcagatagtttacattttgaattccagggactcctcagaggatataaatgccagagccccgaggcgctaggggtgagctcagaagcagctgctgctccccctgttcctgctgttgttgctgtttgtcaaagggccatgagcaaagaatgtgggcaagtagactgtgccaccagacagaagaactggtatggctgaaacaggttcaaaaatcctggtaagtctcagagttgagaaaggtaggcattggaaccggctcctggccaggctctacctatcctggaacatgtaaccaggacaccccactgagaggaccatgacaaccagtcatgtagcataaaaacctagcgttctccgtgctaatgagggatctagataagccccaagtgtttaggcaatgagcttctcttcctgtgcattcctgcccacagaaggtatttaatctctggttcacctggagtaagatatacattcatatcccccataaaaataaagccgtttggacaagcaaggaccatctccttcatcaaggattgtctgggggcagggcgggaacagttccttgtaaagaactgcacctgaatctcccagagaaggccttctctctttcagcccctcagtattcctggcactcactcagaaccaaactggatactgccccacctggactcagtcacccatttttttgcctggcaactagggcaagggcagaccctcggaccaccattctcacctcctccaggtccccagtggtgtctaggtacacaggagattgagaatcacagcatccttcccagcccctgctgtcccctcccctgggaaacacaggctgggaccccctatcttggactacattctaccttccccgagccgcctgccagcagctaggcagacatgtagccctacagaagagaagttggagatatcctgatgatgaagattggacctgccctaaggaactcagtgccccaatcagcaggaagtagtctaaagagatctataccctttgccctctaaccttctttctctcctacctagtgttggggggttaggagagattaagatggaacaaggtttagaaggtaatagataatagaactcaataagatagctaaagaaataactatgctaacacccagatcccaggctggccttgaattcactacattctaggccaaggaatgatgctaaactccaaatcctcctgcctccacaccctgagtgctgggattataagcacatggtactgtgcttgggtttatgcagtgctagaggttgaacccagggcctagtgcatgctaggcaaacactctgtcgttcttaattaggtcaaattcagctaccctgacacaaatggacagttgtcatttccttgggaatcaatagctgtagaggttacagaagggcattttaataaatctttgtaatgctggtcacatttccatgaactgatgattacaagtcaggatctggggaattaatttcacttttgctttttaagcaagtcacagccaaaacttgatagttggcttaacagtttaaagtatcaattagtgaaaattattttgttttcaaagacttgcaaatgagcctcatgcagggcaactggacagtcactgaggggcatcagccacaagacactgcatgactctgattgctgccagaaaggaaaaggaagcattttgtcattaaggcacagagtgcttcctgcttgcttttcagagccagggtttggggaaggcatttttctcttatggcgaggtttgaggtatgaaaacagatctcccaggaaactgtaaaggccaccaatgtgcctggaaattaccatggttcttttttttgggttgctgtgcaaagtatgatattttctataagagctgatcactcttcttcaacaggtcttctgctcagaaaatgggacaggaagctcagcctaaggcagtcagtgccacacactgcagggcttttgtcagcagtgattgtctgcaggtacctttgcctcagcaggccagcatcacattcctaccgctcccctttcacccttgttctcattttgtgacagaacaccaaaggctcccttctgcacccactcttgggagttcttcacttccaggcctcttgccagctcagcctttcaagtctctatcacactgtcagcgtgtggatgctacatgcaatggcaaaccccatgactcattctgacacaagcgctgctctcccctctgtaacctcatcaccacaccacctcaacagcgcccaaatgtccattccttcctacagaatctgcttgcttctgccctctgcaggccactcccactagcacctctgacaggtcacatccatttctgggcccagtacctaccttccttgcctgagcccaaataagtttcccagagtgcaaatctgcttctaccctaagctcaaagctcagtggtccctgtggctcttgttgagcacatggtcctgaaacaggtctcaatggctccctcagcagcctgactcttcccttgccccctctcaccctagtttgctctctctctctctctctctctctctctctctctctctctctctctctctctctctctctggtttttctttctttcttctttttttttgatttatttatttattatatgtaaatacactgtagctgttttcagacacaccagaagagggtgtcagatctccttatggatggttgtgagctactatgtggttgctgggattcgaactcagtacctttagaagagcagtcagtgctcttaactgctgagccatctctccagcccctctttggtttttcgagacagggtttctctgtgtagccctggctctcctggaactcactttgtagaccaggctggcctcgaactcagaaatctgcctgtctctgcctcccgagtgctgggattaaaggcatgcgccaccacgccctgcagtggtggcggcggcagcggcttcttcttcttcttcttcttcttcttcttcttcttcttcttcttcttcttcctcttcttcctcttcctcttcctcttcctcttcctcttcctcttcctcttctttcttcttcttccttcttccttcttcttccttcttccttccttcttccttccttcttccttcctcttcttcctcttcctcttcctcctcctcctcctcctcctcctcctcctcctcctcctcctcctcctcctcctcttcttcttcttcttcttcttcttcttcttcttcttcttcttctatgccaacaaaagcccacacagtgtccttgcaaacgtgcctgctcctctcaccagcctcttccaaggctgctctttcctgcagggctgttagctctgttgtactgttgtagtgggcaaatgttgtagtggtcccaagtgggatggacagccacagtgaatcactatttcatattaatagcttcatcttttttaatagtttgaagcatacacagaaaacagaaggaccccaagtttcccctcgcttctagcccccacaaactccccctaaatcttatgatgggtgtgttctactcctgatgaaccatcttggatttctgttatagtttctgttatagttcattgtccattataggagtcacatttggtgctgcacatgatgtggactggaacagatgcataatgccatatgtcttagttcaggttttattgctgtgatgagcaagacaccatgaccttggcaattctttataaaggcaaacatttaattgggtctggcttgctggaagcatggcagcacactggcagagatggtgctggagagacagctaagagttctacatatggacccaaaggcagcaggaagagacagtgacaccctggccaggctcgaacttctgaatcctcaaagcctatccccagtcacgtattttttccaacaaagccatgcctactccaacaagaccacagatcctaagagtgctactccctatgggcctatggggaccactgcattcaaaccacaacaccatgtatccatcatcacatccagaaacagttccattgcctctgtgtccatttgatgcaccctcacacaccccaccccgatctcagaaaccagcatctggtttaacttttttggaatgtaacatggcattgtgtggagttgtaatagatactgtcctttgcattcaagggtcccatgccttttccagcctagatagctcctttcttccttccttccttccttccttccttccttccttccttccttccttccttccctccctccctccctccttcctttccttctttccttttaaagatcaatgctttctatgtagccctggttggggttggacttgctatgttgatcagactggatttgaactcacagagacctgtctccctctctcaactgctgggtttaaaagtatgcatcaccaaacctggtttagtagccaggaacttaactcagtgcctgggaaggacttgttttcccagaggtccagtctctctccactcacaaccttactttacaccccggttacctcgggtttggaaagtaaggatttctctgccaccggaaaaaccctatgtttgagaacagggaagatatggaagctgtacgttcttctagtttctctgggaaaagaagagaaacaggggcccagagctgggtgtgtacatgatgagcagccgggaggatgaagagcaccagttccacagtgagtgagtgccagccctgttctcagtgtttccaggcaagatccttgctatttgggcccttatgttcaggaaagccaccacaaatgctgacttgggggatgccgagcaatcattttcttgagcacatgcagctgggttcttgaaaacctctggtcacgtctttgtcagctgatcattatgtaaccttgtttgctttgcattatacagatttgttaaggttggacgcacagctgccaccctatgtccaagtaaggcttttctttccatcttcctaagaaggcaattaggagactgggcaggaaagatggtccctgactcatcaaacagtgagaccagcagcagcagcaggaagaggaggaggaggacaataatgtgaaaactggggcactgattggggcccagaagggaaatttgtttataacatgaactgaaataaggcagcctacctctctggatctcaaaacgctgaccctgagcctgcatggcccggaaagtgctacaaggactgactgatttgtagcatctccaaccccagaagctgttactgataaggatgttttcagggtttttctatttagtcccttaacagctctgtaaggaagggatagatgttattttcatatttgttttgttttagagacatggtctttccctcacactatgtagctggctttccctcacactacgtagaccaggctggcttgaattcacagagatccactgcctctgcctctcaagtgctgggtttaaaggcttgcaccattatgccttccttatttccatatctgaagccaaggtttgtggtgatttttgtcaaatcccaaggctacaaggagtggggacaagattctagcccagtttctctccagaacctaggcccttactcattttattatcccccacaatggatctaataaattctttgtaacattgttcagaagacaggtttggcttctagggaacaagaaacaataaaacctatacattggccttttgtttgtttggttgtatgggtttttgagacagggtttctctgtgtagccctggctatcctagaactcactttgtagaccaggttagcctctaacacaagagatctgcctgcctctgcctcctgagtgctgtactaaaggcatgcgccaccacctctagttcagtctttattttgcttttaagatttatttatgctctgtttatttatataataatataagttaatatatgttatatataataaatactaaatatatttatttatttattatgctctatttgcatgtatgcctgcatgacaaaagaggtcatcagatccctttataggtggttggaagtcaccaagtgggtgctgggaatcaaactcagggcctctggaagagcatccagtgttcttaacctctgatccatctctcaagccctcagtccttgtttttaatagttacattttgttctatataattaaatttgtcaggcaatttacacttcaagacatgtgtgttgcccaaggtctctattctacataagatcgtactcggccttaagaatgacaggggcctggagagatgggctcagtggttaagagcactggctgcttttccagaggattcagtttcccagcacccacacagcagctcacaatcttccctaattccagttctagggaatctgatgccttcttctgatagctatgggctgtgcatgaatatggtacacagacacacaggcaaatgacagaagggggtggggtcacatatatatcaaatcagaacactaagaggttaagtctcaggcaaaactgggttactaaatagctttctgtctgcaacacattctaggatcgttgtttattcttgttactataattaacaccctatcatttgtacaaattaatgggtttcactgtgacattaagatccatgtatatgtcaccagaatttttaaactgccactaattatttcaagtacatactgactccttcaaatcgaggtttcaactatattgtgagtactggcaatttcatatatattgaaaaacagacttttcataactactgttatcagattttttaatatagaagttactatacttcaaagggaaaacgtgtagccatattaaaaactattttattggacatcaaggacgatttttattgtacattcgttatcatctttgtaatctttcaaagggcaaagggacggggctttcgcacttttgttcgttcaggtctaactccctgagaacgctggagcagtttcatctgtaaaagatccccttctctagtaatgactgcctttcgcgaggcagtaggattgacaattaacccttttttttttcttgatccaattttaaggaggaagctgttagtgaaatcgttaaaataaaggccatttcattaccatctctccaacccaaaacaatcggggcaggacctgtcactcagtgcctggacagtcatgcaactggacactgtttctctgcaccaggccggacagacagctctaactgtgtccctccctactggctggctgaacgatcttgaggataagaaaagccactcaccagccccctgcgggcacccgtgggcgcgccggaagtgacgtaatcaggcccgccccagcagatt

SEQ ID NO: 185 - DNA, 4793 bp, Mus musculus
actgccctgagaggacctcccaccctcgcgcgcgcggggacccgctagcaccgccgcgcgctgctccatccaacccacgcctgcggctctcctcctcagccgtggggaccgaccctccagtcaagcctcgagctggaatctaagggaaagcgcgcagatactcgttcccttccttcctggccacctgcggggtcttgacacgcatgcccaaggtggcatgtggccctcgactgcaggtgaatctttttcctagtttattttctttttggagtcggtggcccactgtagctcaggctggccttctgcctcagtttcccaagtactgggattacaagggtgagccatcgccctggtttgtgaactgtcggttttgaccagcggtccctgatgtgattagttgcctgtgctggtctctctttgtagtctctcctgcatgaccggctcttccctgagtgccctaggatgccctccccttagaggcagccaccttgctgggaagcgcccctcctctgactgagcagtggcctggaactggtcaggtcaatcttttctctaatgggttttcaattcccagtcctggtcggcctctttggtgatgaggtggggatggggtgcccctccctctgctctgctctgctctccttgactccttcacttccccccatccagggaatccaaggaatgtcaccccccttccgccttccttctctgcccgccattccttccccaccttggggggaggggaggagaagtgggctggcgcgtcggcaggtgagtggctgagggaaagagcaggctgctaggaccgcgggatggaagagagggtcacaggtcaaagtaaggggtcacagatcagtctactccaggatcctcacacgccgaggcagtgtggaacaaaatcccaagaatgctggatgggggctggagaaggagggttctgcctctgttcagagggtagaaactagcctgggatactgctatggatggggggtggtataattgtgggtcatgctgagagagggtcctccccctccagtctctggccagtctgagggtgaccagcgttgagctgccctgtgagccaaggttttacccatcagtcctagtggaaaggcttatgttgtaggttttggcagggctctcaaagctgttttagcattccctgtcacaggaagcaattgtgaaaccaggaaaagtgacctttgcgtggggctccttcatcccctctccaggaagtctttcttcaaccttctcctgtcacataagtccctgcaaatctctggacccccttgtcagctctacacgcccagagatacatctatctcctctgtgtgactcccagccaccgtaaaagtccaggctgtcccacatctcaatcccaccccacagcaggcaagaaagggttgccagatgtatactcaaaggctcagaggctcacacgaaaatgccacccatagctacccaggtacagtggtccactccagagtagacaaatgtatcccagggtgagcaaactgacacgggggtccagagatttgcagggaggtgttcaacagacagaagagggttgaaggaggacttcatgaagaggagatgaaggggcacctgacactcaagaggagtttgggagatcagaacccagcctctctctaagcagccatcacagtacatactggctatcccagctctggcgaggtggaggcaggaggatcattagttcaatcaatcatctttggctgttgttgagttttaggacacctgggtgtggtcgtgggctcctttaatcctatctctcaggaggcagaggcaggtggatctcagtgcttaagaccagcctggtctacagagcaagttccaggacagccaagtctacacagtgaggtactacctctaaaaaatcaaaacaaatgaaccaaaaactcaaccaaatagaaagagttagagaataacctgtgctccatgaggtcctctctcaaaaacaaaaacaaaacaaaacaaaacaaaaatggctggagagacggctcagctgttcagagcacttaaggctcttgcagagtacccaagttcagatcccagtacccatgtcccatcgggtgactcataacagcctataactccatttccaggggatttgattccttctcaaaattgatggcttctgtgagcaccaggcaaacacatggtgaatgcacatacgtataagcaaagactcgtgcatataaaacaaatagacctttaaaaaataaataagtattaaaaacaaaataaaagcaaaacttttaaaacaacccaaaccagagtagccatcaccgggtgccatctccactccccagagggctttcttacacagtgcccaagtgttctctgggactctcctgctcttctgtctctggcctgtgcatctgattactgggtctggagactggcatcagctacttcctttgtgccttcataaagtcagcaggtagctggagtttagttagctggagcttagtggtgcctttaatcccagcacccaggaggcagaggcaggcagaactctgagttctaggccagcctggtcttcagagtgagttcaaggacagccagggctgcacagagaaaccctgtcttgaaatacaccacacacacacacacacacacacacacacacacacacagagtcagcaggccgtggcgctggaggaggtgaaggaggagggccccgtggcaagtgcacagacaaaacacaccatccctggacttgtagaaactagtatcacaatggcatctccctttgtcccctacagttaggccttacaaaacagccagaagaatcctgtgaagatgtgagtcagtccaggccactgttctggtcagaatacgcccacggctccatctccctgaacataaaaaccaatgttctctctgtggtttgaaaggtcctagatataagtcctttccttccctgaccctgccttccctgaccccactttccttctcatctccctcttaagcaacatttttatcaccctggtcgctctgatgacgtgctgtgctagtccatcaaccccagaacctttgcacttcctatccactctgccagggcatctttccactgactggcttcctcctccttcaattctaatctctcctgaggcttgcctcattagagagcttcagacaccagatcctgctcccccaccctgtcccctttatcataggggataaattctgtttgccttgtattgtctggtacagaatctgtaccccaagaggacaggaactccacaagggtcacactggcccaccagtgctaggacagtgactgacttgggagatatttgtgtactgaattaagtcatattctgactctgtcctgctgtctcacttgtatagatcagcagtcacatgtcacttaacaatgggcatccgttcagataagggcgttgctaggcaattgatcctcacgagcatcacgaaagtagatccacaagcaaaatcagctcggacattatcatcaggccatatgattttatgagccagcatcacacatggggtctgtgttgtgtgacacactactctatctcactgtcccttcaataaaaggtagagaaactgcttcgtaactatgtgcatagacttcatactgattatttatttatgtgtacatatgccgtgagcccctccatgcaggttctgggaattgaactctggtcctttggaggagcaacaagtgtcttaaccgctgagccatggtcatcggcactgttgtattgctgtgaagagacaccatgaccaaggcaaactttaagtggaagttcacatggtgaggccccttcatgtggtgctctgctgaggcaagacccgggggaggatgtgtgatgtttggaaagcatacaactaggactccacggtcagtgatggtgcacttacatagctaggcttggaacgcttcgtttgtctcaagtcttcatctttgctgccttcacttcattgagagaggcacaacagagaacgtctcctgttgtcccgaatggccctggttgatgctgctgtcttgtgccgatttggtggaggcctggcggtttcttgctgcagattcctgtttgctatcctgacactactctgctggactgcgggaatcctgacaacagagattggaatcacctgaaagagctacttctaatcaggtccacatccccttgtgctatttaccatcttttctctcctacctttatttgtttttctttcttcttcttcttccattttttgtttgttgacttgtttttttgaagacagggtttctctatatagctttggctgtcctggaactcactctctagaccaggctggcctcgaactcagaaatccacctgcctctgcctcccaagtggtgggaagtggtgggattaaaggagtgggccaccattgccgggcttaattaattcatcatcatcatcaccattatcatcatcatttttttaaaagatttatttatttattatatgtaagtacactgtagctgtcttcagacactccagaagaggtcatcagatttcgttacggtggttgtgagccaccatgtggttgctgggatttgaactcgggaccttcggaagagcagttggcgctcttaaccactgagccatctcgccagccctatcatcatcattattttgaaatggtcttactactatactactatgtgaccttggctggccagaaactcactccatagaccaggctgggttgagtttgcagagattcgcctgcctctctgaatggtgtgattaaaggtatgggttattatt

SEQ ID NO: 186 - DNA, 2742 bp, Mus musculus
ctcgtgccatggtggaccggctaggaagacttgtgaatggcacctcctgggtcttgtgccaagcactctacagacacagatgccagctcctttagtcctcaccattcaggaaacagcagagaagcctgagttctggataaggtcttgaattcggttctctgaagcctcaaattctcaaagtagaacacgagtgggtcctggtgggctgacgttggcgttccacccttcgggtgtgctgggctgtggaaagaatagggaaactgcttcgtgataaaaataaaataaattttattgccttttttattttttaagaattattttatgtgtaaaactgtgcttacggggctgtagagatggctcagcagttaacagcactgactgctcttccagaggtcctgagttcaattcccagcaaccacatggtgactcccaagcatctgtaatgaactggtgacctcttctggtgtgtctgaagacagctacagtgtactcataaataaaataaataatatttttaaaagcctgcctatgtttatatctgtaccctttgtatgagcctgtgcacacagaggtcagaagagagcattgatctggagctagagttcctggtggtggtgaaccaccatgtgagtaggagattgaacctgagtcctcggaagagcaagtgcttacagccaagtctccagccctgaactcctgatcttacaaagttattgtctgggttatttcaagtcctctccaaattctcacttttcttccttaaaagccatcttccctagttgcctgtccttccaaatactacatctcacgtgcttttccttacgaaggctgggggaactagagttctcatgtaataggagccctgggggctatggcaggaggccctccctgagtcttgggaagtggcacctcccgcctgtggcctgccactgttcttgatcctgagtggatcagggtgaatgtggagtgactccttagcattccttcccagacttggagcagtgccgcagcgtctttagtcctggacagttggaagatctgcagcagctatcctctggcctgggccaggaccagcttcccacagtccccacctctgcagatgcccagggatactcaatcatttaaaaggcccttgaggctctggatgtcagagtagctcctcctggtgccactttgcctccagaggcctgcctggtgctgcccactgcacccctccctcttgggaggctaaatccatgctgaggttttgaagggagcccagacagcaggtactgctgtggtgtgtaagactttgatgtctagaaaggtggagcagacgattggcccacatcatctctgcagccacacaagagccttccatcataccagagcctgctggtgctaccatttctcaggcaccaaacctgttagtccgtgctcatccatttgggaattgtaggtctttctcataatgtaattcttgattatttcagcaactgaacacagtggggtaaaggtgtttgagggtcaggggaggggccccagctagtctttgttttataactgccagcccatgactgcatagctgctcccacctctctgcatctctgctcctagagacttgctgcacccatacttcctgattgccacggactgacctggtagggcattgctctcaatgaggagcctcggtggggcttcagctgtccctcttgcctgctgactgtgctcctggcacagattgtcatgtcccagagtatgtgggggtggggtgggacggtgtctctgtcccttcccagtcaacctgatatctttgctggtccaaaatatgccatctatttcaggtgtaattgagaggcagggtgaataaggaaatggccttgagtgttcactggggtcaaggccatgttagtctgaataaaatcctttaccttcgatggcttgaagccagcagttgttcagtcctctgaagcatgtggaactatgcccagtggggattgtgcccctcatttccaagtcatttggtaccactccgtccttagtcctcccgagagcaggggggcagagctgagcggcagcccggagcttggcgggaggaggcaacggaggaggggcaggtggggagatccggctggaggggaggctccgacgtctccttccttcctggttcctgcagtagctgctgcaactgctcagttctgtgaagagctagccggtgactcggagacagtctcaggcacagcagcgtacggatcaagaggctctggcgtccatggatcctggggtaagggggccttgctgtcacggcctgacattcctgggaaggcttcctctcctctggagctggtgggtctactcctctggtaaaggcgctgagaatgggggtggttaaggggggcactcacctgtctcactccacctctccttcctaccggtagatacttcccacctctgcgggggggccagcagcaaatggccagggttctagcggccaggacaagggcatagaaataccccagcaccggaagagttttgaaactttaaatggctgaatgcaggagtttccccttgggccagcctcttgtagcctggtcccttatgctgtgacctcctggccacactcacactgtcccttccctgccccttctgggcctcaactcctcaggtgcttgctagctgcatgaagctctgagctgcttccccagacacagggcaacatcactcctccagtcccttccccttcatacacacacacacacacac

SEQ ID NO: 187 - DNA, 16156 bp, Mus musculus
accgggacttggggagcgagggatgcaacatggtgcatctgggaggcctgctaactggctaacttctccggcgttcctcccggccgaggcgtgggcacagaatagcgcaggtgaggcccagatatggtgtctcgatacggcgcggaaggtaagcgacccccgggccggcgggtcggggaatggtgctgaccttggaggcctcggtccgccacgccgcccttgagcctaaggtcgccgaacgaccgccgccccccacccctccacttccgcctcagcatggccaccctgactcgactacctgcactgcatggttcaccgacctgtgagcccacggatctggctgtgagcccagccttcggcatcacaactcattccttcctccagcgccggtgcatctcgggccattcattccctgcgccttccagcatctgctcctccagcttttgcagatcatggcaggggcgcctgcccagcccccccccccccccccaccaccaccaccaccaccgggatgcggttctccagcttcctctcgctgctcatcccaggtgcaccggtttctgcctctgccttgttctcagacattcggagtcagtatcccaaggcaatgttttcctcgcttctttttcctcgttacttttcctttatatgcagggcacctctcctcacgtgtaggtgctctgttcacacttctgagtgctgttaaaatagcagtccgggtagacagagaggggcacttctctcagtttggaagcactttcttcctggggctggtttggaaagctcagaccatcctgtaagaagttcctttattgtttacaaaacatgtctaggattttactgctttctttcgaccaggtataatgtagaatggtatgtagataaaaatagggacacataatataaaggatttgtaacttttaaggagtatgtaataactcttagtttttgcctggagaatgcgtgttcctcctttgcgtagaataagacataccttaatctagttcctatggagtgcacattagctcagtttaacgttacctcgatgggctttctaaatgtttgagtctgttatctcacactgactgggctttgcccagggaaatactgctagaatctgcccttcctgtgcggcctgtcctggacacttggaaggttacctgaatgaagccctccatccaagaattcagtctactagagtgcactcagcttactgcttagcctagttatttgccatttttcctgaattactcttgttttctttttttgtgtcttttaggtcagtatgtacctcgttttgtatattgtcttgaaactttactcctttgtatggtaattaatgcatatttgttcactttttaaaaggtgggattcaccttaaagattaatttctatgattctcaggtagaaaaatacaaattttcaaagctaatgtgcttaaatatgtaacttcattcctttcatcccaattgaaaactaacattctaaatagtgagaaaaaacttctcaacaaccaatcactgctaataagttccaatgacgacatatacctatagagtcaaacatacacccttcaatagcttttgaagtggaaagatcaaagacttagatatgggtttgaattatgtctctgctggttgtatgactttgagcttttcattcatagtttgaagacatcattttccagttttggagccgactaatgaactagttcttaagtgaaaggcatttaacacgactgtgcatctacaggtactaggtaagtgttttctgtggcatactcttgtagctatgtactaaatagggcctggtatgctagagagaagaatacaatgagaagaagactaatcacgggaaaccttaggtacctgctatctacaagtgaacagatcctgaaggctggtatgattcttagtgttttattagaatataaaagactgtaaatcatagtataaactgggcttggttaatctcagcactagggggcagaggcaggaggatctctgatagtttgaagccaacctgatctacatagtgaggtgcagaccagttagagcttgcatagttagaccccatcacaaataaaaactaaaataaatcataggggaacagaatattgaaaaacaaacaaccaaaaatacttttcacttcttttctagtaagaacagtgtcaactgaaacatcaatgtagatattagtagatttttaaaatttaaatttccttgaacacaacttaagagtatgagaagaatgataattcagaaacaagtagtaggttcctttagtatctcatctccttgtaaaccatgcacagattcaagtcttaagttctagtgttatcttccttagattgttggattagtgccctcactggtgcccttaatttgcttgctggtcctcacataagaataagaatggtcttttgaaaaagaacttggattgcactttttgtgctcagaatcctcgaaacgctctgggttacatacagaattgaatctaagctccttctccctgccaccaggcagccgccaacttaacctaagctttatcccatgactctcactattgggcttcaggatgttacccaggcagatagatgtagtgacttctggttggtggtagttgctcttgtcttcaattgctgttctttacttgtgagaacttctggttcctaaaatagaagcaagtctctcttttcctgttgtttgactcttttgtttggtattaaattacatattttttctttttctcatttgtatttattattagatatacttttcacttgttagttattcccattggactttttggccctctctttctaactacaggtagagatcgcattagatttattcataattttatccctagtacttagaattgtgccttgtacctagtaggctctttgtaaaaattgctaactaaataaatgctgtagttgatttggatatttggtatcttcagtccagattccgcctgctcccatttactgattgcatgaccctggaacggttaatgacttctggtgcttcattttattcagctgtatatgatgactatagtattacctacttcatagcattacaatgagttattgagttaatacatgttaaagaacacaggtctgagtttcccaagctttgtgtagaggtcagatgtctatgtctgatatcttccagttgctcgttaccttaattttgagtcaaaatttttcactgtacctggagcttgctattttggctgcactgattggctcctaggatctgtctcttgtgagacaaagtgttggagttagaaagaaatgtgcagcactgcaccagattttatgtggataagaatctgaacttaggtcctcatgcttgcagagcaggtacttcatttattgagcatcttcctaacacttagaaaacaactacccaaccaacccaaacgtctaaaaattttatttcttctccctctccgttctctttttcctcctcctcctcctcctcctcctcctcctcctcctcctcctcctccttcttcttcttctctctctctctctctctctctctctctctctctctctctctctctctctctctgtcttttttttatgcagggtttttctgtgaaaccctggctttttctgagtagcctatatatcaggctggtttctaagtcatgtgatctgcctaactacttctgtttccagagtgctgggattaaaggtgtgttaccattgcctgtcttctgacaacattttttattgttgtcataagataaaatagaattcatttttatatttgttttgtaagtgaaatattgttgcctaccaaaatttatttatttaactttctaaatagtttctctgtatgtatagaataaaataaaaataaagtgctgagagcgagaaagccaccagagtggctttcctaggttttgctttgatgttctactggaaatacgattgtggtgatgaaagaagttactggggcttcttgtttccagccaggaaaactcaaagatctcagggaagtctgttttttgaagtgttcagggaggagaggtgttttatcatctttagtgtgatggtttctatcatttttgtacaaggagttttccctacatattgtattttggttctcaagttggagtgtaaagcaacctagtaatattctacatacctacctttgctctctttttttaatgttatttttttcctttatcatttatgtaaccaaaaccatatacttgtaataataaaaactttgaggtaatgcatcaagttattcttacaaacttatgattctgcctatggcaattatatttcaacaatactaggtatttttacttaggtttgttcttggcaaaatggctttttgtaattcctttgatatttcagtctcaactttaagccataagtgtctaagccttgtgcctgacacttaaaaatgaacatgaaacactacttgtctttaacttttgttccaaaattaaataataattgataattactatgtatgtgctatgttccaagactctttgttaagtggtttccctttgaatatcaaaagtaccatagaactttggcacactcaacaagaaacagatttgtagagataatagtacttggttgggttacaaggtacaaaaggaacctggattttcatttcctttcctttgattcatgaccaagatcctaactcttttgtgaactacatttaaaaaggacaaagttttgcatttttgctatatatttgtatgtatatgttcctccaaattaatggcagtttttcaatgtagaaataatgaaaattatttcatagaagatgttgtctaattcctggaagctgtagttacgggtgtttgcaggatgctgggatttggattccaggcctcatgattgcaccccaagttcttttaacctgggaagcatttttctagatcccagaactgtagttcataaagtgtttaatatagatttaaacatggacattgtgggagaagaaacacacatgcaagcatgacaggcatgagataaggaaaggtagatgtggagaatcgagctgtgtaaaccaaagacagaagtgagtctgggctgagatgccagatcagctggttgtgtctgtgagaaagctttggaaagatagttgctgttttttcagttttgaaggctgcttctcaggcagccgtgattttgggtccttgaattttctctcaggcccagggaaccccaactgtgttgtgacattggtgaaaccttgtgtcccagctcagggctggggcctaggtttgcttagggtttggggaaggaacctctcagtcagctctctgtagaccccttagactcattacatgtttaaattccaccctgatgcagctttagagtgaagccctagttgtttatactggggaggtgaggggtggattttcatctcagtttagttcggttttaagctggacataaggtgtgccaatttgttgctaaaatttccaaccttagtagcacatataaatgacacacaatctaaatattttaattataagtcataatctagattggattctgggagcctcccagccaggtcgcagggtagtggtggagtcacagggtaggactctggtgatggctttaaagtctgaagggctctttaaagtatttctagctctctaattgtactgaaatgctgatgataacttctaaaaggtcctaaaaactgttttgctctttctgagggtaaaagactgctggcttaggtgattaacacctgtagcttaacagaggaggattaagcaatgcagcctttgttctatctcagcaggaactgttgggcacaaactttcatcctactagtaggaagtcataggaagagaagacacttagagaagtgattacagcatttattactaagttgtaaaaagtttcctatgaaagctatctaaggggaaaagcagaaagattctgggggtcggggggcggaaaaattcttctaagtgggaaaaaggaataaattcttctctctcgatcacactcatctctttgtcctcagtacttatacatctttcagaatacatgatcacatgttacaaagttcatcacaagttcacagaaacaaattaaatcataaattgaaatagaagtttacaacagtgaatatttacaagcatatatgcagagaaagtctggttactatctaagagcaattaactggtgacacttgggagactggcagagttctcatcccagttttactatcataaaggacctaatagcagtcccattattaatgagcttaatgttcactgatataattttagggattcttatagaaacatcataaagacttaagtaatctatttatctatatagaataattacaagacagagatctgctctaaaggtgtgtgctattagtgattgtttatatatatatatatatatatatatatatatatatatatatatatatatatgtatatatacacacacacatatgtttaataataacaggaaaagcatattaatagcaggaatcttgtagcctcccctccccagcctgaaacctgtttgttcaggtttcagtattagagagcatgggacagagcttgccaccctatcgtcctgccactcccactgcctgccttctagctgttccggagccatcatgtgctcacctgcaaccttactccaagatgatttggcgggaatcgggccccttccccgcctttataactgagtgttagaaatagtaaaattgagctttgatcagaattttgtcttagctacatctttcttgcccacctagctccctcttctcttccaggtttccaagatgcctttccagactaaaacccacacatgtgagccgctggccggacaaacatctggcacctaacgtggggctgaaaaacagcagaggacatttggaagaaacactgctggtttggagctccatagaagaagaaaataattaaaggaaattcataccagagaaggtcagtatgggctaagctgaaacagcgtttaacctgagcgctaattcgcttaggttcagcagtgaggcatctcaggagctaggaacgtaacaggcggttagccatagctcccagaagctacatttttaggcgtgagaaaagaaagggtttattaaaaggaaattaataataaggcggactgcatcatgcgggaggaaaatgtcccaaaaagcagagagaaatttccggagtgccatgctttgttctctctgggctttacagcagaaatactctgccccttttgtgtcttgtctaatgtctggtgcactgaaagacccacaacatgaggactcccccacgttctgactcaggagaggcgacaccccaaaccactcacaagaaacggtcttgctgcaaactgcaagaggatttttattcaagagcgctctcaggcccacggtcatacaccacacaggggtagaggactttcgcgtcctgagttgctgggaaagggggtatttaaaggaagaaaccacaactcaaggaagtggggagggcgttgttggaaaatacaaagataccagttaagagtcccaaggaagtgcaaactcacaagagtcacaaggaatacctggaaattttgcaggttatctctcaagacagtttctaagaggccctaacaatagcacatttgcatagtgggttccgccaatggtcagggtgactttctttgaatgaacactctttgaacccaggaagcaggtgggtagaggaatgtcactatctgttttatgattagcataccttggagcattaagtcacagaggtcacattcccaagcctgggcctaaaggcctagaattttgtttttatgttatactttcagcaccaatctgttcacatgttcaattcatgtatgtttgtgtccagtctgtatgaatgaatgttctatgttttatgttggataataaagatggcaaaaaaaataaaaaactttatctgcaaagccgagagctgccacgtgctacaaccaggaaacagacacatggcaggagggcccctgctgaaaaaactgttataggaaaaaagggcgagtctacagcctctcagtttcggggtaaaaaaagctgatgaatgtttttttcctggagggttctctacaatcgtgattaatatgtttggcaaatgataaagtgctttttattccatgattgtagctagaaaaattaatattctctgattggtctaaatgtaactgcttcatttggtttttttattggtaatgtgctctgcgtgttttcactatcaggtcataagttatgggttaagattaataattgttacattgctacagatggttagtcttaaaattgataactcaagtttaatgtctttccaacacatggcataaggcaggccgagaggctgggtctctaaagatatttctagttaagataataattaatgtggttcctatcctagaaagtagaatttaagataagagttaaagcaatgtctctttattaaagcattaaagcttacatgtattcataggtattaattggcagccaggcttcgtaatatgatagaaatgcttctaatattaattctatgagtaataaattgttttaaaattaggctttactttcccaaagttaatgttgcaaaagaaacttaataattctttacagatctagccagatgctgttttaatgaagttcaagttcatagtttgtaaagagtcaatcagaccgtaaaatttatcaaggcattacagtctggtttgcctaccttttatatagttattttaaatccgaaggtttgtttctttttctctctcctttgcatcttaatgattgtaaaggtttggcctctagtgagtttgtaataacctaaatattttgcctctaatatggctaaatattgatctacattatgtaaaaattttttatcatttctgcttctatacaagaagccaaaattttttaatctttcaatgtatattttttcctaagtgaaaaatgttttattaactaatgcttctcaagggaagtttactttaaatctttgctctcacccaaaagattcagagacaatatccttttattacttagggttttagtttactacaaaaggttttacaaaaaataaagaaagcttttatagttgttgttaactatattcattggcaattaaatattagctgtgcccaagacaattccttggccagaaaaaacattgtaaagtcatttttctgatccttccagccgatccttggcccatgtgagcccagctagctgctggctgctgtggggcggggccttgagacacacagtttccccctgtttcagcacaaataatctagttgtgtgctgtagatggtgttttaaaatactgaacaatcaatccttaatttgtatattgatagtcaatgctatatctcagagctcacaattgcttaagattgtccgtccctcagatactattaattctcaaatttgcaattgcttatgcatatataactcatagaaaaaaatgctgtccttttaagaagacggtttttagacatttattaaattgtcctaattgcctggacattttaaaacaatgccaggataaatttatatctcagacagtctatagatcgtccatataaaatagattggatatataaccttgttctttatatattcataacagttatggtttaagataatgttttagtattcttaaaaattgtgcatgtataattctttctttttagtgtcctcagttattacttgtttccacataatagtgttaattcttgaggacttttacttaataatttgcgacaaataaatgctcttatttctagttaataaattatgcacatgtgactcttaataacttttcaagctttctagttacaaccgatccttaagaaaaatgatttcccccaagccaaggttaaagcccactcatctacggatgagaaaatcatttgatcacctcagttaagtgtggccttattatacttaattaatagggggggagagaggttggagaccgtactgttagaagggcaagcccttcacagcctcccaccctaaaaagccaattggccttgtactaaggacctggtcgtcatcccctcctccctgcctgtcatccaagaatgcagaggaatatccacttactctccttcaatgttattcataatatagtgcctttccgccctgtagctgactacttaaaattcaactaggaagttacctattcagtactaattagcattataaagtcagagcctatagctcagggctaatctgctacttgtttattaggacagaaaggacagtcttatccagatacagtataccataagaaaaattaagaaatcccactgagacaagtttcttcattaggccctaaaatttaggcagaactatagagcataaataaattttatgcctcagcccagccttttcttttttatattaacaacagggaggagatgtaacctcccctccacagcctgaaacctgtttgctcaggtttcagtattagagagcatggggcagagcttgccaccctatcgtcctgccactcccactgcctgccttctagctgttccggagccatcacgtgttcacctgtaaccttactccaagatgatttggcgggaatcgggccccttcccctcctttataactgagtgtcagaaatagtaaaattgagctttgatcagaagtttgtcttagctacatctttctctcgcctgcctagctccctcttctcttccaggtttccaagatgcctttccagactaaaacccagacatgtgagccgctggccggacacaacaggatcttttctaaaatgaatccctacagccttgattaataaggacgcacctgccacagattatataataatctgaagcaggccgtttcagaatgatcacctgctagttattagcttgtcccattatggctcctgacaattgggcaaatctaatacactactaacttatttcccaacactatgactccttattacttatggtttctcctggacacgaggttctggtccatatggcttcctcctcccctcttctttctttctgttttttcctctaccagccacccccttttgagcctctggtccaacctttcccctccagtacccaatcctaggctctaactttttattgaccaattaaaatagaaagaaggttcacatggcatcacctaagtacatgatggcctgcgtgtggggtctgacttttaatacaaatctaaataatgttagttatttaaatgtgtgtcttactatatttcttttgtttttgttttttgagacagggtttctctgtgtagccctggctttcctggaactcactctgtagaccaggctggcctccaactcagaaaaccgcctgtctctgcctcccaagtgctgggattaaaggcatgcgccacctctccccggcttcttactatatttcttacacagctgttttccaaatgtgcatttatctagtctgctgtagaagcatagaatatgtattgttaatggtgtatttcttgccagtcatccttttttttttttttttttttgtagaccaggctaccctcgaaatcacagatctccctgcccttaaatatatttaagtggatcttcgcttcctcctctatcctttatcctaacaggcaggcttcctctgatttgggactaaataggctttctttttattgtttccagtttgtgttctttcacgtgagttgggtgtgctcagaattggctgtcatactgcatgaaagattcagccagagtctgagaaatgggtggggattttgttcaattgtttttgcatatatcttgtatgatttttctatgtagtcaaaccatcattaccaagaagtcaagtttgcactaggatgaggaccttaagacaatatctggtagggccgtagtctgaccctcagtctggagttggaagtgtagttagactaacgctgtagacagacatttgaaagagtgaattactaatgtaatccagttttggatattgttactcatatatctctatgaagataaatgaattgttttactaatgtcacttaaacaaattttgtacttgttaatattacttaaaaaaacatgtagagtagacaggatgtgaatctagtataccatttgccatagaaactgcatttgtatgcctgtgtccatatatttgactttggatatttatagcatctaaatacatattttttgcattaattgttcaagtactgtcatttttcttgtaaaaaattttactgagctaatactgcatacttgattcttacatcataccatccggaatagtagtaggctagctggtttgtggctgaatacaggacttcaattctatatgttcgggtattgggtttaatgtcttagaaaatggcttatataaaaagcaaatttagaaccagaagcagagactcgaggaaaatgtattgttcattttatgaatatatatatattcatatatatattcgtatatgaatatatattattcacatattatctaaatgaccactcctatgttagagatgataggttctaattaatcttgtagagaaagttaaagagcaccagtggatatgcctgtgtatgcttgtaatttcagtaattgataaatgtcagtagaagggcatttaagaagtaggcaatttagaccctatttttaaaaaagatgaaaaacaagaaaagaaaaaaaaatgttcatgtctttagtttgggcaagaattatcctttgttcaaacaaatatgcttatggtttaactttctaatacttagtggggaaatagtaagtaacaaggagaatttgtattttaagattttaagttagatatatgagcttcaattcttttttctttattggatatttgctttatttacatttcaaataattatcccctttcccggttcgcccgcacctccacccctggcaaccccctatcccatcctccagttccccacttgtatgagggtgtttctccacccacccactcactcccacctcgctgccctcagttccccttcactggggcttttatcaagccttcacaggaccaaggacctcttggacggatggccctaaataaaacaggagcctagtgtgaggctgagtgccacggaaactcaggccagacagaggaaagcagagagctggccagagctgcatgggcatttcttgaaaagcagtgtttgctgttccagtctcccatttgatgctgtgtgccccaacatttcaaagaggctagatttcattggtctacaacttcataaagtctcaacaatgatctgtttatccaaggacatgaatagtaaaacttacgtaaacacaacttgactataacaaatactcaaagcattaaagtggctctgtaattttgtataaaatacaactgtgtttaaaaatatgattttgtaccaatttgtacactgctgaatacatgaatgtttggatgtggtgtgcgtgcatgtacacacacacacacacacacacacacacacacactagcgctcatatgcacaccccagagaaggaaaaggaaagctgaaatacaggatgtgagtagtggaggagcaaggaaagtgttgctttctatgttctgtgtgtgcatatgcatgtctgtgggcacatgtacatgtatgagcgtacatttaagtaggggccagaggtcatcattcttaggagtcatctttctttatttttatatagggtctcatgctaagacgtcaagctcaccaatgaggctagaatagctggccagagagtctcacagatcacttagtcctgatatttcaagcatatgccaccatacctggcatttcatataggttcttgggaattgaagtcaggccctcttgcgtgtggggctagcactttactggttgagccatctaaccagctcctgtttcacttttttcttcattctcctagaacaccccagtgatggctattcttggtcataaacttcactacatatggaaatactaaaacccaatccattggggtccaaaccaatggagggatcgttcttgattggatcattcaagatggaaagacccaccttaaatctggatcatttgacctggatcagaagatccactctaaatatgggccacaccttctagagacaatgtatataaaagaacagagaaaaaagcccttgtttttgcctgcttcccttcactctgactgacaaattcacccattctgctgctgaggcattccttcactggtattagaagccacttcttcaggattccaatgtagactgaagaccagctgagacatccagccccatggatcaaacaattattggattcttggactatcgtatcagactagacagactagagactttaagcctctctaataaattgtacatacagagatagagatagatagatagatagatagatagatagatagatagatagatagagtgtgcattcgtgtgtgtgtgtgtgtgtgtgtgtgtgtgtgtgtgtgttgtcattgctcttattacccaggacttgatggtaaaatggtaagacactattgctgaagacaccacatacatagacatggagaaacaagttggttcttgcctaaagttttcatccctactgtctagttttcatggtgctaaagaataatagaaaccaggcttactcagttgtggatgctgtaagttgcattagcaaccagtctggcaatacatacccaccaatgtaatgatggcatgaatgtcatggcagtgaccaaccagtttctgtttagacttaaagcctgctccaaaagagggaatccatatctgatactattactgagaccactataaggaactatctctataaggatatagtattttctagactcaacaagacagtcgcaaatataaactcacagatttattatgacatgacaaaagcctataaaatcccaagctagataaactctcagaatggagaggggaggtgggcaaaaaattccatccctacctgaggtgcttctggtagttgatggtgcctgttagattgagtttgtttcatttaaggatatggcccctggtaggtcaatcattgtcttaaggttgctattgtgataaaacaccaggaaaaaagcagattgtggagggaagggtttgtttcaggttatatgtctcaatcacaatccatcatgaaaggaagtgagggcaggagttcaaggcaggaacctggaagcaggaactgaggcaaaggctatgaaagaacactgtttactggcttgttccacatgacttaaccagtatactttcctataccattcaagatcacctgcccagggtgagaactggctctctgtgggctagccacatcactcaataaaatgccccatgagcctgcccacaggctgttgtgtggcaatgggttggggattattgattgatattccttcttcaatgacatgtgccaagttgacataaaatacccatagaaagagttacagagagaaaattcagagctgagatggaaggaaggaccatccagaaactgccccacttggggatccatcccataaacaaccaccaaacccagacactattgcatatgccagcaagattttgctgacaggagcctgatatagctgtctcttgtgagtctatgccagtgcctggcaaatacagaagtgaatgcccacagtcatatatggaacacaaggccaacaataaaggagctagagaaagtacccaaggagttaaagggttctgcaaccctataggaggaacaacaatatgaactaaccagtaccaccaccaccccagagcttgtgtctctagctgcatacgcagcagatgatggcttagtaggacatcaatgggaggagaggcccttggtcttgtgaagatcatatgccccagtacaggagaaggccagggccaggaagcaggagtaggtggattggggaccagggtggggggacagtatagggaactttcaggatagcacttgaaatgtaaatgaaaatatctactaaaaaaaaatagctagcagaaccccaggacactcaacgaagttgaaagtcgtttttgttttttggttttagttttttccaacggttaaaagtaccctacatgctttcaaagtaagtcattgtattttgccatttttaaatgtcagcatttgctac

SEQ ID NO: 188 - DNA, 262776 bp, Mus musculus
tcgagttccgcgcgattggattggggcaggcactgtgatccactcatcagaggtcttagggtcccgtggggagacccgtgtgggcccttgcgggtgttgggcaagactctgctggcaaggtagcccggggctcgagtctcgagtcgagcggaagggcgaggaataattttcatgtgtctttcagagtaataaggtaagactgtaaggaaattgaagttttgtgactgaattgtgcattttacttttcttcttgaggagcttgactctagagtttcagattgaaccactattctatattgcctattataacattaatattaaaactaatattcttttgtttatgctaaagtttcctattttgtctgtgttttttattcatacctgcaatagctatctgacctgtcattcataagtaataataaagatcataaaacactattgagattcttcatgtgctaagggagatatttcacaaccactatctttattggaacatcatttgaagattatctatagagaacacctaagtgaattttgggtaatgtttatatctgtgtctgggagagtatcctaattcctagtaaatagacttttagtttcttgctcagctggcaggcatctccagtctttctcttgcactttgaactaacatggatgggaagtttgtgaatcacttggcatttttccttttattgaaaatggattattttctcaaatattatctcctaaatacagtcccacccccacttccattcctcttagtttttcccaacctcccttaccctaaacatccatttcttttatttttctcataaaaaataataggcttctaagagataatagtaaaatatgacaaaataaaatgagataaaacaataatgtcacatcaaagttcaacaagaaaaaaatcaacgaaaggataaaacccccaggaaagacacaataattccagttattcatgctcttagacatggaagccataatatatacaaagagaccctagtgccaacccatgcaggctctgtgtatggctgcttcagtctctgtgagttcatatgaatttaactcatgtttatttagaggtccttggtttcttagtgtcctccatcctgtgactcttatactctttcccctcttttggtggtgtgaacatgcttggcccatagaatttcactattacaggaccaagggcctctccttccattgatgcccaacaaggccatcctctgctatatatgtggctggagtcatgggttgctgcatgtgtactccttggttggtggtttagtccctgggagttctgggtatgtctgattggttgattattattgttttttctatgtggttgcaatccccttcagttccttcagtcctttctctaactcctccattgggagcctgtgctcagttcagtgtaagtgaaggcggggggatgagggggagggggggagtggatagatgggttggggagctctctcatagaaacaagggggggtctctggagagggaaggggatatcatttgaaatgtgaataaaatatctaataaaaataaataaataaatacataattttaaaacaaacaaacaaaacagaattgcactattagaaggtgtggccttgttggaacagatatgacctttttggaggaagtgtgtcactgtgggggtggtctttgagaccttcctcctagctgcctagcaaacaatcttctcctggttgctttgatccaaatgtagaattctcagctccttgccaggcactgtgtctgcctgaatactgtgatgcttcccgcgtccacaataatgacccgaacctctgaacctgtgagccagccccaattaaatgttgtactttctaagagttgcattggtcatggtgtctctttatagcaatggaaactctgattgtaaacttcatttctctttgatgtaagaggagggatttaataaagtcagtttagattgagcacctctctctctctcattgtgtgtgtgtgtgtgtgtgtgtgtgtgcgtgtgcgtgtgcgtgtgcgtgtgcgtgtgcgtgtgcgtgtgtgtgtgaaatgttggtctgtgggtctctgtatttgttccctactatggaggatggctctctgagaatggctggcaaggcacagatgtttaagtgtagcagaataccattaggagtagataaaaaatacttggtttcatcttagtccctgggctatccagtctgattcttagttttccaagcaatgtcagatatgggggccatcttctagagtatatattaactcagtcatttactggtaagtacttccatatgttttatgacaccattgccatagaatatcttgcagacaggacaactttgtaggtctaagggcctggagttcctccagtgtttgtgtttctctttggtcaagggttctcagctgtaggttacaagccctttagggatgaacatgcctttcacaggggttatctaagatcattggaaaacattgctgtttacatcacactatgataatagtagcaaaatagcaattatggaatagcaacaaaaataattttatggtggagtgtcaccacatcatgaagagccaaattaaagggtcacagcattaggaaggttgagaacttttgattttcctgacatgcagagtactgtcttataaaaaagatacttaatttttaattactttttgcaacctaccctaagccacttgaagctataagctacaagttaaataacgtgaccatttctaggttaatggtagctaagacttaaactgctaaggtgtcagcacacaattaatctctaacttcttactgtctaaaatttgagaatatttagaggttacatttccaaccggtacaactttgttctgccacttcaataaagtactaggaaatacaccttcccactaagatttatgaatatctaacaggaaaattcaactttgtacatgtagttgtaactcatatacaaattctaaatgtaaaagcagttcataccttacctttttaggtctcattgaaaagataactctgttttgtcttttattatcaaaagttaatcaagtttgtaaagaaaacatgtttctcttcaactgtgtaagatgacatttaaaaagataattacattaaatattcattaatgattaaaaatgaaagattttatagattataatggcagtgagaattactaaaaccacaatatttgatgtaaaattgcctgtctccttttcctttacctattattttagaatttagaattttataattattttctttgtctattaatttagatttttcttacctatcattttagaattctattagaattacctattaatttagaatttaatttagaatttttagaatttctttaactgttattttagaattacctatttaatttagaattttagagttaataggtaaataatacatacctattcaaaatttaataaggtaaatggaatttacctattaattttagaattacctattaattttagaattttagaatatttaaaattcataaatgtgatatattttggtgatattcactccctaatctgcaactactctcagactcctctgccatgtccctcctattttcatgttctctcagactactgatactgctcagtattgtacatatggacatgtggacatggatgcaagaacaatccctggaacatgagcagcaggtcagtgagtacttcctggaagaacactgattcatctgacttcagaggccttcagttctcaaggatcatcaggttggtgtggagcttcataagtaatttcctcatctatgctagaattgaggctggtttgatcttgtgcagaaaagcacacatgcttgagctgatgagagcaatagtcctgtcctatctagaagatatggcttggcagaatttccccagtctctggatcctatccattcttcttcatcattccaaagccatatatgcctccaatctttctgcaaatatgacatgcaatgttatgatgcatgtatgagtcacaaatttcttgtcttctaaactttctatggcgattaagtgaaatatctcatatttttttacagaactagtaaagcaggaaatctacaataaatggctaactcttattatcatttttatttaattcaatgggttgagataatttaatcagcttttaaaaatggcatcctagtttctgtttttttttttttttttttttttttttttttgagcacagtaagtttttaggaagagtttaatattctaacaacaaaaaaaaaaaaaaaaaggcgtagacagaatcccagctctctgacccagttaaggtgctcagaaacttgttcacaaaaaattcctccattctttccaggggtcagaaatagaaaacagtttgctggaggcaaattaaaaggggggccacaagaagtactttttctctattaatatacctattgaaatacttttctcatccttcacttatgtatccatcctttgataatttccttctactaaatttagcatataatttgtatttaaactacactgttatctcattaaaagagaaatattaatagtactaaaagattgttaaactttcagtattcttgtaagtcatgctcagtttttaatgtagattttccacctaacattaccaaataatgtatgtgcacatataattattattaaaatatcactctgtatctgtgagtctttccatcagaaaatatagatctcagatatactacatttttcactaatatcaacaataaatctaacaataactgtataaaaatgaacttgatgaaaatttatggctatttagattggagagatcttacagatatctttttggaaacaaattgctgatctcaagtgtttagaacactttggaaatcacagacaaaattatgatcataatacttttaccatttgataattatttagaatttgctccattgccaagatcataattataaatgattcataccctgaacaaaatattttatttagtgttcttagtttccatggtcctgttggctgagccatgacaagaataattacatatcacatgaaaatacatataataaaaatactaactctggatcagaatatactaaggcatatgatatagaattcttaatttggaaagacagctgtgcttacagtttatctaacaaatgaatgtggaagttatgttacccagattcaataagctattatcaactttaatcgtaagaaattggaagtgcagaaaattcagaaagtatttgtctttgaagatctttgacttttctgcaatgaaataaaaatgtgcttcataactgacagatatagttgacattccaaatgcttgctataagagcctttgtggagaaagctacccatgaatatgcttctcaggtaataagaagacggagtacttgcattaaattgaaagaaaaggtcaggctatgacagcagaaagagagagcatccaaaagtgggaagtcaaactgaatgcacagcaggaaagcactgctgacattttatttacttattttagtgtcaatctacaaagcttcatccagtccaaattatagccaggcatggtcttttatgctaatagttgaactatgcatgagagattgctcttagtcccgtgatccataaggtggaaatatccataaggtggaactcactgtcagtaggagttagaggatgagggcagtaagccacaagttgggatgagttcaaaatcaaacatggtgaggaaatgaactgggcagaaaaactagttcagaagaatcaaggaagggggacaaggcaaaaaaaatgtaaatcctgaaagagagaggaagctatatagaaaaggaaggtaaatgcagacacagcatgaacattagagcactaacatgaccagagatgtcagttggagtggagcaagggggcatgaagagagaggaagcgcttcaaaagcaatagaaaatgctttatgtctttagttatgtatgccctctgcatgaccatgaaagttacttatataccattttggaagaagatttacaaaatgaactagttgggtttctctgccaaaaattgtctaccaggagctatgagtagtatggacacataattgcagcaccgtgagaatatagagtaactctgcattaacctgagtggatcagagataaaacacaatctgaaggtttagtgtatgttaatttttaaagatcgctaaatatcaatctcagtttctccattttatttagtaatatactgatgatgtgcagaaatacacaatcatatacagaggaaactgaagaggcagcatggagaggttcagaaagggcatggccagggctcagggagcgcttcacagataacttatcacagggaccctccagaccttgaactgcatctggctcctcaggcaacctcattactatcaacacagcactccctgttccttgaaaagaaagaaagatgagtctttgtggaggtctggaacacagccagactgttgatgtgaaaagccactctgccattaatcttttggattgggcatgagcagagaatggatgttttcagagcccatggaatgctactctgaagacagctggaaacacacacacacacacacaaaaggaaagtcatttgtgtcagtcactggcatccactgagaagaacccagctataaaattctggaagatgatggcatccaaggtcaagtcttagatagaggatctagaagagggcaggccataggtgcagcatacagaagatgatacctcaaagataaggaccataaaaaacacaatttgcagaagcatacctgtttcacaaatgacaattacattttgagaacaatggcttcacccacttcttttgtttccctacacagtgacatacatgatgaaagtcaacgaatttgtttgaaattttttagttttgtacctcttccaagctagaaggtcagtaatcctacctggcccaggaagaagagtccaggcctcatatgacaatagtttccctgatgtttctcctaagtttattaatacaacatattgaagcaaatgcttttaagaattaatatcagatttcccatatatcaggaggcctcagtcacattaaactcttagtaattctcaattaataatatttcatcattctgtagtttgaaataactcatgcagcactagagatgggaaacagtttgaacattatactgtttacattctaaagagggaaaaaaagaaaaaaaagaatcagtattgaataggcaggctctctggaagatatacattacccttgaatggtatgtttttcctattttatattttgaggaaaggaaaataacaaagaaataaggtaacttgacccaaagctttctaaatagttggatttaaactatggcttagctgcctttaaaattaatttttgaaatttcttgagattttaattgtaatattttccactactcccttgcctctttccaaacccacccatatacctccccttgttctctttcaaattcattgcttctttctttatttaggaatatatctatatgtggctatataaatacatacatacaacatgataatgtggacagtgggaatctcagaaggcctctatcttacacagggaactagaggcaacaaaggaattctgagagcaagggaaaccttcttctggaaagagtctcctgattgattatttttaaagatctttcttttccctttgtccttccttttctgctcttcttttatctttctgactttctctttgttttttctttctttctctttccttctttcactttatataagccaatagataacaatatgacattatttcacaagagtcttctttgtaatggtcacaatattgtctggttgaaacaataatttgtttctatcctcaaataacagtttcagatgcagaaagtgaataaacaactagaatgaattctgataaggactatggtaatttaagaccaaggtttctctccaaaagagaagagaaacttcaaagaggatgctatctttctaagattctaaagatgattaagagatactgagaatatacaagatagattggattgggagggcaagcagcatagatgaaattctcctcaccagggaaataccaacttaagtgtgtagcctgatgccctatatgcacattccttgaaaatgtatctatttcacctggcttccagaaataaagacaagtctcagctgagagtatttttaaattcaactaatctgctttttttgtgagtaagctgtaactatcctataaaactacccaacatgtgcagatagagctaacaacctcttgcaaacacaagaaatgttgtagaaccaactcagctttagagaagatagctgaagcctctattgagattgtgttccactcggtgtttgcccctggctgaccctattccttttcttccatctccatgtgtatgaatcccaagagtttccctgaacaagtctcctgggtttcagtttctataccaatcctcactggattataggattatcagctactggtatggtggttttataaatggttaaatgattctgatgttggaagtagactaaatatacacagatgaagtaaaataactatataataaatagggccaggcaagtgattagggttctggccttcaagcatgttgcctcttaaagagcagggcttcagagcagctgatttcaggaaagagttttgaaacctgaataaaatctttcagtcatctttatcacacttccttatcaggaatagttgttatggaggacactgccttagagttgattgctaactctatccacctgtgaattcagtgagaataggtgtctgtattgtatactactccagtccggtgactaatgtggagaaaactcctaaagaacacattttggaaaccttagtcttataagggctggcaaatcttctcaactttgtcttaatatgaaacatgagttttattattctgggctgagattcagagattacacaaatttctattttccagagctattattcatataaatgtcttcaaaaacaccacctaggacaaagggtgaataatattcttcatactctctgcaaaggtctacaaaatattagaactttataataggaagaatagaaaagtaaatatattatttaaaaataacttatgtttttctattgcttaaattttcttctttgtgctataaaaaagacttggacactgtaagaaaaaaatgagcatgagtccaaaaagaaaatataaatagattttaaaatatctgaatccaaccatccttagtaagctattccaatataatgaattcctactgtgttccaggaatttttaggaactacctaatttaatacaataatcacaggacatgaaatgccatggtctgtatacttaaaataatcaattaggggtcagagatatagctttgtgggtaagagtccttattgtataagcatggggacatgagtttgaatttccagtctctgtgtaaatagtgggtaatgattatgtgtgcctgcaacctcagcactggtgagagacaggagtatcctagaagctcatttgctaggcagtctagtagaaatagctcagcagcagtctgtgtctcatggcaataaggcacagggcaacagaggaagcacccccatccccagtttcttctggcatctacatgcatgcacacacatacctgcacagttatcagcattaaccacacatacacaggcacacacaagcacacacacagagtgatataaagatttgtatcattgctatgatataaatctttatttcaaggtttccaattttttctctcctcaaagggcaagataaaagactcactcctaccatatagagataagtcactgtggaggtaacagaaacctaatgactgcttgtcttgaccaatctcttcacttctactctacaaagcatatcagaatatgagtggttaaatgcaactttcttctgaagatcatttgatacactttaattaaattgcttacaagctacttattttagaagtagcaaattatcatcgacacatattaaaactgaatatattatatgagttgagttgtaacctcataattaaggttctccccctgtgagaaaattgctataaaatataataacataaatccataactaggtagctacacatgtaagcatgtgtcaatatcacagctgtcagatgagccatgtatatgactaagcttagatttgattgtgacaatgaacacagggtgaataacaaaatcttaaagataaaaattccctctgatgtaagtgcaaccatgtcaggtgatctttctccacttgtcactgctcctgacaaagaaatagaccaaattctgatgaagaggaaacatcacatggcctcagatatagaagaaccctaaaaaggtaatactccagtcttgaggaatggtaaatcaacagaagtacagaaaagatggaagatgactaaaagactcagaaaacagccatgccttgttaatccccacggacactagctaaatgtgagtgagaccctaggatgcagaggtagacatgtagcaggatcatttctgggggttgacatttgaatgacaggtatgtagaaaatatgtccttgtttgtatagttaatacactttaaagaatgccatactgggatgggaatcatgttggtaattggttcctgaattgctcaggaagaaaatgaatcttgtagtctacttgtaactgtgttatacatttgaagtggtccctaaaagtaagtaactgaatatataaataggtgttggagatgtcttcaacaattaagaactataagcagaatagtaaatgacaccccagacacagaaccatgctgtctccaagttcaaggtcctccatgattataaattgtagtggttgccttccaagagtcttctaaccttctcccactcaattttgtccatcaagttgacagactttgtaagtaaagtggacttcctgttgttgatgtacttctcatctgtctagggcaatatcacagctctaggaaactacttcacaatataattgatttaaaatgtaaggtatgcaaaaatgtaaaaattaatagatgtttaaataaacattattttatcaacctcattagctgccacagctaatatttacaaaattttcactgcatttgaaagcaatttacaggttcaatttctcacagtcaaagatttctcaggcttgtgaataattgcttaaaaaaatcagtcaagtgtggatgaaatgagtttctcattttgaaagtgaaataacaaagtttttttcaaatgttcaaagaaggtaaatatgtccttcagattggtcctgcattttagtggcttttctatgccactatgcaaggctttcaaaaggatttgaggtacatttctccaatgcaaatggaagagtttgatataagttaggcagagaacttggatctttgttaaaaagagaaaaatgaaacaaggtagcaaaatgaaatatttgaacttttaccaatggacattctgtctctttaagaggattaatttcaaagttgttcaggaggcctgaagaagaagaagaagaaacatgagaaagctgtatatgtaaccagtagcaacccttcatttaaaccaacagtgaaggatatttggtatgatatgagctgtcagtgatcttgttcactgtatgatggtttcagaatgattctgcttcatgctggtgttctgtgagcatcttttataacaaccggaaaggaacatggcttacctgagatcatcagccttgcctgtgaaatctctagacctactgtagagttttaagacaaattcccagatggtaagagctgctttctagtgttccaatattctggacagggtgtttctgtctcagcagaaaagacacacacttcagcttcttatggcttttccgttcataccttgacttctgttaccatatagggaaaacctggaatccaatatattaggacacaaaatctatggggaatagctgcacgtgaggatttgcttcccttctattctgttatttctcacagtctacttcacatgcccaaatcggagacccgtggaccaaagaagactattataaatgtgatacttgaccttcaaaagtcctctcctttgtcccactcatttttgtaatcaagctgacctttccaccaaatgtcctaatgtctcatccttagagagtgatttttgatgatagctgctccttactctctgtagatcaggagagcacaattctgcttccttgtagaataaagagcatctgcaattaaatatcttgatatattccttatttaattacttcctttatcttcagttagctccttaagttcttcaaggatatttactgaatatcttctcctcagtgtggaatcaacagtgcttagcacagtacttaacacagccacagaaatacacatatggaaaaacatgaatgaaccaagaaacaaactacaccttatgggcttatgcaaatccaaagaaaattactttggggatggatagaagctataagcctctcattaaaaataattttgttatgataatgtgtgtgagtttatattgtaatgctttagaatgactggatttgggagtaacatctgaagccttgtgggctcttgagataagagtgatgtctatagatatttgtcctacaaatgggagcaagttttcagccctctcccctgtacaggaagacttatcaaaggtttgctgtctatgtgcacagcatgacagctgcatctatagagacctccttattaagatgctgtctccctgctaataagaaaaatgatgactcagaatacttgtggagctttgagcccttaagatgaataccaaattccttctctctgttagaatgcaggagacttgcattatagaacagtcctttttttctaggacatctgctgtctctttcagtaaagcagtagaagaagctaagagataatgaaaatagaaaaggcacaaaagctttgagaatgtggatgtgtgactggccagtggatatctaatttttaaaattaatattataatatgtaatttgtggggcagatcttaaaataacattcctatcaaataatacatggaagccactagatatgaattatttgtatgtgagtaaagtagaaacaaattgaaaagtctcagataaagaatgactctaggtcatttttgttaataggtgagaatcagatctcagtaggtggtgttggcatatcttattgcttaaaagggcaaaacctgttttctttcttaaacttggctgaggcaattacagacatgccaaacatttgggtttgcccattgaatctgtcttatctcttaagtttctactggagaataatatgtgtctacaatcctttgtccatggtgacatgtgctactttcttatatggcttattttaatttcatagtctaatagctggactaaaaaggctgtttcttttaatgctaccccagttaaggtctctttccatcactgatttcactttttttcaccgtccgctgcttatatttaccgtataataggtatcatatattattgttattattattagatattttctggtaatctggaaggatcataaatgaggagctacatatatttacccactccactttatttttcatattgatgaaattcaatcattgcccagcataagttttcacaactattaaagaattggctatttgtttaaatgatctatttattcatgaatattaactaacgactggatatttaactgagtctgttttgattaatcttattagacaaatgaaaaacagggttaaaggcagtacaaaattttgtcatactctctcatctatcaaggaagagaacacaattggaaccaaagacatttcctgacagatctttattttaagtgaattttgtgtaccttttcccagtactcttagaagaaaatgtcaaagaataagaagtggacatttcttgacgctgtcttcgtacctttctgcattatttcacttttcacatccaacaatacagtgaggaaggggttagtattgcccattcctctgtctacatttttcaataccaggcaagtatcacattttccagtggtgttgcaaaatattctctcgctaatgttctgtttctcatttcatgagtggtgggttggagactcattatcactagcttcttgtgttaaacaggtgattctaagacatgattaggctcaaaatgtttcccttatgtgacaatagaagctattagaagttaaatcatccagagttagatggataagtggccaatttagctcttgagcctcatcctgaacaagattctgtcattttttttgtattctcctcccatccattgcacactgcactttcttattctaaattatctcaatgtatgtcaccacttgaaatgtgtgttcgaatctcataccattcttgtgaaatcatatacagccaaaatattttaccaagattatttttgggcaaggtttcactataaatctcagattagtttgaggcttctgatctacctaactctgtttcttgtcaactgtgattaaaagttcacatcaccatttctagctaacatgattatttttgaatgcacagaacttgtgcaaaccaccaatggacactcaaataaacagagttgttgtgagatagaaagagaggatggatatatataaacaataacacaagtacatattaatttgcaatattgagcttatattaaataggctactatctactgtcaaaaacaattcatatatgtctggttctggaaagcattgcacaccaaaggtacataaattatctaaagcccaagaactttggttagaactttatgcttgtgaatgtatttaaccttaatgatgtcttaaatgtcttgtttttattgcacttaagcaaaatcttcatgtgtactgcaagaatagaatatgacagtgtatgtgggataaagaatgcttactcattcactggaatcaaagtaacttttattctccattctttgggcatatcttgaaaagggtatggacatatagagaagaaaagcagtcatttggactttggaactaaatagagaaatgttgcatttaaggtttagtcaaattctgaatgggtaaggacaattcagtgcaaactgtcggttaagagagcatgacctattatctaatgtggatttcggatatcatttgatgatggatcagttagtaaagcaattgccctgaaacatgatggcctgtttcaaatacctagaaccaaggaaaccctggtagtgaatgtctgcagtttcagtgattccactgctaaataggaggcggagacagagtgggcatgccttgaggttcctgggctagccacctaatgtatgcagtgataatcaatttttaatcctttcttgagcaaggtggaggtatgtactggtaacaaaggtttccgtctggcctccacatacacacatgtgactacattcacacacaggaatgaatgtgcacacatatgatacatgtaaacacatctgcacacatataaattaattgaaaatggggcatacttagacggtaaaaggaatggggaagcagatgtaggtctaaaaggtaaaaatatcagtagatttcggttacaaattcttcagatagcagtggtaatcattaaagctgcaatggactgttattaatacaaattttttgacttatagtcttgttttagggttgacacgattcatgatatatatttggcatgggatacaaaagaaatttttaataccactgtaaagaaggtgacagttgagagacgagctgtgttgggattttgtctattttgatgctatctatttggatgtagaagcagaattttgtggggcaaataccatgtggtacaatgcttttgaataaaggtaagattgatgcagagtacaggtgacattttactatggcttttcctacctttaatgttttgaataattaatggccttaaacatataagtaataactaccttacaatttgtaaaatacatctgcaattattttggtaagaactgtacattttagtacagactgaacgccaggacacataagttagacatatgaatcctatttgttctctgagtgtgtttctttgtagaagtactcatgagtaatgggaaaggtcagggcttgtgtccaagtccaaaagtgagataagatagtctgccaaaaacatggtagccttcgggttgcttgactgacttttgtatttccttagcatttcagctgacagatggttctcaagtttctcctcttctccatccttctgctttgctacatcaatcagacttgttcacatttccaggaataggagggcttcattggtttgatttatcataggaatgtttctctaataccttgaaccataatctttttgaaggaagataaaggtctttaagaaagatgtgtgtgattgtctcctcggctaaaaaatactaccacagaagcaactgagaaaaacagaaagacttctaggaaaaaaacttatctacattcactcgatccttctgtcctttttcagttgaagagatatgatttctgatagaaatatcaagatttctgccacttcttatttaaccctctattgttgcagagaggaaatgagctgatgttttttagtattaaggagtctcctatattagaaagcctttccaatgtctccctgggagaaatgggtgcacttttcctcgtttatatgagaacattttataggaactgtcttaatagcaattactccttttatacctacaatctctctcaaaatgtgagctactttcgagtaatatgtttcatcttttaaatattttctctaagacaatttattgaaattgatagaaaaatcctgacatcattttctaaacaatttatgcaatgccactccctaccaagaaatggctacatatgttatgctcatttatttacttgttccagaaaccaaccagatatctgagatacttgcctagcaaacacagaagtggatgctcacagtcagttattggatggatcacagggcccccaatgaaggaactagagaaagtaccaaaggagctggggggatctgcaaccctataggtgaaacaacaatatgaactaaccagtaccccctggagctcatgtctctagctgcatatgtatcagaagatggcctagtcggccatcagtgaggcccattggttgtgcaaactttatatgcatcagtacaggggaacgccagggccaagaagtgggaggggtgggtgggggagtgggtggggaagcgtgtgggggacttttgggatagcattggaaatgtaaatgaaataaatacctaattttaaaaaaaaagaaaagaaaagaaacgttggcactctaccaatggctaagaattcagcaggcctttcactgaaagcagagcctaattggctgtagagagccttgcagggaagttagaaagcagacagaagacaacactatgagtttttaaatatttatgtaagctaaataaatggtcattttgagtttcaaaaaaatgattgctagataaatgttcagataagaagcacagacaatgctaaataacattaataatattcgctgaggtttatttcaaggaacgtaggtacctctaggctgacagcaggttttaaaggcttacatctatacaaccaacctaaaataaaacagttaaacagttttattctatgaactttatgtagcatagcatggtaataacagaagtgtgtggagtctaagtcttccttgatggctagtgtttctcatgctcttcttgtttcctgttgacaccaagaagaacctaaactatatatatatagagacaaaggctgggactctgacatggttcattggggttgatgctcagagcagagagctagatttgagagagagagagagagagagaaagggagaggaagatggagacagagatagagaaacagagacagagacagaaagacagagaaagacagagacagttctagaggtaaacgccttcttgtttttatagtcttggtgatatagcttcagttccactctgaccctgggagtcagaaacattgacactaatggaaatacatcagtcctcctacattttagtagatggaatttgtgtctctttctcttccttgaagtgatgtctttctagggtgtagaatgaggtgaggcttcagtgtcatccatacaaccagtgaaaagagatgctttgattgtggtgagatactccaagtccagtttcagtactcaaattagtcaagattattcaaggaatggcaacttttgtcacactagagacatagagaaaaatcataaacatcaagggcattacatcagaattcaagctaatctcagaatttaactctccttagaaaattccattaaggtgcgtaaacaaggaggcacagagcataaaatgacttatgctagctcaacccaaaaatcacagtcaagttatataacatttttaaaataaataatatttaaaaggcatgtaaaatgtacaatataagtgagcctatgaagtaattctgcagagatgttttgaaatatgcaattgtatatagaaaattcatattcagctgtcatagttctttgatatcagtgagaaagctatgatgctcagataagcagtgtaagagtacagaattgtcagaggaaggactctgttaccatagcaacctgatttgagatgtacaaggtgtgttttaacctaagttcctgtcttggaaatgaacacaagcaaataattagataagtaaatcgctgacaccgcatccaagaaactcaagtgtttttaaggaaaatgctcactcaaatataaattatcagttgattatgaatgagaataatagcagtctgaactgggccataatttctaactcatttctgcttcatttaatggcatgggtgtgaatctagtagttgctcagtcccatgaggctggatatttcagctgggcttctgtataagctggagtcctgaagaaataggttcctgcagatgtgctggcaagtcagtgcaaccaggtaaaaaggaattctgtttttcctttgtccttatgtaggacttcagccgaatgtatggaccagataaaaggtttgcctcaaggtatggattaaaggcttgtgtgtctttcaatctgaaggtctagatcaaaagcttgtatcatccagcctcaaaatctgggtcactggcatgccctcaatttctggattgcagttcactctagatatagtcaaactgacaaccagaaattgccatcacaatcgaccccctgtcaatttgacacaaatcatcctacttacttctgtttcaggtaaggtttcattgctgtgaagagacaccatgaccaaggcaactcttatcaagaaaaacatttcactggagctggcttatagtttcagagtttcagtccttatcatcatggtgtgtagcatggcagtgtataggcagacatgatgctgaagggaccaagagcattttgattcaaagcaacaaggagagattgacttctacaggcaggcagaaggagggtctcttctccatggaacagagattgagcactaagagtgttcaaagcccacttacacagtgacacacttcttcaataaggccaaaattattccatcaaggtcacatctcctagtagtgatacttccaatgggccaagcatattcaaaccaacacacacacacacacacacacacacacacacacacacacacacacacacacacacaaacacacacacacacacacacacacacacacacacagcataaaacaaaacttgatggaaacagagaggtcatgaattttttagaaagtttggaggaatatacaggaggtttcagagggataaatggtagagaaaacattaaattataatctcaaaaatcaacaagaaagaaaaatagctcaaggaaagctaatttgacccacaaatatgtttattgctcatgaaataatgtcataatcaaatgcaaatttagcttatagttttacatttctaacttctttatcactctgtgcctaatgccccattcttgctcatcctctttctctccgtaaatagtttccccttctaattacgggttacacttattctatttccttccctttgtgtcctttcccccggttttacagtctctttgccttatgtaaatttagctaactgactgactaactaactatagagagagatttattctataaattctatttatctatggaatacatacatgcacactagcacaaacacacatacacacatatgaaccatgcacacaaatatataacatgtatttaaatatttatagatttatttacttttattttatgtgtatgagtattattgcccatatgtttgtattgtactattccaagcatgtctagtgcatagagtggctagaagaaggtgttggattccctggaataggagtaatatgagctgccatgttggtgttaaacttcactggatcctctacaagagctgtaggtgatcttaactacccagttaattttttagccccaaataattatttatatgtagacttatatgactgagaataatcatgatatttgtctttctgtgtcttgtttattgcacttaccagttgcattggtttactttgaagatataccaagtatatccagttgcattggttttctttgaagatataattattttatttttctatttccaaatgaatgaattcccggatgtgtatgtaccacattctcttcatacattcatttcttgatgaggatctagctaagcctgttccatttcctagctattgtgaaagcagcagccgtaaaagtggatattcaagtatctctgcatgtgttcacttagagtccttctggcaagtactcagaagtgatagagatcagtaaaacggtaggtctatttttagttttctgaggaacaccgacattgacttccacagatgtactaattcacattctcaccagcattatacaaagattcctctttcctcatatccttgcctgcatttgttgctgttcattttttttaatgactaagtttattattttgcatcattattgcaccttcctctctcacctttcctcctaactctctctgtcactcctcttcccttcatcaaccccttctcctcttctcatcccccaaagggaaatactcctatgaatatgaaccaggcccagcctatcaagctccagcaatactaggtgcatcctcttccactgaggctagacaagccagcacagttaaaataaagggatccaaaggcaggcaatgcagtcagagataacccctgctaccacttcaggaataccacacaagacccagctgtacaacttttacgtatgtgaagagaacctatgtcagtccaattcatattctctgattggcagttcagtctccatgaaccagcatgggccaacattagtttaatctgtagatatccttgtgctgtccttgacgttccctctcttacacagaaatacccaacctctgcttgctcagtgtttggctgtgggtctctgtagcagcttctaacagttgttgggtgaagcccctatgatgacatttatgctaggtgtctttctgcaagtagggcagaatattattgatagtttcagggatgggttccctctcattcaatgggtcaagctaggccagtcactgattgcgtcttacctcaaattttatttcagccccaattgggtctaaggacttgttatcaggttgatgtcccaatccctccattagaagtcttgcctgattacaggagatggccctttcaggctccatatctcacattacttgtagtcttagctaggattaccttcatagattccttggtgtttccattgtcatgtgttactagagatacttgacttcccagtccagttgttgctcccggtagtctttccctccatccatcccataacatcattcttgttcccattcccaccccatccccagttaatcccctccttccttctactcctaatgtctaacctatttccccttttcaatgagattcaagcaccttcccttggatctactttggaattagcatttttagatctgtggcttgtagtatagttaccctttatagctcgtatgaaattgtctttcttagtttagtctttgtgttgtttagttatatgtattactatggcctcataaaatgaatttagtagtgttccttctgtttctcttttgtggaataatttgaagagtattgctaattcactcctaaaggtctagtagaattcttgactaaaacattctggtcatgggctgtagtgactgcttctatttcctttgagcttatagatctatttaatttgtttacctaatgttgacttagatttggtaagtggaatttatcaagaaaattgtccatttcatttagattttccaattttgtggagtacaggtttttgaagtaagacttaattattctttgaatttctttagtgtctgttgttaaggtcccctcttatttctgattttgtaagttgggtgttctctgctcttttatttggtttgtttaagggtttttctgtttctgattttcttaaagaaccaactgtttgtttaataaattcttagcattgttctcttcatttctttgttatgtaggaacttcagagcaggttttcatggcaattttactagttgtggatttatgaagtagtttactgatacaaatggaccttaagatcaattagagagttgttggttactattaagatacaagtgccactattgaacctttagggatactgtgccatgttgattacttttttagttcacaagctgcctggaagtattggatgatttttctttattggcagcttgcataacactgtctggtctatgaaaattaatactcagggaagagtctttcaggtcagatctaactcagtttctttgagtccttgtcaaatgtacatggtactgttcagcaatagagatttattttcagcatcttgggggatggcaactaagggtaagagcaatagcctacattgattttggagtctcttgaatactcatgatcaacagttcaaaataaaagttcccatggctagtactgcattttctgctagatacctggatcttgggagaagcattaatactccaagtgttataatttcacattaagtgtaatatatatatatatatatatatatatatatatatatatatatttgtaattttaggtatatataaaccaacatattcctgtggtacatacagaaggaaaagcagtaagttgaaattaaataatattaataatttataaataaacctgaagccatttacaatagatagttttagaaatcatatattttggggttttttttttactccaatttatcagcaaatattgtgttttcttatcagaactcatgaagaattcaagactcatgttttcttttcttggactgtgagattgaagataattttttctcacatgttttattagatattttcttcatttacatttcttttttaaaacttttttattaggattttcttcatttacatttccaatgctatcccaaatgtcccctatacccacccacccccactcccctacccacccactcccacttcttagccccggggttccattgtacttaggtatatgaagtttgcaagaccgatggaccgctctttccactgatggccgcctaggccatctacaggtacatatgcagctagaaacaagagctctaggggggactggatagttcatattttgttccacctatagggttgcagacccctttagctccttgggtacattctctagctcctccattgggggccctgtgatccatccaatagctgactgtgagcatccacttccatgtttgctaggcactggcatagcctcataagagacagctatatctgggtcctttcagcaaaatcttgatagtgtatgcaatggtgtcaatgtttggaggctgattatgggatggatccctgggtatggcagtctctagatggtccatcgtttcgtctcagctccaaactttgtctctgtaactccttccatgggtttttttgttcccaattctaagaaggctccaagtgttcacactttggccttaattcttcttgagtttcatgtgttttgcaaattgtatcttgtatcttgggtattctaagattctgggctaatatccacttatcagtgagtacatatcatgtgacttcttttgtgattgggttacctcactcaggatgatgccctccaggtccatccatttgcctaggaatttcataaattcattctttttaatagttgagtagtactccattgtgtaaatttaccacattttatgtatccattcctctgttgagggacatctgggttctatccagtttctggctattataaataaggctgctatgaacatactggagcatgtgtccttattaccagttggaacatcttctggatatatacccaggagaggtaatgcaggatcctctggtagtactatgtccaattttctgaggaaccgtcagactgattcccagagtagttgtacaagtttgcaatcccaccaacaatggaggagtgttcctctttctccacatcctcaccaacatctgacctcacctgagattttgatcttagccattctgactggtgtgaggtggaatcttagggttgctttgatttgtatttccctgatgattaaggatgctgaacattttttcaggtgcttctctgccattcagttttcctcaggtgagaattctttgtttagctctgagccccattttttaaaggggttatttgattttctggagtccaccttcttgagttctttatatagattggatattagtcccctatctgatttagaataggtaaagatcctttcccaatctgttggtgatctttttgtcttattacagaagctttgcaattttatgaggtcccatttgtcgattcttgatcttacagcacaagccattgctgttctattcagaaattttcccccgtacccatatcttcaaggcttttccccactttcttctctataactttcactgtctctggttttatgtggagttccttgatccacttagatttgacctttatacaaggagataggaatggatcaattcacactcttctacatgataacagccagttgtgccagcaccatttgttgaaaatgctgtctttttttcactagatggttttagctcctttgtcaaagatcaactgaccataggtgtgtgggttcatttctgggtcttcgattttattccattggtctacttgtctgttgctacaccagtaccatgcactttttatcatgattgctctgtagtacagctttaagtcgggcatggtgattcccccagaggttcttttatcagtgagaagagtttttgctatcctaggttttttgttattcctgatgaatttacagattgccatttctaattcattgaagaattgagttggaattttgatggggattgcattgaatctgtagattacttttgtcaagatagccatttttactatattgatcctgccaatccatgagcatgggagatctttacatcttctgagatcttctttaatttctttcttcagagacttgaagttcttatcatatagatcttttacttccgtagttagagtcacgccaaggtattttatattatttgtcactattataaagggtattgtttccctattttctttctcagcctgtttatccttagtgtagagaaaggccattgacttgtttgagttaattttatatccagctacttcactgaagctgtttatcaggtataggagttctctggtggaatttttagggtcacttatatatactatcatatcatctgcaaaaagtgatattttgacttcttcctttccaatttgtatccccttgatctccttttgttgtcgaattgctcgggctaggacttcaagtacaatgttgaataggtagggagaaagtgggcagccttgtctagtccctgattttagtgggattgcttccaggttctcaccatttactttgatgttggctactggtttgttatatattgcatgtttaggtatgggccttgaattcctgatctttctaagacttttatcatgaatgtgtgctggattttgtcaaatgctttctccacatctaatgagatgatcatgtggtttttgtctttgagtttgtttataaagtggattacgttgatggatttccatatattaaaccatccctgcattcctggaatgaaacctacttggtcaggatggatgattgttttgatgtgttctttgattcagctagcgagaattttattgaggatttttgcatcaatattcataacggaaattggtctgaagttctccatctttcttgggtctttctgtggtttaggtatcagattaattgtggcttcatagaataaattgggtagagtaccttctgtttctattttgtggaatagtttgtgcagaagtggaattagatcttctttgaaggtctgattgaactctgcactaacccatctggttctgggctttttttggttgggagactattaatgactgcttctatttctctaggggatataggactgtatagattattaacctgatcctgatttaactttgttacctggtatctgtctagaaatttgtccatttcatccaggttttcgagtttattgagtatagccttttgtagaaggatctgatggtgttttggatttcttcaagatctattgttatgtctcccttttcatatctgattttgttaattaggatgctgtccctgtgccctctagtaagtctggctaagggtttatctatcttgttgattttctcaaagaaccagctcctcaattggttgattctttgaatagttcttcttgtttcctcttggttgatttcacccttaattttgattatttcctgttgactactcctctagggtgaatttgcttccttttgttctagagcttttaggtgtgttgtcaagctgctaatgtgtgctctctctagtttgtttttggaggtactcagtgctatgagttttcctcttagaaatgctttcattgtgtcccataagtttgggtatgttgtggcttcattttcattaaactctaaatgtctttaatttctttctttattccttccttgacgaaggtgtcattgagaagagtgttgctcagtttccatatgaatgttggctttctattatttatgttgttattgaagatcagccttagtccatggtggtctgatagaatgcatggggcaatttcaatatttttgtatctgttgaggcctgttttgtgaccaattatatggtcaattttggagaaggtaccatgaggtgctgagaagaaagtatatccttttgtttcaggataaaatgttctatagatatctgttaaatccatttggttcataacttctgttagtttcactgtgtccctgtttagtttctgtttccacaatctgcctattgatgaaagtggtgtgttgaagtctaccactatttttgtatgaggtacaatgtgtgctttgagctttactaaagtttctttaatgaatgtggctgcccttgcatttggagcatagatattcagaattgagagttcctcttggaggattttacctttgatgagtatgaagtgtccctccttgtcttttctgataactttgggttggaagtcgattttatttgatattagaatggttactccagcttgtttcttcctacgatttgcttggaaaactgtttttaagcctttcatttgaggtggtgtctgtctttttccctgagatgggtttcctgtaagcagcaaaatgttgagtcctgtttgtgtagccagtctgttagtctatgtctttttattggggagttgagtccattgatattaaggaaaagtaattgttgctttctattatttctgttgttagagttggcattctgttcttgtggctgtcttcttttaggtttgttgaaggattactttcgtgctttttctaggtcatggtttcaggcttgtattttttttttctattattatcctttgaagggctggatttgtggaaagataatgtgtgaatttggttttgtcatggaatactttgttttctccatctatggtaattgaaagtttggctgtgtatagtagcctgggctggcatttgtgttctcttagtgtctgtataacatctgtccaggatcttctgtctttcatagtctctggtgaaaagtctggtgtaattctgataggcctgcctttatatgttacttgacccttttcccttactgcttttaatattctatctttatttagtgcatttgttgttctgattattatgtatcgggtggaatttcttttctggtccagtctatttggagttctgtaggcttcttgtatgttcctgggcatctctttctttatgtttgggaagttttcttctataattttgttgaagatatttgctggccctttaagttgaaaatcttcattctcatctacttgtattatccgtaggtttagtcttctcattgtgtcctggatttccagtatgttttgagttaggatctttctgaattttgcattttctttggtttttgtgctaatgttctctatggaaacttctgcacctgagattctctcttccatctcttgtattctgttgctgatgctcgcatctatggttcctgatttctttcctagggtttctatctccagtgggttttttttattgtgtttacttccctttttaggtctagtatggtttttgttcatttccatcacctgtttggttgtgttttcctgtttttctttaaggacttgtaactctttagcagtgttctcctgtatttctttaaatgagttattaaagtccttcttgatttcctctaccatgatcatgagatatgcttttaaatccgggtctagcttttcgggtatgttggggtgcccaggactgggcgaggtgggagtgctgcattctgatgatagtgaatggtcttgatttctcttagtaagattcttacgtttgcattttgccatctggtaatctctgtagttagttgttatagttgtctctggttagagattggtcctctcgtgattctgtcagcctctctgcagacctgggagactagctctcttctctgagtttcagtggtctcggcaggcatgctctactcttacagggaaagtgcacagatatctggcattcagacctgcctcctggcagaagatgaaggccagaaacaggacctgtcccagaagctgtgttgctttgacctgtcacagaagctgttagcttctgtagtccacactctcaccagcacagactagtctctgaggaatctgggaaccaagatggctcccccaggtgctcaggcaaagccctccaaggcagggcagacacctctcctctggcatggaaggtgccggatgtctggagccagaaatggggtctgcctcagaagctgtcctctagagaattgggggtgtccgcagatgttgctcccaggtgacccagtggtggcgcctaccagaagggatttggaccctggtcaggttgggttttctgctttcctcatgctgtctcaggtcctgcatgattcgattggaacagaagttatgttccactcaccggtggtcctaagatcgcgtggtgagtcttctaggagaccttgggggtgtccgctaactccacgccaaaggtgacccgatactggagcagactggaagggatttgtagccctggtcaggccggatttttttctttcctaatgatgtctcaggtcccgcgcgattgggttgaaacagaagttgtgttccactcactggtggttctaagatcctgtggagagtactctagtggaccttaggggtgtctgccaactctgcgcccaaggtgacctggtgctggtgctgaccagaagccaatagtcatttttatatcttgctttaaaacttgggatttcagtatattcactgggtcatatgatgaacaaaggaagatacctttcactgaggactggaagagtttggaagcttttgattaaaataaaaattacaagaatcatagcaactttagttgacaatattattctcaaactcttggaaatcaaactgtttaaatattttatgtcccgagaaatattaaaattggggacctacagaagcagggcccaatgaaggaagccatgcctcctgccttgtgctccactataataaaggaatgtgaggtggagaggtgggaaagatgtaagagcagaacagtgcttgtgctgcagagactcagaactggaacagtgatggcatggcagcgacagatatatgagaaggatgaggttgatagtgaaacaggtttttgactagtgtggtaggtggcatggtggtgtgcagcagactgcagcttatgcaggtgtaggctcagcccccaaacaagctgcctggccacagggttattttggctctgggtaaagatggaggccaaaatgaggaaagtttcattttctggactgtatctcctcaaatttccactgtggtctatgaagcagccgaggatcatatgtaagttataggtcagtgtccactgtccatgttaaaacctaacaccatgaggacatctgtggccagtgatgccttgtttatatgggggccataggaatatgagcaacctgtgttgcccctgaggccatggtgatgttcttttctgggctgcctgcaatggacatccttgtgtgattcagtggagctactacaggtggaagctgtgttcacttattttgtgaaactctgaagaacctagaagctgagaagaagctcatgacccaagttctagaagactacaacaagcaaggaagttactttaacgctgatatcaatgactgcagatatacaattgaataaaggaacatggaagtgggctgtaataccctctatcaaccctcctccacccacagaaataacaatctaaaaaaggaagccatcaaagagaggttttaatattgtgataatgatggtgaagagcagcagctctctacaactgatggctttttttcaggggtctagatttggaaggcttaattttctttagggggcaggccattgggagttaatcatgctacagtaagcataaggacaatacaaacagaagttattttgtttttggtattgttgggggagaggtcataagaagtggggaaggcagacattgtaggacttggagtgatggtcatctggccatattaggtgaaatttctatagaatcaataaaaatattattttctagaaaagatgttaaaacttattaaaacttagtactaagagaaagttgtccaaaccttaaaaaccagcatgtaaccctaaactttataggaaggtttttttcaaatataagaacagattatgttcatcttttcaaaaattacgctttccttttcatagacaaatagaactatcttagctcattcataaaattatgatgagtttactacaaaaaaatcctcagtaaatactatattaaaaacaaagcaattggagagcattactttaacattctcaaacaaagaactaataaaatgactcactgatgtgttaggtgcacactactgaaggatggtcattctgtgatgatctatgattaaatacacattgggtgacaaacctagatagtttccctgaaaccctccttcttacagagatatatttgtttgtctaactgctaaggtggcagttcagctggatctacttttcccaggtgtcttggtaattaactatggccaaatatttgtcaggggaattcaggaagacatcattctgtcaaagacttgaatgtggccattcttcatctgaagtgggactgtggggacaaaacttctgaagatgatgaagtagaggaaatttcaaatgactaaacacagccaatagacttgtagcaatctatactatagtaaccaaacatgattttttattattatttaggaaatttgtattactatgtatgtatgtatgtatgtatgtatgtatgtatgtatgcaaacatataaggcctatgatttcctcaatgagtttacaatttgcattggtctcagcaaattgtccttttctgtatgggtgagcatcctccaaattatccagtgtatcactaagagaaaagcaggagaaattctctggtttttgctctctgcctggttgcttgagctggggctttttatccactcatttgattgctcatgttcacctccttcctttttctagactgaactacaccaatggatgtccttggtctccagaatgcatatggcagacagtatctgttctcagccttcataaatgcattactaatccaaatataaacggagatgacagagatgtatatccatttgtatgtaccttagttactattctattgctgtgaagagacactatgactaaagcaactcctataaaagaaagcattaaattggggggcttgcttacagtcttaaagggttaatgcattataatcatggtagaaagcacaatggtttgcaggcaggcaaacatggtgctagagaagtatatgggagctacatcttgattttttaggtggcaagcagaaagagaggacgagagggagagagggaaagtgcgaaggagagagagagagagagagagagagagagagagagagagagagagagagagagactagacctggcatagccttttgaaactgcaaagctcatcttgtgtaacacacaaccttcatcaaggacatacctactccaacaaagccatagctattgatcctccaaaacagtttaccatctatgaaaatatatgagccaatgggaaccatgcttattctaatacctacagtataattataacatacctatactattagtatctacaaagtacacagacagacagacagacagacagacagacagacagagagattgataatctttcaaatttctttctttgaagaatgtccaattaatactggtggcttcatggatagaactgtagataggtagtaaaagtgagtgtaaaagtaaaaatttgataacagcagggataattcaggagtcagtgaaaattcaaatttcttactaatttgttgatgttttgcttattctcttgagctcttttctaattgctctgaactttggtattgttcctttattcggtgcttggatgactgatggtaagtttaaagctacctagtaagattgcagaagaaatgctattctgtctctagaaaatggagaaagtgcggttttaaatgggagatatttatggaaggctgccaagtaataacatttccagcaaaataacattgaagaaaatgtatatcgtgaagcaaagtgtttgaaaatgaatttccaaagaaccatgtatgctcgtgtgagccctgaactgcccatgcttgtatcttcagaaggcaatttgtttagcctgaagaccgacttctgggctcaatcggtgtttcaaataatatggtttgtagcacgcatagtttggcagctcatgggatggttattgatgttttaaaaattgattacagtctcagctccaacaacaatctatagctctggaggtggaaacacatcatcagggttaaagctctctgggtggttccagatacataaggcctctaggtcatttttctgaagaaagtattgtggctgaaaacatagaatacaataaaaaaatcaacttcaatttttcttaccttgaacacacatcaagtccacagctcccaacattatttttcaaatctcccattatttcttcccaactctttcccactcaacacccctttcctttcatatatacaaatgccaacactcacctgaaagaagggaagtcaagcagacaaaagtctttgctatattccctgctcttggttatgttggtaagcttgcacaatccttcccaatctccttcaccttttcctaatcaccccgaccccaaatgctggggggaatggatgtagactcacacaaacagtaattaattttttaccacttatatttatcccaaacatttctaactacattttgttcccaaatatatggcaatctatcaaaaaattcaggaaatgaactcaagaaatcaaaactctatttgttttcaagagtaaacagtacagtgatacatagatgcaaacagtattaaaattgattgcttttctcaattctggaaagtttctcaaccggagaactttgagaaaggagtctgaagatcttaagagtgacatgcactaaaaataatctataatccgtcacagcattggtgtggctttcttcttcctgctgtgtttttgcctcatgcacttctatgagaacatttcctttagtttcttctcaggtcatactgggctgctttactttttgtcataacaactagcagagagaagtgatcaaaggaatttcagctggaccgctcaaatgggtgtgcacgtgcattagcacaaataccttatgtgcaatggcatagaggatatggtgtgttccaggtctcagaaaaggctattgcagaaaggtagcttggactgcaacgactttataagactcaaaaggaaaacgaaacactggtcagaagccaaaatatgaactctttccacatccacccatttgaatcacgtccatttgctccatcgtctccttatccatgtgtcaacttaaataccactttttgggagagactgctctgagctcctgatctcagttactctctattaaagccccttttcctttacagaacacttttaatattcaatattattgatttatttcattttttgccttgcctcggaggctgaagcactgatgagggcaggggtctctgctgcctgtgtctatcactgtatttttcagggcctccaggaagaagggaattagttactctatggttatcatcaggaagtgctcaatgtggagaactctaaatgggcagctgcagttttgcaaacacaactaaatttttggatttgggtcaaaattaaaatcaaagtgattattataattgtaggtgacagtttaatattatttatggaatgcttcccacagtcctaaatactttccatacagcaattctcaatgtcataataacttaatgagataggacatattatttctgtactttttagtggaggatctaaacaaaatggatttataatgtctccaatggcatatactttgagagtattagaaccaatggtataaacccaagtaagctagctcccgatctaatatctttattgctttaatatcatttaatatcatttcagtgcaatagttttctgtccatgaaaacaacacaatgaggaccaggattcttcctcgttaggattccaatttggctaagactatagagtgggaatacgtctaggtttctcttttatgcagtttcttctttatcagatattctaaattacccttagcagataatcttgatggtttttatctctgtcttttctgctcattcccagagagaatctataagccattcaaagtagtatatatcagtaagccagtatatatcactagtatatatcactaagtatattcttagtatatatcactaagaataatagtatagaaagatggtaagtgtaagacccacctaaactaaatagtaaggttctgaggaagctgatactgaaagggaaacaaggagagagagagagagagagagagagagagagagagagagagagagagagagagacagagagacagagagagagagagagagaatcttccaaagtacagatttaagtgttcttcaaagttaactttgtaaaaagactaaggtatgaaataatgtagtgactgagcaaatatctacctccaccactttggggctaaaaaaaaactatattttcagttataaatagaaatcatactttgcaagagtaaattaagaatatatttttcatatccatatatctatgcaacaacagttaatctaaaaggccatgaagttgaataatgtgtttaagggggaaaagggaaaggtgaaatgatataattgtattataatctcagcaattaaaagaaataattttaaaatgattaaattaagcacagtatttactacagactatgtagatgaaaaattttaaagaaaaagtccattttatttcctaaccattatccatggttgctcttcgacaaactcagagctttttgtaagccatgttaggtggttcagtttaggaagtgccagttggataatgaaatttgaactaaacttattcaacaagaatgacatttctttcagcttacgttcaaagatatggtaactatacaaggaatctgctaatacttttttgctcatggagaaagtaataacaattaaaatattgttttcagtttttcacacttgaaggcatatttatgtgttgaatattggggtgttactagaccctgatgtgtttttaaaacattttcaaatatttaagccatgaggtgaggtctattgtttcttcagtcatagtctcatccaagatcagcccttttccctaggggatcctagagcacacactgttgtatcttatatcttgggtatcctaagtttctgggctaatatccacttatcagtgagtacgtattgtgcgagttcctttgtgattgggttacctcactcaggatgatgccctccaagtccatccatttgcctaggaatttcataaattctttttaatagctgagtagtattccattgtgtaaatgtaccacattttctgtatccattcctctgttgaggggcatctgggttctttccagcttctggctattataaacaaggctgctatgaacatagtggagcatgtattcttcttaccatttgggacatcttctggatatatgcccaggagaggtattgctggatcctccggtagtactatgtccaattttctgaggaaccgccagactgatttccagagtggttgtacaagcttgcaatcccatcaacaatggaggagtgttcccctttctcgacatcctcgccagcatctgctgtcacctgagtttttgatcttagccattctgactggagtgaagtggaatctcagtgttgttttgatttgcatttccctgatgattaaggatgttgaacattttttcaggtgtttctctgccattcggtattcctcaggtgagaattctttgttcagctctgagccccattttttaatggggttatttgattttctggagtccaccttcttgagttctttatatatattggatattagtcccctatccgatttgggataggtaaagatcctttcccaatctgttggtggcctttttgtcttattgacggtgtcttttgctttgcagaagctttgcaattttatgaggtcccatttatcaattcttgatcttacagcacaagccattgctgttctattcaggaatttttcccctgtacccatatctttgaggcttttccctactttctcctctataagtttcagtgtctctggttttatgtggagttcatcaagtttctctttctatgataggtcatctaaatccttcagtatgcaaacaactgattagacttggcctgagaaccatatgacaatttagaatttaaaaaaatcagaagagatgatcagaaagctgggcattggccaggtattattttagccttgacttgtggagaaaatgcagacaaggagctcagttagcctcaacattatcaccccagcttctcccatcatatactgcatcgtcaagttaagcatcgtagtatttgcctatagtgtcagcactacagaggctgaggggggaggatagcttgagcccagcagttcaaacccaacctgtacaatataacaaagccacaaatcaaacattaataggttacctaacaatcaaataatctaagtttctgattctacatctgcatcaacaattacaaaattaggatggattatttactgaagcatttgttgtacctgtgtcctgatgttagccaagtctacttcacttctcacccacactacacactttcaggatacttgcttcctgtgaaattaaataatagcacagagggacatgtgtttggagggagaaatgggaaaagtgaaaggatataattaggttataatatcagcaaaataaaggaaataaataatttttaaaagaataaattaagcacagtatttgcttaataaaggaaagtgcttattgctaaaactatctccacagagattggatggagagaaactaccaacaggagatcaaagaacatatgattctctctactcactaccaacattctggctttgtagaaggaatagccctgcattgtcactattcttctacatttcttgcaacaaacatctgcctcaggacacacaaaggggcactatataataaaaaagaaatgcggttactgccctgaagcagtgagtagcagtaacaagaaataatcaatttaaagtccattccaatcctccaaaatcacaaagtacaaccatatactaataaaccatatactaataaaccatatactaataaaccatatactaataaaccatatactaataagccatatactaataaaccatataccaataaaccgtataccaataaaccatataccaataaaccatatactaataaaccatatactaataaaccatatactaataaaccatatactaataaaccatatactaataaaccatatacttataaaagctcagacaatgtccagtccactggagagcacagcagtttatatgattttcagccttcagagttgctatattgtttgaatcagttgtaaaaagtctaagaatgaactaaaagtgcagtaagacaaagagggcagtggatgcacaaaaacctaccaaactggaaaaaagaatccaaatacacaaatctagtgaagctctaatagaagataaacatgcagtcatagccaatcaatagggaagtggaagcaaatctaaggtcaaatgaaaacaatgagcccttgaatttgcatataaagtaaatcttcacctaaccccacagaggataaactaatgacgatagagaattccaaacagtatgttccaaacagagttccaagcaattcagagagtgaacttgtcatagacccactaaaagaccattctgggccaagggtggaaactgtaagaacaaatacaaaaattcaaaccccaagagagtgcagtaaataacttattgctgtcttttgctgcaagaagccagtttccttcaaacacaactgtatctacctgatctacttctccacctcctacatctgatgtcctacttacaacagaatacccactatcacagttctatatctgtaaacttatggtggagtgagaaacagactgccttggccacacagtaaattctgtggaactcctcagttttctagcagggtgtcacataagactaatacatgttcactataatcctggtgaatagcacacagtcagttccagaaccacttggtcatttataatgactgagctgctcactactatggtctcagccaatgtttcagcgaaaagatagatacaataaaaggaaaaagaaatgcccaagaagtagaatagtctttccaaaaccacatctgcatgcatgaccatttaatttgcgggcttgaaacaaaggtgggaacctacagtgattgtgaaaagcactaggtctccaagatgaaacataacctggatttagttatggttgaaatgcgacagagctgtttggagcaggaattgttcagctctttgccgaggacctgaagatgcagtaagtatatggcaccaagaatcagtggtgtattgattttaagaaggccaatttttacttcagttgaagtataagctattgagacatcccattagagaaggcaaaatggctgagaacaggaagtctgcacccaatcagctgcacactttaggagaaacagatgcccaggtggacagggaaatcagaagcaggaacaaggtcattgcaggtgactcctccaatgcacaagcaactcattaggaaagagctagtacttccaaagtgctgacatagcccaggaaaacaagaatactggccagattcagtaacatgtcagcaccaaacagatatctttctcccttcttttgctttagcatgtgttatatgcaacttttcctgtgcttcaaccataatgatccatcagcttcatgtactctaaatacccagctgataagtacaatacttggaatataaaaatcatgtcccagccagaaagtggtggcatgtgcctttaattccagcacttggaaggcagaggcaggcaaatttctgacttcgaggccagcttggtctacagagtgagttccaggacagccaggattacacagagaaaccctgccttgaaaatccaaaaaaaaaaaaaaaaaaaaaaaaaaaaaaatcatgtccccagaggggtagaagaaagttaaggtcagcctgctcatagcacaacaccaattaaaaaaaaaaaaaagagttgcatgcacaaagtttctttactggataccttttgggactaggagcacatagttaccaaaaccacctttcctgcaggtacagagagtactctggatgccaaggccataggaaacaaccaagctagaagagtcatcttcagaactgagaattctaaacactgcagctcccatggataagcctggtactagctcagctacaggcagaattctttcttaaaagcaccagccttgacttggactctcacctctaagaagcccagtgcttcataatagatgtaaataagagacactccttagaccccattgacatcctttgccttccctttgaatatttgcatttcctttgacttaaaaacatcaagttttaaaagagatacataaacaaaggattttctgatattggaggagtggtcacttaggcactaatcatgtggtggtatgaaacatgtccaagctacctactgctgttccacagagaactttgtgtttgggtccttaaagttgttaagccactaccactgtgctgtgggtcaggatcagaaatgggaatacaggtgtctcatgaatgatcacatgaaccttttggccccttaataacactaccttattattttatgaaatgaaatttttttgaaccagaacacagagaaagaaatgcttttgctttcttggatttaaatgatggttccttaaaggaaagatcaggttccttccttgcagaaggaaccaagtggtaacaaggctcgttcagtgtatccaaagggagctagagaacactagtatcatgatatctactgcaaatacaactctttgctttgtgtgttccttaaacgcatccataaacacttgtgaaaagacacaaagcccttactgaaacaagaactcaaagaggagaaacacaggtaagacttgcatgcattatttatatgacaatgttctccatttttcgataaacatggaacaaggcattctgagaaaaagcaagacttgccatgctgggcttcatactgtgtgtgttgtggcatcattcttttatgtcgcttaaaacaaaaactatactgatacaagaggtgacaatacatgtgagaaaagtggttgcatggtgtcattcctaccttgtttttgatgcattttagtcccttagaagaaccctcgcttcagtattgataagaagtatgtgattcaaagctccttacctgtattatagaatagaattattaaaagacaggagagaaacaacactcgtggattgtcaaaaaaataacctagctggcatcataattgtttttatcatatagaaatactctttcacattttaaaaaatgaatctatcaaatatatggcccatgagatgactcagtacctagacatgcttaccacaaagcatagccacctcatttacatccctaggacctccatagtgagagaaaaataacgacttctacaaatttgtcccctgacttccatgtacttgttaaggcatccacaatgccactttatatttgtattttgaacatgtaaaggggaacttaaagatgtttttgtaggaaatgaaagtgtcttgcaatattttctcaggatgccaaatgatacttctaacagtgttaaaagaaaggaaggacaggaaaaggcaaaggaagaggcacgggcaataaatagtagatgttgaaggttttaatattgtgattattagtgtcttgagattctcattaacttctgaaatagagataaggccactgacttttatttccagaaaagacaggggtcctgaaacctttaaagatttctgtactatcaagaatctgcataagtatgtataaatcaagtaactattgacttgactagattcagacattccagaagatgaaataaatgataagctaatgttagtaaacacacattttctgtctttttttaaagatttatttattttatatatgtaagtacactgttgctgttttcagacacaccagaagaggaaatcagatcccattacaaagggttgtgagttaccatgtgggtgctgggatttgaactcaggacctgtggaagagtagtcagtgctcttaacagctgagccttcacacagtttctccaattggcatatcaccctatactgtaggttagattttaaataaatcagagtctcttctaactcctgttctccttatcatattgcctccaacgtttcacgcttgagcatttcattcaaatttttctcatcaatcccccatacaagaaattttactctgcatggtcaaaatcacctgtggtcaactaaggtcttaaaacctgaagagataaactccataaataaacaagtacagatttttaaactgtgcaatgttggggcatgtgaaaaaaatcttcagtgtcctgcttgcatgaccaaggtctcggaagatgactcagtcagtaaagtgtttgctgcatgaacttgagaagctgaactcagatccttggcacccacacaaaatccaacctcctggttataagcctccgattccgattccttcactggtgaggctctgactggaggatgccagaagcttttggccagtcagtcacactgaattgtcacctcaaatctagtgaaagatggtgtttcaaagctaagatagaaattgaagaagacaccaaatctctggcttctatattatacacatgcatacactcaagcccatataaacaccacacaaacaaacacacacacacacacacacacgcattcacacactcacacatgtacacacacacacactcacacactcatacatatctatgtattacaaaatatttaaagaatggtaaacattatacaggaaagatggctcagaggttaagagcacctattattcattaaaaatgtcatttatcacttgagtacaaataataataatgatgattcgtgttttctcacagaactatgaccctccatcaaaatacttttgaacttttaaggagaaacccactttatctcctatgatatttaatgaaactcctgagtcactgggattccttgagagataagagaattttgttttatattcctttgtttattgagtggctaatggaaatattatttcctcttttttggacaattttttttattaggtattttcctcgtttacattttcaatgctatcccaaaggtcccccaaacccacccccccaatcccctacccacccattgcccctttttggccctggtgttcccctgttctggggcatataaagtttgcaggtccaatgggcctctctttgcagtgatgaccgactaggccatcttttgatacttatttcctctttttattgtgctctcctttgccttgggaaaataatgagtacatcatccatggtaagcaaaactggttgtgttgctttgaaatgtgcaaatgaatggatggttagaaagctggactgtttaacccttgtttagtaaagaagtcccacttcatagccatagtggtgctccttggatctttgccataggtcctcatctttcttccaggtacaatagatggctggctacctttaccagctctgaagcactctatcaatgtactctatctgcttcaggtggttagaaccagttcctaagtaaaaattataaaagatatttttcttatttctaaatttccctcccaaatgtcaaaccaatttccatttccatctatgacagcatctagctaatattctgagggagagggcaagttttaaaagggacacaaatgactaatacataagataaactgtttcaaattttcttgatcagaaattaaaagtctcttctctgtcatggaatcccagtgactcaaggagtgcattaagtatcacagcagctaaagtaaacttctccttaaaagttaaaaaatttcttaggcaaatgaatggaactagaaaatttcatcctgagcgaggtaattcaaccacaaaagaacacacatggtatgtactcactgacaagtggatattagcccagaagctcagaacacccaagatatgcaaaccacatgaaactcatgaagaccaaagtgtggataatttgatcgctattagaagggggaaccgaatacccatggaaggagttacagagacaaattgtgaagcagagactgaagaaatgaccatccagagactgacccacttgggaatccatcccatatgcaatcaccaaacccagacattattgtggttgccaacaattacttactgacagaagtctgttttacctctagagaggctccaccagtgcctgacaaatacagaactggatctttgcagcctactgtgagactgagcacagggttcccaattaaggagctagagaaaggatccaaggagctgaaggagtttgaagctccataggaggaacaacaacatgaactaacaagtatccccagagctcccaggaactaaaccaccaaccaaatagtacacatgttaggactcatggctccagctgcatatgtagcagaggatggcctagttggtcatcaaagggaagagaagcccttggtcctatgaaggctctatgtcccagtgtagggtattgccaaggccaggcgagggtgtgggtgggttggtgagcagggggacgagtaggggatttttcggaggggaaaccaggaaatgcaacaacatttgaaatgtaaataaagaaaatatctaatacaaaaattggaaaaaaaagttaagaattttgatagaggtcatagtccctgggaaaacatgagtgaattttatcatgcaatacagacatttccactctagctgaaggttaaaacccctttggaatcactttgaaacatgttcaaacttgctaagaagtgatcatcaattacatgtttctgtgaataaacatccaatttgctgcaataatttgcagatacaattttggctcgctgtgtgtatctgtctttattccagtgcacatagcagcgatagatgctatgattacaaactagctatgtatatatcattttaaatggtaattaggaaacaaatctcctgaaaaaaactgaaggaaagattgctagggtctattaggtttgagtaatcccatttacctttcaagttgaatttaaagtataagaacgaaacaaccaaaagaaaacacaggctgtgagctatatacatcatatattttccaacagtgaaactaggaacacacattaaagttgactttaatatatatgtatatattttccttgataatggagacaaagaaggatgcagaaatgcttggagattaatttaaccatttgtcttagggatgaggctctctaaaaacaattaaccttaagtaaaagaaaaaaaacttatttcaaaacaagacatattgtttgatatgaaggaataaaagtctcttatgacttttgcactaaatgattgtctaaatttgaaatgttggtaatactaaggcaaaggaatgtggtacacagtaacacgcaagactgaggctcagcatttgtattcactatcagtgtatttgctggaatttattagaagtgtcacaggaaatactttggatataaagaataatttctggaggatgatactatataaatttttaggggaaagtatattaagttaggaagagagagtggaaaagtggaagaaaggggagagcaggagagagaagggagagagggaagaagggagcgagagaaagaggtagagagaggcagagagacagagacagacaaaccgagacagagagaattagctcaggatttgatttaacatcaaacactaatatttcattatggaatgtagatagagactatttagaataacatattcaaatataagctctctaaaggcaatttttgaaaaggctctggaataaatttggaaaattaaaagactattgggaaagaaacaacctgagttttctggtataagaaatttcattatggatattttttcttattttatttttttattaaatattttcttcatttacatttcaaatggtatcccaaaagtcgcttataccctctccccaccctagttcccaacccacccactcccacttcctggccctggcattaacctgttctggggcatatgatcttcccaaggccaagggccacttctcccattgttggctgactaggccatcctctgctacatatggaactagagacaaagttctgatgagttcatattgttgatcctcctatagggttgccaactcctttagctccttgggtattttctctagctccttctttaggggccctgtgttccatccaatagatgactgtgagcacccacttgtgtatttgccatgcactggtatagcctcacaaaaggtagccatatcaggatcatgtcagtaaaaaatgttgctggcattatgcaatagtgtcaggatttgctgattatatatgggatggatccactggtggggcagtctctgcctggtcttttcttccatttcagctcagaattttgtctttgtaactccttccatgggtattttattccctattctaagaagaaatgaactatccacactttggtcttccttcttcttgagttccatgtggtttgcaaattggatcctgagtattctgagtttctgggctaatgtccacttatcagtgagtgcataagatgtgggttcttttgtgattgggttacctcactcaggatgatatcctccaggtccatccatttaactaagaatttcataaattcattgtttttagtagctgagtaaattactccattgtgtaaatctaccacattttctgtatccatttctctgttgagggacatctgcattctttccagcttctggctattataaataagggtgctatgaacatagtggagcatgtgtccttattacaagttggaacatcttctgggtatgtttttctagctataatttaaagataaaaatccctctgtcctttgctaaacacaataatcataattgctgagaattttctaggaaaaaaacaactatcagcttatttgccttagaactaagaagtgcagactcctttttaaatacagtttttttttagcagggcctctcctgctgagcttaattgttggctaaagtgtgggggctactctcagcctccccggtgcaaactgagactgaatcagcagataaagttttaaccatttttttttctttcttatcaacatgaaacatagaacagtaagtcattcagacaaggaaacaaaaacatacatgaattgacatgtggacagaatggtgcaccaaatacagacaatacaaagagggtagagaacttgatgtaaccaaaactaaggatgtctcctgtaggggccagagagaattaatttcttaattcttaacttcttaattaatgtctcctgacttccctccatccctgggagaggtccaaaatccactttcctctttttcctttcctttcctttcctttcctttcctttcctttcctttcctttcctttcctttccttcccttcccttcccttcccttcccttcccttcccttcccttcccttcccttcccttccctttccctttccctttcctttcctttcctttcctttcctttcctttcctttcctttcctttcctttcctttccttccctttcctttccttctcttccctccccctcccctcccttcccctttccctcccttcccctcccccttccttccccttccccttccctctttccccttcccccttcctcccttcccccttcctcccttccccgttcccccttcctcctttcctttcctttcctttcctttcctttcctttcctttcctttcctttcctttcctttcttgtttataacaggcagcttgtcaaaccaggattaaaacccagatttcccaatcatccaaagcttccaattcatccaatccaagggcaacgcacagagaaaacacaatctctatacactaaatgctccccaaataacccaaaggtctaccatgctgaatcttttctgaagccaccatcatcagcccacacttagtcaaacagtttacagccattagcaaaaccttctctgcccattctccacttcctgcaaccaacaaaaacaccaaccacaaaatgaattatacgtgtttgaggaaatgatttcctaacttccaataaagccttatctacaaatttttggcacaatgtaggattggggagttgtaaataaggtaacagtaagaattgagcaatattttgatctttatgaagtgtctttataatgctttaaccataacttaattttacctaaagtatcagaatctacaactcgaagtttttcttataactggggctgtgtcctataacgaggtccacagttcctgaacagagctaagaggctgccccttatctaggtttttgtcttacccgattctttagtgagtggagtcccatctttattggactttgacttacattcattcctccaaggttctcttcaccacaatgtgggcagagacctggaggaaggcccttactagttcaccatgcctgacctcaagctgtactacagagcaattgtgattaaaaactgcatggtactggtattgtaagaccccccaactcaatgtgtttcttatacccctagaaatgaagcccagcgtggagttctttgttcttttgccttcagcctgagagaatgatgaccactgggtgacccacccaggtgcctgacccatagtgtaaaggaccaagaatgtttgccgaagatagcctataacctttctgtgagagatgagctgtaattcaccatccccattcttacgatgtttactcagcatcctcattctttgtggtcttatcctcccctcactttgcggtttattctttaaaagcccttgactgcaacttctgtgggtcgatctcctctgcccctgtttgggttatgagctcagcttcagcatattgatacccaaatagacctcctgcgatattgcatcaagaatggtttctctccaattattggggtgtcggctcatcccgggacttgagcgagtgtccccagaaatgggggtctttcagtacagtgacaaacaggtagatcaatggaatagaattgaagacccagaaatgagcccatgtacctatggtcaattgatctttgacaagggagataaaaccatccagtgggaaaaaagacggcattttcaacaaatggtgctggctcaactggcagttaggttgtagaagaatgcgaaatgattcattcttatctccttgtaccaagttcaagtctaagtggatcaaagaactccacataaaaccagagacactgaaatgtatagaggagaaagtggggaagagccctgaagatatggccacaggggaaaagaaaaatccctaaacagaactgcaatggcttgtgctgtaagattgagaattgacaaatgggaccttataaaatttcaaagtttctataaggcaaaagaaactgtcaataagacaaaaaggccaccaacagattatgaaaggatctttaccaatcctaaatcagataggacactaatatccaatatatatgaagaactcaagaagttggactccagaaaaccaaataatcctattaaaaatgtgatacagaggtaaacaaagaattctcaactgaggaatactgactggttgagaagcacctgaaaaaatgttcaacatccttaatcctcacggaaatgcaaatcaaaacaaccctgagattccacctcacacctcactccagaatggataagatcaaaaattcaggtgacagcagatgctggcaaggatatggagaaagaggaacactcctctattgctggtgggattgcaagctggtaaaacactctggaaatcaatttggtggatcctcagaaaattggatatagtactacctgaagacccagcaatacctctcctggtcatatacccagaagatgttccaacttgtaataaggacacatgctccactctgttcatagcagcctttttttgtaatagccagaagctggaaagaacccagatgcccctcaacagaggaatggatacagaaagtgtggtacatttacaatggagtactagtcacctactaaaaacaatgaatttatgaaattcttaggcaaatggatggatctggagggtatcatcctgagtgaggcaacccaatcacaaaagaacacacatgatatgcactcactgataagtggatattagcccagaaacttagcatacccagcatactatttgcaaaacacatgaaactcaagaaaaaggaagtccaaagtgtggatacttcgtttcttcttagaagggggaacaaaatattcatggaaagagttacagagaccaagttcagagatgaattccttatcatggattgtctcatagctcatctcatggtgagaataagctggttacttttgacagttggaaatgaaaggaaggagatgcttccaagcataaatgggaaaatgggagagaaacaggtaacaaacagtgtggttagatagaggaggtgtgaccctcacagatgggaactctgaatttgaaggataatttagcaaactgacagggaggcatctgagccttttgatgacagattcattcactttccttcccatatctcttccattagttaaaatgttgaagggactggtttgctcccatctcttttactgtatatccctagtctccacatggttgaatttaattactaaacagatatcaggccaattggaagagagctgattgtagattgttaggggaacatttgcactgtagcacctttgactacaaatgaaggagcaaataatcagatgatttgtgtttagaatgaaaggcatgcatgtatatgaataagtgtttgtattgttattcagcttcttgctggggcatgcagttccctcattttcataggagaaatcaagaaagacacaaatgttattatctcagctcatgtctttgttttgcccttcaaacactgtattgactttaagttagaacagctggggatttataggctttaggtattttttaagttcacatcaccaaaatatttcagcgtatttggcttactgttctttaagataactagatcatcttatcttttatttgaaacagcacaataaaacaagtaaaacaccattttctctacttggcataaatattaatttatgctttcccagtcagtataaatgttcttcatcaatcaatgtaaaattgttattaaatactaaatgttattaatacagtcccatgttaaatgttgggaaatttttcttcatggttctctactattatttttgcctagaaatttcatttcctaatcgttctcttattgcgtcccgctcgaccggcaagaaagacgcaacaaaccagaatctttcgcggcaaaagctttattgcttgtttctcaggaagattccgaaccgggaaaatggcgctgcttttataacccgctgcgtgacgtttcagcacctgatatgacgtgacagctccgattcgttgcttgcccatcaccccactattacaccccgagaatgggagtgactaggagtgaattcactctcgcacctgcgtacaaggcttgtttactagttaggcacagcggaggcccgcgccatcttataatggcgattgctcgcggcacacacggctctcctcagagattactggcggcacacatgcgattgctcgcagcacgtaccggctctccacattctctaatttttattatcataactcatgcttattctagaaagcccaggtttatgctgcatagctatttatatactcatgccaggcataattaagcgcccaccactcatgttcttggaaaccttcactgttgaatggaaaacatcttcctaaatgaaatatttacaggttggtttcacccactcttttgaaagcttgactagagcatgtgcaggtccatctttctcacatcttagtcaagtcctagcatgtgatgagcgctcataaatacagtgcaacaaagaataggagaggtggcataataagtaagatttatgtttccaagtgtatattttttatatctgctaagtcagataattagaaaatatatgccttccctcaccatgggttttaactcttctttacagtagtactatatatgggttccctcctgtttagaaaattacatagtctttgcttatatgccaaagagtgaaactaggtggatctcattttttagaagcctccagattggtttccagagtgtttctactagttcatagtccctgccaataaacagtacataaatgttctgtctcatatagccaaagcaacacttattgccatttttttctttataataaccattgagcctgggaaaagatgtaaatacacacttgaatgatgactaagcatgctgaacacctttctagattgtttactaagtcattttcatttcttcaatgaagatcctattggtataagttgtttttttctaaatagccatatagttaagatgccttctaaatatttgcatatatattcatatgtagatatatgtgcatatatatatatatacacacacacatgtgtacatacatagatatttgtattgcttctagacttggttggagaatcttcttattttagtgtgtagtgtttagtacagacatataactgatcatagtgctggaaataaatgactatgagtaatcagtgatagacattacatctgtataaatctctatgtgtttgccatgtgccagaacctatagatcaagaagtctgtattacagtctgagagctgggattccaggaagtatgaatagcccagtgttggtgctgatatcaaagtgcagcattcttttattctattggatatttctttatttacatttcaaatgctatcactgttcctggtttcccctcctaaaaacatgctttccctatcccctaccccctaccactacccaccactctcccactcccacttcctggccctggcatttccccacacaggggcatagagccttcacaggaccaagggcctcccctcccactgatgactgactaagccatcctctgctacttacacagctggagccgtcagtttcaccatgtgtactctttggttgttggtttagtccctgggagctctgggggtactggatagttcatatagttgttcctcctatggggctgcaaactgcttcaactcctcaggtcatttctcttgctccttcattgtaggccctattctcagtccaatggatgactgtgagcatccacttctgtatttgtcaggcactggcaaagcctctcaggagagagctatatcaggctcctgatagcaagcacttgctggcatccacagcagtgtttgggtttggtgactgtatatgggatggatccccatgtaggtcagtctcaggatggtcatttctaaagtctctactccatactttgtctctgtaactccttccatgggtgttttgttcccccatctaagaagattcaaagtatccacactttggtcttccttcttcttgagtttcatgtggtattgtgaattgtatcataggtattccaagcatcttggataatattcacttgtcagtgagtgaataccatgtgtgttcttttgtgattgggttatcttacccaggatgatatcctccagatccatccatttgcctaagaatttcataaattcattgtttttaatagctgcatagtactccattgtgcaaatgtaccacattttctgtatccattcctctgttgaggggcatctgggttctttccaccttctggatattataaataaggctgctatgaacaaggtggaacatgtgtccttattaaatgttgcagcatcttctccgtatatgcccagcagtggtattgccgggtgcttaggtagtactatatccaatttcctgaggaactaccaaactgatttccagagtggttgtacaaactagcagcaagcattcttttttttttaatgcttttatttctgtctctttacttgaaaaggaatgagaaaataattctttattttatgttttctagctatgttcctgttaattaattgtcaaaagacaataagaaaaatgaacagaccttattagcatatggcatctctgttaataagaattgtttggggcctgggttttatttggggggggattgggttttgttttgttttgtttttgtttttttgtttatggaaaggaatatatataatgatttacagacaaaatgttacatattccccttagataatttaactaataatgcctcactagataatgagaggtttgacaaaaataacctattaaatgaataaatacatatgtattaatatttatcatgaataaatataggtaattaatgtaaaagagatattttatattgactgaaaatgaaatatagaaatttatttataataattgatgataagtcccagaatagctccatacttttatatttaacattattttatgaatcctttcaaaatctaatggaatggattttgaacacccaccccaccccatagtccctcccatagccaccctgttatattcctattcaactttgggatttttctttactttccatggaaaactgaacttttagcaaatagagcagtgataatttgctatgaattcttaaccaaaagtaaaattgatttagtgaaaaaatagagaaaaaatattatgaaaaacagatgattagacttctgtgtggggctccatcttcttttagtttttgtgttttttggggggctgaggagagttatgctgttcttattggaaatcaaaggcattcgtgtaaagcttctcaagtggtatcttctgattgccactgttttaacattgaaaataatttgacataattgccacatatcttcgtatttttcattcattaaaatactgtctgagcatttacctcttattttgagagaatattaaacagtgttctgatgtatgaaagcaaataaggtcattgaaatgtaatggcataccaccacttttttttggttttggttttggttttggtttttgtttttgtttttgtttggtttttgtttatttgtttcggtttgcttttttgagacagagtttctctctatagccctggctgtcctggaactctctttgtagaccaggctggcctcgaactcagaaatcaacctgcctctgcccccagagtgctgggattaaaggcgtgtgccaccacgcccggctttataccaccacttttacagaatgaagcatacaaaattcaaacatttttattgtacatactacaaatatcacttccttgtggtttaacatttaaaacgtattaagtgaatgagcagtatttgtaaggggatgtctaacaactttttttttccttttccattttttattaggtatttagctcatttacatttccaatgctataccaaaagtcccccatacccactcaccccccttcccctacccacccactccccctttttggccctggcgttgccctgtactggggcatataaagtttgtgtgtccaatgggcctctctttccagtgatggccgactaggccatcttttgatacatatgcagctagagtcaagagctccggggtactgattagttcataatgttgttccacctatagggttgcagatccctttagctccttgggtactttctctagctcctccattgggagccctgttatccatccattagctgactgtgagcatccacttctgtgtttgctaggccccggcatagtgtcacaagagacagctacatctgggtcctttcgataaaatcttgctagtgtatgcaatggtgtcagcgtttggatgctgattatggggtggatccctggatatggcagtctctacatggaccatcctttcatctcagctccaaactttgtctctgtaactccttccatgggtgttttgttcccacttctaaggaggggcatagtgtccacacttcactcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataaagctgctatgaacatagtggagcatgtgtccttcttaccagttggggcatcttctggatatatgcccaggagagatattgctggatcctccggtagtactatgtctaattttctgaggaaccaccagactgatttccagagtggttgtacaagcctgcaatcccaccaacaatggaggagtgttcctctttctccacatccacgccagcatctgctgtcacctgaatgtttgatcttagccattctgactggtgtgaggtggaatctcagggttgttttgatttgcatttccctgatgattaaggatgttgaacattttttcaggtgcttctctgccattcggtattcctcaggtgagaattctttattcagttctgagccccattttttaatggggttatttgattttctgaagtccaccttcttgagttctttatatatgttggatattagtcccctatctgatttaggataggtaaagatcctttcctaatctgttggtggtctttttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttagctcccttgtcgaagatcaagtgaccataggtgtgtgggttcatttctgggatgtctaacaacttaaagttaaacttttcaaagtcaaacactgtgcagtttgaagattagtttgaactcatctatatccccaaacacttatctttctaccttaatgaaaatatccaaaatgttttgactgatggtttaaacttgacaccgaagtttttctatctgtagttacctcaccatgtcatatcttccagggcttgccattcctatttactttaattaatggtgataaaatatttcaaagaataataatgaatatgatctcagagaaactacaaaggtctaatgagcagctgtgccacctgaacctgtggctgtgtgtctacttcctttcaaaataacaaaaatgatataagatgcaagagacagaaaataaaatccaaataaaataagacaatggatttgaggctctgcaggttttgactctgttttgtcttcatgataaaaaagaaaaaaaaaactggctatgtgagttgttataatgctgctgtcaaactccaaaatcagcttatgggagctgaatctgacacaatacaatagcaaacattgcaggtgtctaccacattatcttgcctattccacacatactgtgaaaatgcagctaggcagtagctgagaagcacaaagccacatttccctcctttgtcccatagttctatttgattgcatctagatcaagcactatagctggatcagataatataacatatttgaagcatcgagatgtgtattacttctggaattaaatgaaatcatattttaaataaatgggattcactaagacatatgcttgtgtgtgtttatgattgtcagatgctaagctcttgtagattgtagagtcataagatgaaaacaatttaactaccagacttaataatggaggaaatatccttgggccaaggatacctataagtacaataggaacttgagcagagtaaaaaatttaaagctattgaaaggccatagtatatgtgttatattaactagacctcttatttggtctcaatattagttttgaggtctttatgatttcctccaatagatacacttagagtctcttatggttactaatttcacctgtgtgtgtgtgtgtgtgtgtgtgtgtgtgtgtgtgtgtgtgtgtgtgtaaagtgtatatgtacatgtgcacaggtaccatagaatagttggacaagccagaatacatatcagacatgggttcatactttccaccttgattgaaatggaatctcttgttacctgctgcgtgcctcaagctcactggtacattagcttgactctgtctcctctttcactgtagaagtgctgttggctttacatgggctttggggatccaaaatcaagccctcacacatgtgtggcaagcattttacctgtttaactatcttctcttactgttaattttctctgtgtcctatgggggagtcattcatcacccataatcctatggaagttattgttttttaataacatgtaatatgtcctgaattgagtggtctctgatgtcattcatctaattcttaaattcttttacttctccgtctttctccccattcttccttttctcattccttcagcttgttttatttttgtcaagtgaacacatactgactaaactctaggctataaggatccctgtaaatcaggtataagagtttagatcattgcaattaggcatgaaaagtaaagttgattgccattcaagaaggagtcaaacttaagcataaaattaggctggtcaaggttatgttcattacatcaaaggttatcttagcaaacatattacagttggaattttagcattcatatcatgaactttatgcaagttatagaagtataaaaatactttataaaaaaacttgaacttattaatagttatgtaaaattctatgcatgatttaattaaaagttgggtaaaatataagtgctgaggcatttgttccataaaatataaatgagctacagccaaaagcttctttctttctttctttcgcattttttaatgacctacatattataaaccaaaaatatatttctcttggaacctgagcctaatggataacagttttctaaatttatttggcattttactgctaacttttaattatgactcaaagagcaatcacgaaagattgagagctatggtagagtgcctttggccataccataataagttcccatagaaaaagtgaaactttgcttaaaaaaaaaaaaaaaaagcttacggaataagagtttactcaaattcagacaaatgaaagcaaaatgaacacattaatatttgaatgtgaccaatgccacacattctctgctagcataattgcagccagtaccctgaccaacagtggattagaacatcactttccaatttcacatacaattcttacgtgctgagatttaaggtttaccctaacattcccttggaaaatagcttatatcaatatcataattaaaatattagatctaccatgtaccagagagatctatataagagacaaaggctgcattctgaaaatttttcccaaatggaagatttctctgaaaataatgatgcctaagcaatggtttttagcatgacaacacctggctaaatgagtttgaaatttatatgtttatgtatgtgccttgagatctatcccatatccatgcactttctcaatctttggccagtgatataacctttgctttgaacttcagttgatctactaggagtggctgttattcatactttagtcctcactgatcttccgacttattcttgacttactggatcttgaatcaagctaatgctttgtaaggtcaaaagtttgagtagttctgatgactttcaaagacaaaaataataccaaaattgactcaggtataaaggactgaattttacttcttaaatttgctcattgataatttcatacatccagtgcattctgtttattctaatctcttcctcaaattcccctcccacgcctcctagccctttattcttccctgtaatttgttttgtttctgtttgtttgtttgtttgtttgtttgttttgtgacacactgattttattctggttcacccttgtgtacacaggtagatcctaaagcctactggctcatcatttgagacataattgaaggcaataaaaatctgtatcacagaatccatcattgccacatagttcagcatgaaggatgctctaattgtcattgctggggtcatgacaaatacccaaataaaaagcaccatggtagatgaaagtgtaaattacagcccatcaactccatcatttggggaaattcaaggcagggtctcaagtagtatgaaatatcatgcccacagtcaagatcaaagagagaataaatacatctttgattgcatgctctcagcctgatttttgctcatttttattgttcagaatatactgggtagggaacggtgctgcccaaaataggctggctacatcaactaataatgatgatggggtggggtgggggcagattggaaatggactgaagccccgaggaccagcagaaagaatggaaacaggcaacctcaggaggtaggaagttggaaggaccctttaaaatgtaccagagacctgggaggagaaagacactcaaaaatctaaaagaggaacctgagacaaaatgtcctacagtggagagagagaacttgtagagcctaccctctcagaaaaacaggacatcaaatgaaggatgggttgccatcccacagtcaaaactctgacccataattgttcctgtctgaaagaggtgcaaggattgattggagaggaacctgagaaaaagaaggtccagagacaggcccaaagtgggacccagctcaaggggagggctctaggcctgacactattactgaggctaaggagcactcataaaatgggacctatcatgactgccctctgaaagacccaaaaatcagctgaaagagtcaaatacaaatatttgtacccaatcaatggatagaagctgctgatccctgtggttgaattagggaaaagctggaagaagctgaggaggatggtgaccctgtaggaggcccagcagtctcacttaacctggatccccaagatctctcaaacactgggctaccaatcaggcagcatacaccagctgttatgacacactccaatagatatacaggtaggactgacttctgggtctagatttagtcagagaagatgcacctaaccctcaaaagactggaggcaccaaggagtttagaggtctggtgggttgggggcatggggacatccacgtggagacaggcaagcagggaggaggtatgggatgtggaccagtgggagggtggaccgggaggggaataaaatctggagtttgagagaaagaaagaaagaaagaaagaaagaaagaaagaaagaaagaaagaaagaaaggaaggaaggaaggaaggaaggaaggaaggaaggaaggaaggaaggaaggaaggaaggaaggaagggcaatttccatagatgttcccacagactaacctgatctaaacacttctttgttaacattctcttcccagatgatttggagtagttaacataagtgatgacagaggctccatgatattcttctcaattcaagattcgctattgacacagcaagtttagtgcacattcaatgtagtcaactacagatactgtgagatcttgtttgcaatggctatctaatgccctctgctcttttctgcaatttcctttgtaacttagttgagatagtgtaaatgtcttgtttaggttgagcacaaaccaataattatttcaaaaacataaggctgagatgtatggatataccagcaaacatctccaacagcaccatctgaactcattttctctctgagtcatagatttcctccattttggagccatttgtttggcctattatcacacacagcagcaaggacttgcaaggttttatgttattctctcagtttcagcaaggatgaagaggatttttactttcttagcagatccaaaacattcaaacattgaatttcactgcactgtgtgaattgagtcatttttctcattcctgtgtggtcagaagagaaaacatattgattgtccagggatgagtaatatactcctgtttagagcagatgattgataatgaatgattccaaaattaaaaacattattctatttattctatcatcatcatcatcatcatcatcaattaagagaagaacaggtgagtggggaaggcacaagaaaataacaacaaagcaagtgccctttatgtatttttgtagtaatattagagaagcctaagtacgctgtgatcaaaccattacttcttttcagcctgatctgtcagaaattgcagcagttgcaaagatcacaaattgcaataacttgcaaagctctgtatcatacacaaccttttctttagactgcatctctaaggatctgtgatgattaatcaagatcaaagtagtattgctaaggggaaataatgatggtatagccaatccccaaagagacatttctagtttaaacagttcaaataatcagagtgtaattttcccaaattcaaagagcctatccatcaattgagagttgaatccaaactcttcctgggagagtaactgcaggaaagaaattgattgtgttgagtttcacattaatgttgattactattctttgatgtgcttcagaattttctttaaaaatgtgatcaacttgtggcaaagagctcttcatatccatctctaattaagcttgtctttattggccatattcagactcattagaaaaaattttattatttgaatgtgtgtcgtttgacttcaaacagatttactcttacttacatttaaaaagaatattttagaagttcatgcactttgagagcaatgactggtctgcagtggaataaagtacaataaagtgagtggtttagatcacgattaggtatagaaggtaatgtatatataagcctgttagcatcaagggacttaattttcttatccatggttgcagattgaatttacaataaatcatagcactaaaactatattgatccacaaatataccataaaatgaaaaacaaagtagacatgaaatgttgatgtaatttaatactaatttagtaggcatgttcaatgtgacttttaaaaagtattaaaacaactttcaggatagcatttaaaatgtaaataaagaaaatatgtaataaaaattaaaaagtattaaaacagtattgtatattcaatgagaaacaatgaaacacataaactatacagctcaccatttcaggatcggtggcttgaacagacaggcatattgtagagtctactcttgtcttcccaagaaaagccttatatgtgtgtgaagtaagcgtctggctacatattagagacctagaactcagacattttctattcattactacagagttgtgcagaggttgactaaattccctatttcattttcattttcagcctcagtaataagccttacagagaaacatgtatagcccctgaccattggcagatattttgggggcattatgatgcaagatttcagcctcttcttaccaccaagttttcactaccatttttatttcttattcctgtaaataaggatgcacgctgtatctggtttagacctttcacatttctgaaagttcgtttatgtgctttccaaagaaaaataaggttgtccttgtattcacagagacccacctgtctcttcctctccatcactgagattaaagttgtgtactatgatatccagcctaataaaacattacataaaacatagatacaaattttaaagttgtgtactatgatatccagcctaataaaacatagatacaaattttatcatctacccatcacataagacaacatatcctcaaataccctttccacttaagtttctatttcaaataaacatgcttgactatttgaaggatatatatttgtggaggtgaaaaacatgaaactatcttccataattttgtggtgggagacttaaagaactatttcttactcctcagcaaccaaaatgaaagcctgaaaattgctgcttttctgtacaggcattacaacaaggaagggctcatcaacatggaaggcagtgtctttaataagtcatagagacacacagatatccactgaccaattggcgctattgttgagaattcggttctgaagcatcagcattcttttatcattacatactcacatattttcacttcttctctttgccccttcccattcttgttcctccaaataactaaaaaatgcaccccatggcttttctctgcatttctgaaagttcattaaagactcattaaacttctgatttcattttacaaacactgagtcatggtgtaaagtcattgaactggaggtcatattttaaaatgtttcaaagcaattacagaaaaacccagcaaggtttccatttttcccatgcgttaaactgactttgtcttccctcctcttggtggacatttcaagaaactctaaatgaagaagtgatcccatgggaaaagtatgaagtgtttgattgacaggtctaccacaactttacataatacagaagtatggatccatagatgaaatcagagtgtttggtttgttttaagcagaaaaatgatctaatggatgatggtataaagtagttgttgcattttggaattgctttgacatagatcatcagtaaacccccaaaaatgccatgtttgaaatgttaaatgtgacactaattatattaaaataattattgagttaatcaaaaataattatattttcatgacttcaaacctttaatcctctacagcccaatgatagtatgtatatgtgtgtgttcatatgtgtgtgtgtgtgtgtgtgtgtgtgtgtacatatacatatatattgcattttgaattagtgcaggaaaatgtgtacgaaaaaactcaacacagttaactgaacttatttataagatgcttgaagtttgtatatggtcattctcattatcttatctttttacttagattttaccaataagggctgaacataggaggattatcacttgtgaaatgtaagatgacaggtgcaatcgttttcatagttgtctagaggaaattgtttaatgatagcatcatcttcttttaatgatttccatggcctagaaaaaaataacatacctgttttcccaggggtaccatgagttgaagaagcctttattttcacatctgttattcaggttattttcagtcttaaactaacaagcagtttggagattgctaaaatatttgaaacatagtcacttttgccattaaaaaattttggtagatataatgcccggtcacaatttcaccatagtttatttttatccttgagttgaattaactggagagtggtccatgctaaatgacttaaagataaaatgtattttcccaacatctattttaatgccaagaaagacacattcatgcaataacagtataagatagatatactaataatcctgacaggttaacagatagtgtttggctcgctttttcttttaaatggtaatagaaaggaagaagaaatcagacagagttgaaaataacttatataagaggtgtggctaggtcaatatgctaccagtttaaaaacttttgtatatttaattaaactccaaaatgagtgttctgtatatttaaaatacttcacataaaaaagtctgggcacaatagggttttagcaagcaagcatatagggcacctaattaaattttcattccaggtaaatacttataatgaaaaggtatcaccttcgtcttaggaaggaaattttatctagacattttatagcatgtttggcaagcctacatgttatggtactcggtaccaaaagtcagaaagaatgacctgagagcttcttaacaaagaataaattactgtgtagaatatagagataagaagacaaagatagaagatgaaagagccatgtttattacataatagcactatataaaacttagaaggatgcattgctaatattcgtgtgtacaatttctcccttatgtaaatagttaaacctacacagatatttttatattttacaaatttataaatggacatcctgatttaaacttgtcactaatcacaacacaaattaacaaaaaattcttctatgactctgttgattagttagttttgaagaaaaattgcagtactttatgactctgggaggttagttttgaagaaaaattgcagtattttatgactctgggaggtaaaatttggggtttttattgttttccttcttgttcattgttgtggtggcaccccgaatgaacccaggtcttggcaagctacacatgataataactttaatactgaatccatctcagaccttgaagttttcttgaagtgtttaagaacatttaagggcttttagaactcatcaggaccaatccatgattgatgcctgaatttaaacaaattttatacctatggctttagtaacgaaatatgtttagggactgctgttagtcagctcagtgattaatcagtgtagtagtatgttttaggtaaacttgaattgacataaaataataataaattttccttgaatcaaattaatcaatcccacagtatacaagggctatatgagtagtaggacttctatcaaacttccatggtagtgttgtcaagtccttaactgagatgtttacaaagaggccaaaaggattatcttatgtcagggtatctcagaaaggctcataatgatggactgaaataattccatctcaggaaactagaacttatccattatattgctttctccctccctctccctccctctccctcccttcctccatccctctcccttccctccccctccccccctctctctctttctctctgagtctggaagaacatatatatacacatacatacatatatatatatatacatacatatatatatatatatatatatattaacgttgtcaacagtgatgtaaacacttctagtatgcaaatgacacttaaataagatatcttgtaccaatgcgtttgtgcaagaataaatatctaaagttcttctttatatatgttatttttaatcactgtgatggttccgatgagtgacgtgcttttcaattactctccaggtacctttgatgaaataaacagctgtaacttgatgataattcagtaaaggaattctttcctcttttacagtttctttgaaatagatagcaggaaaagccaaaggaaatgaaaaatcagggtaaagatttacataacatttttaaatagaaagaaaatcattgttaatccctctttttaagaaaatgtcttttgtagctcaggctggcttcaaagtgaagctcagtatgctctagaacttctggtacttttgactccacctctaagttcttgattcataagcatttgtcaccatgaagaatttgtgtcaccaggaaatgaacttagaaccatgaacatcctagtcaagaaatctactaagtgaattatactccctcctcttgcgcatttctttatttagatatatacttagtaatgtgttaatcacctcagacagttgtcttaacggagatttgtttcctgaactggaagtctacagtagagctggcttagtaatatttatgatcagcttattgctattattatgtaaaggccacttaaaatatctccaaagcaaagtcaacagattcaaatatcgaatgaaaatatcacaacatccttgagaataagctatacttatatagtgagactctactccgtggttcaagtcataaggtcgttataaaggagcagccttcatccctaggacaaataacattgacttagcatcaactgaaagaatgaaatatctccaacaatttcttcttataaaacactttacatagtacatgaagaaaaacatttaccttgttaaataggacatagactatatgcacctatctatgttatatgaatattctacttttctagccagacatatagtgcatgtttttaattccagctttcggaggagacacagagatctatctgtaagttcacgtctgatgtacaaagtgagtttaatgtcagtcagaactacagagtgagaaacttaccatagattcttaaacatagacaactacatcttttgtatgtaagaagtcaaaatgaagagggaaaaatatatcagacactcaagaaattagaattacattttgataacaacagatcagatagatatctgtcctatgctgaaatagatttcatgttgcagtgaggatgattcagtaatcttggacttattactctgaatatcatttttagtagaattgaatactattagtaactatgtagagaacgcttcatagaatctgaaataggagataatatctataaatcatactttttgatctctgtgtgtgttttgtttttgataccaagttaactttttcacttgtttttaacatttcagtaaaagtcaactgtcaaatgtcaactttcctgtcaaatgcagtctatttagttttccctatctcaactttactaaattgcaacaataaataaaaatttgaatcatttttaaaggtgtgttttatttttagttgcacaattcttgcaattctatcattcattaaagggggggtattcttttatacctaacacaaagtcaccagatatagttaatataacaggcaaaggtattagtatcaagaagactcctagtgtcttgaaaaaagtattgatcatttatgtgcaggtactcagaagtgaatgctaaacaaggagctacttagaatactagatgcaagaaattccacttaacaaaaacccataaaaaacaaaacatgagcattttagaaaatgcaaagctctacagatattgacatttgaaatgactctgcaaggtcttaataaagccatataatgaataaacagaacaaggaaacagagagaccactgggcttgctattgatcaaactctctggagcattgtgtctagtctcaggataccctaacagatcgtgtaactcaagcaaaatgctgagagaagtagagacactcacataaaaaaagaaaaaatgagatcttttccctaagaactgaggtgtttgctagcttaaaattccctaatttaagcaatagacattatattttatataaagtaaaaaaatttggttaaatgatgacctaatgttgttcagttagccttaaagtaatttgtttccacagcaactttgtattctaagcagaatcattgatgtagtgttgtagagattatttttccttcccttcccctttctttctttctttctttctttctttctttctttctttctttctttctttctttctttctttctctctttctttctcagggtcgttttgatttgcatttctctgatcactaaggactttgaacatttctttaggtgtgtctcagccattcaagattcctctgttgtgaattctcagtttagttctataccccattctttgattgggttgtttggtgttttggtggttagcttcttgagttctttatatattttgatattagccatctatcagatgcagcattagtgatgattattttcccaatctgtaggttgtcgattgggatgctcttaatgtttcatttcaaacattacctttgattgtcatatacagctgtcattattaaggaattttgctgtataagcaatatgagatagcattgcaatatttttaatcatttatcctggttcatatatgctctgtatattcaacagaaagatatacaattaattagagtgccattttgaggcactttaattaagaaataagcagaacaatgagactgtacagttaggtacagcataccattgagaaaagaggatcattttaaggtcctactaccagctgtttcttctgcatgtaagcagtctcttaaaacatgttgatattgcaaaaaagggggggagggaagtcaaataaatgtctatactatttgaatattgatgagtgggtatggggatgtggaagtttctaattttcattcttgtttattttattttattttattttattttattgcacaatagcagtgacacagatatccacttcccacatgatggatacataactcacaaaaacaataataaagcaattcaataaaaggtaaggcagttcagaaaagtagaagtgaagattgtacatatatttgcaaggaagatatggggagaagcaattctaaaaatggaaatatgaaataggcttcctttgggaaaagagcctaacaccttctgcaaaatctaactaattcttctaggttttaatcacgagagatctctctttagctgacaaatcaaacagaggagtactatttacagttcccaaccaaagcagattgaacttaatgagcctcattcctatggtaatgtgatatttttcccctttctgcttctgagatagacaaaaaaaatatctaggtgttatcagatcatcaaatcaactttgcaagatgctaggtgtttgctagagttctgcaagaacagggaaaaatcttgccagataaagtgaattttagggtaaaggactatatgctaggtagagatttatatgctcgtggcatcctgtggttaggtagttggtggatatgactgttgcacatgttatttacagaagctctgatttcacccccaagagcaatacaaaatctaaccagacaaaaatacgagtatccatcaggaagaagttcatgaagtttcaacccctgatgaagagctattaccaatagatagttgctgaagaaggtgaaccagaattcttcatggttactgtcacagagaaacccataagcacatagacagcaagcagtattaaatggactgagtaggaccttttttttttttaaaagagtatgctaaaatgtaaagaaataggggacaaattgggaggaggatttgaccaatacatattatataaatgaaattctcagtaagaatttttacttatttaataatatttaaattaaattaaaaataaaagaaatgggattggtagtctagaggaaggaagaagatgttcttcttactgtattgaggaaggtctcagatttctgatttctggatttacatattatttggtaatgcacccccaatcagtccaacaacaacaaccaacaaatggagaaagacaagaaaaagaagcaaagatatgacacacaggaaagtagaacccaccttattttttttggcttttgcaatatgcagtgtggtcttgcctatctgttgaatacgctctggttttgtggtttgacttaaacaacatttgatacattgccatgtaagagcctccagaacctaagcttcaaggtgcctcaagtaagatttgttttcctggggagttgctcttgagggttctatgaggaaccaaggctgaagctcattttgaaggagcatgaattgatcttagtaggaaactagcattcatgtcagacaattctttgatggtatcatatctctcagactaggaaccctatgaaatatagagtcatgtgagccactaaggtggtaaaatgcaatatatatatatatattttttttgaaggcttatgttcaacctcataacagtatacaaataaaataaacagctcttttggagtcagaagtcatttatcaatctttttatacttaagtgctttattgatagttataagaataccaattatagggttttggtaaatgtacattttattacttgctgactagttattatgttgttttctgaacatactcaaatgttctacattgactatgacaaaaatctaatgttaacaacaactattcagttttacttgtctgcttttattttagaaatcacaaataatttaaaaataacattttttagaaattgctagagtgaaactttttattttttatttttaggatacaattttaaacattgtaagacatatgcaagaaatacaaaccttacaatagtgagaatacagaacagtctcatttccatcaaaatatcagttatataacctactttactttaagaaaccctttcccatgaaaataattgatctatcttaaatcgttatgatagtcagttttcatgtatgagcaataaaatcacacaatagagcatactttctcacatggaattgactaacatggtattattttaaaatccaatctctattcaagtcatcttatcaaataaacccattttataatggctcttacatttttactttttttagtgtgtgcgtgtgtgcatatgtgtgtgtgcgtgtgtgtgtgtgtgtgcatatgtgtgtgtgtgtgtgtgtgtgtgtgtgtgtgtgtgtgtgtatgtgtatgtgtgtgtgtgtgtgtccacagattactgcaatatcccataaaagctagaagggagttttggacttcctggactggaattacaggtttgttctttttttttttaattaggtatttctttgtttacatttccaatgctatcccaaaaattccccatacccacccccacaatcccctacccacccactccccctttttggccctggcgttcccctgtactggggcatataaagtttgcaagtccaatgggcctctctttgcagtgatggcctactaggccatcttttgatacatatgcagctagagacaagagctccagggtactggttagttcatattgttgttccacctatagggttgcagttccctttagctccttgggtactttctctagctcctccattgggggctgtgtgacccatccaatagctgactgtgatcatccacttctgtgtttgctaggccccagcatagtctcacaagacacagctatatctgggtcctttcgataaaatcttgctactgtatgcaatggtgtcagcgtttggatgctgattatggggtggatccctggatatggcagtctctacaaggtccatcctttcatctcagctccaaactttgtctctgtaactccttccatgggtgttttgttcccatttctaagaaggggcaaagtgtccacactctggtcttcattcttcttgagtttcatgcgtttagcaaattttatcttatatcttgggaattacaggttttgagctgaccaatatggatactgcaaactaaatctgacctcacaagaacagaaatggagcttaaccaaaaaactttctccagccccaattcagccacttgtaatgctgagttatacaaaagattgaagcaacaactccaggttgatttttaacagagattaatatatacatttacaagtggaagatatgaaatattttatgatatgtgggccacagactgaccactagtagatagatagacagacagacagacagaacatagatagatagatagacagatagatagatagatagatagatagatagatagatagatagatcatggatagattgataaattgggcaaatagatgatagatagatagatagatagatagatagatagatagatagatagaaagaatagattgattaattgattgagtgattgatttctgataggcagatagatatacataatagatttttactaatataaaagcaattgtttggatgtctgcttagaaattaggaaaactgactccaggtaggattcttcctgtaagtttccttcataggttcctgaaacatgaacttgctgaagttaacagttgatgtttggctcttgttagttccaatgtctcagaagcatgggcctacccagctgctttcagattttgctaattcctctatattactcatgatttcatgactacagttcaagagaagggtgttgacattttcatctatgcctatttatttttctgtttcttctttttgtcagattgtctttgatgtattccaaacttctgctgtcatataacatcattaacaatatgagtcaggaggatcttcctggtgaactaactccctaatcagaatactgtttcatttgtcttccgtcggtttacttattagaggcaggatctcgttctctagcctaacattattgctattattttgacaattattcgtcacactttcctaatattaatctttataaccactttttccacaagtttttttcatgagagaaaaattaaatgctatgcagtccaagctagcctgagcattacagcttattttcctgcctcagcctctagactctagagtctagaatgctgggattacaaacataagctagcaagcctgacttttctcattagcttcaacaaaatatcattaatataatctcaaaatacctctacataagaagaaatagcctaaaaataatcaaaattacaaaaattccccatgttctttgcccctacttgtatatacccactcatgttattaagatcctgtcccagaatagtgagtttgtcactgtccaagagccttaattgtcctcagcagtgaagtgttcattcatagtttgaattcaattcttcacaaatttgcatattttaagcatgaccagagtttttactgtatgtacactaaattaacatcatctacattagtcttttaacaaaataatttttgtggtatctccatccatgcctttctacctctgaacccctagccaactgtcccttcaatccctccagtgatttatccaatatgttgcctttcagaatatctagtaacacacatttaagttttctctgtgcttcacatgttactagaactcattgaattgttaccatcaaataggtcccctttcatgggcataccacattgtatttattttttcacttactgaagaatgttttggatgcttatatcatggagacttcataaaactataaacttctcaggacaaattttcatttgaacctaggtttctatctcaggtttgacttggttagtagctattaggcatccttcttttccattttctctttagtcatttgaagtttgtttttctgttctattcaataattctgtttcttttccagtgtatctttttctataccttcccaagtgcctactctagggattataatatctatattaacttggtagtatgtaggggctaaatattactatttccgatcttctatggaaaattgtagagaatgattttgagaatggtttttactccttagactcatactattctcataagaataacatctatatacctttttaaaaaggcaaatcagctataatcaaattctacaagtaggaaaggatagaaactatctctatgccacttcagaaagtactgtatttcagaattatacaggtatccaaacttctgactgattggccacatgtttagaatactaccatactctcagagtgactcgtggaaatcagaatatttttctacttataagttatctatgatgcatataaatcagagcaaatgaataaaagacacattaataaggtctaagagagaattttaatagtttctccccatgcaagtaagaaagccatccccagttttcaagtttcactgtgcttcagcatacaatattattgaaaatttgtttcataggcatgcttgattgagtcacaaatcatatgattaatttcaacatttaagagtactcccttacgtgtggtgaggctaactcaaggataatcttttataacaaaatgatctttctggtattgtttgtcataaatctgaaactatctaaggatctgtgctgtgttccctcattggtgttaatgaatgcctaagacactcttagtacacaagaaattctagtgtgagttttggaactgaattcgagataaagggacaatgacagacaaattaaaaaatcaatattttcattttttccactattaaacgcattatagaattaccataagaataaaaataatctttgtttaaccaatattcttcattttgtgtctttttgcttttgatatcttgaggtgtttgattttttttttgactaaatatcttcattttactgttagttgctaaagatgtctttaactagatcattccatttctatctaactctactgctcatgtattgctatacttccagtttgaccctgggtcttagaatatatgacacatgaattctcattctctctaatactctgagtagtgtctagtccatatacatacagtttggaatgggtagagaatgccatagaaacatattatggttctattgccaagtacctacctttttacagctcttgcagtcatttccatttccttaaacatgctatactctcttttgttcccttgataaaacaaaaacaaaaacaaaaacaaagattgcattcatcttgttcttctaaataatttctcaagtgatatcacatctctaaccaaagagtagaggccaaaaagcaaaagcatcaatgggcaaactctatcataggattcagagcagaacccacccctcccacaaagtctgggctttgtgtggacccctgacatctgcagttgttacctaaagtgcattctcacttgaagcctggattgtgggtaagcagaatagacagagataagataatatgtttctacattctttacaaatgctagaggagtctttcctaacactgattgagctggaaatggagaatttacctgacctttctctcctcctacttcatagagctgcactctagtacactacttaaggcagacaattccaatggagagaagataccaattgaaatccttgtaggatccatggtcattggtaatctttatttatcctaccttcctgattttccttcctggatcctcaaatgagtattctatgcattctgttcacagctatatttaatgggacatgcaatgtaatatagctttttccatttcattcaggtcctgagcctggacttcttgaaaacagagtagacgtcatgtaacagatcctaagctaagtgatctataaagatgatctctttatctctgataacagactgctggggttggtgcagttgtataattgaagacactgagaattcaagaggttacatatcattcttatagtaaagctgctactgagaagtctccatgctcaagtgcttaggacagttgggtggtagagcagaggacctcagcttgaaaaccgagaataggaagggaaattggtatgaaagctctttgcagcaaaacttgaattatgtaataatgctgacaccaaatttcttctttcatcgttttgtttgactccggtcctcctgccaaagtcttcccaaggtcagagctcgcatttctttgcaatcagaaatgtgcttgcaaagcttcttaaagctctaggaatccagggggttagagaacaaacctttgctacaaacttcaacaattgcacagtagaatgcagaaaaacaacagactttttagtaatcctccggctttatcctatgatagcttagtttttttgtaatggctgcataatgatcttcaaggaaggttgctggcattttttagcaaactggggttttattccagcattttcttttcataatacatataaaacatttaaaaacagatgcatttttttttgttgttaacagaaaaattatcgtctggaattgcattaaattgtatgaaatgccttcaaacaaaattttcattatgcaaaagcctgagggaaggtcccatgttaatgattaacataaattgtaagataattacaccttgacttgggactttgttatattttatcattgatttccttttaaaatatgaaatttcatacagtgtttgtggtggtgttttttataagtttaaagccaatacaagatgcatgtgttgacagagtgatgacttgtcatgccacctcttcaaatatctacagatgacactcactgggttttcacccagttctttgtatgtcattctgtccccactttattttattttaaaaaatcatttttatgagtgtggtttctgttgtgtgtttgtgtgtgtgtttgtgtgtgtgtgtgtgtgtatgtgatttattgccattaatttaaagatctggattttcatatcatgggaaatggatacttttcataactgataatcatgcaatatcgtgaactgtgggaaatactataatatgactattttaagaagtcacagattttgactacccaagtgcttgtcactggaagctttgtttcctttgattttttatttcagaaatatcagtaaataaataatacatcactacagaatctaggaagtaaactatcattcaaaattattagattagttgcatagtttcaagtatcttgatgacaaatcaattttagccttggtaagctacagagagttgacttagtcttttggctattctataattttggagtgactacaaacatagtattccatgatttcccctcagcaagattatttaagctgatgtgtgtggcttggcagcagtggctgtagtgctgaccctaccaagagctagttctcacatgcctcatggatgtccatttacttatctcacagatgataagccatccttcctggataagctgggctacttcattaattacatggcagaatttgttacagaaaccaatttcgagttttacctgataggcaaatctcatgaatttcaaagaatcaggacagaggtttaaagacgtttgttcactggtaatctctgaagactttatgccttcgatggaatcgatatggaggagcacagttggtagctgacttccagaaatgctcactcatgagatttccctggaagttctttctgctcgctctatacagggaccgttgtttgagagccagcactccagccatagagctttgcttatggagcagttgcttcttggaacagtcacactcattcctacaggactcttactactctatcatctgcctcatgacatccagacacagcctacttattactttataatgagaatgtcaaatagcatactaaattcattttccttgatatcagaagctctgctaacgttaatgttttataaatgtctaaactgcattttaaaaacacaatgtttgggaagacaattataaaccaatttttaatctttttctattagctattgtatgtgtgactccagaagtcgtggcatttagagtagtcaaagtagcctgtggctctgctgtgcccatgggcatgccatcctttgatcaggacagtccccacctgaatttttgagttatttacatttccagtctgccctttggatatgtgaatttataacagacattcgaagaatgtaggggtcttggaaacagcacaagtggcatggctttatgtttttctctccctggaaaaagtataatgatgtttttgattccttgtctaatactagaagctgttgaggggcatgggttagttaatatatccaggttagtatcagataaaaatgagtcaatatccttgaagtttgtttttttcttctgtgaacataccttcagaaatcagaactgtcaatttttggcatggttaatataagatggaaaaggtatcctggcattcaggagaaaaggaatacaacaatgtcacactatgtacaaacatcacacaagaggtttttaggaagttaaaacccaggaggctggttgcctctgcttaggagagaagcatcagagaactggatagaacaagtttatatatgggtttggggagggcagcttactagggaagcctggaaatggggagattgatggcctgatcttgggggaagctcaggggtcggtgggattttttttcttgtgagtgggacttgactactcttctgccttgggccttataacattgttatagccattaaaagccagcccttatggctgttagggaagtctggggaattttcctagtggctgaaactcctctactttcattccttaaggttttagaaaatttacaattatacaaagtttacagaaggaatatctgagcaaagtttccctgtcacttgaattggtatgaatagccaaccgttgcattagtataactgtcagttaaaacgaagtatattaaaaatgaacaattttcaatcaacactataatgtttataatttacattatttgatagaattgtctatttcattcttttgtttttataataaattgacttcagttatatgtgggactagttattcttttagaaaaaaagtaccagtaaacatgtttaaacttgtctgcaatataatttttcaaattccatttagatgactgacatcctagacacatacacacacacacacacacacacacacacacacacacacacacacacacacacacacacactcctatcactgaattggttttctgggataaacgtgaccatagataatggtgcagtatgcattctatgacagctaaaagggtgagactatgtgaagacttatgaatggaaaccacagattgatttcgaagttctaacatatcacagaaatagttaagaataaatgaatcatattaatctatgtgtctgatattgtgggattctagatttgatgtctgaaattaatttcacagggacaacctctattcttccaaagacagttctagtctcacatcagaataaaacattccaaggttcttcaggtgatcttttcaagtaattaaacagaacatatgtagtcattatgttctcaaagttagtgagagatgtatatgctaactccagtattttctttcttctgttttctttctcattttcattaaatattatcagtattacctcacgatagtcacctcttagcaacactagttttccaactgccacctatttcccatgccactctgacttgtactgctgcatattgcaagccatgtaaggtttgtattttgacagaaatcaataggagaaaatccactggataacccatttatctcatttaccaggtccagaacctttaccatcattcaccagtactttggattttggaattttttttctttttctctagattcgaagatttctgtggaaactgagatatagtcagatatgcaggcaagtaaagactttgatcaaggcctcttgtggtccaagttctacctcgggtgcagtaggcagtagctttgaattaatataggtaaatatagataggtatagatgtgacaatgctggcttcattctgctgtaccacatgctgattgtcatattaaagggccctcctgattaaaagctgtagacatagcacagcatcttactatattattgcctttgtacacacaaaagagtcatctcggtgctttgtttttgtagtgtcactgagcaagaagctaccagctctataaagcagccgtgactgactaaagcctgaggataatgatagtgggaaatgggtcaaagtgtaaggaacagccttgggttgagagaaagcacttcataacgatgctgacactggcccagaggctctgggaaagaacagaagtgtgaccttcatgattcactgggcatgctggcacctgtcttgacatattctgaatagatgccctggagtagtatgaacccaaaacctaacttgcaacagtaacaggaattggaaggcttctctgctgggtgaccattcctctgtagtttgattggctaaatggcaaacaacttaattgcaaacttactgattgcaattataattattgttgtctgttgattacttttttttccttccaatcctccagaggttctcccatcttactagctcctgcgctggctggttttctccctaacggggtgtgtgtgtgtgtgtgtgtgtgtgtgtgtgtgtgtatgtgtgtgtgtgtatgtgtgtgtgtgtgtgtgtgtgtgtgtatgtgtgtgtgtgtgtgtgtgtgtatgtgtgtgtgtgtgtgtgtgtgtgtgtgtgtgtgtgtgtgtgtgtgtgtgtatgtgtgtgtgtgtgtgtgatagagaaatacagacagaaacagaatgacagagagagagagagagagagagagagagagagagagagagagagagagagaaagctggtatgcaatgacatgtagtcttgtagaaaaaaggcaaacttcttgatagtcttcacagcactccctgtcagttctttaggctgcttcaaggtgactgctttttgtgttacatttcttatcttgacattctgtttcaggagctgccagacattcattttattttcaatatgaatgcaaaaatctcacaagcttctgcaggaccgttgaagcttactaattagattcgttaaatagtactcaaaagcaaaaagaatttgtcctttattgcttttcttttttttttcttctgtgacttcctttccacattgctttattaaaaattttgttatgtttaaacacttcttggtaaaacgttggatcaaaagtgtaagttaaataaattttctttcattacaacattgttaatgtcaattcttgacctgctagtattctgggttttgggaattcatggagtagtcaaaaataagattgacataatgtctaattttggagctgcaaatgtgctaggaaaaatatcatagaaaaaaaaattgaaggttttatgagattaatttaaagaagacaaaattatctctattgctatataacagtttaataagtggaatgggtaagactcactttttttcttaaattgaaagtttctgagtattaacacatgcgtagatttagacaatattaggatcatacagaagtcctttttctctcctcttgttgataaaagtcaacttcagcttatgtcagtctgtcagttctctctctctctcatatatatatatatatatatatatatatatatatatatatatattctatactattgttatatctatctttatctaccatgcaccatttagatttagtattggcttctttcaattaggtcttaattcttttagaagttattccccatgttgcatatatttattgtcttttcttttataattaagaagcattctggcataattgaatgagaatttaccagtttactcactaaatatcatttgtgttctttctagtctgcagtcatgatgaacaaagtatgcaacattcatgttgaggtttgtggatgtgaagtcacacattcgttatcaattctataaggccaattaactgataagagctttctgactctggacacctggaaagttatatacagttctgaaggctatacttagctttttcagtgaacattcactgccccttcttttttgacctaacatacatgtgaattataaggtaaatcgtgtaaggtaggaccattacttcctacaaatccaaaagctaaaaatatcaccagaaaacatgtgaagcataggcagagatttctgtgctttgctgtaagctgcctacctaatgtcatttgaaagagctttgatttgtgactatcatttctttctgttcatacaacaccttcgtaagactgttattatgctgaaacttggtttttagagtgacctgaatgcatgagctctggctatgatcactcatgtttatctctagaattaatttccccttactgcctttgagaagagagctatttttgcatcagaagtgataatggatcacaagtttccaataagtctaaccttactgtaattgactagacatctaattctcattttagcatataaggtttttaaaaattctactctgccctaacaagtgaaaacatgaagaagcagaaaaatataaaatgcttctcagatctgtcagaaaagtgaggttgtgagacaaacagcctccaatcggccatatggacaaataggaggaatcagaaatgaatggaacattgattctggagaagacttctgcaagagagttagcaagatgggaacattaactgtgactccccaatgaaagcttagtggagaggatctaagaaaaaactgcagagaaccagtcacagggataccctgacacttggtgagtttccttcactgccatgtttttacagtaattaccagaaaccccctcatgttctgacagaaaagggattaaaagggtaagagagaagtctatatttgattaggtttattctaagcagaagctagttagccatacttgggccagcggaaatataatcagaggctaactactctgaaagacgataattcccttcctctgtagcagctctatatcactaatagaaatgtaaacatcgacagtgggagcattgatagtccatggacattaacaaacaggtctgtgtctccattcaacaattttacatcttcaacacaattttgagctgctgtgtctcttcctttgactgttaagatcacattcatcttacaacaaaaatttataggtcataaagatatgaaaaatagtttcgagaaatttaacgagttatcaaaattatcacaaatgggaaggacattagaactatatattcagattttttaaacaagctattatttatattccatgagcttcaggggggaaacaggcaacatctaagaaaaaaatggaatgtataaaaaaaatggaaatactatcagaaagtaaaatacaaatgatagagataaaatggtactagggaaaaaatggcattactacactggaaacatcaaggatatcactgtcttgtctaattttatgtcaatatgacacaagctaagtcatatgagaggagagaaacagaactgagaaaatgcatccctaatactgggctgtagttatgcctgtatggtattttcttagtgactgatgtgggtaggcctattccattgtgggaaggctgcatctgtgtagatgattgtgggttctacaagaaggcaagttaggaaatccataagggacaagctagtaaacagcactccccatggattctgcatcaaccaggctatgattccttcattgtctaaagccttgctctaagtttcttcaatgatgaaatatgataggtaatcataagcaaaataaacccttttctgtaggcttaaatttacttttaatatgggtagttaaatgctttaacctcccttctaactcaccacccaccaaaattaatggaaaagaggttactgggatatgagtggagtagacttgtttagaaatagttctttgtcttctgccagtctttgctgcaggggcagactcctagttggtctctgctcccatcaagacactatattctggttcaacctagaggacccttcgcactcagagcagttgagggcccgctgtactcagagaagttgagtggttaaggaccctctgtactcagagcagttggggatcagctgtactcaggggagttggacaacagcttgactgctccactgaagacccaacagtctgaaggcctccaaggagatctactgcagccagagcagcagagcaggagcttttctgccctttgaagagaccccatttggaaggccccacaggtggtctgatacagcaggacctaccaggagacctgaagcaacccagggacaaaagaagtagactccagacagtcacccagaccaacaatcactagggatatccagatggcaaaagacaagtgcaagaccataagcaacagaagccaaagaaatcatcagaacccagttctcccaccatagcaagccctgaatacacaagcatacctgaaaatcaggaatctgtcctaaaattcaatctcatgaaaataatagaatcctttaagaaggatatcaataactcactgaaagaaatataggaaaacagctgaatgaattgaataaagtgatctaatacctaaaagttgaagtagaaacaataaagaagaacaaatggaggcaaacctggacatggaaaacctaggaaagaggtcaggaattacacatataagtattaccaactgaatacaagagatagaagagagaatctcaggtatagaagatatgatagaatagattgacacaactgtcaaagaaaattcaaaatataaaaaaactcctaacccaaaggcatccaggaaattcaggacaaaatgtaaagaccaaatctaagaataattggaatagaggagaatgaaggttcccagctcaaaggacctgaaaatgtcttcaacaaaatcatagaagaaaacttcctcaacctaaagaaagaggtggccataaaggtacaagacacctatagaacaccaaataaatgggaccagaaaagtaaatcttcttgtcacataattatgaaaacactaaatgtacagaacaaagaaagaatattgaaagatgcgagggaaaagggccaagtaacatacaataatagacctgtcagaattacaccagacttctcaacagagactatgaaagccagaaaagcctggtcagaggtcatgcaaactctaagagaacacaaatgccagcccagcctactatacccaacaaaactctcaatcaatatagatagagaaaacaacatattccagggcaaaaccaaattcaaatagtatctatctaccaatgcagccctatagaggatccgggaaggaaaactccaacacagggaagatgcctgaactaaagaaaggacaagatattaagcatctcacaacaaagccaaaagcagagagccacaacacataaagccacctacaaaaacaaatatttaaggaaccaacaaccatcgctctttaatatgtctcaatattaatgaacgcaactcacttataaaaagacataagctaacagactgggtacacaaacaagatccagcattttgctgcatacaagaatacacttcaaaacaaatacagacaatatctcagagtaaaaggatggaaaaaggttgtccaagcaaatcgtctcaggaaacaagcagaaattgccatcctaatagctaataaaaaaagactttcaacaaaaacttatcaagcatgataaagaaggacacttcatattcatcaagggcaaaatccacaagagaaagtctcttttctgaacatttatgccccaaatgcaagagcaaccaaatcaataaaagaaactttactaaaactcaaaacactcattgaacccctcacagcaatagtgggagatttcaacaccccactctcacaactgaacaggtcattgaaccagaaataaacagagacacagtgaagctaagagaggtttgaaccaaatggatttcacaactagctagagaacatatcaccctaaaccaaaataattcaccttcttcttagcacctcatggtaccttctccaaagtcaaccacataattgggcacaaaacagccctcaactaatacagaaagatagaaataatgccatgcatcctatcagatcaccatggcctaaggctggtctttaaaaacagcaaaaactacagaaagatcacatgcacatgaaacctgaacaactatttattaaatgataacttaggaaagaaattaaagacttattggagtttaatgaaaatggtaacacattatacccaaaattatgggacaaaatgaaagcagtgctaagaggaaagttcatagcactaagtgccctggtaaagaaactggagagatcttacactaaaaacttaacagcacacttgagagctctagaacaaaaagaagcaaactcattgaagaggagtagaaggcagaaaatagtcaaactcagggctgaaatcaaccaaattgaaacaaagaaagcaatacaaagaatcggcaaaaccaaaagctggttctttgagagaatcaacaagatagataaacccctagaaaaactaaataaagggtcaagaggcagtatccaaatgaacaaaatcagaaatgaatagggagaaataacaacagaaaatgaggaaatttttaaaaatcattagatcctactataaaaggttatactcaacaaaactggaaaacttagatgaaatggatggtttctagacagaagccacataccaaagttaaatcaagagcaggtaaactacctaaacaggctcatatcacacaaagaatagaagtcattaaaatccaaccaaccaaccaaaaaaaaaaaaaaaaagccagggccacatggatttactgccgaattctaccagacctttaaagaagacctgataccaattttcctcaaactattccataaaatagaaacagaaggaatattacctaactcattctatgaagccacaattactctgatacctaaaccacataaggacccaacccaaacaaaaaacttcagaccagtctcacttatgaatatcaatgcaaaaacactcaaaaattcttgcaaatggaatccaagaacacatcaaaaccatcatgtaccatgatcaagtaggcttcatcccagggatgcaaggttgttttaatatatgaaaatctattaatgtaattcactatgtaaacaaactcaaagaaagaaacctcatgatcatatccttagcatttgacaaaatacaacaccccccttcatgtaaaagtattggagagaacaggaattcaaggcccatacataaacataataaaagcaatttactgcaaaccaacagccaatatcaaattaaatgaagatgtacttgaagcaatcccaatagaaacctggacaaggccaggatgcccactatccctatatctagcaatatagtacttgaagtgttagatagaacaataagacaacaaaaagcgattaaggggatacaaattggtacagaagaaataaagttatcactatttgcagatgatatgatagtatacataatcacccccaaaattctagaacttctccagctgataaacaacttcagcaaagtggccagatataaaattaactcaaataaatcagtatccttgctttatacaaatcataaacaggatgaaaaagaaatgagggcaataactcccttcacaacaaccacaaatattataaaatatcttggggcaacaataaccaaacaagtaaaagacctgtatgaaaataacttcaagtctctcaagaaaggaattgaagatgatctcagaaaatttagagatctcccatgctcatggattggcagaattaacatagtaaaaatggccatctatatattcaatgcactccccaacaaaattccaacacaattcttcaaaaaacaaaaagatcaattctcaagttcatctggaaaggcaaaaaacacagaatagcaaaaacaactcttcttattattttattagatattttctttatttacatttcaaatgttatcccctttcctatttttccctatcccctttccccctcccccgcctcccaagcccacccactcctattcctggtcctggcattcccctatactggggcattgagccttcacaggaccaagggcctcccctcccattgatgactgactaggccatttgctgcaaatatagctagagctacaagttctaccatgtgttttctttgattggtggtatagttccaagaagctctgaggatattggttagttcatattgatgttccttctatggggcttcagtccccttcagctccctgggtgtttctctggctccttcattggggaccttgtgctccattcaatggatgactctgagcatctgcttctgtatttgccaggcactggtagagtctcacaggagacagctatatcaggctcctgtcaccaggctcttgtcggcatctgcctagtgtctgggtttggcggttgtttatggggtggatccccacaagtggggcagtctctggatggtcattccttcaggctctgctcctaactttgtctgtgtaaaatacaaatcaaaacgaccttgagattccaccttacaccaatcagaatgtctaagaacaaaccctcaagtgacaacaacacatgttggagaggaagtggaaaaagaggaacactcctccattgctggtgggattgcaaactggaaattagtctgaaagttccccctgaaaatcttttggatgtatgcccaggagtggtatagctgggtcctcaggtaatactatgtccaattttctgaggaaccaccagactgatttctgtgtttgtaccagcttgcaatcccactaacagttgaggagtgttcctctttctccacttccttgtcagcatacactgtcacctgatgttttgatcttaaccattctggctggtgtgagatagaacctcagggttggttgctttgatttgcatttccttgatgactaaggatgttgaacatttctctaggtgcttctcagccattcagtattcctcagttgcgaatcctttgtttagctctgtatgccatttttctaaggaagcgttatgcatggcagtgatgcctgtgcgacatcactagtgagtaatgaaaggcaaacgaaacccacaagaccaagataacatatacacctatcattgtgcctgtaatgaaaaccatagacaatagcaagtgctggcttcagaggaagggactggaaatcgactattaggaaaacagatcagtttcatccctcaggaattgcaaaatttaatatttgtcacctctgtccttttgtttgaatgttttgtgagaaattggatgtaatttctaacttccttcctctgtagacttggtgtttttttcaaggctttgtcatttttattatttgaaaactgtatacgaccagccttatatttctttacccttcctttcttcccctccccaccactctttttcttttgttcatttttcggggtctaagaacttgtcactagatagttcatggctctagataagaacctaatactattattcggctaaagaaagaacatgaaaatgattcctaatggcatactgctatatccgtaagtcagtgactcacacaactctcagtagattagtcgatatctatttacatagagatgatcgggtgatcaacatacaaagaataatatacagtcaacccttcagattacatgcatatcatatgcatgaatatgactctcttatcttcctacaagagggggaagtaaaattttaaatgccatgagtggtggataacttgaagtgacagtgtgcttcagacaatagggtagtagcacttataaacttaaaattgtgacagcttcttcaagatatgctcaagctagacaaaatctcgtcatgaagagagcaagatgtgcataataagttatattaggaaggtgtatagacttataattttgtcatcttatattataaatggctcacatcacttcttaaaccagaaagtatttcttttacaacaaattttagaggctttcaggcaatatttcttccttgtttggaaagagaaatctaaatattgtcctatcattataagactacaagataatgggatttttgtgttattctatacatttctatagaatacctgttttctcttttcttttttaaataattttttattcacttcacatactgatcatagcccccatcttctcttcttcaagtcccatccttacatgtctcttccattattgcccttctcctcagagaagtgaaagcccacctttcctctgactactatttacagcagcactaggcacatcatctctcgctgagaccaaaactggtagtcgagtgatgggaatgagatacaatggcagggaacagagaacagagtccaagacagcccctactccatgtattgggggacccacatggagaccaacctgcatatttgctacatacgtgtagagggcctaggtccagcccttgcatgctccctggttgttggcttagtttttgtgatcccccatttttcgaggttagttgactcagtaactcttcttgtggtgtccttgacccctgcagattgattaattctatccctcactctttcacaagactccccaagttctgcctgatgtttgattgaaagtcactgcatctgcttccatgccacatccagcagttatgctagactcctttctgcaagctagcaaagtgtcattaacagtctcaggagttggctctctcacataggatgggtctcaagttggggcagtcattagttgttccctcagtttctgtcccatctttattcctgcacatcttgtaggcaagacaaattttgggttgaagattttgtgggtggattgatacctccttcctactgtggaagtcctacctgctacaggaggtaatgacttcagtttctatatccccctctgataagaaacccaacaaggatcatcccccactccctagatttaccatttcttccccgttcccaagcatatatcatcctgagtggggtaatccaaagacagaaagacatgcatagcatgtactaactagtaagtaggcattagccataaagagctcgataaccacactacaatccacagacccaaagaaactggataataagaaggacccaagggagggtacacaaagctcactcagaagtggaaacaaatttgtcataggatgtggaatgagagaggaaactgggtaggagagggggaaggagggaaactactatgatgatcagatgtgggaagaagggaactggaagagtgctgggagtgaaaatggaaatcagggggtcatttctggcactcatttccataaatatctttatgtcatatggtccagaataatggttatattaatttacatttaggttcattaaatatcccttcacaagttttgtcatgaccatcagtctatttagtatttatttattgtgtattatatattctacttttaaatgttcacttaatagataactttattagcatctatgtcaatcttttcattcatttcaagaattctcattattaatgatgtatgattttcatcattagctgcatgaaaatctgaactcaaccatcctagcttcttatttatggcaggttgcactgccaaatctccatttccttagaaattggtaaagatttacctgtttcctctgtagattaactaagttatgttgtttctagcacattttgaaacagaaaattctatttctcaagatttttaaaatcatttcagagaacttgttaatagataattaccattgttcgattggccttcaaattctgttataacttaactgggatatggtttcagtgtctactctttgtttttgttgtttgtgtgtttgtttgtttgtttatgttttgagagcatcagtgtgaatgggtggtctcaaacacaagctcccctactatgcccaatctttcctatggcttcgtggcattcaagtagtgaaaggttgactacgtctaacatgtactttaggtagaacaaaggcttgatcttttttggcctcactagatactttgttgaactcctttcttggaagtttttgctgtgggatgatactttatcttttgggatgtatgagtatattttctttgtcgtttttcttgtataagtgtcacctatctactctggttttaaagctgtcccttttcttatctagatccatctgcctaaagtgaaacctccatcccttcggtgctgagaagattgcctacatatgtcagtcatcaaagctttggtaagagtatcttctacagtagcatccatccatagatcatttcatcagacactctgttgtaaagaacctctacaacatcactgccttttagagctttaattgctacactctaaagtcatagcaatgggtatctcctgaacttgtatcctttttcagacaaatgagtaaatctggacattattattaactctatcccccagggttgaggtgtgacaagttttaacctccagggcaagcagagttggaaaagaaaactaatttaaaaggtacacacctgtttctgctgctttaaatgtcagctcccaaattctctgaccacaaagacaggcttccaggatagcagttgttgttgttgctgctgttgctgttgctgttgctgttgctgttgctgttgttattgcccctttaggctactcttagtaccagaaggatgaggggaaatggacggagttgggtacaaagaaaggagctgatgttcattgaccgtcattgttcaaattttagatttaattcttaattgaaagtaacctttacccatttcccaagtccctcaatgttgtgttatggaaccaactgagtgttttcagaggtaataagtggaagaaacaggatattgaccaatctttgccacaacaaagattgttttactacttcttgaacaaaaatcatattcatttattttttttcttttcctcagtatgtctgaactgaggctctaggtggagacagtgatgcctctgtcactattattgatgtagtgccaagttgagtttgttgctgtctatgacttttctcttttatcatatttgacattttatctaaatgaaatgaaaactcactaggactagctgcaatcaaaaagctaatctgtcacaacttgaatgtcaaacattttttatgttgtaagtgatggtgtttggctaagccacttttattccaaacctcaagccacccacccaggaactctttgaatccccaactaaaagacatacacacatgcttatttttgaaatgccacgactatgtcatatgctgggcagtccaagtcttcttatcagctatcataggtttccctctggtactcctgattcaacaccctccaaatctatgatttatctttgctgctgtatttttctgggtgccccctattctttgctgcctaagatttttctgggtagcccttccaggatgcacatgcattccctctcacctacatttcagatgatttccttctgcagctctaagtctgatctatctccttctgaaacctggtgattctcctcctctctctccattcctagccaatgaaaatctcaaggtcctgctgtgtctccctttgtccagacattggccactggcatttttatttattgatcaaaaacaagttggggacaaggatcttcagagtttggacacacagatttctgattaattcataaccttagaaccaatcccctacatataagcatggttgttcttgcctcccaagagaaccatgtctcagataaagggtaaaagactcaaaacggggcatttcattgttggatttcaaaagtaaggaactacttctgttttccaagtacaaatgtcatcctcctatgtggaatatttcttggtcttgattttagccacccatctttcctttgtctgtgaatcttccagagatggaaaagtgttgctagttttcaactcagagaacatgccctagtagttttaaatttcagggagctgcaggaggctggtgtcagtgtagagttttcttaaggatagagcatatgtaaattgttatgcagcagatgtgtgtatacatatgagggtgttatacaaggatcaattcttcagaatatttctacaatttctttcaaggagtaaaaaaaaaaaaataaattaaaaagcaaaattacaaagtctaagttattgtagcatgcttccaaaacaggcagcctagtttactctttcaatatttcagggtgcctgtagttgaaaaactatactgagaaatgttttcttgactgttatttttttctcttcattacagtttggtatcagtcctatctacttttaactgttcaaggtttacaaacaaacaaacaccttttgttgtggctttatatatgactaagaattttaaaatgtttaggaccataacacacacttgaacacacattcagtccccacataaaaaaatgcaatctaccttttgcatctatgtgtggcttgcaactctgaggactctttgaccatgagtataaaaatccatggctgtcaaaattggagtagagggggtagatgttcctaacatgttgctgataatactccaggaatattaactacataaaatgtactgaacatcctttcttacaatggataataaaaccttaaacagaattagttgacagatgcaattctgtatccataaacaatattctaattcctcattataatattctagaattattattttaacctcatgatagtagatttgaattctctccatattcaaatttcttatttgaatgatctatttatttcaaggtcaaataactgttctatagttaatgttgtgttcttatttttattttctattgtgtccagattttgaaatatctgctttttgtttgcaatttgcttcacaggcaattccacataaaattatagttattacaatctgattgtcttcaaagtgattttgaccacctaaaaagaagtaagagtttgttttcctaagcagaaatacgtaccaccatgccaggaaaattctgtatgcagttcagggttcatgggctgtatatccttggatgaaccttagcaaattgggactggattgattctttgtggaatgcaaattgtaagattggagttagaaccactattgaagaacttgttcacccagtgtacaatttccatttaaatgtattttataacctatgcttttcagcaagaaattgaaatgggcatcaaatttcaaaaggaaaattaatttatttgacctggtatctttcttgatgtgaaacttctgttgtgaacactatttctccttggagttaaaaatgaataagcaatgtatccagactgatggctcccacctataaatctcagcatggaaaaacagataaagggtcactgtaacttgagaattgcctgggctaggaagtgcaccctgcctcagtatacattaagtaaatgaataaataaatatcacattggtttccccaaatataaagtactttataacctaagtcaaaaccaatttctagatatatagaattctataaataggaaaattatatgttttgatgaacagtcttattcaataggaaatataattaaattatacagctttggcctaaaaataatatagagaatttttcatatcaatacgtacaattctgccttacttgtaattataattatgttattgggcaagggattgttgaattgcatgtgaagaaatcaacactgtgtgtgttgtaatgttgcagaagggtaggcttattacctaccctattgacaaagaagtcaagcaatatgagctcacatcagccgtccttccttactatcctggaaaattagaataggagaaagtagagactgcctttgggtgttgaatggcttccattttcagaagtatcatatgtataaattattggaataagggtgaaactgtgttgtacttggggcaatttgagttcctgatgtcatcaatcacaatagttatttattgttaagcctggtgatacattatctccaacaaggcctacctcttaatccttcacaactgattcttctaacagtggactaaactcatacacatgttcttctgactgccattcctattcaatctaccatagttacaaaaatgtgtgaataatctgcttattttctgaaagacaacttactattacttaggtagttattgtctggccccagtcaatttatcacaatttaattatcacaatttaatcaggttaagtggagtatgagtatactattctatcccataatttaacattcatactgcttactatggatatttggcaagtacccctcttgccaaacttcacccaagattgttcacactcaagattttatagttgctagcaccaggctctctgaatatatgttacagccatttgctttgtgttcttgtgagattcataacattgggaatgggtatatctcttactcttttacctgctattgagactctttcttttattgggttggcatgtccaatcttggttttggggctttagtcttgtatcttgtgtttttcctgttaggttgttatcatgccgtgaagacctgctcttttctgaaaaggaaatggattgtaagggtccataattcattgaagaatgatactccagcctaagataggatacaaaagcaaaggtgttttattctgcagaagtccagcattgggggtgggggtggggtgggcatgtgtaccaagatgaaaactgcaggtgagctcacaggcccaatttaaagcacattagaggaattccagggaggggtgggtgacctttctcttaattggttggctcaatctctaagggtgtgggggcctttggaattggctagggctctggagacttcagaaccattgcttggggttggggcctggaaactgttgttgactccttgcccttgtttcaggtcctgtgacaggtcagtttctgattggctgcccgaggtctgggggtttccagtaattaacttgcctggacttgcccagttctggaaaacagggcctatgtcctgaagtgccagtttgaagcctttcatggtatcaacctgtgtgagtcctctcaagagggaaagtagggagaaaggcagtggggatatctcggactcttggggggagcagagagagagaggaagcttgggttgtgaggcattacatgagagaagatttctattttcaataataaagagacttttcagttgttcctaggaatttgcgcaaaaattcaaaccagactcaatccagtaaatcatatatgtgatttattaattttttccacaattatcaagtgaatgaagcttaatatgaaaaacatatctttcttgaactctaatggcactggaggctggagagatggcttaacacttaagagagcatcctgttcttcccaaacacctgagactgattcctagaaccgatatcaagctgctcacaagtgtctgcaactccagctccagcagatcttacaccttcctccaagcctccaagggaaaccataagttatgcaccaacggctccagttgacagcttaagcagattacataaataaaaccatataaatgtatgtgttcatatatgaagttaaagtagaataaggttgcaatgaccaaatattaattactgatttttttaatctaatgatgtaattaaagatctgtttgtaattcctatttgccaagcatgacttgctacatggaatagaagaatctggaaaaatagtttaaaacatctagtcatccctttataaacctgacaactgccacaggtgcttctgtatagcctcccccagccttgaagcaggctgattcagaccttgctgccactgagaatgagaccacctggggtggacccttctgacttagatggctctatgctctgtcacctgctgctgctcttctccaagacactgctacctgctgagaggccctggagatattccggttcagccatctacaggctggcaacaggcaccaagaatggattgacaggggatgggccttcccctttataagcacagactcttagtaaacttcgggggaccttgaacagaaacatgtcttggcctccattatttctctcgccatttccttccatacagctccggcctcccactcaggaacccagttagtgtggccgcaggtggctacacttctgtaaattccaagtgcttgctaccatccatgtgattttttttttttttactttaaaatgaacatgtaaacaataccctacatgaaactactgtgtcccacaaggtcttagtagaggtcgaatgacctggttcttgttccaagaacagggccaagaaggcctgggcctccaagagtatccatggctgctgtggggtaaaccttgtttgtatgtaaatgcatgcattttcacatacctcggagaaatttcctccctgttaatagtaaggattccatgataatttgaaacagcaggaagtccaggagttgagggtatatcggatgtctttagcaaaatgataaactctggtaccttcaggacagcccttaaggatgtggaaaagaactctaagagcatgagttcaaatatatataatttgtcaacaatgaaaaaataaataaataagggtgcaatttgcatcgtataaggagcttcacagatctaaaagaacaaagccagctgtactatgagccagtttgtcagaaatatttaaaaacaggcagatacaaatacaggcagattcttgagttcaagatcagcccgggacacagctgatttaggtccaggtgtggtcatcagaacgctaatctcaggacaagttccttcccagctaaggttataaaggcaggcagatctctgaattctttcaaaatgttaaaaaaaaaaaaaaaccacgtacttggtattcttttcctaagagtcaaggggctaaggtcaaggaatgatgggattgttaacaaggaacctgaaatgaataactgaattgatacgtacatatatttaaaaaaaaaaaatcccaccaccaccaccaacaacaacaacaaaaactggacttttggtctgcaagagataagctagcagaaagaaagcatttcctttctttagaattgtcttttttttctctttttctttttaatttaatctttttttatttcccagattccatccccctcccattccaccctttgaggggttccacatccacaagcatgtccctaaccccacaccccccaaccccaccagacctcctcattccgtggggcctccagtttcttgagggttaggtgaatcttctctgactgagtccaaacctggtggtacttggatgtatatgtgttgggggcctatatcagctggtctatgctgcctggttggcggcccagtgtctgagagatcttggggttccaagttagttgagattgctggtcctcttataggatcacactcctcctcagcttcttccagcatttccctaattcaaccacagaggtcagctgcttctgtccattagttgggtgtaaatatctgcatctgactctttcagctgctggtctggttttccagagggcagtttgatagtcccctttttgtgagcaaaacatagcctcagtaatagtgtcaggccttagggccttcccttgagctggatcccaatttgggtctatcgccaacctcttttcctcagggtcttcttcatttttattcccgaggttctttcttttctagcaagaactgagctgtcccgggatctctaaagagcgaacacagcacttcaaggtttttttctaacaagatttatgatttcagttggaaaatccatgaagagagaacacagctcttttgaaaatttttcatagctcttttagaattttttcaaatagtattttctgagagagcaaacacggttctttttgactgttttcaagcagctatctcgagaaggctgtctgataggtgaacacagttcttcaagaatttttttctggctttctgattttgatcagaaaactaaaaaattacatttagaatctaacaggatttatgacttgttctgaacatccaaggattttttatcgcagcatttctgactttggtcagaagacccatgagctatatagagagctttcagaatgtttactagcagagagagctatatcaaccagtgagttttttagaatagcaagaacaggctgtctagatctgagaggaacacagacacagacacacacacacacacacacacacagacacagacacagacacagacacagacacacacaaacacagagagagagagagagagaaagagagagagagagagagagaagagagagagagaaaagagagagaaaagagagagagaaaagagagaaagagagagagaaaagagagagagagcagtctaaaaagctgtctccagcagagacaaaggatagctacagagaactgtctagggactcatcttgagcagaacacaggttaccagcttgaacacacaatttgacatagaatcaaatttgttttcactgctcccaaataccccttctctcaggaaccccaaactaactgaggctggtccttggcatgaagccttcaagggtatcttggcttttgttctactgatgacatcttcacccttgtactttcattggttccacagtgcttattccagaaagatttctgcaacatatttagaggaacctcccgccagcctgatctcccccatcacaacccaagagcaactagagttccagggcctcttaggctaccaaatgtctctggaatagagaagagggaatttttagaaacttttccagtggtcaaggagactgggaggctcagaaccggagtcccatggcagaagaagatgagattaggctaaacaatgagaccaggaaaggttccctgtagtattggcagggagagctggtgagggattcatcattgagcaggggattgcaattcaagtcttggtaggatactgagttggcaataatcttcagtgaaaagcatttgcagggatactgagtactgacatgagtcttcagcaatatagacagactaggcatttaaaatagaaatgtgtgagttctgaacagatggtgaatgaatctatgaatgctttgaaagatgcacaggacctagtgaagaagggatgattccaagtgtatgggataagctttgccctcacagaagtgctgccatgtagtattcagtcaacattaaccaacttactgcacaacatctcacctatgtataagtcatatacatatacacacacacatataccagcaataatcaaagagttacaaataactcacgagagataaaacacaatgaaactgtgttaagttacaaattaataagaatttgtcttttactatctgaaatttgacctgaatgagaaggttatgtgacattactgttatgtgggtggaatcacgttaccctgttagctgtagagaatgtagtgctaacaacattagcaaggaaacaacttctgtctatcaaggtgatctgcgaaacaggtatacaaacaaaacttggaaatcagtgtgttcgtctacatgtctgtgtctatttcactttgtcttgcagtcacaagcacactgtagctaggtagcaccattttactaaattggcatcaactgctttctaaatattcagccttttatactcacataataaggatgctcttatttctcctcagagaagcttatttttgcagggaacaatagttaatgtagaaactcacagaaagtgctgagaatatgtgctaaaccaatggtcatctctaaaagaaacatctttattaggtatcggccatctataacccatacataatgatcagtcttagggaacatcacagaagaggcaggcagatgtcaagatacaggagctggggagatctactctgcagtcatgcctccagatgggccaaagtgttgtactcatgattagaacagctgggctggctgcacaaaacttggagataaccaaaccagtcagaattccagcataagtggattagcagctcaagaggcctatcctttggatgaggagacatttcttcagctgataatttttggtgttttcttcaggaatatgacccagctccagtacaaggtcctgtgcctgtgaacaatacaggaaacattaatgggatacatacatacatatatccatacatacgtatatacataaattctacatgtgtaaaaaaggccatattaagtgagcaagtgtttttaaatgtgaattgaaaatattgaaatcctatatattaagatcattggttttatttaggcaatttatattaaaacgccttagtcttagattacctaatacaaaacattacacacacacatacacacacacacacacacacacacacacacacacatacacaccactattttcttactcccactgccataaagcatctagcacttagtacatattttacaaataatagattctttaaaactatgtgactgttggaaaaggagttatgcccacttaatttgttcccttagaagaaatgtggttggggcactctgggcacgggaatgccttcctcccatctcagaatctgtcacagattgtttattatccaatacctccctaattcgaagggcatgtaagtctcagtcctaagggatgggctgagttaaaggtgctaggaacacacgtattatcttggtttttgtctcctcatagccatgtagactgccccagaacgtcacttttgagttatgagagaaatgagctcattaatcatcattacactttctgttaagtggatatgttggctgggaatacttctgcctgagccgaatagaccacagcttcaggtatagaaccctagacttcatcagccgtactattgaagaatgaaatgaccagggagacggaagtagaagccatggcagaagagtcaagaaggagaagagaagccagagattaagaacaacatctgtgcggtagaaccttctgaacccttgagacgcttagagctttggcctctgtcatttggctcttgagcctttcaatcgtttacttcagtgtgctcagaaaccttttgttttccacctgtaagaacccaggcaagatattttccattatttctaagctttgggcatttcaacacattagcatctacaaagttcacatatgagagtcatataacagaattacaaaagaaaaaaaaaatggaaaaaacccataatgcataagtaagtttataatgcttggttggatcttattcataataatctgatgactcatgtggtccacacgtctcaggttggatatacctagaaccaaacaggaagcattcgtgtctgctttgcaagcagtcctaaaggaagtttatgagatctgcctgtcactacacatgtaaatagtgtcacaaattcctcccttgatttaagattctgctctttctactttttactcttcctaaatacattgttttcgactgttattaacgtgacatcaagtagccacaaacatacaccaccctcaaagctttgatctggaaaccagagcattgctaaatctatgcatcatcacaaagggtacttaatacaatggtttcaggatgtggccttcctataaactgcagtcattgctagatgaactgaacttcctagtaagtgaggccagtgtgcctgacctaaatatgactctggagaataaaaccctaaaataacagaaggaaagcggtccacagagactgtgggaggtgtcatggaggagactacagcaggaatttaaatttgagaggaagtaacagtgattctggctaaggcacatttctaaaacatttaagttgaggcgacatttcctagttgaaaggaagcataaacacgaatgtgtgcttagcagataaacatttaaattacttttgacatatagctaaaggagacaacaaaaacaaaggaaggctctgctgttatatctatggctactctgaaaccctcccagagtcactccatcccatggagaggaaagaaacatatctgcctttctaatgaagccaaggcttgggacaaggttcacaggaatggaaattcaagtgaaggacagtgagatccaaatgaggggacttgttgatcccatgagtaggctgttcacactggaaaggtatttacagtctatatccaaagctatatacagcacttaatatgcctttgtaggaattggaaattagtcctatcttcctcttgatcaaacactgtcttttcccaacttattcagcctgtaacataacagcatgaatactgggtttcatctctcatttgagaaactctttgccacccaagtaccaaatcgattttagtttgtatgtttcactgactatcaaaatgctatctcctttgacctgtgatctacactcttcaaaatcatcttataggtcacagggaccttgacatattgagcataaacaaaaagtttatctttcccaaatagttttaacattttttagaagtttctagaaataatcttcaactatgtgttctcatagatgaacaggatactttggttgctctggagatttgaattgctcctaaaattgaaccgtatgattttgtgctgtgagggaaaggtctcaggtttatctttgcgggctcaaaccaagtacaagtcagttgtacttatgtactagagcctcaataagaatctgtattatatagcataggtgaagtatatcttctggatattttgctgacagtatactgtgttcattgctgtgtttgaatgtgcggaggccatactttctacgtctccatagtcaagagcaactggaagccttatattaggggtttacttaagctctgctctgtagatcctctgctctctcctgttctagatttgaatactcactctgtagccataatgaatactaacataatgcatgccctgtagctttgaagagtatggatgtaacatatacttattagctcccataaatatttagctgtgacttcatcactcctcagcaattccacctttctatttatcaaattagataaatttttgtcttatagacccttcctaaaattacaaatagtatttgagataactttacgttttattccctgtaagtttcagatgttttcacttgaacttggcatcactacctcttttatttactctaatcctgctctttctcgccttgcctaacacttaatgttgttaactatcatacctttagaattatatatgtgttctttatgggggtggttaatgctattttcaatagtatgtaaacccaccagaaatataatggctcatatacagctagttatgccacacctttattttttacctgctctaatctgttggtgtcccttaagttatcagtagctaatattaccatatggtaatggtgtaaatggtttgacaattatatgtgtcaatttctgattatctcctaatcttatagtacatattggtaattccccaatgtttcaatccttaaatagatattattataaaacaagcgacccacaaaaagcacttctggggcttccacatctaacagctcacccttaagagggatgtcctgaagatcagtgctttagctaatgtaatattctgtttgctctgtttgaagctaggacaatatcttcagaaaagcataacaacaaataaagtagtttaagaacctattatggaaaaggcacttttgaagaaatttgcatgcaatttcattcaagcttcataacaaagtcatatatatttttaggtataatattttgatatgaggatggattccaagtgattgggttcaagaacccagttgccatactgtgcattttcaaattgcgttaagtagcctgtgaaaatgtggctactcttacttaactccatgttgcagaatttccatttttctgtagggaatgtgagaggtatggtattcaactgcctccttagctctcatccctgtattgttgtttttctctcctatatattctacatccttccaattcccttgcctcaagtgccacctgctctcctgaaaaatgcaatgtggcatttgccatttatattgctatgctcagcggtgtcctggaaaacaaatataaaatgacagctccaatccacactatctctgggtttcacacttatgcttccctttgcaaatctggggaaaattcagaattccggtgagaaaagttgttgataaaaattgttgcttccattttctggcctttagaagaaacttgaaggacctatctttataataaccagagaactccaaaagcaaatttaagcaagcacatatccccccagagagaaaagagagtattatgcttcctctatcatcattattatcactgaatagtgtttgttgagtttccagacataaaaggcagggggctggataaattggcatcttttctgcctcccaagagcttatagtttaaatagaaacagagtgtaaaagacaaacatatacaaggtcaggctgagaccaacagtaacacattaacatattcattaaaatagatctcattacaattcaacaatgggaggcagcgccataatgtactaaactaggagtcaggagattctgctgctcgctgaggggatggctttggggaaagcatctaaacatccttatggttaaaatgcttgaaaaatcatggagaaggcagtttgggaagatcagccaaacacaaaatgtagaggcaggaaaaccgtacaatttctggaactataatcaagtgatccacggtttatagctcaattcattgtgttttgtaaactaaaggactttaaagttgcttcaagatttggaagggggcatagaagatgtctcagtcattacagcacagacaagcaagacatcttgaggtcaggtaccaccacccatctgagtgctgaccgggcactggactgattttgataatagaaatacacgcaagcattattatgagaaggtgcataattggatgtagatggacgtacctggacttacatgcaatctgagtgactgtttcagcaggatgaggaagcccatgaggaggagaaaagccgcaatatcctcatcctaatagtgaaaggctttgcttactttgcaaaagaaaatcgaaccagtattgcaccacatgctccaattctcagcagtcactttccagttggcatatgaaagtcagcatcagcaagactcttcttctcatgaacattgagctaagagattctctgatgagaagtagagaacacaagtcccctgggttagtagctgcaccaactgacatttcatcttccactggagctcattaagctatggttttcttcattctccatgaacaactctggtcttagaaactctgtctgctgagttgtggagcttgagagctgtatgctaatttgcacgtctcttcaacaggagtctcttttcctttgaaaattatagaagaaaagtttgtgccaataatgctaggaatttacacatgcagatccctctatggtgatggctattagagacatattaaaagcaattcaaatgagcattgccaaaaaatatatcaaaatcaagtttgatatggactagcaagggagtatagcatcctgtgacaagaataatcacagagatttaatggatgttcacttgttacattctaaacactgaaatggatatttctgagctacaattcaattaaactttcattaaatagatatttccacagtttatcagaggataaaaatgttcacagaggtagaaagttataggaatcttcccgttccaaatctaggtgcacccagcgtcattcattacataataagatcttgggaaaattacatattaaattcaccatgttctcttctgcttcaggagcaaagattctgtttcaccatttctcctcaatgataaagagacaggatataaggattagaaaatatatcttatcaaattttctaaaaatcatattttaataggtagatattactgttactacatatatatatttttattaaaacacgagaaaagtcacaacaacagcaactggcacaagtatttaaagaataagacattttcagttaaattcacagaccttaggctggatagacaaaatgttcatagaggtagaaggataaaggagtcccatacctatgaatcctatggctaagagatgactcagctattaaaggctagcctcataaccaaaaatataaattcacaaccttttttttaggaagactaatccaaggacaagtttgtaatgatatcatgtagactttatcaggtatttgaccatcaataagaattcaaatttctttggcagtactttattaagatgacaaaatgttttatgatgggttttaaccataattattgaaagatatttttagttttagcaaccatataatctaattcttatacttcatttaccaagcatataagaatattcatcgtacttttgtaacatgaatgacatatttgtgactaccattgatttaatctattaatgcatgttaataattataataattaataagttctttctttatataaaaatagtttttgtggcatacacatatatacaggtataagtgtgtgtatggtaattatcagttactgctttagcgtccatcagctcccccggtgactccaaggctagttcttacttacgtaaacttggggaaaacattatttcagtacagcttcctatatctctcatctttttctggaaaggacagcattaaatagcctaggaaacatcaggaaaagctaactcagaatccagcaaagctcagaaagctgctactaagaaacaatgttcctgaatctaagttcattcactgtgtccatcccctttgttgtgagactgggaagaaggaagacttggaagctcttctgtgtctcactactggagtgcttgccccttctattttccatttacatcatttcaatcattactaactctaatatttttgtattgaaaatatttttttaagtaggtataagtgttccagtcttatcttccctctctttaaattcttgcatgttggtttccaacttgggttttgttagttgtgtggggactggcctcatatttatttttcagttcccagatgtcagaaatggagataggagggtagtttgtacacagggtaagcaagtcctccaagagggagctgtttaatgccaatctagagcccatagcagacacttagaagcacctaccttactcagcttttatactcagttaatacccacctattctaatcacacatgaggcatgggccagacccttgggaattgctcttaggaatctgaatattaccagtgttgtatctgcttccttagcctacctggtgactttgtcatagaaatcactattgtggtgcttgctaatatcctttaggtacccacctcttgattgatttaagggctcttatgcatgacttcttaagcatgtccccttatctgtgtcagagcaaactacattacaacgactttttactttttgatttttaaaagtgggtaaatccagactagtaactatatctatgagtgtaactatcttaaaaaacagcggccatgtcaataccacatgaagctctgtaagttggttggggttgaacatatttattttatatctaaaatacagttttttcccactgggcagtgggaatctccatattagttactgttcaaagaataaaaaactttaatatattctctaatgggaatgaacttgatagtttaaatatatacacacaactcaattcaatatactaagaggagaaaagtaaacacacaaacaaatcaaattaagcaaaccaaaccccttaatggttttagtgtctccagttggtcttaagaatttagctgagataagatacatgtggaaatggggctggggtttacaggggttatagctacactggcagaatgtttctacaaaatggatgaagtcctgagtttgaacctcaacaccacataaatcaagcagtgtctgtctgttaacccagatggcagaaatggagttagaaagtcataatttcaaggtcattatcatcaacataacaagatagaggccattatgggattcatgagatcctagtatggcaggtagacacatgcaaaagacacatgcaaaagacacatttaaataggtcattagaattttatgtaaacatgttacttagtgtttctattgctatgaagtaacaccatcactatagtaattcttataaaggaaaatatttatttgggctggcttacagttcataggtttagtctgttttatcatggctaaaatcatgacaggatgcaggcaagcataatgctttaaaaggagctgagatttctacatcttgatctgagacctcaaagtacatgcccatggtgacacacttcccccagaaagaccacatctactccaacaaataaggctaaattttgtaattgttccactctctatgggcttatgggagccatttttttttttttttttgcaaaccatcaccataaaaggagatgaaaaccctaaagtgtcaacagaccagaaagtttgtgttccttttaaatgaagacattatcaatttgtgaagaaaatattagcctccaatattcaccctgggagcagcacatctggaaaagttactgtgagatacagaggcaaaaactggtgggagacagggtattttggtgagcttgttcctacatagccagcccggcatcattcgagccactaataataatagtgttctcccttcctttatacaggggagagtatgtggcttcttttatgtagaaaattgtatggagagagaggggggaaggggaggggaggggaggggaggggaggggaggggaggggaggggaggggaggggaggggaggagaggagaggagaggagaggagaggagaggagaggagaggagaggagaggagaggagaggagaggagaggagaggagaggagaggagaggagaggagaggagaggagaggagaggagaggagaggagaggagaggagaggagaggagaggagagaaataaaccaagcaagaagaagcacacacacaaacttctgatatttctatctttcccaggatcttgcagttcaaattaattaccaaaacaatataggtggggatgacatgccttacacccctttaatatggatggaaaaatatagctaagagcaaaaatccaaataacatttgtattatgtcaaatacattggagaaagtcattacattgtggttatgtatactcaacttttcagaggacaattccaccagctacttcactcttccatggtgatcatcttaaagtttcttttggttttctcctttcactaagatttttcctctgaaaaattttaagtaattagacaactcttttggcacacatatctgtggcatccttggctctagaagtaggaaacacaggggagaaggttttctatttagggagtagcaagcagattaacattatcttgtgctcatttgggcaatcttaccaccaagggaatattacaaacattagaaacattagaggcttaatcaatatatgtttctactttatttagcctactatctaagtaacagagaaagtatttaggtagtcttagtttttcccaagttaattctctttttgatggaaagtcctttactaatattttttcttttttgtacaacctgtcctcacaaaataatgtgttcaaaatatgaatctgtcattatgtgcagttcttctataaaatttaagtagatgagaaagaacttttgttcttaaggcactgaaatgtttctgaagaaggtagatgattagaactctcgcatgcacttgagtacaatttaataaaatgaaaagcttcacttaataaaaaattctagtgtgggaaaaacttgtaagagcttttgaaatgtattttaaagatcagaatatattgtctagtactccaagtgaattctgtgttcctttgactttaggctattttgaaaatttgttcattttagaaagatcaactgttatggagaaagttgttcataatactgtgaattgtgttcactgaggtttatgttgattgttactctatggaaataaagttttgtcagttttgtatcaattatataaatttataaaatattcctgatgggcatctgtggtcatactttctttaaacttttcttttgagactctcaatgggaatatggttcattccttcattgacaaattcaatatcatttaaaaatgcctgtgatcttattttatttctaaagtattttattatgtttgtgtataggcattctgcttacatgtatgtctgtgtaccacatgcatcatgtaccagggaagtccagagagggtaacagatcctcagaaactggagttatactcagttgtgagctgcttttttggtgctaggaactgaaaccagacctctttataagcagtaaatgctcttaatcagtgacccacttctccaaccccctgaaatgtctcttttaactatagtattttattttataaattaatacaatctccagtgagtagcttagacaaaatatcaaatcctatagctcttctgagtatcagattagttaactgtataaaggcagagtcctctgagggcacaagaaaaaaggctttccgataccagataatgaagaatctttttccattctcctatgggaaaattttgattcctccttgtgttgtttgtaaccctggagcatagcccacccctggtttctgtagggttttttccctcctgattgagcttctccaggcttaccttgtaatgtgatgatccaacacaaaacagaaaaccaattccaagggaggtgttcttattggttgtttatttttggatcccaaaactttgatatattaatgggtaaagcaaaagttattaaatcacttcctatggtatgctagttttgagacatgaaagacaacatgtgtgtttcctttattgggttattttagctgtggttatagtctacacagccattcctatgagtagaaactataattattagctgctttcttaggcaggacattatttattcaatgaaattcccagtcaatttcaaatgacttcaaaccaatgttgactgatgtgtatgacaatgaccaataaccctgtctttgattagtattgcatagataacaagttagacaaatatttctgggcttccccacacatctgtgcacacatgagaagccaaccaatagttagaatgaaattaagtttataccaaattctttccatcagagtgtaatttgttcactaaaaaatcaattccatatgtcctcactcatgtgcatatcctagactctaactattaagtatacctatacaagtgggggtaaatatgagtaaaggccaggaaactagaaagggaaatgtacaattgggaaaacatgatgtcttgagggagtatgtggtaagataataaaacaaagttgaagtggaaaatagtaagggtatagtggggaagaggggaaaagagatgacttgagagttagaaaatgggaggactgaaccaacgttttacatatatgtgtatatacacatatgcatatataatcgtgcatgtatatatgtgtatttatacatatatgtatgcaaacacacatatatatgtatacatacacacacacatatgtgtttgtgttcagtcagcccgtttttaacctcccactcatctctttgttcctccttccctgcttcttccatatatatgtatatatatatatatatatatgcatacgtatatatatatatatatacatatatatatatatatatatgcatatatataaactttgttagctaacaatattttttagtgaattaaacaaagtctaggctttttagctttttagttcttctctcatacaatacgtgctgaccacagttttctctctctccactcctccctgcaccaccaatccccctccccagatccactctgcttccattttccttcagaaaagagcagccctcccctttattaaccaataagattaggcaaataccctcctatcaactcagtaggagggaagtgtagctgtccaacagccaccaatgaactgtgtttaacagaaaggtgggctggagatgaaaaggactgggtgagagggaaagatgaagccaagacaaaagttctgattaaggctccaagtttaatattcagcactgtatttacatagggaaagcctacagacccatcctttgtttcaactggattataatgcaaagcaagctcagtggacagtctattcttctaggttcctgtaggaatttgcaagtacaaccaaggcagatgactccacttgggtcattaagcccattgtggcaagcactcaaggtcagttcagcctggtcaaagctcaggaagggcacaggaaagtgtctcaagagatgatgaaagagttgcagagcctgttatcttttcagggagaagaaagacacatatgcaaaagagaaatacacaaaaaagaagcaacaaaggaaatccaaggcgtgcctattctctgtaagaaaaacttaaccaagcaaaactgaataacgactaaaccaggagttggagcttcttttgtggttaataaattctttgggcaaatgaattgtggttattacatcaaagagggttaatttactggaaatcctattgtatgtatgtgttctctagtaatgatttcttgtcagcacacagaagaattttaaatacagtgatagcaaatgggaagtgtgtcaaaatcaaatattttgaaggaagcagcaacctgcatcataaggaaaaaatgagaaagatgtgaactcagtttatgaacttacagtttcttatatctatgtcataaagcaacaaaattatgaagttcagattagtttttctgccacctgcttccatccttgaaccagcatcatactggagaaagtgtatgtcacacagccttgctttaattacactgaaagtctctcactccactgttctccattctgagtacagaaaatctcatttagatagaaaaaagtgaaacttttctctatccagatgacaattcttttcttttacttaatacttgtttttccagaaagaaatcactcagaacatggttaacatatcttttactctgtccctgtgtatactatttatatttcttttttttgtacacattataacctaatcataagtgattttgagatttagtaacagtgaaaaattatcaaatatttactccttgcaaataacacaactgaaatttaaaacatttgataacatttgaaatagaattcttaccttagctgtgtgagaacacttagtgttgagaatctccattttccaaattcttttttctttgtcattccactgtctctgtcttgttttcttaccttgtacaatgattcttaaatgagtgaacatatttgtaagcttcataaaaaaagaattgtttctaaaacatagaaattgagaaaatatgatgacatgacttaaaactaccaaagaagtttatatatgagatatgtggtgctaattcactataatttaatgtttaatcattttgttatatcttttaattcaggcctcttcttttttacatgtagcttaaacatatcttgtacttattgtatcatactgaaatgattaaagcttatctgaagacactaatttttttgcacattgttaagtaccaaatactaaagtcagtagactaaattagtcacaggacctatcacttgccaatagactattatcaattgctgtttgggggggtgtattataaaattttagaaaatctttgataaacaagtagatgaaattctttgaaggttggaaatttttgtacacatttaaaaaaattcttggctgatgttaaaaataaatttgggggttagttctatttagacttccaattgttatagctgctataactgaaaataaaagtctcattctatattttctttaatctaatatttcatcagaaacaccaacttccaagcaattcatttcctgactagcactaatggaaagttgccagttttcttaccagcccagtctatctacagaacctgaagtatggaagctgactgagaaatttttaataggcattactatgaatttgtttgagaataaatacctgtccttagaaagagatgcactctgtttcacagggttcttgttgatgaggtaaacccatgtatagtataaatacttatgactactatagaatgaaacaaaagcaaattctcaacattatatagagaatagcacaggattaatatttgacataaggagtattttgaaaatatcagatatagtgcagataaaagtgttgataggtgctattctcaaacaatatttgagaagtaaacacaagcagagtaggtatagtctgatattcatagctataatttagttatctattgatatagtgacccacagaccaaaaacattccaacacagatgcgttagttccaaatacagtatagacttgtctttgtctcaaagttcttataacaatgtagcctagagagtgctttctttaaatgaatgcgtattaggtatcaaaagcaaccaatagatgatttattatatgtaggaaactgtgtataagtcacatacaacctttttgactatttttcattaggatgggtattttcagaatttaatatctgtaggcgttccaaaaacaattctcatgaaatatagattgatagtaccaatgattttataataatcactgtagtagaatgtgggagaagggcacacctcccacaaagaaaagaaatcgggcatggatacagatggagggtatagtaaaaggtcctccagtcagattttctgctgtggttttcctttggttttgagaaaaccattgtaagcactgacctttcatcttctccttttgccccaatgactttgaagttgtattactattttgtgacatttccaaaacacaaatggccagaaggcttactatagccctgatgttccttcatattagttagtagctgagtataaggatcaaatcttcatggcacagataaatcccagtcttgttaatatgtcggttgtctaagagagtgattcaggagaactgtgaccattttagaagagtacagctccgatgtcttggttcactttatatttctcctcttggccttagccatgctttcactctccttactggttcatttccacataacaaataaacctcctttattgcttcaggcaaggttgctgtgttccctgatggtagccagtattcatcagagctctggccatctagtttgttactctctataaaacggggtttgctgaccatccatcattatttcaacactctccttagggcatttcttctcacttacggcagttaagcaaattatttgtttcctaaagaaaagctgtttaatggaggggaaagattctaataccaagagaagcttttattttagattttcatatgtgtctgaaaatttgaataaataagaaggtaagactggaagtcataaaggtactaaattcttgacatttaaacaagaagtgctgatcatgccaatttcccatgacaattggttaaaattaagttatactggtgattttagtatgttatattggcttggaatagtagttttataaaattccattcttgatccaacagaaaagatattaattaaatacagacatttatttccccctttctatcttaataaaaccattatgaaaataggataattgccctttcctgtttctttttaaaaatccagagttctaaagaaaatgtcattcctattttatactcagtcagctttcaatctggaaatatattttaggcatctgttacgaacccaatccatgcaacgctgaagtatatgaattaatatctttgtttattcaaggtcatggaaagagaaagaaaaggcaggggaaagagtagaaattcaactctttttggagcaagaactgggattgatgcaatatataaatgcaaatgtgtatatttcagggggtgtggctagataagaacagccagaaaatgaaatgagacattatgcagataaagttgcttgcccaattagacaactgaaaagtcttcaagattgagttaaaattgaggataaagggataatgggagctaagtagattgctaaattatatcatcctaacatctgcaaaagagaatgtgaaaatgtctatgggattggaaagtaagaaattgcttcctaagggaagaagaacttggtatggaccttaagagatggttacagtttgtccacatgaaggaaagaacaggttaactccctaagaacaccatgataagctgttgttaaacaactctgcctgtctcttacaaggttgaaaggtgtcaacatcattttccaagacgctctgtattgtgtaattaaattaaatttagcagatgtgaggaaacataattggaaagcaataatctaatttataagaaaacctacaaagatcctcactgcccctttaaagctaacagcattatatacatgaagcaaaatgtagttataatttactttctttgttaattttattctgttctgccaatttttttgtcatacttaagtaaaactcatatgtatggtgaagaatatggaggtccttctaaagagtaggcatgcaaatgcgatatgactctttgatcacattattgagtatatgccaattaaatgaagtcagtattatgaagatacgtctttaccccatgtttattaaagcagctttcacaggaactgagttttggaatttgcttgagtgtaacaatggatgaatggataataaaacatggttaacatatgcacctactatgtaataccactcagttttgaaatagaatcaagtcatttatgatatgcataatctggaaaacacaaagttcattggaaaggccaaacacacaaaagaaaccacagtgttttatctttcccaggagtttcctcttctgtagcatcacttacctatgatccctaactacctgggtacagttatagaaataaatactgttttaaagtttgagccattctgaatcatgggattatgtcttatagtactgcgtgctgtctcactggaacatgtgctgtatatgacacctgtccattagttatttaggacctgtcttggttatcatattgactgttgatgcattgcatgcttgcatctaatggcattttatgtgccctttttttgctctctaacatccatgaagcatgagaatagtgatgtctaacaatcaaatacaccaaaggaaaatcctaaaattctttaaagtaagatgtaaaagcagaataagaaaatatcaaaaaaattttaactatgcaagagaaaccttggtcacataaaatttatttcagtatattattgcaattgttctattttactatgaactagactaataattaattgtgatagttatcctcttacaccatgtcatttttaggtgaattgttacagtaggtatatataattaccaaacacaaagcacagttacattttagtattctccagttttaattctcttccagggtcttagaatatactctccctgagtaaagatatatatcaaacagcataatttcagttttatgtagagtgaacaagcagagaaggagaaattagagcaatggtggtcaggagcactttggagtaaatgtcaattaaaattttttaataaaagagaatgaattaattcaagattttctattatagaacattttatacttcaagattgctattattaggtttcaaggttttttttttttttatttgtctaagtaagagtatggatatgcaatcatagcagcctggaactcattacatagaccagatttgccttcaactcacagagatctacctacccctgctcttcaagtgctgaagttaaagccatgtaccaccaatcccaaaagtataaaaaaaatggagattatatgtgtaaaacgtttgttcattaaatttgttcattagttcagtatatctctttcccaatctatacacatattcaaatatcatgttatttatcataaacatatgctttcttaataagaactaagttaaagccaggcgtggtggcatatgcctttaatcccagcacttgggaggcagaggcaggcagatttttgagtttgaggccagcctgctctacagcctgagttccaggaaagccagggatatacagagaaaacctgtctggaaaaaaaccaaattaaaataaagaagaagaagaagaactaagttaaatgtagagtcaagtatgagatatatatcaaagcattcaactatttacaaaataacagccacaatatatatcatacattttatggttggaaaaagaatctcagtaaaatatttgtgtgacattctgaggaatcattgtgcagtaatataatacatatatgtattttcacaaaaaggattttccttatttttccaatactaatttatttttcttttgtctccaacacctttctcctttttgccaaaaagcaattctaaatccagaagcctcactgtaattgcttctcccaggattctgaaattagtgtacctcccaaaatttatttagctctcgaaaacaatgagaaatctctttaaacaataaagagagattgaaatcagaaactctgtcgcctagaagagcgttgccctgaatatcaaacactgggagaagtttctagactccttttcttcatgtactgtaaccaagctctgtgcctgatacttgcacttaacaagagtctctacaaactgaaaggtacttagtctcacattggcagagaaagctacaaggtataaatgcatacattgaaatgtggtattagtgaaaaacaacagtttcatctcatcactagcagagaaggctctcacacaataaagggagtgtctctatcactgaggctatggagcactcacaaaaagggacctgtcatgaccacattctggaaaacccaacaagcagctgaaagagtcagaggcagatatttgcaccctacaaatggacagaagctgctgacccctgtggttgaattagggaaaggctggaagaagctgaggaagaagggatcctgtaggaagaccagcagtctcaaacccagagatctctcaaacactggaccaccaaccaggcagcatacaccagctgatatgaggcccccaacacatatacagcagaggactgccaggtcagggttcagtcagagaagatacatctaaccctcaagatactgtaggccccagggtatttagaggtctggttgggtgggacatgaggggtcaggacatcctcatggaggcagggtggttgtggggaggtatggaatgtggaacagtgggtgggtagactagacagggggagggtaataaaatctggagtgtaagtaaataaataaaagacaaaaagaaaaaagaaaaagaaaaaaaataatggcagtttctttattgtttctcccaaaacaggctgtgtcaactggttaaagcgatgaccattcaatgttttcctttgggggtagtgggtttaatgagtacaacaccaagcctgaaaacgaagatgtaaaatagaaggcttactgtgtggatccagggcagtgtgctaccctctctaagtgcacacttctgcaaaggttgatgaaggtggtttaagagccatgttgacaaaaggctttgtgttccattctcttccaaacttaaaatgcttgcagctaaagatgcctctggtttttaagactgacactgaaaaggcttcaggaaacattgtcagcaatacaaaacaagcgatccatccgtataagtgactctgaagactttgcatttatttttcagataagtaactccctgtgtttgactatttctaatatgaggggcttattatagataaagaagtttttggtttctctacccctagtttaaaaaaaaatcccttgattttgcatatgggtgataatttaaattaataaaaacatattgtgttctaatttgttttagttatattattattactaggaaactattttgacctttacatttgcttgattttctttgtcctggtttttaatttggtaatatgtccacccagtagttttcttactttagttcacaatcacttcatatagtctttggttttgttttgtattttgagacagagtttctctgtgtagtcctggatgtcctggaacccactctgtagatcaggctggcctcgaactcagaaatctgcctgcctctgtctcctaagtgctgggattaaaggtttgcgccaccactacctggcctatagtcttactttcaattcaaagatcagaccatcttgatttctcctgtttttattaattatttttatcataatatatataataagattccctccgattcttcctatggattttcatagatatcttcacaggacccatttttcttctgtaactgcatttgatctctgctgcttatagttcctaatacagtgaaaacagtagatgtgtgtcttgtttatatcacttatatataaaaatagaaaagaatcaaagactacaacttacagtatttttccatttattatataccaactataataaactagaactaacttaaagtctagactgaaactcagtcctcagctatggaaatagaaaatactggacacttttttcttgctacagtcagaataacattttaaagtcagttcatatgatcaggcttgcctagaaccaaagtgggtgcctgagtcctatgttccttttaaatcatttactggtgatcttacatggcaatacataacttgaaattccacttagacaggcagatgaaggttaagcttagaatctcagagttattcaaaagaaaatcgctcctggatctaggctaactttgttgttgtctcatgtttttcaaacactttgtatcttttaaagtactttactttagtcatcaaatattgtttgtgactattactatctgttaatacttctagctgcactgaatctggcttagaaggttaaaaatgtttccacctgactatttgtatgtttacggagatctatggtatattttgctaaaagataacaaaatttactcaactcataaaatcatattactgatgagtaggtcagggaagatgaatgcaataaagcttgggaaaaataaaaggacatgaaaaaatatcaccctttattgacaggagcacacacacagaaagagaatgtgagaaagaggcaaagagacagagagagaaaatgcacacattgaagtaaaatttcccttaaggtttttgatagtattataggcagtacaagttgaaagtttgagagataataaaatgtttgcatctacttttttacccttgattaggagttacactgaagtagattgtttcttcgtgatataaagtttctcttttatctcttcctgtttcatatcctattgtttccaaaagccttggtcctgggggatagtttgccctgtgcagagagtgagagatagaaagaatgggacatggagagggaagaaggagatggggaaaggaaaagagagtaagtatttaatctcccagctactctgctttctccttggcctggctacgtctctgaagggtaaggttatcactccttatggacatatccaaatggctctttaagaatttctacaagttatgtgcccactcactctttctgggttgcaaacagtaccaaagttcaccccactgcatctttgtaaacagttcttttattaagagttatcctaatttgaatgtaccatctgtttcccactggcaccctgactaatacacccatgatcagatctcaaaaattagtaacactgcatagcttctaatgatttgaatagtctgagaaatgaattgcaagatattccttctatttcacaagttacaaaaatataccaggcttctcagtgttttcttattccatccttacatttttctggtttggtggcctgtctaaaaccagtcaggtggactccattgggaattatcattgtcccttagagcaaatggcttcttataggtatttaagaacttgataaaaagatatgaggatggaaagaaggagataggacaaatgagtcacgaaagaacaaaaatatttatgagcagctttaatccagagaaaagccttaaactactgataacaactgattaaatatcagaaaaaatggtcctttcagctgagaaactctctttggacttaaaataagatagtagtcatattcatgttttttatatctttgcagacctcacccttcacctattttatgctgtctttctttttcagaatttagtttttacccttccaaagtaatgtcctgttttagggtgatagtccacaaccatcatggcaggaggtagacaggccaatgctgtcagctttacaacctggtccacaggttgtaaagtgacgcttggacttctgtaaacttttgaaaccaactatctgtggtataccttctccaacaagggtatatgccataatcttcctaaacagttcaccaactgggaacaaggcatgtgatgggaaatcacctaggtgggaaatctcattcaaatcagcccacaggctacttttggtgtgtgccaagagtggtatactcagagtttctatttctgcttgttgtgtgtgtgtgttttttttttttttttttttttagaaacttccatgctgatatccagagtggttgaacaatgtgacattactaccaacaacttataagagttatatttatttggatttccaatgatattaccgttctgacctgggtgaaatggaatgttaaaacaggtttaatttgtgttattcaagtggctaaagatgcagggtactttaaaaactcttttgtaagtattgtcatttcttttgagtttttttgtttgtttaagcccatagccttctttttataactgtttgttttcatatttttagcatttcatttgtttgtttctagctctgtatattctagaaactaattctctgacagccatagagctggccatgattttcttccattctgtaagctgcttattgattcacttcataggtccctttgctgtatagaagcttttaagtttcatgagagcccacttgttgacttcagttttgtttcctgtgctactgacgtcttacacagaaagttcttacgtacgtcaatatgacgaagtgtaagcctggctttttttatctaacaggatatcacatctcatgttaaggtccttgatccttttggagtcaagtttacattaatggcaatctgattttgcttttctgtgggttgaaccccagtggtcccagtaccatttgtagaagatgcacttttaaaattagcatatacacatttttcaaatgtttaattttgacaaatccaagtatactctgggatagctgatatcctaccccccctccccctcactgacagcagataattgcctgtagagaaggaatcattatttggcgtgttggtgggtgtggctacttgtaggtttcatatctcatgctccagaggatgagcccatacatgtaaatgctcaggaaacgctaactagactttagtacactatgagatgggaaggcagagtttggggttcagcttgggagagctgagggagctggaggggaaatagaggtagatatgatcacattctattgcataaatgcatccaatcacaaaatttgcagtaaaatagacttattatataaatagaatatttaatattaaataggccatacaacctcagaaggaaaaggcatattctcctgcatatgtgaaatctagtcagtaataaaaatacatatatgtaaacaaatgcatgtgttgacacagtgtacaacatatgtgaaagagtgactcagcagtacataaacaataacccaactcatcaattaacatcataacctttcatccctttttataggtttttagtcacttcaaattataaaatgcacttagtttagcttcaaaagtgccagtagtctttaacaaccccaatgttttaaaagtctcatctgagacgcatgatattcatttaattgtaaaaccctatagaatgaaatatgaagtatatgtttgcaatatacaatttcacagaaattaattcaaacagagaatagcaagacttgaacaggtcaaagcaagactggagcccatctgtctaataaccaagccccacagcttcagtggcatggcagaagtatgatgatgcccatttgtgaagacaccatgaagtaaacaattacttcttaacctaaacttcaaaaagggaataaaaattcggcatgttctactcatattataagagtggaactaaactacctcatttacagaaatagaagtaatgaaaatattaatctctccttttgtctaattcattgattaacatttctcacacttgttgattagagataccaaagagaactgtggtgttgttaaagtgtctaccctgaaacattcaaagtggaatggctgccaaaatctcttattctaaaaatatacaaaaaaagtctagtgtccctgtccatcagacaatagttttgcagccatgtgtctgcactgaatattggtcctgtgaaagtccagttttttctcaaccatagcgtttctagttcttttcatgttcactaagaagcctcagctgtggtagccattgctgtttgcatactatatgagaattgctaattccaggtaagtaggaaacactctcacatccacagtgatgacaaatgaactcgctggttttaatggttagttaagtcttggttttttttttgatgcaacttgggttgtttctttcccagcatttcagatgaagacctggtatgctgtccgtttaagagatgtaaatggaaatacttctaaacatagacacttgccaatgtctcaagatttatctttcctcttgtattcaaacattcaaaattatctggggtttgaatctgaacactggcttgttcaacagaaaaccactctttgatctttaatatgtgtcaaatcactcccatgttcagaaacttcaagattaaagaaacaaacagaacaatagtgtcactagctagattctaggtgtcacagacatgtgtagaattatgcacagatgaggggatttgactaggtcctaccaagatttatttgtcacttgcttatgaatgaaatgttaactcacttttaggatttattgaagtcggcttcatggtttttaattacatcctcttggaaaaaggacgaccacactgattcattcaaatttctagaaaatacattaaagcaaaaagaagaatctgatgatttctgagaatgcaatttgtatgagccaaaaattttatattaaaatatctgaggaagcaacattatttcacatatttagtctatattttactggccttatattctgagtcttttgcgttaaaatatacctccaatggcatatgttcatagctgcagaaagaaaggtagaaaagatcctccagtaaatgcaattgatatctcttaatttagtaagtcagttttacatatacagaaaatttgtaaagctgggaaaagacagcatatagttcttatatagtgtggccttagtttctcctgtcctgaccttatattggtatagtgtatttgttaaaattagtatgtgactgtgtgtctgctttgctgcagaggtgcctgagtgcagatggcaagctactcctaggaggtagaacacagtccatgataggggacccagcacacgtttcccagggtgagaaacagcagcatcagggatggatgctatgttttcctgtctcttgtgtatccagacttcacaggggtaccgctgggacttgggaatgggggactgagaatctatgcttccctttggggtatttacccaacaggcaggaagggaaaggcagagcccatgacaggggcagaatcaggtttggttgcaagtgagtgccgagggtatggagggctgaaagatagaagaccttctcctagaaatttagatctggttctttaggatgaaggtctcgccccttgtaatccttccttgtcaaaactgttttatttgatggtggatgtaaatgcgtataaattactcaggcaatcatggattaaataccttttgtgaaatacttttgtgcccaggaagagaagcctcaatggttaaacgctaagggcctatctagatacctatttagcatacagaattcctggcttttatgctacttgatcaattgtcatagtcctctcagtgggatgtcatggttacatgttccagatcagatattttgggagggagctggccccaagcctgcctttcttaattctgagattccctggggtttgggcctgttcaaccctaccagttattcccttgtggcatagtccaattgccccacagactcacatagcagtacataattaatttatataatcaattttacctagtacccattcagagtccttgtccagaggacatactaacagtagaaacatttctttagtcacctcccatgtatgacagattctgagactcttctggttttgatgatcctggtaattctggagggagctggtcaaatattttctagatagtctttattgattgatgattttttttctcataaccaagcttggattgtgagttttatgacaaaactcacattgttaatgtcactttacttagggtctcatcagcatttcttgtgactgttgatgtaggcctcaataggttgttccactttatcatcctgtctgttctgtgttgtgaaaggtaaatggaacacaccttatttttgcatatacttaactgataatttccaggtttgggcaattaaagaaaaacacatttcctaggtgttctcatgtgttttcatgtgatataatttttaacaaggttgggtaaatatttctaagaataacatattttcttttaaaaaataatttaatttttattttttagttggatattttctttctttacatttcaaatgttttcccctttccaggtctccccttcacaaacctcctatcccatcctcctcctcctgtctctatgagggtactcccccacccatttacccatttccatcttcccacactggcatgcccctatactggggcattgaacactgctcaagggcctctcctcccactgaagtccaacaatgacattctctgccacatatgcagccagcgccataggtccctacacgtgtattctttggttggtggtccagtaacctgggcctccaggagtctgacctgttgacactgttgattcctccatggggctgcaaagcccctcagctcttacatcccttcttcaactcctccatcctggactccccgcactcagtccaatgctgactgtgagcatcctggtctgtatttgttaggttctttaagatcctctcaagatacagcttccatcagcaagcacttttgggcatccacaatatcgtccaggttttgtggctgtgtatgggatggatccccaggtggggcagtctctggatgactactctttcagtctctgttccacagtttgtctccataattactcctatgagtaattagtttacccttctaagaagctctgaagcatccacattttggtcttccttcttctcagttatcatatggtctatgaattgaatcttgtgtattccaattttggggctaatatccatttattatcagtgagtacatactgtatgtgctgttttggaactgagttagctcactcaggatgatattttcaagttccatccatttgcctgagaatttaatgatgtaattgtttttaataattgagcagtattccattgtgtaaatgtatcacattatctgtatctattcctctgttgagggacaactgggctctttccagcttctggatgttataaatatggctgcttatgaacatagtggagcatgtgtccttattacatgttagagcatcttctaggtataggcccaggaacagtatagctgactcctcagttagtactaaatccaattttcagaggaactaccagactgatttccagaggggttatacaagcttgccatcccaccagcaattgcggaatattctttgttttccacatcttcaccagcatctgctgtcacctgagttttttatcttaaccattctgactggtgtgaagtagaatttcagggttgttttcacttgcattttcctgatgactaataattttgaacatttctttaggtacttttcagagattcaagtttcctctgctgggaattctctgtttagatctgtttcccatttttaatggggatatttggatccctggcgtctaacttcttgagttctttgtatatattggatattagccctttatcggatgtgagattgttaaagatcttttgccaacctgttggttgccattttgtcctatttacagtgtccttaggcttacagaggctttgcaattttatgaggtcccatttgtctatgctgttttttttttcacctagaagttttttatttatcattccattcatttacatctcaatgttatcccatttccctgctaccattccccaagaaccccccccccccatccaaccacctcattctcttcctttcccattccatctatgtgggcactccccttcctactatccctctcccaccttaccccttcagcatcctcctacattgaggcatcaaacctccacaggatgaagggtctcgggtctcattgatgtccgacaacaccattctctgctatctatgtctctgctatctatatctagtctctgctatctatctatccacagggagccatgggtcactccctgtacactccttggtctcttcttgatcttagaacataagccattggtgttatgttcaggaatgtttcccctgtgaacatgtattccagatgtttcctactttgtcttctattagatttagtatatctggtattatgtggaggtccttgatccacttggacttgagctttgtacaagaagattttcattcttctacatgttgacctccagttgaatcagcaccatttgttgaaaatgatggttttagcgcctttgtcaaaactcaagtgaccatgagtgtgtgggttcatttctgggtcttcaattctattccactggtctgcttgccagtcaccgtaccaataccatgcagtgtttatcactattattcccccagaaattctttgacagattagaagagttttcatgatcctgggttttctgttattacaaataaatttgaaaattgctctttctaaccctatgaagaattgaattggaagcttgatagtaattgcattgagtctatgcattgcttttggcaagatggctatttttactatattaatcttgccaatccacaagcataggagatttttccatcttcagaggtcttcttcaatttctttcttcagagacttgaagttcttatcatacagacctttcacttgttttgttagtcacaacaaggtaagttatactgtttgtgactattgtgaagggtgtcatttccctaatttctttctcagtctgattatccttttttataggaaggctatttatttgtttgagttaattttatatccagccactttgctgaagttgtttatcagctgtaggagttctcaggtgaagtttttggggtcacttaagtatactatcatatcatctgcaaatagtgacattttggcttcttccttttcaatttttatcattttgatctccttttgttgtctaattgctctggctaggacttcaagtacaatattgaataggtagggagaaagtgagcagcattttctagtttctgattttagtgggattgcttcaagcttctctccatctagtttgatggtggctactgcttggctgtatactgcttctaatatgtttaggtacgggccttgaattcctgatctttccaagacttttatcatgaatgggtgttggattttgtcaaatgctttttttccagcatctaatgaaatattcatgtgagttttttctttgagttgttttatatagtggattacattcatcaatttccatatattgaaccacccctgaaaccctggaatgaagcctaattgatcatggtgaatgatcattttgatgtcttcctggattcagagtgcaagaattttattgagtatttttgcatcaatattcacaagagtaaaaggtctgaagttctttttctttgttgagtctttgcgtcatttagctataagcataattgtagattcatagaacaaattggtagtgttctttctgtctttatttttgtggagtagtttgaagagtattggtcttctatgaaggtctgatacaattctacattaaaaccatctggtcctgggcttttattggtttggaaactattaatgactacttctatttatttaggggctatgggactgtttagatgttttatctgatactgatttaacttttgtatttgatatctgtctagaaaactgccaatttcatccagattttgcagttgtgttgagtatagacttttgtagtagggtttgatgattttttgaatttcctcactttctgctgttatatctcccttttcatttctaattttgttaatttataaactgtctctgtgccctctggttagtatggctaagtgttgatctttttaattttctcaaagaaccagctcctggttttgttgattatttatatacttatttttatttctacttggttaatatcagctcttagtttgattatttcctgcagtctactcctcttgggtgtgtttgactcttttttttccctagaacattcaggtgtgctgttcagctgctagtgtatgctccctccagttttgtttggaggcactcagagctgtgagttttcctcttaggactttattggggaattgagtccattgatgttaagagatattaaggatttgtgattgttgcttcctgttccataaatttgaatatgttgtaccttaattttcattaatttctaaaaagtccttaatttctttctttatttcttccttgaccaggttatcattgagtagagcttccatgtgtagttgggttttgttgttgttgtagttgttgttgttgttgttttggtttttttgtttgtttgttttgttttggtggtgttgttgctactgaagatcagccttaatctgtgatgatctgataggaggcaagggattatttcaatattcttttatctgttgaggtctgtttggtatccaattatatggccagttttggggaagttaccatgaggttcggagaagaaagtattattttcttttgaaatactatggtatggtctaaagatatctgataaatccttttggtgtataacttctgttagtttcactctgtctctgtttagtttccgtttccatgacagttggatgttgaaatctcccactattatggtgggaggtacagtgctttgagctttagtaaagataattttctgaatgtgtgtggccttgcatttggagcatatatgtccagaattgagcattcttcttggtagatttttcctttaatgagtatgaagtgtccttccttgtcctttttgataacttttggttgaaagttttattttatctgatattagaatggctaataaagcttgtttcttaggaccatttgcttggaaaattgtatttcagccctttactgtgaggtagtgtctgtctttgtcactgaggtgtatttcctgtatgcagaaaatgctgggtcctgtttacatcttcaatctgttagtctgtgtctttttattggggaattgagtccattgatgttaagagtattaaggtttcgtgattgttgcttcctgttattttttatgtgatttttatgtttgtgtagctattttcttttggatttgtatgagaaaagattactttctcgctttttcgaggatgtagtttcctttcttgttttggtgtttgctacttattatctattgtatagctgcatttgtagaaagatattgtgtaaatttgtttttgtcatggaatatctttgtttctccatctatgtcaattgagagttttgctgggtatagtaatctgggctgggatttgtattctcttaggctctgtatgagttctgctcaggatcttctacctttcatagtctctggtgagaagtctggtgtaattctgacaggtctgcctttatatgttacttgacctttttgctttagtgcttttaatattctttgttttgtgcatttggtgttctgactattatgtgatgggaggaatttcttttctgatccaatctatttgaaattctgtaggcttcttgtatgtttatggacatctctttctttaggttagggaagttttcgtctataattttgttgaagatatttactggccctttaagttgggaatcttcgttctcttctatagttattatccttaggtttggtcttctcattgtgtcctggatttactggatagaaatccagggttaggatatttttgtattttgcattttctttgattgttgtgtcaatgttttctatggtatcttctgtacctgagattctctcttctatctcttgtattctgtttgtgatgcttacatctgtaactcctgacctcttccctaggttttctatctttaaggttgcctccctttgtattttatttattcttcctttttttcccattttagatcctggatggttttgttcaattccttcacctgtttggttgtgtttttctgcaattctttaagggatttttgtatttcctctttaaggacttctagatggtttacctttgttctcgggtatttctttaatggagtaatgtatgttcttcttaaagtcctctatcatcatcatgaaatgtgattttaaatcagactttttcttttctggtgcattggggtatccttggcttgctgtgttaggaaaactaggttctgatgtttacaagtagccttggtttctcttctttaagttcttgcccttgcctttcactatttggttatctctggtatcagctggtcttgctgtcttttactgtggcttgtccctcctacaagcctgtaagtggaggtcttacttgagttcatatcagtactcttgggagaccaggagaaatttggatatgtacagctgtggcacagattcagctctgggatacagtcagaaaccagaaggatcctgtcccaggctgttccttgggtcttgtgtcctgttgtctctgggagggtcccttttgggccaggaatttgaatggaaatggaggtgttacctgtggttacaggtatgttggcactcctgggagaccaactctctcctggtgttttttggttatggaatgctgtggcacaggatcggctccaggagcagaaataaactggaagtctcctgtccctggctgattctcattccagtttcctgagggttctggatgggtccctctgaggagaagtggaggtcttccttgagttcaaaagcttgtctgcattccttggaggctagctctctcctggcggtatttgggtatggagcactattgcacaggataagctctgctctattttcatatttacggaaatattatattcatgctaatttataaaatttcctgcagatgctaccatatttttgtaaacaaagactaacttatttttattatcaacatgtatatcatttctttcattcatttttcccttaactatgatgtcctctacaattttgaattgaagtcataagagtggaggtccttgtttattggttgttattgaatggattttttctcattgattttaatgagaaagcacataaaggttgagtataactcagcttaaattcttgaagacagaaatgcttagactcagatttatatataaatatatatatatatacatatatatatgtatatatatatatatgtatatgtatatatatataggtatatgagtagtgagatatctttaagatgatacctaaatttgaacaaaatgaaagtttatagtttaggatacatgtgtacacagattctgaagattactctacacctgcagttctcagactatagatccttacccctttgacagttgaacaacttttcataagagtcagctaagactatcagaaagcaaaatatttacattatgactcctgtatttggactgctatgtcaaacattatatcagaaatagtattttagatggagttttatgtaaaccctcagatttttaagccattttgccttagaattttcattaagaacattcattcaacttgtagtttttctattattaagtattatcctatatattttaaatagatatcctttattttattatataccttaggttatttctagtttaacatttatattatgttttctgaaaaaaatcagctcatgttaacataatcacagagttgtattattaaagactgttgattctttaagtgttaggaaatatttctttatcatactatttttagaatttattttcaacattttctttaggtgtatgcatttctctgtgtgtatgtgcacataaatcaggtgacagaggcaatattatgccagagtcacctaatgtgagagcagaaaatcaaactcagtatcttgggaagagcaagcagtgcattctcctaatcactgctcaattccttcagcccaacagtagattttaaagcagaactaacatatctgagataaatcttactttatggagtgcatatttctccttgtcaattcttttctcagagagtgaataaggcatttcatcatttattttagggggttttcatggatgttacatccctcccagccaaacctctgtaattaagttatcattgtcttgaaaaggcagttcagtgaatccattattgctcaagtgagccactctagggactttccatactccacagattcctaagaagatctcccaaaagcaagttgcttcataagaaacataaggcagggggtttaatgttatgaaaatagtctcagattttacatccatatggcaatacattaaaggaggacatgctatccaacaaaacatcagtaacttttaatgacttaaacttccaagggacatttttctctgtgggaattttcttggaccacagatttgaattaggtgactgctgtgcatgtatgtgaggagtctgattagcagagtaagggaagaagccattggtttttaagcaaacattgacatatttttggtagttcttgtgatataaatttattctgcctctttttccctattctaacaaaacatattgtacaaataaaatatttgctttgtttataattctcctgttttttctttttatttttctctcatgtattacaacttgaacagatatttttccttccttccctcctcccagtccctctcctgtaactttaatttttcagcccttatttttaatgatggttcttaaatgcttaaatctctcttttagcccaccacccatcagaggcagtggaaaagaaagaatatgggggaagtgggcctgtttggaaatgttcttttgagcaactcccatctgtgttttccggaaattggcagttcagttcataggagtcagcagcagcacctctagctgctcacaaatactttatgaacacattgcagatagcaaacagaaatcagcaacagtggcactatataacagaaatagccagggctcagtcttgacatgagtcagcaggagggtcccagagggtctccaggagaactttttagctgtgcctctctcagagaagcaaagatcatagaagctgcaaaacccacaagtgttgtgtagctagctctaccagcaagtcaatcttagcctttcactgtccatcacattctgtttatactccctctaaacatcatgtgtcctccatgggtcttgcctcaccacgtgtcttgcccaggtgacatcactctgccaatcaccctgagtttgcaaaagtggcaagaaattgtagcataccaccagaagatttggtgtgtttctttctatggagtcctgacaaataggactcaattatgcagtataaagtgaactaaaacatgcatatcattaacaaagaatcccttatcatgtgtcctttcatgtgcttgctctagcagaacaacctctctcttgtgtctgcttcggtgaaaatttccttcacaagtctgccttagcctttcacttgtgtccacttcaggaaaacattgtttcatgtgtttgtcccagcaaaatactgtctaacacagctgacttttcaaagaacccttcagtttccacttcattccctcctacatctacttctacttctttccttcctctgcttcccttccaaaaaacaaacaaacaaacaaacaaacaaaaacaataaaagagcaggctccccagggataccaactgaacatgttaatttatagcataacaaattactctaagtctaggcacaaaccctcatattaaggtgggaccaggcaaactagtagggagaaagaagttccaagatcagtcaaaagaatcagaaacagccaccaatcctactgttaggagccccaaaataacatcaaactacacaaccataatatatctgcaaggtacctagctcagacccacaaagcatcagagactgttgcttcagtctctctgtgtgagtctctatgaaccctgcttaattggtttcttgggccttgttctccatatccttgaccctctggctcctaaagttctttctgcccatcttctgtgaggttgtcctggtcccaagtacaatcaataaatgagacctcataaaactgaaaagcttctgtaagacaaaggacactgtaaatagcttaaaccagcaatctacaaaatgggaaaatattttaacaacttcacaatagaaaaatctccgatggctgagaagcacttaaagaaatgttcaaagcccatactggcagcccatacttcattgctggtgggattgcaaactggtacaaccactttgtaaatcaatccggtggatcctcagaaaattggaaataattctacctgaagatccagctatactactcttggatatgtactcaaaagatctccaacagtatcacaagggcatgtgttccactatgttcatagcagccttatttgtaatagccagaagctggaaacaacccagatgtccctcaaccaaataatggatacagaaagtgtgattcatttacacaattgaatactatgtagcaattaaaaaatcaagacatcataaattttgcaggcaaatgaatggaacttgaaaatatcattccaagtgaggtaaatcagactaaaaaaatacattgtatgtactcagtgatctgcggatattagccaaaaattgcagtttaactaggatacaaccacagaccataagaagtataacaaacagaaaggtccaaatgaaggtggttaaatcccacttagaagggggaagaaagtaaacatgagaagcagagagtgttagtgacctagctaggagaggagcggggctggagaaaagggaaacaggatcaggttctggggagggggtcagaagagaatctcagagggccaggagaatggataaaaatatgcagcaccatggggaagaaagtgagagaaccctctctaaagtaccacagaccctcaggaggtgacagactctcaggactcaatgagggcaagcttaacaaaaatgtccaatctggggagagggaactcgaagagtccacctcaagtagatagggtgtcaagtggagggacaaggttaataacacacaatcaaaatttctgatgcagcattgtttctgtctaaaagaactacagggacaaaaatggagatgagactaaaggaaaggcagtacaatgaccagcccaacctgggatccatctcatggctgaagggttgggggaagacattgaggcctgacactaattttgattctatgatatgcttacagatgacagtctggtatggctgttctctgagaggccctaccagcagctgacagagacagatacagatacctacacctaaccattggactgatgatgggggcccctatgattgaattaggggaaggactgaagaagctgaagggaaaggtgaccctataggaaaaccagcagtctcaactaaccttgaactctgggaactactagagactgagccatcaaccaggcagcatacagaactattccaaggcccacagcacttatatagcagaagactggtctggactcagtgggagatgagcttaatcctagagaacttgaaaccttagggaagccagaggactgttagttggggaagtgccctctcagtagtaagtagagaggaggaatatgatgaagaacttttgaaggtgagaactggatttggggcaactgctagaatgtaaattaaataaataaataaataaataaataaataaataaataaataaaaactattgtatgtcttatgctaaactttgagataacacaaaagaagaaaagaaataaaggtttactctgtttttctaaaaacaatggtttaggtgagtgatagagaatgtgttcaagttaaaataaaatgataatagtcataaatcaatacacttgaaaccagaatttgacagtggtagatttttgcatatatatgttttttttcagtaaaccacacattctttgatctctctaattccatagagtaatccttgtcttcagagcatgcttgattccttcagggttaatctttgaggaaaacaggggctttgaaagcaattcagtgctcagatatagacttgggcttagccaagagccaattgtgtaatgttaaatgactttatgaatgtgcaatcttcatgtgatgctcataaactgttgagttattttcatggctagcctgtgtcttgaccttcagtatgtctactttcttaagattaattcagctagaacactctgtgagatgattaaacactggcattgacctctttggcaggaaaggaagcatgcttcctgagatttcatttctcttttcttttgggagtaactgacaaaattcagacaaagttactgtactggctagttttatgtcaacttgacacaaactagaattagcagagaggagagaacctcaattaagaaaatgactccacattattagactttaaaggtattttctttatggtgatcaatgtgggagggccaagctcattgtgggtagtactatccctagactggtggattggggttgtacaagagagcagattgagaaagccacatggagcaatccagacaacaacaccccttggtgccttctgcatcagctcctgcatccaggctcctgtcctgtgtgagttcttactttgagttcctttcatagtgaactgttacatggaacagtgagcaaataaactcttttccccaagtttcttttggtcatggtgtttcatagcagcaatagtaaccctaactaggacaggttcccttaccctcatttaccacactcagtacttggtactttgagcaaagaactgatcattttattcaacatgccgagtatgacagactgttcttctgaaatgccgtgtcttctctcctttttcttctgaatagattttatctgtggaagttctttatgttttgagacgatcaaaaccaatgtctcattttatcctaggacatgaagatgaaatgatgcacacttatgttatgtcacctctgcctccacatccacagctttggtatgttttgcctgtttttatctttctgtaaggagcacattgtaaggggcagagaactttctatattctcaattcttggctggcaagtctggtataacattatccaggatgtgttagtactgtactttttcagctcttgttcatcataaaatactttgtaggttcctatgaagaactggagaaaattggctattgacacttcaatgcaagagtgtaaaaagaggaagtgaagttgatagatagatagatagatagatagatagatagatgatagatagatagatagatagatagatattcattgattcaccaagtttaacaagtgtcactcacaaaatttagtataataggaagttatgccttgtgcttaagacaagggaatagatagagtttcattgattcaccaagtttaacaagtgtcactcacaaaatttagtataataggaagttatgccttgtgcttaaaacaagggaatgaagaaagactatatgtaagcaatatcctggtaattatcttcatccaataaggagcatatttctgctttcacaagtgtctactctacctttctgataagtgttgtttagatatttctgcaagttttgttctatttcctcccctggaatataaaaacaatgaatttactgttttagccattaatgttttgtttctttctctatgttattgtctaagatcttccagaagttattctgtggatcatccacaaatgccccatacatcctgtcccctgccaacaagtcccagaatcttgtttctgtcaacctaatttttagatatgtgcacctttgacctttgacctttgaatgcagagagcattggcagctcatattttcactttcctctgtatttccttgattatttctcaccagtgccacattctctttgatttctatgattacacagagaagggtaacatggaaggtgagaacagagctagctttgaatctcatgctcacagctaagacttcaggaaagttgcatactctcagataatgccagggtgttctgaggaagactgtgatttggagacaaatatatcctgagatttttaggtccttgtgagtgtttttcataatctttatatctagtctacctgtggtgccatttgtttttccaagaatcaatcagctttgagacaatgcatctctgtcagacatatgtactgaattaatatgttgtaaaacattttagtagtaaggggaagtgtgtttaagatgggccagtcacaaacaaattcataggacatgggcagatggtagctaggttctttgcgagattgttttaagagctacctctcggtcagttttctacgcaatcaggagtcaaagtttcactatccgtattcctcagcattctgacccttaagtctcccactgtaatataatattattctcttctttcagcgttttagtgctctttttttctatgttcaactcatcaacattactcctagattggtctaatatcattgagcatatccactctttatgtgaattgagatcccagatttcatacaaatgtgaaacatatctgaacactaggacttgttcctctcttcatcttgactgatagatgatgtaactagtggcctttcccgccataccataattacctttgagtcctgctataccttttagtactactgctccaaattccttctcagaggcctcccgacctggagaggtgacaaaatttctccttagtaaaatctaaggccaggaagtatggtttttattttctaaaagttagaagtagtttcaatcttagtagagtttaagggaatagtaaacatttaagggaataaagaacacttcttcccaatattatttaaccaacagttatgcttatgttgaattttacctaaagtcttagacttttagccatcttcccttgtttattatactgtagcaagcctttcaacagataagctctctagtgccaggagccatgaaaaggaagctaaaaactagcaggcaatcttcctgagatagttcaaccctgtattccatggattaaaatctaagatggacatgctcttttaggcaaggtcgaggagaatttcattttaggaaagactcctgctactaatatgcttttcctgttattattaaatatataaaataattactgggtattagatcatacttttgagatttctgcagaacaacaaagttatactgtcttgtactaatattatatagacaaatagatgatttcttaattcttaatgatgatcctataagaattcctaaaattatattagtaattattaagctcttttataataggaatgctattaatgccctttctgatgtcaaaactgcatggagaagtctgacagtcttcaagtcatatgagttaattgtttctgagatagcaagaaggcatctgcaacttagtgcacattccaagaggttataaaacaattaaccaaaggacataaaaagggaactgaggatttataaaaagtgctaggacagaagataaaatattgactgggtttatctatctgaaattcactaatacctttgtcacaaaaattatgttttgtaaccttccatgaatctgtagaggtgatgatagatgaacgcttagccagataaatactgccaatggctatgcacgtgaacattctctgttgtaaggttcttattacatttatgatttgaatttatgtgtaatcaactgatgaacattttaccacgtgatcatgtattctgaaggatgagtgagtgctaacgacaaagaagaaaaaggtacttaaaaaaataattaaatcatcaaatttttttacactgcatattttatccccccatccactctccaactgttccacatcccatacctcctccccacctccctgtctccaagtggatatccccactcctgaccccacctgatctctaaaatccctggggcctccagtctcttgagggttaggtgcatcatctctgaatgagcgcagatctggcagtcctctactgtatgtgtgttgaaggggctcatatcaactggtgtgtgctgtctttttggtggtccagattaattgaaactgttggtctcctacaagatcacccttctcctcagcttctttcagcttctataatttaacaactggagtcagatgcttctgtccattggttgggtataaatatctgcatctgattctttcagctacttgctgggtctttcaaagggcaggcatgctaggtcctgttttgtgggcactccatagcctcagtaacagtgtcatgccttgggacctccccttgagctggatcccactttgggcctgctcctggaccttcttttccttaggctcctctccatttccatccctgtaattctttcagacaagaacaattatgggtcgaaggtgtgaatgtgggaaggacccctctctctcctttgattccctgtcttcctgctggaggtggcctctgtaagttccttctccctactgtctggcacttcatctaaggtccctccctttgagtcctgagagtctctcccctcccaggtctctggtgcattccggagggtccctctaacctccaatctcccaaggttgcctgtttccattcttgctgcttggcctcagggcttcagtcctttttcctcactcaatacctgatcaagttcttctcccctactccctgttcctgtccactttccctcccaggtccttatctccccacttgtgattgctttcttctcccttccaagtgggactgaggagtcctcacttgggcacttcagcctgttgacctttttgagttctttggactgtatcttgggtattctggattttgttgttgttgttgttttgggttgttttgtttttgctaacatccacttattagtgagtacataccatgcatgtcctttggggtctgggtttcctcactcaggatgatattttctagttccacccatttgcctgcaaaacacaggatgtcctcattcctaacacctaagtagtattccattgtgtaaatgtaccacattttccatagctattcctctgttgaaggacatctggggtgtttccagcttctggctattacaaatatgtctgccctgccccacctgggggtccataacataatcagctaccaaagacagacactattgcatatgccagcaagattttgctgaaaagaccctgatatagctgtctcctgtgaagctttgccagtgcctgacaaatacagaagtggatgctcacagtcaattatagaatggaacacatggcccccaatgaaggagctagagaaagtacacaagagctgaaggggtctgcaaccctatagatggaacaacaatatgaactaatcagtagccccagaactcgtgtctctagctgcatatgtagaagaagatggcctagttggccatcattaggaagagaggacccttggtctagcaaactttatatgccccagtacaggggaatgccagagccaagaagtgggagtgaggggggagggcgggagggtataggggacttttgggataacatttgaaatgtaaatgaagaaaatatcctagaaaaaaaagaaaaaatatgtctgccatgagcatagtagagcatgtgtccttattacatgttggagcatcttctaggtatatgcccaggagtggtataactggatcctcaggtagtactgtatccaattttctgaggaactgctagactgatttccagaatggttgtactagtttgcaattccaccaacaatggaggagtgttcctctttattcacatccttgccaattatttttcaatgtgtccttttttgttcctgagacttcaactaacaggctggaagttagatctcagcagtccctgcagagctaaaatgactttacttaatcccctgctgttttaagacaaggtgctagtgccagggactgcagtttttgggctcaaaggaacacaggttggctacagcagaaaagtgacatggacttaagatagctaaatgttttattattaaacaacaaccctaaatatctttaagaccatgatttacctctgtcaacactcttccccctctgctgcctcaataggaaccactaagaaggaacagccttgcctgccccccggcactctcgtaactttctgttgtctctggcactatagttatgtcttgatggtggtattgtatggttgtaaggcaaaaggtagataaaagcatccctcataatttgtacaaaaatatgtgccaaaagaggctatcaaggtgataaaagaagttttaaaaatagcacatcaatgttatttttcagaaatgtcaacagtacaaaaggtgagaaaggctacaggaggtgttcaaattagaagaccaatgaaacattctagctaaatatgtgccaacactataatctttattggaagaaatagaatggcatgatctgctttctaaaccatttatgctatatctgttatgctacagttctgaatagtcaataaaagtaacttgataattatagcatgggtaaagtcatatttttatgacatcctcttaactaatgtaaggagcaaaaggcatgccatatttattttactcaagcatataacggaagtatgatatacatgttatagtcagaactctgtccccagcttccatgtctgctagatcataaccacctgtaacttcaactgaaaaacctactcctacttctagcttctacaggaaccctcccttgcatgccccacgattgacatatacatagggacacataaattaatctagaacaaatcagagacaaaaccaaacaaacaaagaaccaaaaaactccaaagaacatgtaactcaaattatgcacttatacatagaaattgtacagattatatatgcatttgtattcatatttatgtcaatagtttaaatggtatatctttaattttcacagacttttcatgtataactccccacaaatcagtacttagtatttttcttgtttctgttgtttttgtctcacttgaatgcaatgatgacattcttgttttacacctacataagtgactgtggagtcctgatatatttctactggtattttcaaagacttactctaatgatactggtaatttattcctatgctaattaaagacaatgatgcctgtttttacattctcatcactgtaataatgaatggagtctttgtgtgtttttttttaacaaatagatagaatggtcaactagaggtttcattttgtattttctatattgttgcggccgccagcagctcgcaacgtgaacggttcgactgagaaggccgctcgagctgtaagagaggaatctagacggggcggaagaaagaatgtagccaagacagttactctgatcaaggctcaaattttattgttgcgacactagttatgaaggaagggggaggggacccgattcccgccgaataatctctggtccagtagaaaggtgcacgggtgtggctccgcaggttccagcagtgggcgtggcagaacgaatgagcaggaagctccacccctgagcaagcaggtttcaggctgggggaggggagactacactatattttgaattagtttgatgtacttttaaagttttgtagtattaatgttatctttacttttgtgtggtattttgtaatagcatacagttttttgattgccttgacattaccatagatggatcaagaaattaggtaacttttctgtaatattagatagatactattttctcttagttcatctcttttctttgtttattgaatttttattggtgtacacatgtgcacctaattttatttgtgtgcattgatcacattgcttaaaacataatgaaatatatctgaagtcctattttttttaacttattgacatatcttaatgacaaatcattcaactcagattaagatcaatgattttgaagaacaaaaggtgatgtagaatgccaaatgaaaagcaatcagcattgtttcttagattggaaattatacttatgcttcagtaatttgctttacctcagaaatcaaaaacatgcttggattttgtcaacaatatcaattttcctggattaactttacaatcaaagagaaaaagatctattttgagatatactccatagcttctgtaattaattcacattaagaaaattatttagaaaaaattaatatactagtcaaaaaagaaaaaaaaatgtacttttcccgttgccatcatatattacatttattggtttgtacatcttgagccatctatgaatctctagaataaagtcaaattgatcatgaaaaaaatattatgtcaaacaataggacaggagagttatgtagtattaagcttcaggaggccataatgtgtcttatggaggaagtatgtgttatagatgttttgtttcatcaggaagatagttctagtgcctatgagttcattgcatttctgtgtttcaagatctcataaaatatggaatcattaaaggagaaaacacaatgtaagatcatttattatcattaattagttagcaaaaatatggctaacagaatcctatatttttgccaaaagcaaatgatgctgttgtggctcatacatttccaccttgatgtcataatcacagagctattacatgaagagtcactgtgtctatattcctgtggttttttttaatcaaaatgctgttggacaaaatttcccagtttctgagacaaaatgaccagtgtcaaaggtgggtatgcatgagatattccataggcctcaattccctcaccaacaagcattaatatttatgctactgtgacaaattatttggctgttctaaaaacatacaaacaaataaacaaatcaaaacaaagaaaaatattactacaattgttgtctgaaggttttctgagagttagcatagttcatgtacagtgtttatattttagtgccttgcaaagacaacacatgatcagtgtcccattcataccaagggatgcttttatatttttcatataaatagtggcaccatgacttgtgatttttcttaaaattcagaataggtcatactagaaaaggtgcccagatgattgtcattttcgtgttgacttctggtccttgaagagtattttgtttattttattacttttcatcatttctggttttcttggttgttgttggtggttttctttggtttgtttgtttgtttagatataatctcacccagaaaggcctcaaaatcatgtcgatctccctacctccttcctctgctacccagacatacttgattacttgtgactgccgagtatggagtctatggtatttttaagtcactttgaatacccactccacaacctgactgctctgtgtgctcaataaacctctctatatcttctgactccgtgactgtgacaccgctgacctatccttcctgctcagagctctgagatctccagctgtcagcgctctgctgtttagtttgctatgctgcttggttgcttaaggattacttctataaaactttagtcaactttttacgtttagaacaaaagaaaacaaaggggttttttgttgttgttgttttgttgttgttttttttttacatgaaaaaactttgtatttattatttttttaggaaatgcttatgagtcatctagtacattctaagcaaaatctgggtgacatgaacatctatctactcattccttttgtatggagagcactttgggaagcccttgctcttttgagctttaattttgaagaggcctctggccatgtttcagatgtcacaagaagaatattctctttaaccaacagcactgtgctgcgttattatgctgcccacactgtacttgaagtgcaaggccttaaggatgaggagaaactggagtcttgtaaccttgcatgtatttggctatcagggtctattttcttgttaattgatgagggtcaaatgccagggttagggcttagttggtttgttgttgttgttgttgttgttgctgctgttttgtttttgtttttgtttttgtttttgtttttttagacaggatgtctctgggtagccttggctgtcctggaactcactttgtagaccaggctggcctcaaactcagaaatctgcctgcctctgcctctgagtgctgggattaaaggcgtgctccaccacacccggcttagggtttagttttagcttccaatgtattttctgaaaagtgacatggctaatggttaaatgaggcttcccacaaatgtgatcttatttatttctttgtatacaccatatattaaattgtgtgacatttggaggcatctgtattctacatcaccaagtgctcaggatccattcctgaaatgtctctcaaccactcttattattattcttattatccccatctactttttatgatatctctttacactttacaagttatagtggacagaataatgtatttatcaaagatttacaatggaatatattaatacatatattagttgtgagaagattgccataatcaaactgttcgttcacccacaaatttacttctaactaccattgtgtgtgcctgtgtgtgtgcttgaaattagataatcttggaaaatttcaaatatacaacagattatcagttatagttgtcattttgtacgataaatccataatatttattattctttcataaataaaaccatgccccttttcatatatcttattagttctctatcttcagccccaacccactattctgggactttgaccttagttacacacaggattgagacataagctatatgtttttcattatgagcactatgtcttctagatttgctcatattaattcaacagatggtattcctttttaaactaatattccttctttaaaagaaaacattgatatatacacatacatatacattgcatactatatatgaaccacattttaaataattctataatgaacattaagtacaaaggtctcttagttattctgatttcattggctttggttacatgcctgtaaggaggaaggacatttcatttggtagttctggtaattttttagtaaccttcagatagtttaccatagcaggtatatcaatttatatttcttccaacagtgcacaaatactttcttcctccacatcttcaacattagtcactgttttcctttatttataaccatgctaagaggcatgagtttatgtctcattatggttttcagttgtcatcttagggctctggtcttgctaactaatgagtttcttagcttgtgggaatgtccacattgatgggtatttgtgccactagagtgtcatcctacatgtcatttcttgttgatgcagcagcaaatttaagacctaattatgaagtactaggaaaagctttgccattgtttttttgttttgctcccttgtcagccttgcttttcttttaaggtatagaaagagcagcacctgtcacaacagggtgaaagaggcaaactctttcggagttttaaccttaaaaatgtgcacaggaaagttcccagtagaattttgttcaggagggaatgacaaacatgatttcaagtggcagattcactaacactccgctctaatttgcttctagaaacagtattagtatatagttcctaattagaactatgcattttagtattcctaaagaaatcgtggtagtaaggctggtattaaggaaaaacaaaacagtagtgacatttgatacttgtcacaacccacaacactaaagaggacaacacagaagccatgagttgaagctagttgggctacacataaattctctgtttaataaacaaatagacaagttgctttgatatatcacgatggttgtaaaatatgcttaatttctctatcacactatggtcaagatcaaggacgaatttgtgcgttaaatcattaaccctctaaaggtgaatcccttctctcacatcctagtaatcatagattattcaaaaatgattaaggaaagacctgaagagataaaggttagaatgcatgtggatgggaaagcaggaaagaagcatttctgactagctttttgtagcttaaggcattggttttagattctgtaccccaaggaatattttcatggcttccttctctgattactctaaatctgtctcatgccagcctattgtttcttgtataagggtactttgcttgaattatctacagatgcttctgtatccaaatgactttctgttaaacctctgttttgaaaatatatgtttcatctccatgtaataaatctatttatttaacatatgtgcactttttacaaccaacaaatatttattgagactgtactagctaccattcacaaaaaataattatagtaaaatttttgaaagaaaagtcaaaatcttcatgcctaggatgcccttctcagtagcagaacattttccctggaaaaacactctgtttggacaatataagccaaacctctatgttataagggtacatgcacatttgacagtcaatacatatttattgagaatgtactggataccagttacaaaaaccaaatcaaacaaacaaaacaacaaacaaacaaacaaccagagcactaaagtttcagagaaaaaagtcaaaagatttgggtctaggatgcccctccgtaggagaacataatcccccaaaatatgaattctactttttcatacataacaccagagaagcaaatgaaacaaacaaacaaacacatttcaagtcaagtatcctggaacagacctgcaattctggtatccaggatgttgaagcagaagaatattagtttgagatcctttgctacatattgactgtgttaccctctttcaaaaacaaaacaaaacaaaacaaaaacaaaaaacaaaaaacaaaaaacttaaagcttacatagacactgaaggcaggagggctgcagaaattcctcagtagctcagagcataccctgatctcccagaggacctgagttagatttgggccatcctcattcggcagctcacaaccacccataactctaggtccactaggtctgaactgggagagggatgctactgactttcattgcagagagtagaagaacctctcaaatcattacatagcacaaagtatcatttctaagactaagcaagcttgatctataagtgctgctgcattactccctctgacatcattgcccctccttttcccgatacccgtcattattgcccagtcaactgcctcagatatgttttaatcgaattaaaggtactcaggttcatacctaatgttcttagagtaataaatgcactcatactagaataaagttggagaagtggtttactttaacccagacaaaatttatgtcttcgtgtctttttctaaatgtcaggaaaatatgtaaagagaggagatagttatagagccaaaccttcattcatggctccaaactatttgaagccaagaaggaagtaaaaaagaaaagccttggaaaatatatacaaaagcttcaaattttccaaattttggagtaatacatacaattgtaacattgagcctaaatctttctaaagaaaaggaacgatcgtaccatcccaaagcgtgaatttgcttaaggagtggcttagcatttctccttcttaggaaagacactctgtaataacctaagtggaagtatgcgaggaaaaccaaattgctttcaacccatttcagtaactcattcccacagaaaatggcctgactgagagcatagagtacacagattaattttactgagagctgcccaacatcagacctactcaccaccatggctccattcttccagtatatcccacacacacacactccaaacacaaactgaaagtagtactcacctctcactattctagtatcaagcaaatgcattctaaaattctgatccatttggttgcctaccacatcattccagttattaattttaaagaaacttggatcatatctcaagaagaaaaatttgtcactatttaccacacccaaggttaccatacaaactctaaaaacgatagtaattagatgtagggattacagtagcaatttcaggtgttgctatagattaagtggaatgtgctgataacactaagcaagggaaaccctgacttgaaaaatgacaggcatcagcaacagtaactatttcagaacttctaactaacttgtctgagtctgaatgtatgttatgggcatggatagtagaagcagcagcactcaaataaagattaacacacagggtctcttttaggagggatgcttacaagttgaagagagcatgtttgagcttggtttagaactgtgaaacagccagttcataaactctgctagagctgaagtggctctttggaatcaccccaggttggagcaaaagagtcccatgtggatcattcgctggaaatggctgcactttgaaagaacaaaattttttagaaaccacctgcctgagctatggtaatgttccaatataagtcattcaatctcaaagagcagaaagagggaagttttgcattttgcgttttaaggtcaggtgatgcttccctaagttgtcagtcactgagaattcttgcactcacttctaaaacgtgctggtcattatactctatgcccctctctctgcttttgagatatattttttcaatgcttttgtctgcagtagagaattgctggcttcacagaaaacccaggatgaaagaaaagttttaaggttcagatttcagagtgttgttgtgactcaccaaacttgaaatgtcttcctaatttcttcttcttgttattgacattgagagtcagctgtgtgtcctcaagaatctgttcttgggaggtacctgctgtgcgatgtgatcatgtgtgcttagaatcctagtcccccactctgactctcttgtcttctctcctcctctttctttctctcctctatctattttaaaacatgtttcacatgtataattgtaataactccagtagcaatacaaaatatctgtgtgtccccattcatatcaacaacggagagattaattcaaaattttctcctctagagtttctttatgaagatcaaatgaaatcataagtgcaaggatatttataaacggtgacgtgcagtgcaatcacaagacagggtagcaatagcaccactccaacctagactgctttagcagccaggaagtacgatttgtacttgattaattcacatggcattttgataaagcaaccttgttaaataataattttagtgttattgttctcacataccagcagaggagagaatgaggaaatagcatgttcaaagaatatgaaaaaaccatataaaacaaataaacaacaaaaaaaaagatttttggtttttacctaacatatttattttccccttggctatgagagcaagaactaaaacctttacacgtatttagtgtgcaatgtagcttatggtccatgttgtttctctcaaggacattcaagacagtagttttagaatgcagggatgaacagagagcttgaagataacctcatcatattcataaatttcttgaatgttactgaaaccatccataaagtgggaactggtctcaatgttgccataagacctctctgcattcagcatggtcttcagagatgtacccatgagtatatatcggtgctgccaggtgaggcagaatggaatagcttgaatcttgtgatatcttggagcaggtgaatggcttttacagctagctggtagtttcatccaattgtgaggagttaaatggtccatttgcttgttctctagtatttctcattggagcatggatagacaatgtctaataagtaggacaaaatgcaatgaatgtatgtgagtctcagatgttccatcaatgagctgtgactatttttctcccttcctcccacatctcctcctcccttgcctattaatgcttctcccacacacctcctctctctcccttactctgggagaaaaaaaaatctcaggatataatcaagctcttaaaagtcacatgggaaaggattccagcttccaggatgtagtgagaacaaggctgtatgcatgagaggggcacagctctggtccagtgtagagatcaatggtccataggcaaggaccattcccataagttaacggtcaacttctggtgctcagaagcttgtaagatttttaaacttcctgcatttaaaggttgtttcagggaaatgtatgcttaaataacgatacatttaaacgatcttatcacaggtaaatgagtatatggaaataaaataaggaaacagaaaacattgtattgtattcctatatcaacatattcagcaagtgaagcccaattacaaagatggatgtttacaacccaccattgcctgacaactaactcagtacacaaaatgtctttgctataagtagagaacaatactccttatccatgtggagtaacatatttcaaacagaaacaaaatgattcaatatccctggttttcaagagacatggggaaaaaaaactcactaaaatccctatgtcactttaccttctataaaaagaatcatgtggccttcgagaagatgcagcccattccagggaaatgcacatgtagagagcgatccagacttaagaccaaactggagttgcattgtgaactcaaatttcactagcagtattacaatgtattgtattatcttcccagaagcatgctaaggaaaatggtgagagaaatcccagatctttggagcccgcatatttgtgtcttctaagaactcgtggtgtgaaggcacgtttcatttcaacactgctgtctacagatgacatacagaggaaaaactttgactttccaatgtttacttgacaaaaagctatttcagagaccatttctgcactgcttgctcggtcacgcatccatgtccagcacagcatctgtcagaacttgtcacttttatttaagaaaggctttgacacattaaaaattctattctaataaagcctatgccttatttgacagctttagaatataccatgcatgtgtccactgtaaacactcagatcacttctcagcaggtttttctcctttgtcaacttggatagattctcaccttcttttagtccaatttctagagaactaaaaagtgtatattaaaaatgtcacagtttctgaattctctgaggattgtgtgagaaaacatattataggaaaaaaatgtaatttacagttggtaaggaaaaatgccagtgtaaagtagcacaaacagacacataatcacagagaactgaaacctggattgcatggtttcactttgaatactatattgactaagaaattaaaaagtattcactcagttttgcctacattagacactatactacaatgcaaattaaatgttgtgagactgacgaggtacaaattgcatctccttatcttatctaatataatggtcttctataatgaattgctatcatttgtgatccaaagaaagggtgttttaataattctatcaataattttcactcattataatgtgtaagtgggtcaagatttgagttatatgcactagtacatataacatatttacatttataaaatattaactccatttagcagaaatggaaataattctcagagtagacaaacatatcattcaagtttctcttaaataaagttgccaaggagagatagtcatttataagacaggttggtagttatggatacatgcctttggaagtcttgaatacattcatatggaagcaaactaatgtgcttcattatgatgaagaataataataaccagaaaataatacaaagtcttaatgatctgcatccttaatagataaagagagatgaaatgattgatactgaggaataatgaaataacaactatacccagtttacacaggtctttaaaacctgaatacctggataccctgaagaaattaattttattaattttattataaccatctaaaaatttattagtagacaacattttcatcaacatacaattgtgatcttgcctcattttctattctttcttgtaattctgagacagatatattttaacactatgccaagagaattatagccaagtatcagtgcccaaactgctgtttgttctagtacattgataatagcgtgataatgtaacttctctataatgctaatggtgcaagcccaagttgaagaataaaaggagactgcatatgatttctcagctttctcataaagcctgaagttgtctcaaaaaaaaaaatgtccacaagcaagtagcatgtttagtctcttctttcactttcaaactggtgaaactccaagatatggaaaacaaacaaacaaacaaacaaaaaccccaccctgcctttagaagcctccaggagaatgaaatgaaaacactttcatgttaagacacagaatttaaggtttaagatcaatttaactactctagtactgatgaaaaatagaatagcatctcctaatttcagcaacattcagtttgtaacttctgaatgagcatccccatttctttcatgtgtgtgacatccggtccttaccctaaagtaattaaaaagtgactcctgctgaactactagagatagaggtaattctcttgtattcttcaaaacccagggtttctcaactattggatgatacttatcctccccaatcacaagctctttgtcaagcagtagccattccagaaggtgattcggctaaaatattggcagtgttaaagaactttgatcctatttaaatgttgatatgtgaagtataaaataatgacctgtatcttatgtcaaagatagagaaatatcaccaagattaagagtgcaagaaaggtgacacataaaaattgtcttttacaaaaaaatatttttttcattcttgagaattgcatatatatgaaatatgtaacatattcagtctcatggcaccagctccttgcacgtcccctgcagcacatcatctgcccaacattgaagcatgggattttgtgctgtgaaaaaaaaaagattcttgagacatttcatgaggtctttcagacttgtcatttatagctcatacagtctgtgacagtatgaagctagtagatagaaaaactaaatgcaagggcatccacattcattaaagaaactttagttaaactcaaagcacacattgcacctcacacaataatagtgggagattcaacaccccactctcatcaatggacagatcctggaaacagaaactaaacagaaacacagtgaaactaacagaagttatgaaacaaatagatttaacagatatctatagaatattttatccaaaaagaaaatgatatacctacttctcagcacctcatgataccttctccaaaactgacaatgtaattggtcacaaaacagtgctcaacaggtacaaaaatattgaggtaatcccatgcattctgtcagatcaacagaggctaaggctgatcttcaataacaacataaataatagaaaacaaagatacacatggaagctgaacaacactctactcagtgataactttgacaaggaagaaaaaaagagagaaataaaatacttttttagagtttaatgaaaatgacgccacaacatacccaaacttatgggacaaaatgaaagcagtcctgagatgaaaactcatagctctgagtgcctccaaaaggaaactggagagagcatacactagcagcttgacagaacacctgaaagctctggaacaaaaggaagctaattcacccaagaggagtagaccacaggaagtaatcaaactcagggcttaaatcaaccaagtagaaacaaaaagaactataaaagaatcaaccaaaccaggagctgattctttgagaaaaccaacaagatagataaacccttagccatactaactagaggaaacagggacagtatcctaaataccaaaagcagaaatgaaaagggagacataagaacagaatctgtggaaatccaaataatcaacagatcctactacaaaagcctatactcaacaaaaccggaaaacttgaatgaaatggacaattttctagacagataacaggtaccaaagttaaatcaggatcagattaatgacctaaagagtcccatatcccctaaagacatagaaacagtcattaatagtctcccaaccaaaaaaagcccaggactacatggggttagtgcagagttctatcagaccttcaaagaatacctaatttcaattcttctcaaactattccacaaaatagaaacagaaggtattctacccaattcattgtatgaagtcaaaattactctgatacccaaaccacataaagacccaaaaagaaagagaacttcagaccaatttcccttatgaatatcaatgaaagataataaaattctcactaaccgagtccaagaacatatcaaaacaatcatccatcacaatcaagtaggtttcatcccggggatgcagggatggttcaataaatgaaaaaaccaacaatgtaatccactatataaacaaactcaaagacaaaaaccacatgatcatctcattagatgcttagaaagtatttgacaaaatccaacacccattcatgataaaaagtattggaaagatcaggaattcaaggctcatacctaaacataataaaagcaatgtacagcaaaccagtagccaacatcaaattaaatggagagaaacttgaagcaattcaactaaaatcagggactggacaaggcttcccactctctctctctctctctacctattcaatatagcactagaagtcctagctagaacacttagacaagattaatacagtaaaaatggctatcttgccaaaagcaatgtacggattcagtgcaatccccattaaaattccaactcaaatcttcactgagttagaaaggtcaatttagcccagcagtggtgccacactcctttaatcccagcacttgggaggcagaggcaggcagatttctgagttcgaagccagcctggtctacaaagtgagttccaggacagccagggctatacagagaaaccctgtcttgaaaaaaaaaaaaaaaaaaaaaaaaaaaaaccaaaagaaaaggaaaaagaaaaagaaaggtcaatttataaattcatctggaataacaaagaacctaggatagcaaaaactattctcaataagaaaggaacctctggtggattcaccatccctgacctcaaactgtactacagagcacttgagataaaaactacatggtactggtacaatgacagacaggtagatcaatggaatagaattgaagacccagaaatgaacctatatacctatggtcacttgatctttgataaaggagctaaaaccatccaatagaaaaaagacagtattttcaacaaatggtgttgtctcaactagtggttagcatgtagaagaatgcaaattgatccattcctacctccttgtacaaagctcaagtctaagtggatcaaggaactccacatgaaatcagagaaactgaaacttatagaggaaagagtggggaagagccttgaagatatgggcacagggggaaaattcctgaacaacactactggcttgtgctgtaatatcaagaatcgacaaatgggatctcataaaattgcaaagcttctgtaaggcaaaggagagtgtcaacaagacatgaaggcaaccaacagattggggaaagatctttactaatcctaaatctgataggggactaataaccaatatatataaagaactcaagagggtggactccagaaaaccaaataaccctattaaaaggaggggaacagagctaaacaaagaatcctcaactgaggaataccgaatggctgagaagcacctaaaaagttgttcaacatccttaatcatcaggaaaatgcaaatcaaaacaaccctgagattccacctcacaccagtcagaatggctaggatcaaaaactcaagtaccagcagatgttgactaggatgtggagaaagagaaacactcttccattgctggtgggattgcaagctggtacaaccactctggatatcattttggcagttcctcagaaaactggacatagcactacctgagaactcagctatactattcctgggtatatacccagaagatgcttcaacttgtaaaaaaagacatatgctccactatgctcatagtagccttatttataatatctagaagctggaaagaacccagatgtccctcagcagaggaatgaatacagaaaatttggtacatttacacaatggagtattattcagttattaaaaacaatgaatttatgaaattctaggcaaatggatggatctggaagatatcctgagtgaggtaacccaatcacaaaagaacacacatgatatgcactcactgataagtggatattagcctagaaacttagaatacccaagatacaatttgcaaaacacatgaaactcaagaagaaggaagatctaagtgcggatacttcgatacttcttagaagggggaacaaaatacccatggaagtagttacagaaacaaagtttagagtagaggctgaagtaatgaccatccagagattgccccacctggggatccatcccataaacaaccatcaaatggagacactattgcatatgccaacaagagcttgctgacaggagcctgatatatttatcccctgagaggttctgtcagtgcctggcaaatacagaaatggatgctcacagacagagcacaggatccccaatgaagcatctagagaaagtacccaagaatctgaaggggtttgcagctctataggaggaccaacaatatggactaaccaatacccccagtgctccctgggactaatccaccaatcaaacaaaacacatggtaggactggtgtctctaggtgcatatgtagcagaggatggcctagtcggccattattgggaggagaggctcttgatcttgtgaagtttctatgccccagttataggggaatgccagggccagagagtaggagtgggttagtcggggaataaagggaagttgaagaagatagtggatttttggaaagaaaactaggaaggggaatagcattttaaatgtaaataaagaaaatatctaataaaaaagaaaagaaaaaataaaaaagaaagaaaactctagtgtttcaaatgtgaatatgttattagaacaatattatagtgttagtagtgatagtgattataagtagattagaagtgaatcctcctaatactctaaagttgctgctaccgggtatattcaggtataataatgctgtctgagtttctttatacagggctggtactctgttccctgatgtctggagtctgatcatttgcttattatgcagtttcttttatttcatttgttaaatgagtgagttagtttaagttcaagctttccttcagaactaagttctataaaattaatatactcactccaaaaaaaatttacggtatgtgtgatcgtgtgtgtgtgtgtgtgtgtgtgtgtgtgtgtgtctatggagagtgggcatatatgagtgcatttgtgaccacatgatttataaaatagcaactactgtgtactgtccatgacagttattacaaattttattttttgactgattcaagtgatgatagtgtttgtaaaaactcatatttcttcatgtatattcaaaaggctgaaattcagtgattctatttttggcatcatctgagtcataccgaagtaaagtcttaaaaagctattggatggatcacagggctcccaatggaggagatagagaaagtacccaaggagctaaaggtatctacaaccctataggtggaacaacattatgaactaaccagtaccccagagctcttgactctagctgcatatgtatcaaaagatggcctagtcggccatcactggaaagagaggcccattggacacgcaaactgtatatgccccagtacaggggaacgccagggccaaaaaaaaaaaaagaaaagaaaaaaaatgggaatgggaatgggtgggtagggaagtgggggggagggtatgggggacttttgggatagcattggaaatgtaattgaggaaaatacgtaataaaaaatattaaaaaatgatgtcttgatcagaattaatatcattattggcatcttaatatgacaacatgcctcactgcataatctgtgaaatcagcttagatgtgtccaatcttaacttttgaagcctggaagattggacatagcaatagatgacaaagggaccctgagtacccacatctttaggtaccatacatgtgaatgccattttctatggtacttttttttcttattcatttgacaaaagcaatccatcccaagacacttaagatagaaataataatataatttggggaaatttgctaaaatataaataatccagaaacacttggtgcatatttagatatcatattttccactgagaaggcacatggcatatttcagtttcccaggattccaggtgatgctgttgtagaaataaatcattaaggaatcaacaaaatatactaactctttggaaaacctgataagcaagggataggacccaacagttgcagttttggttttcctttaaagtggcaggcagtgaaacatcctagatataatattgaccttttgtatctcatggtaaagagcccagaaatgatactaatattaatactggcagaaaagtgtgaaactaaaataacagataacttttctttttttttttttttttttttttttttttttttttaagttaaaacaaagtgttttatttcattgaagtattcacattaacgtttgcctacattgagctaaatattcacagaaagaaaggaattttatccaaaggaatttggacatttgctcttcttattgccatagtaacaatgcactttacagtgggtcattacattattcaccagatttctgctttgctctttttaaaaataggaagaaaatacattgaacaactgggaagaaaagaaaatacataatgacaatacaaatatgatttgaaatatgatatatgcaatcatttactgaaagctggtacaatcataagtgaaatatatgtatcatagtataaaatgctattataaaattacataggaaatgcaagcaattttttgtgatgaccactcactctgatgattttgagggtttgtgactttctgcaggaaaccatggtaacttagggctgcgctcttttttttttttttttttttttttttccatttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgggattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggctgtacaagcctgcaattccaccaacaatggaggagtgttcctctttctccacatccttgccagcatctgctgtcacctgaatttttgatcttagctattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctggtggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatattcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacctctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttagggaaaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtagctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttcttgctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctaggttttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggacttggttcctgttagtaagattcctccgtttacctttcgccatctggtaatctctggagttagtagttatagttgactctgtttagagtttgttcttctgatgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtagtacagactctcacctaagcagactaaattcctaagttccttggagtcccgggaccaagatggcgaccgctgctgctgtggcttaggtcgcctccccagccgggcgggcacctgtcctctggtccggaaggtggccggctgtccccggcccacacagggtgctgcctcagcgcctctgtgcttctgcctgttccagaagctatcaggttctctggcgcaccctctcacctgttcagactaatttcctaagttcggcgggtcccggaccaagatggcgaccgctgctgctgtggcttaggccgcctccccagccgggtgggcacctgtcctctggtccggaaggtggccggctgtccccggcccacgcagggtgctgcctcagcgcctctgtgcttccgcctgttccagaagctgtcaggttctctggcgcaccctctcacctgttcagactaatttcctaagttcggcgggtcccggaccaagatggcgaccgctgctgctgtggcttaggtcgcctccccagccgggcgggcacctgtcctccggtccggaaggtggccggctgtccccggcccacacagggtgctgcctcagcgcctctgtgcttctgcctgttccagaggctgtcaggttctctggcgcaccctctcacctgttcagactaatttcctaagttcggcgggtccaggaccaagatggcgaccgctgctgctgtggcttaggccgcctccccagccgggtgggcacctgtcctctggtccagaaggtggccggctgtccccggcccacgcagggtgctgccccagcgcctctgtgcttccgcctgttccagaagctgtcaggttctctggcgcaccctctcacctgttcagactaatttcctaagttcggcgggtcccggaccaagatggcgaccgctgctgctgtggcttaggtcgcctccccagccgggcgggcacctgtcctccggtccggaaggtggccggctgtccccggcccacgcagggtgctgcctcagcccctccgcgcttctgcctgttccagaggctgtcaggttctctggcgcaccctctcacctgttcagactaatttccaaagttcggcgggtcccggaccaagatggcgaccgctgctgctccagataacttttctattctgcccacatattcagcattgaaggtgcttttgacatagaactgtagcctcccccagccttgagcaggctgactcagacctgttctgacactgtcagcccacctagtgtggagtcttttgacctagatgaggtctactgttttgccacatctggggttttctccaagacaccactaacctctgagaggctgaacctatcttcctgaggcaatcctgactaagcaataggctggtgatagagtgaagagagcctggtggcaaagcaaggagagcctggcatggtgggggatgggctttcccccttttaagttcagactcaaaaagtaaactttaggccttgatcagtatctttgtcttggtctcatttttctctctctgtctctcccatacagccccatccttcttctccagaacccgcttccacccagcaggcagctacaggtggcacccaacgtgggtcctgaacatggaaggaacaattgggggaaaacactttcttggtggagctccaaagatggtatctggcacggtaagcaacattttgtattcatacaagcactggctttaaacttcatccttttggtattgtcggtgtagatgtgaaaggatacgggctaagttgggacagcattgacccggcactgattccacttaggggttgacagtggaaattgggatcagaaaattctaagcaggcatttgtctgcagccttcaagagctgcttcaggtgagaggagtagggtttgaagaacaattgttagaagacttttcagatcagatagattcttgctgcccatggttccgaggagaaagaactttaaataagaaaacctgggagagaattggagaagctctgaaaaacacccaggcagataatttcaccctctgcctctgggtgctcataaaagatgctattgatgaagagactacccaggagagcttgaagaatctcagaaagaacacctgccaagagggttttctcagaaaagggccctctcagccctaatttaaaagttatagagatcctaatgattaagaatctcattcagaagaaggagcagtcaaatattatgacaaggattgtcctccctatgaaccttctgccccacctatggcctctactgtgggagatgctactcaaatggacatgcaactaagtaaattagagtttgaaacgaagttgaagaaattgactaatgagctacaggagctgaaaagggtgccaagtacagggaagaacagctattctgagatataccaatcgcccgttaaaagagcggtgagtcaggctctccggaaaggccaggatacatctgacattgtagctttccctatagttgagataattgaccagcagaacaatagagtcagacaatatcagactttggagttcaaggtgataaacgagttaaaaacagctgtggcacagtatggcccttcagctccttttacaaaagcattattagatactgtgatggagtcaaatttaactccccaagattggaagacttcgtgtaaggctaccttgtcaggaggagatttcttactttggagttctgaatggcgtgaagctagtaagagaaatgccgctttgaatgctcagacaagtaacccagactgggatgttaacatgcttttaggagaaggtcaatatgaaaggaatgctaatcagattgggtttcctgttggagtgtatgcctaggttgcaatggctgcccaccatgcttggaatcagttactgactaaaggggattttagtgaaagtttagccagtattcagcagggccctaatgagcttttccaggattttgtggctaggctattaaaagaagctagtagaatgggctctcccatacagccccagcctccctctcaggaatggtaaggtgtaagctacatagaactgttgtaggattttccctgtccaatcacattagggcagtggcacacttgtgattggacaggagaagggaggcagagctaggagttgaaacagggatagagctctgaggaggagagcgaggaccagaatggaggctgacatggtgttatcaaaaggttagaataattatgttaaagctttatcattatcatttggctctgaaattattgtattggcatcttgtaaattgtgttattattgatacataaatctgattggctaattaagcattaagagtcttgattctaccgggtaattaggtgttcagatggctaaccagggatgtgtgggacattgaatgaaagtgagaggaactctgggggccccatccgagaaatggcccagtgggagtcatatggcctcacagggctggcgacttggtgggcctaactgagtgagtgagattacctggtgcagggcctagctagctctaaagagttggtggtggtggcaggagcaagggaacgcagcctggcccagctgagagttggtggaagcactttttaaatatttcccccaacatagaactacagttttaaatcccatttattattttcctatattggactagatgaaatctatgttgcactgtttctttccattgagactctaaatgaaagcacattttagaaagaaaagtgataaatccttatatcttcttcttaacactattcagaaaattattatgtacacaaaaatcatacaatggtatttatggtctgactatgtaaccttaattagcctaagattctgtatataggcaaggcggaactgaatttacagagatctacctgcatctgcttcttaaatgttgggattaaaagccatccttcccggctttgacaatctttgtttatgtaatttttaattttttaagtcagcatatatgtgaagcatgcaattacataactcatgcaattacagtaattcagcttagtcataaatttacagtcatcatcatcatcgttatcattttactaactggtcagccctgagatcatctacataaaagtagcatacatactgagaaggttgtatttatatttaggaatatatatatatatatatatatatatatatatacatatatatatatatataaatcagatatctctttggaaagcacttaataaaagcacaaggcaggaagtcctcgaagaaatggaaatagtcttactaatacattcaaaattgagcaacatgtatactatgattttataaggtacaaattaggaattctttggcagctaaattactgtatttgcatgagttataattccagatcacaaagttcattcaatgtattgtgaaaaagatgaacaagcagacttgtaagcagaagtacccctgtgcttatttttctaccgttgttaatatatccaggtttattagtaagaaatgaagatgtatatgtgaggttaaatataaaaagcaacagcattaactgtgatgaaagcatttgagatgtgatttcactcctgtactcttctctgtaatggctatactcagtggaattatatttaatcaacagtttgatggcttggaccgtctgatattgcattatttgtactagaaaaattcagtcatattccagtactgagcctttggtgcaaggctttcaataaaaagaatagtcctcttaagtaggtggttcacacagactctacaaacccatacaaaaacaaaatcagatactcatgtcatgccttcacagaaatttcaatttcatttaggcatcttaaaaggtgaataattgaaaccaagcccagtagaactcatgcatttcagtgactaatattaacagaagtgagaacagaaatatttcgtggatttgtgactgtaaatttgagagtaagcatagagaacgaggattgaagggaggaaattgaagtgggaaaatgcttaaaatatatgctgatttaaaaaattaaaaaatacacaactggaggagttgattatatattcttgtttggattacaaacttctacaatatagtaggctaagatctagtggtttaactccaaatttcaacatgcctctgttttatgatctaaaattccatcactagctatctgcccaagatacttgaattcatatgtgcacaaatgattcaaatcccagtatctacagcagatttgttagaaatcaccttaaaatacaaataaaagttagataaccttctattggataaacaaatagcattttacttgtacagcaccattttattcagaaatataaaggaggaatctatgtaacaatatcactgattaccagatgtattgtctgtttcaaaagaaaatttgcaaaaaagaattcatgtttccatctgatagcacattctagaacaaacaatatctatacataaaaatgtagaccaagatatttttgcaaaattgattataaggagatagccagccaccttcctggtgagagcacgggggtctgccaggcctgagaggtttgtggcacaggcgccggcgggagacttcttggctccgggactccgcggagggcaggctgcacgggtgaccgtgtggaatacagagtgccagccgtttctgggacgggcgagagtcgcagagcttctgggcggcgccatcttcagctccagacagccggccaccttcctggtgagagcacgggggtctgcctggcctgagaggtttgtggcacaggcgccggcgggagccttcttggctccgggactccgcggagggcaggctgcacgggtgaccgtgtggaatacagagtgccagccgtttctggaacgggcgagagtcgcagagcttctgggcggcgccatcttcagctccagacaaccagccaccttcccggcaagagccacagagcttctgaggcagcgccatcctcagctccagacggccggcctccttccggacaagagccacagagcttctcagggggcgacatcttcgactccagacaactggccaccttcctgaccaaagcaacacagcttctgggaaagatcctgttttgggccttcaccttcagccaggaggaggtccaaacaccagataactgtacaccttccctgaaagaggagagcttgcctacagagactgctctgaccactgaaactcagagaagagagcttgtctcccacgcctgctgatagagggtaacaaaatcaacagaggaacaatctcttaacaaagacaactataacaactaactccagagattgccagatggcgaaaggtaaacgtaagaatcctactaacagaagccaggaccactcaccatcatcagaacccagaacgcccacttcgcccaatccaggacaccctaacacacctgaaaaggtagacctggatttaaaagcatatctcatgatgatggtagaggacataaagaaggaattcaataactcacttaaagaaatacaggagaacactgctaaagagttacaagtccttaaagaaaaacaggaaaacactgctaaagagttacaagtccttaaagaaaaacaggaaaacacaaccaaacaggtagaagtccttatagaaaaacaggaaaacacatccaaacaggtgatggaaatgaacaaaaccatactagacctaaaaagggaagtagacacaataaagaaaacccaaagtgaggcgacgctggagatagaaaccctaggaaagaaatctggaaccatagatgccagcatcagcaacagaatacaagagatggaagagagaatctcaggtgcagaagactccatagagaacatcggcacaacaatcaaagaaaatggaaaatgcaaaaagatcctaactcaaaacatccaggaaatccaggacacaatgagaagaccaaacctacggataataggagtggatgagaatgaagattttcaactcaaaggaccagcaaacatcttcaacaaaattattgaagaaaacttcccaaatctaaagaaagagatgcccatgaacatacaagaagcctacagaactccaaatagactggaccagaaaagaaattcctcccgacacataataatcagaacaccaaatacactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaatgccagcccaggctactatacccagccaaactctcaattaccatagatggagaaaccaaagtattccacgacaaaactaaattcacccattatctctccacgaatccagcccttcaaaggataataacagaaaaaaaccaatacaaggacgggaaccacgccctagaaaaaacaagaagataatccctcaacaaacctaaaagaagacagccacaagaacagaatgccaactttaacaacaaaaataacaggaagcaacaattacctttccttaatatctcttaatatcaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggtctgaagaaacaggctggagtagccattctaatatcggataaaatcgacttccaacccaaagttatcaaaaaagacaaggagggacacttcatactcatcaaaggtaaaatcctccaagaggaactctcaattctgaatatctacgctccaaatgcaagggcagccacattcattaaagacactttagtaaagctcaaagcacacattgcacctcacacaataatagtgagagacctcaacacaccactttcatcaatggacagatcgtggaaacagaaactaaacagggacacagtgaaactaacagaagttatgaaacaaatggacctgacagatatctacagaatatttaatcctaaaacaaaaggatataccttcttctcagcacctcacgggaccttttccaaaattgaccatataattggtcacaaaataggcctcaacagatacaaaaatattgaaattgtcccatgtatcctatcagaccaccatggcctaagactgatcttcaataacaacattaagaatggaaagccaacattcacgtggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctctgagtacctccaagaagaaacgggagagagcacatactagcagcttgacaacacatctaaaagctctagaaaaaaaggaagcaaattcacccaagaggagtagacggcaggaaataatcaaactcaggggtgaaattaaccaagtggaaacaagaagaactattcaaagaattaaccaaacgaggagttggttctttgagaaaatcaacaagatagataagcccttagctagactcactagagggcaaagggacaaaatcctaatcaacaaaatcagaaatgaaaagggagacataacaacagatcctgaagaaatccaaaacaccatcagatccttctacaaaagcttatactcaacaaaactagaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagatgggtttagtgcagagttctatcagaccttcaaagaagatctaattccagttctgcacaaactatttcacaagatagaagtagaaggtactctacccaactcattttatgaagccactattactctgatacctaaaccacagaaagatccaacaaagatagagaacttcagaccaatttctcttatgaatatcgatgcaaaaatccttaataaaattctcgctaaccgaatccaagaacacattaaagaaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaatacccattcatgataaaagttttggaaagatcaggaattcaaggcccatacctaaacataataaaagcaatctacagcaaaccagtagccaacatcaaagtaaatggagagaagctggaagcaatcccactaaaatcagggactagacaaggttgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaccagagaactcctaaacctgataaacagctttggtgaagtagctggatataaaattaactcaaacaagtcaatggcctttctctacacaaagaataaacaggctgagaaagaaattagggaaacaacacccttctcaatagtcacaaataatataaaatatctcggcgtgactctaactaaggaagtaaaagatctgtatgataaaaacttcaagtctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattagaaggagcaatttgtaaattcatctggaataacaaaaaacctaggatagcaaaaacgcttctcaaggataaaagaacctctggtggaatcaccatgcctgacctaaagctttactacagggcaattgtgataaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattgttgctggcacaactggttgttatcatgtagaagaatgcgaatcgatccatacttatctccttgtactaaggtcaaatctaagtggatcaaggaacttcacataaaaccagagacatttaaacttatagaggagaaagtggggaaaagccttgaagatatgggtacaggggaaaaattcctgaacagaacagcaatggcttgctctgtaagatcgagaattgacaaatgggacctaatgaaactccaaagtttctgcaaggcaaaagacaccatcaataagacaaaaagaccaccaacagattcggaaaggatctttacctatcctaagtcagataggggactaatatccaacatatataaagaactcaagaaggtggacttcagaaaatcaaataaccccattaaaaaatggggctcagaactgaacaaagaattctcacctgaggaataccgaatggcagagaagcacctgaaaaaatgctcaacatccttaatcatcagggaaatgcaaatcaaaacaaccctgagattccacctcacaccagtcagaatggctaagatcaaacattcaggtgacagcagatgctggcgtggatgtggagaaagaggaacactcctccattgttggtgggattgcaggcttgtacaaccactatggaaatcagtctggcggttcctcagaaaactggatatagtactaccggaggatccagcaatacctctcctgggcatatatccagaagatgccccaactggtaagaaggacacatgctccactatgttcatagcagccttatttataatagccagaagctggaaggaacccagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaaggaactcacacaatatgtactcactgataagtggatattagcccaaaacctaagatacccaagatataagatacaatttcctaaacacatgaaactcaagaaaaatgaagactgaagtgtgaacactatgcccctccttagaagtgggaacaaaacacccttggaaggagttacagagacaaagtttggagctgagataaaaggatggaccatgtagacactagcatatccggggatccatcccataatcagcttccaaatgctgacaccattgcatacactagcaagattatgctgaaaggaccctgatatagctgtctcttgtcagagtatgcctgggcctagcaaacatagaagtggatgctcacagtcggctattggatggatcacatggcccccaatgaaggagctagagaaagtaccaaagaagctaaagggatctgcaaccctataggtggaacaacattatgaactaaccagtaccccggagctcttgactctagctgcatatgcatcaaaagatggcctagtcggccatcactggaaagagaggcccattggacacgcaaactttatatgccccagtacaggggaacgccagggccataaaaggggagtgggtgggtaggggagagggggtgggtggctatgggggacttttggtatagcattgcaaatgtaaatgagcgaaatacctaataaaaaatggaaaaaaaaaaaaagaatccaccctcatgatctcatttaaaaaaaaaaattgattataagtttctgtgataaatcagaaggaaagtctgtagagacagtaaaatgatattgttaaattagttcacatttatttgagaaacaataatttcactgcttgaacttgcatctactccttggtaacttctacatagattcctgctgctcgtttgtaattaatcaccttatacactgtcctgtaatcaaccctgagtattatacagaataccacttttattaatactgtggtaaattactcattgagcagtactccttgagccttttagtactgcacttctttgtgttaaatgtaattttagtattaattctttgaaaatttaatacaatctattttatgtatgtattttggtcatattcacccccactcctcttactactggcttctagatccactcaccacctcattatctgcctccaactttgtgtcgtcttttaaattttttaaatatcccaccaacataatttgtgctgacatctactcttaggtatagtcacatccattggaacatggttgaccaaccagtggccatatccttaatgacatctgattctttctcattatcaatagctcagtaaagtgtcaggacttgagaatgctcttgcttttcatattagaatagtgactagcttgatcatgcgcaggcaaccagaactgctttgagttcctgattgcctcaatgagtaggtctagaagagagggcttcaatccagtcttcctggatctctgactctttctaccttactggctcttcatatcccatgggtttgagtatctatgagaagaagggtgatagagatgtctgatttgtaaccaaatgttacacagtcatcttttctctgtaccacttcagaggcccaaaccaactatccactgcacagagaaacatttttctgatttggcctttgaactgtatgggaataaagatacaaatttagacagctatatgctactgtgtccatttagcaaaacaaacatagtgggctcacccctagagcctctgtgttctgcatgcctaggttattgacttgatttatagcaccaggtattttgttgtataagtctatcatttcccaagttgaaattctgcttctgatttgttattggattattttccagttcagaagtaacatactagctaaaaatctgagcattttgttttaccgcctctctgcaataaatcttgtacttctgtaagggagatgatgatgatgatgatgataaggaggaggaggtgatggttatttgttgttgttgaaaatagactcttctttcatcaccacagtttcccctccttccactccttctagctccctgtgcctgccttcacctctagattcactccctctctgttccctcttcagtggaaagctggcatgcaagaaaaaaacccaaggatccagacaacagcacacaggacaaaatgccacaagaatatgatactttccctccaccactaatgttcaccacagtatctctcctcactgcctatagctctttctttaactgatgtccctgtcttaggtcatggtttctccaatccatttttcacaatccaatctctgtgagtttcagaagtcaaatatgatcatgtcactttttggtttatttaaaacctgtcaatatcattccattgccttcaggataaaatcctactccttagcagggcatgcaaggtcactcaagaggaagcatatgcttcaattcttagatgtgtctatcaaaaggattctacttcattgcaagctccaaagacaggaaactcaaggtcctcaatcatgctgcatgtttcttaaagattttttaaagggggtaattttctcctgcctaacaattttattctcttcccatacttaatatcatctttcacaatttggctcagaggaccttctgtggtcctctttccccaatgaggttctgcttcttttgttcaagagaagtgggcattatcatgatcatagaatgcactggaagctttcttggttgattttatgcccagtttgtagcccttcaaaggtagatgactttttttttaagttttttttttttagcttagttttctcagaatgaaaatccaagggaaggatttaatgcatgtggttttgaatgtgactacaggaactaatagcaagagcatagagacagataggagacattattattaaagaactgtttggatgtattggcaccactggtatatgaagcttagttcgtgtatcggggcatgatgggagggagtatctataaaatctatgtctctgagctaccccagcttaggaaaggttaacatttacaaaagaacctgcttgaacagcttcctgtccctaacaacagctccctttgactactggttggaagcaggttaactgtggaggtgaataactgttaagtcctggacacatttagcttagggtacataacatatggatacatatggagtcctgtatgtatccatggcttgtttgctgtgctggtctttgtcttcataagtattttcaaaaccatttaccaaataagtgacaatttaaagaaaagaaaaaaaaccaaacaaatgtttggggttttgttttggttttttttttcattatttttctcaccatcaagcattatttctggcacctgatacttcagatgtttcaaatgactattttagtaaaggcatcactgataaatcagaataccttagaggtttatagatgctgtgagatttcaatacatatttataacatatacactgacacagagagggggaggggagagagaaagggagaggggtgagggaggacggaggacggaggacatagatgaagacagagacacagagagagaggtatacacacatacacagcagagagagatggaattctgttgtgttagaaatggtcttcttgttcactgtgctagtctttgcctatataagtattcaaacccgtttactaaataagggaatagctattcaactccacagctgacctgctttcaaccagtaactaaagggagctggtgttagatacagtgtacacacacactctcttttttttattagatattttcttcatttacatttcaaatgctatccccaaagtcccctataccctcccccacaccctgctccccaacccacccactccttcttcctggccctggcatttccctgtactgggacatatgatctttgcaagaccaaaggcctctcctctcattgagacactcttttgtctttctctcttcctgtctctcacttcttcctcattctcatttcagggtgccttctcaaacatatggctttgttggctcccgttctttttcttgatttaattgttcttctccagcccacattaatgaagaggacttttagagcctactttcttcagcatttacagcctagtggccatgagtaatggcaagagggtcaagacaatagagatgggtgcggggagggctgtcacttcagaacatctaaaatcacaatgtggggtattggagcacagattgactgctgctacctggactccaccaatggcataaaagaaaagacaacacgagtctcagggccactaccctctatacttccaagaattatttctgtatataattttttttaacagaaagggaactaagaatagaagctaaggtgtaggagaagtaaaggctccaaatactttcttgaaatgtcatataaaatgagacagcctcctggggcaagacaaacatcagctagctgacattcaaacatcagcagaaaggtaatgcatacaactttgagtttttgaaacaattgtcaaaatcaaaacagaaaatttaattttttttgctttgatgaatttatataaggtctactacatagttcttatattttgtagaattttcatttctcaaaattatatatttctatactgatcattttcataatatctaaatatttttaatcaggaatttttattctagttccataccacttgtttaaagataaaagtaacttataattataattaaattatactaatcatagtaacatgtatctgtaaaccccagtgtctgataagatcttctatagtatgcctcatgccttttgtatgataaaataaatgaatatacatacatatttaataaatttgtatttttgagatatgcataaaatatattcatgaatatgccaccataagcaccaacacaaatatggcatacatttacataaatacacacacaaaagtaaataaaagttttaagacagagttgggcagtggtgccatttgtctttaatcacagtacttggaaggcagagtatgtgtatctcaaagtcagcctggtctacagagtgagatctaggacaccctggtctatacagagaaaccctgtctccaaaaccaaaccaaaaaaaaaaaaaaagaaaaaaaaaacaggcaaaaaaaaatctaaaacaaacaaaaaaatttcaaaatgtaagatataacatctcttgtggcttgacattttgctctatggtagcaatgccatacccagcaacgtacttacttatggaactgtatattagaatatgttactcttaacagtatgccacattttttttaaagtctagttgcatcattttctgttgaaaaattttatgttaacttgacacaagttaaagtcacctgaaagtagggaaacccaattaacaaaatatcaccataagatctgtgaaggcaaattttttttcaatcaatgattgataggggaggtcctagcctattgtgattgggaccataactttgtttgtggttctgggttccatgagaaagcaggctgagcaagccatgtggcaagctaacaagccacactcctccctgcctctgcatcactttctgccttcaggttttcaccctgcttaacttcctattctgacctcctttgataattaggtttgatatggaagtgtaagcctaataaaccctttcctcctcaattttccatcatggtgttccaacacaatagaaacccgaacacatggacagaatattagtattggtattcttccacataattgaaaacgtctgaaaatgtctgtcatttaaaaaaaaatgttacaatggatatatgattaactaacattaaataattacatatcttcatttgaaaagagtgacatggttggatcttgaagtaaatttattctcagatgcctgaggaaatgccacactatttccacagtagctgtgtaagtttatagtctcaccagcaatggaagagagagagagagagggagagagaagagagagagagaattagccctctttggatataattggtaaagatattttctttaaagggcttttaactaaagtatatcaaagcacagttctacgtggaaaatgtgttaagattaaaaatgtaggatccaaatatagtaatacagtaaaacacaaaacattcaatctcagaaggttaattatactaggaatgtaaatactaaaattcagagatgcatctttctttgtacatacctttttttttctgtcttcaccatgactactaaaacagacctttactgaacacaagctatgagctactacaaatggcacaacatttgagagattatagaaagtattttttattcagtggacaacgatgaagagaggttttaaaatggttagaagttgcaatgtgaaggtccatctgaaaattcaaatatgaaaaaatgcagttggagtctgttaattacttctcatatccatgctagttattcatctccagctctctgcttcctcttagccatggctttgcacttagttttgatcactctgaagacctaaaatggcttccttcatacatcttgagtaaagtacgtattcgagtcaaaattatactctgaagtatacctatagcacactgacatcaggaatattatcatccatttattttcttctggctgttatgaggatggggacacacacacactaaaccactaaacaaaaacttctcaaaattggttttcaggaagttaaaaaggaatcaattagcacagttataaacagcatctatctttaatagaataatagttgtgggttttactgttcttggactgctttgtcttgaaacatctcgcttaaggaaacaggttttatatatgtgtttatccccaaaacaaattgattctgttggttaacatgaatggataattgatgaataaaaatttaacatgtcttctgaaactttgttatggtttatagctaatactgttgttgatttcttagattaactttatacaattttgatactagttttggtctttttgtttggttgttgttttcaattaatttatttatttattcactttacatccagatcacagcatcccccctcccagtatgccctcacatggccctgcccccatgtccttactcccccacctcctttcacctctgagaaggcagagttcccttccagggtaccaacccaccctggcacctcaagtcacttcaggaatagatatagcctttcccattgaggccagacaagacagcccaggtaagggaacaggatccacaggcaggaatgagtcagggtaagcccttgatccagttgtttggggacccacatgaagaccaagttgcacatctgctaaataactgtggggtgcctatgtatgacccttgtaggctctttggttggtggttcaatctttgggatcccccaaagatccaggtaagttgactattggtcttcttgtggagtccctaaccccaccaggttcctcaaccttttccccaactcttccaccagacttcctgaactcggtctaacttttgtctgtgggtttttgcatctgtttggtaatctgttgggtgtaccctctaagagggcagttgtactaggctcctgtctgtggatccaggctgacatatacaaacatagcctgagtctccaaggtactcagtactgcaggaaagtaatgtgtaaatatagatattctgaggacagctcagcaacacccccccaaaaaaattagcaagggttcttactgcattcatttatgtctgtctcacaccaaggcacctgtgtagctgagccagccgtgacaaatatagctgccaacagtgtctttatatattatatcattgcgataaggctttgactaacaaagaggcatcaaagactcatacatatttgtccaattagtggtacctgaagcaggtgcttggatgtctttctttgggtcaacccagttggcaaggctggatagatgcttgagtgtatttcgtcttggctttgattctttaaaaacaatattattttttatcatcttgaggaagttttgtgagcattagccttagaacattttgatgatacatgtatatgaatatatatttgggcgttaagtactgtttgtaggaaataaagattgacaggtagactctgcagccttaccgttaagaagcttgtagcttcataagaaagactcattccttatatatgctctatatattctacatggcttacatttattcagccacccgcacactggaaatattaaagaaagacacagaacaaacctttcacttcaaatggctcagctgttgtcactttggcctagcttgtgccaattaaaatgtaattgtctttgtagtcattgcatttgtaaaaataggactttgcttttgttatttttagctttgaacccatatagaattgtgctcttgggtctccaatgactcagagctctgtcttttttaagccttgtgataacagaggagaagtgttggctcaaaaggtcctctcttggctaaaacagctcagggctgtcttggcctgcgaatgcctgactgacttggcacccttgctgtggggactaggtagagtgctgcggctattaacccacattaactggtggaaaacagttggataaagacatttacttgacctttataaaaccatttggaaactttttcaaaaataaatcatgtgtctctaatattctaacacaatgttttttcttaaaggattctttattttatcatatatagatatatagatatgatatgtatataggatacatacatatattatatatgtatatatgatatatacatatatatatttttttctgcatgtatgtctgtgtatcatgtgcttggtacccagttagactagaagagggtgttatataccctggaaccggtgttacagatagttttgagctgccattagggtgcttagaatccaacccattaaggttctggaaaaccatccagtactctttttttcaattagatagatagatagatagatagatagatagatagatagatagatagatgatagatagatagattgatatcttattcactctacatccttctccagttcacccctctcacaatccacaatccttcccctctgcaagattaggcacttcctgtccccctgaagccagacaaggcatccaagctagtagaacatagcccacatacagtcaacagcctttggaatagcccctgttccagttgttcaggacccacatgaaggtcaagcttcacatctgctatatatgatgggggaagcctaggtccagctgcatataattttgagtttgttgagagctccaagggtccaggttagttgactcttttgttcttcctgtggagtttctatcctcatcgggacccacaatccttccttctattctttcataagaatcccaagctccaaccactctttagctgtgggtgtcactatctgtctgagtcagctgctgaacagagcatctcagaggacaacatgctactgtctgtctgcaagcataaaaggcagatagagggaggggtctgggagggagggggtacagagaggagaatggaagattcaggttcaggtttagggaaggacaggagagatggctagatggctatgaaaatgaatggaaatctgcaactgactggtgtgaggaggttggggccatctccaggatgagacatggccttggacaagagaagtgcctaagaatcaatgggtatgatcttagccgtgacttactgggatagggaatctaaagaggcaacctcctatagtcagacaagaagcccaggggagcaatagagacacaaacctacccacaaaactttcaacccaaaatttatcctgtctacaagtaatgcagacatggggggagagatcagagactgagggaatggccaaccaattaccagcccaacctgagacccatcccatagacaagcaccaatttctttctttttttaattagatattttctttatatacatttcaaatgctatcccaaaagttccctataccctccccccgccctgctcccctacccacccactcctgcttcttggccctggcgttcccctgtactggggcatatagaggttgctgttttgcattcactactattaactgaagagctccatcattttatttaactttagagatttattatgcatcatgtaaggcctcccccttgcctacctttctgttccaaactcttaggtttgtattactctgagatttttggcaacctcttttacttactttcttgtagaatttcgaagacaatataccaatgcaatctttttaaaaggacatcttgttgacacaataacaagtgtaattgaaaaggccaaattcctcattttcttcaaacacgtataacatctggagacggcaaatgggaattctcgattttcatatcacagatggtaaatttcagagaggttttcagggtgatatacattttgcttctatggatccactgtccgtaagtctgctcaccatgagtcagtgaggaggctgcgactgagccctctgagaacccagcctctcctaactgagcaataattagaaatggctgtctttattagagctaatgctcctggcatgcagcttttgctctttctaaattccctttagggttccattctgttttatttaagctttaacacttattcattattatgaatttgtttgtgtgtttgcatatgtgtctgtatacatgcatatgtatgtgtatgtgcataccaggaaaaacatgatgtcataggacaacttatagaaattgagttttatccttccatcaagtgggtcctgggatttgaactcaggttgtgaaattttacagcagtagactttagcccctgagccatctcactgtccagtgaacacgtcccactaagatgttatggtaggcagaagagtaaaccctaagaagcatcaacattttattctctaaaaatggtaacgattatactatctgctctaaaaatcctgtttttaagcatcggtaagaatttggggaagaggagattattctaggctgtcaatatggcctgatgtaattacatgaattcttgtaagtgggaatcatgatgtcagacctagggataaaacaaaggcaacatttccgtgacataattttctgtgacttcaaaagagtaataatgcctaacaaatgtgtttcttgtagcattatttaattataacaacagcaaatacatatgccaaatttcccatggtataactgaccaataacaacagaaagacaaaaaatgtgtattatttaaagtcatacgtgcatgaaaaattgtactaaaatataaatatgcacaatatccaccgctatacttataaatttccagagctatgtttgtgattttatcaattaatttacctacctgtctaattcatctatgtgtttaaacacatgtggacaagggaacacatgtgttcttaagggtggctagtgaatttgtgatacttcctcaaactttgaaaaattctactactccttattagtaattggaaaggaggttcctacatcaatgataaagtcttacatttggcagagctttgtaaaaaaagaatgctttcttggatttactatcaggtagaataatgttttaatctataaggactattgtgtgtagccctgttagagttatttgtgttttcatgtattctttctgtcatattcttgatgctccaaggcaatgcgtgccttcagttgttctctttctgacctcacggtgcctagcatgaagcgtgtgcttctgtagtcactgaaagctttctgccgaatttactttataggtgcttaatcaaaattactttgataagagacttcatctcagaaccataatacacacaaggttcagagaaaatatgaggaaaatttatgtagcagaagatagacataaatataaacaccctgatttaggatgcaaatgaaggctgaattatgcgtgccctattcttgttaaggcattattcattcaaattttgtttactaggatgactgggtgaatgttcagtactttgatgaagtaaacattaggatgacgtcattctaaatcataccaaatagtggacaaaataaaaggaaataccttactgcgtgttagtaaagccataaaaatatcctagatcttgtagaatattcacagatggaaaagtctcttgagaattagtttgagagaagctgccatgcaaaataataaacagcccaatgtggctatgtaaagataaaatagtttaatatatacagattcaattgaaaccaataatatctgctctaataaatgtcaagggagatatagaacaaaagaccattggaaagagaaggggtctaataccctcattcaactatgtgaaactaatctcatagagaagagtattttagcaaattcttatggtattcatgtactaatgcttgttttcggtctcattttaatgataaaacagcattcctgtagatgttagccactgaagaacataaacatggttctaacacccagttgtttttgttgttgtttgtttgtaattttattttttgctgaggagggtaaataacattgattcatttcatagcattgtctcaactatttatataatgaaaatatatgatcagtgccaatattatctctaaattttttggagaggaggaaactgaatcatacaagaattgtccaacactgaaacggtgtggagccacatgtctgtaattctagagcttcaaacactaaaactgtaggaccaagagttcaaggccatttgggagtatacaggaagatagtattacaaataaagaaactgatctaacatgttatatcagagcaaggctttgtacacatgaaatatgagacaagagtctctgactctccatttttataacccaaagtatttcaaaagaaacttaaaattgattatgtaattgtcctattctctgtagtcatagaaggactcataaaggccagccacttctgactctaattcacagcaccgttgccctgcagaaataatacaaggaaatattctgcagaaaatagcgatgagaaccttcaggcaggcatctcatgtcccacaccttagagacaaagctagatctatgtctggaacttttttttaaaaaatgatttcaggtccctttgtccttaaacaagaattctgaaagaagtagaagaaatattaaatggtaagtagttatcatatatgatggagaataaaagaaacggaaaatgtcagtactataaaaatgcagtatttttgtaataaataaagtcaaggaaagttttagaaaaggaatcttcaagcatgaaggatccgaatggattcacagaaagataatatataccagaattttacttccaaattcagaaaaaaacctatgagacaagggggaaagagcaagccatgcgaccttctgtagttcactgaaaatactgcagtccctgtggtggaggtcattcacctaccttctacacctttgacaaaaatccgttgtgacagagcataggagcagcactttttcccctacataatccccacagacaacaccatttggttaatttaatttgaccttcatcacagagtttagtgctagtagtcaggataacattgagatgaaagatgaatgtgggctttacacaagaatatgcccttagctgaagataaggtactggtgaaaacgatcctgacctgaacagaaggtgaaaaacagaagtttaaatcagactcaggtagacacagcagggtaagacaatgacatgcagggggagttagaacagattgtcagtatctggtttcattattttattctcaggagaatttcaaagacctctgagaaaataggacactgtcattgaatcggagatcattgggtctctctgtttcaaagtttggaaatgtgatttgttaagaggttaactggaccttaaaggtaactattctggtttataagaaaatttttaacagatctcaattttcaacctatatttcatctctctctctctcttcctcctaccattcctctactccctatctctgacactctgtatgtgtctctgtctgcttttatttatctatctatctatctatctatctatctatctatctatctatctatctatctatctatctatcatctatctatctattgatctattacctatatctatgtgtgtgtatgcatctctctgtgtctctctgtctctgtctgtctctgtgtgtgtgtgtgtgtgattgtgtgtatgtggtaggggtgctttatcatgtccgtcctcacttttcaccttgtttgagacaaaatctctttcaccatcacttctcaaaaaaaagaaaatgatattacataacaccatcttaagaaagatacatttctcttctataaggtggctgatttggttggaaggaactgaagtagatgggtacaatagaagtgagagaaaatgtttgaccacttgttaggtatcattgactggggtgatgttataatatctaatttgtagcttatacaatagagacttctaaatgttgccttgtcaagcagcattctagtgataccttcattccaaccttgaaaacagagccaatagatgtttgcattaaaggtcctgtactggataaatacggggcctcctcaatgtcgttaattcttgtgtcttccttattcattctatccacaaatgcttatctcatttattcatttgactctgtagcaaagagaatcacttgttcaatgctggaacaaacagagttcaccagtaaatctcagggtgtttatggaaatgaaattggaaacaaatcacacttgagagagaaagagaaaatattccaaccagacaactgaggtgccaccatagattagaatgcagcattttttattgtaaaagtccatatgctaggcatttttttgtgtgtgaaaaggtttgcaaatacatagacagggagcagctgatgattgagacttagatgatgtgtaatatatatccatattgacagtgttatacacatgttggtatgctagctttaatttttatttccatgtcccaattgcaaaacacattccaaattgacaataataccttgtttctcacaaattaaattttccagcaactctcccaaagagtcaatattgattattttgacattttaaaatgagaaattaatcacttatttacatctgtttgaggttagatactaaaacactggtataataaaggtttgtaaaaccagcagctgaatgttttcaagattcatccagatgaattataacgacttcgtgtggttttctattaacagagatgcttcctttaattgtcttcctattatctatagtgttactttatgatttaacattgatttgaatcaatattttccttaaagaagaactgaccatagggtcatattttagaaaaacaagaattcagaatagtcacattaaggtccaactcatcatgactgaagtcagccaatcactccatttaattactatggagcaaaatgagcccacagtcagaggctccatgtcctccatgcaagtcacttaatattgttcctgcttttaatttaaccttcagtacattgtttccaagcatactgtataccagtcaggtatgaatattgctcatactttcataggttcacaagcagaattttcaccagacataatcaattctttcttttaaaaaatgggataatcaagaactctatgcttaattcaacaattgctactttggtataggaaatagatattattttaaaatagatacactttgcctaaaacaaatttttgaagatgaacatataagctacagttctttagattctcgggtatttctacagataaggaagtatcagatgtcaacagtaatgtgaaaaaaaacataaaccacttgttctgggtcagaagaagttattcaccagacaagagtatgcattgctcccagccatatttattgagcactgactatatgccaggcacagtgcaagatgttgagaagtaaaagaagaaacaacaagaactctgcctacaaggcgttcacagtcactagaagcagatattgaaatagagagcaagttctgttgagaacgcacatcgtcaaagtaaggtaaaacattagcaagcacatacagttactttatattctagtgataaagttgggcatatttagagctgtcaaatgtcagtcagcctaaatggtacttaaggtgttttaatgtcgtacagacaaacataattttaaaacctgaattttcatgcatgagggagaaggttgtgagcccccttcaatttcaagcccaaatttttataattatattaatatattattttatagcccaaagaaataaaaaaaaagacaatgctatatgatgataacatgagttcatttattttggctctaaagagatgcatgcattaaacctgaagcattctacattactgaaatatttacatcactgtacatatgatatgaaggaaatttgctttctaccttggaataaaggtataatagaattctaatctaggcttttctattgtgattcttcacagatacgggaggtattctaattttttccagtttaccacaacttgatcccaagtgaacatagtacacagctttataccttttgtactaaactatatatgagtcaaagactgataatgccactttaaaccctcccagcttccactgttttcattgctgttgctcaaaggtatcttgctcagtgtaacagctcttgttctaactttactttgccttgcaggtttgaaggacagtgcacgctgaaattcaaattacaataaccacggattgggcatggatagtatgacattatatgtattactacgttgagacagagaaacacattcggtgaccacataggggattatatcgttggacttagaaagtgcattttgtctccataagattcagcgaataacacccctatcaataaaacccatacctctttacagataaagataggagacccagtaaacaagattgaacaagcaaaaggcggtagggaagaagatccgagcataggagtccattttggcaatgcgaatatgtatcctcccatgtctccaggctcctgttcggcaatcttcaaaacagcagaagaaactggcacagtccttgccatccaaacactcatagccatattcttcatccctctcttgaaggtgtgtggcattgttcatttgaatggttgctgatctgggacgaatatcaatggtaggggcctgagacaaggtaggtaaggagagagagcaaagttagttatactggagctatataacacagtacttccacaatgtcatcaatgagatgatgaatctgaaaatgagtattcagaaaattgcttatgacatcgtgatcttacgatggtaaaattgaactcagaaagatagcacagttgcaggtttcagattttgcgcttaagcagtgcagctggaaataatgtcatcaagctaatagctacagcaagactattgaccaccaaaagaaatcaaagtataaagatttaaatcaaactacatggaatctcattctagtaattattaaatgttaagccagttacatgaagctagttaatgatgctgcaagtgagtaaaatagagaaataaaaatgcattgattttcaaatcaaattgcatgtcatgctaacttagaggcaaataggtcccatcatactgaacaactatactgaacaattttagtagcaaatgctagtactcatggagaaataaagaagttcgttgattttatgcaacaaaaatttaatttatgtatcaaaagtatgcagtttgtctaacattcactaacttaaaactatcagtgtttatatatagtgaatgagattgataattacaaaaaaaagtcattacttttagtttttcttagcaaaatgaactgcagttaatgacaaggtaatctaaggttcaatgcatgaccaataataaaattaaagcaaaactcaaagcttttttggtagcttttaaagtgtctggatataaactgtagtttctaaatcagttatagagagaacaaaaatttcatttcaatatttcacagagccaacaggcctagcaattaccctggcaggaaaggaaggggagtttaacctacagtctgataaatgcagttttattaatataaagttctcaggtatatagagattaagttcataaaacaagttttaaatctcattttaattagtctttacagagttaaactttacctttaacagtatttatatatatatatgaatatgcacatgtatatgtataaaatatatgtaaattataacaggtgaaatggattttattatatatatatatataatgagaaatggacttggggtttatagaagacttgttatctatgctcactatttgccttgtggttttgagctgaaggtagaaccaaaacagatgcaaattatgtctagtttactgaatcacctctagaggtatgtgtagtgtccttcaccttatgtgtaccagaaactagtagattatttaaatattcactcattaaaacaataaagcaccatgggaagcattaatagttaattcagcagtcgcatgcagtgaaatttccattccaaaaacagtataccttgaaggaaaacatccgaagaagctttggatttgtagacagaaaagagaattgcatatttttttaataaaacaaaataggaaaaggaaaaaaaagagagaaagagaaacaaaataagacaaattaaaaatacattttgaaaacacagtaagtaaaatgaactgaaagcctaaacacagaaggtggactctaactctgccgtacgttgcatagctaaagttccaaagccgaaatggttggggttggtaatccaattatttacaaatgaccccacaagcactggactatgaaaggcaatgttgtcagtggcgaggaggatgcctcctagtgaatacttgcctgtagaaaaatagtgtgaattgggtgattatgtttaagaggaccccaccacgtgagtcctgacagtgacgcatgaagagcatatcacacaggaaagaaagttttcagtttcttcccaccttcaccatctagactagttctggtaaataaacaaagggacttaaaaggagaaagtgcataagattctccaggaattacattttcttgttttctctggtctcttttcctatctgctttcttccttttttttttttttttccttctgctcttgctatgcacctagcttaaagaatccaactatttctgtctctgtagcaatttctacactgaagtgacacagctgataaggggagccaggaagcttttgctaaagggcttgagccttcacctagaagcctgcctgtctcccaacctcatcccaactgagtatcagcacagccatcttatttgagggaaaatgacttaggaaataaaggagagagacaaagtagagaaacgaaatttcaagcaagaaaaatcaaacaggaacatgaaaagatggagctgtagagactgaagaacatacagggaaaagaaggaccacatacagtacggtcaatatttgggacattaaaatcgagcatttcctttattcattaaccagtaagaagaatggtgctattttgtttaccatccaccaagtcttacttgcaaacaaatgtgtcatctgtcaaatttcttcagtatttctaaggtgcatcgggataaatgtcagatgcaaatagttttctatagcaacccctcaatttatggtcagataggtacccactgtgatgttgctcatgcctctcagagcagaaaacaagggaaggatgtcaatcaagaaggtaaaaccattactcctgtcagcctctcaaaaggagataagattttactgtcacggggactcctgtgacagagacattaggcccaggtgggtaagtgaatatctacatgctgtcctcaacactcccagtaaaaggcaaagctctacttatctatacttattccttatcctttcgttttaaggtctagtacaatcagaagtcatcctacctgtcgccaaatcaagcagttaccaaaaaataaaatcaggttgtcaacttccatcgccatccatcaaggttaagaaccttcttgtgactttttctaatgtttttatatttcggtgctttattgatcttcatcacaatttttatagaagctttatttgacatgtgtttttaatatattcatcttattttatatgagaaagcagagacaagaaggtccacattatctcaactcatttgttttggaaacaaaacaatacatgtagggatacaaatgagtagaaatattttagtagtaaaaatgcatatgcctgcataaacaaacacacacacacgtgcacatacatgcacacatgcattcacacacacacacatgtgcacatacatgcacacatgcattcacacacacacaaacacacacatacacccctacacatgtgtgtgcacacactttaagttatttataaattggtataacttaaaccaattataagaaccttaactttgcaatgcctttgatgtggattttaattaaaaaatatttatgtaaaattattatagcaaatttatcagaaacatcaaagtccttgagatatagaaaaataactcaaacacatatgcatatctgaatattctttaccctccaccccccccacacacacacacacatagaagacaatggataattacatttgcaaaaagagtctaacttaaagtatcttggaagtctgatctaactagtgatcataactaaacctttatgtactcattgatagctaacttattttcttttcatcatggagctcacagcactgagcctcagtgtagagttgagctaaccacatcaaacccaacgacctgtcctcatgaaaagttcagttgtcccaatagaaaatgatacatacagggtttttcttctttttgtctttatccttgcttggcttccggttgctgacaaaataatgcagggtgccatactccaccaaagcagaaaacacaaagatgaagcaaacagatacaaagagatccattgctgtgacataggagaccttgggcagagattttctggctatggtgcttaaagttgtcatggtcaggacagtagtgattcctatggacagcaaaataaaataaaacaaatcacatggtggcatcagagatagcctagagcacaagacggatgatgctctgtccaagctcccacaggatagagatacaataaaaacgtgagcagccttacgtcaattgctttaaactggactacatttttaattttcatatgtatttgtaaatataggaacatatatagaatgacatcccaggaagttggaagctattgaatcatctggatttgggaagtaatgtggttcttggagtttccaccagcagctattagtaggaggattttccgaggatttttattggcttttgcagtgttagatttagggtggaggatggtaaaatagtgtgtagttttataaggttttgtgacagttagataatgtattaatgtatgtgtactgcattattttgggaatttgaacttctattgaagggttcatgtgataagagtcttcatcttgatgcttgtgggacacaggggaacatttagtggcatgggaggaagttagagaattggaggtgtgcaagtgaagagatattaagatgccagtcccatccccttactctatgtctcatctatctgtgtaacataagcaggtttcctccttgatgaatttcaaacatgatgttccatggctcagaacaacaaggctaaatgaccacgttctgacaccattgaaactttgaactaaaataaatctttcttgcatgcatattgatttattttatatacttgctactctaatagaaaactgactacccagagcactgacatctagtaaaatcccaagtatggttacatatttgtgttgtttattatggagatgatctacttcctatgctaaaagaaactaattaggttgggtacacattaattcaaattggactccttgattgtacctaattgccacttttatttttgcagagacctttaaaactgatatggaaactgagcttttatttccacaatcaggcctgaatctatatttgaaagttgaaaatgtgaaaatgcaactatttttggtggaaactacagaggagttcattttagaagaccctgcatgtaacacttaattcaaacaaattctgacacataatgtaagtactgatctcacaaagcagagagatgttatttaaggactcaagaaagttcatcatgctatgtatagcttgaggaattgtttcaccatatttccagggttcttcctggtggggtcacagaaaagaaaagctatgacaataggaaggagagaagtcatggttttacctgactcaccaaccaccaataaggtaatgatgtgactttgaaacccagttttactgactggacaaattaaatttctattaccttggcaagagaaatgagatacagagcgtttgctaattactcctggttttggcatgaagtgagcttctccaggatgctgtcttaccttagaatatttgagtgaaaaataccaacatgtgttttcatctttctgtgtacccactctcactacagcgtgattaacttttaccagccaccagctgagcacaaaaccacatccatgtgttacaagatccagaaatatgtcatcactaattggcccatatctctgagtgttcttaggacttctaacatcatacaagtcagctctatttgtttgatgatgagaagttcaaaagctgcatatgttcaaggtaatttcacttaaatcttgatgatcaatacctggaaaggtcacggagcttcacaatcatgcttcaaaagctaatgacagacttgactcttttggaactaaaacattaaaacacaatagcctaagacctgggctaggcttggggtaaattaagtaaaataccttatgggtgggaacattttacctgtacttcccgaacattcttagcgatggagatgtattacaacacttaagaagcactaatctaaagaactgagaaaaatttaaaagagatgaacgttcagcttggcttcttttctttggtgacaaatagaattcagagtcctcacacccaggacaaaccaatgaccaattttccaagttgcagatctgttacaaactcattgtgtgactttgtggatattacttaacattcatcaaatttgctcatttatctcaggcctaaaatatgataatgtgtatgatttcaacttctgtatttgatgatagcaaagcatagaaactgtgctagaaacattgagcatccctgattaatactccatcaaatgggaacctgcttcctgtcttatgaagggccctccatcaacacatctttttttcaaacggtttgttgctagacatggtcataaaagatatattagtgaaaagagtctggccttcaaaaggaaagattgaaatatttaaaaaaataatttggggaagatggttggttggaatataccagcacacttgttatacctaatcataaatatgaaattttcactgaatgatcagtgatgcagtagcacattggaagctctatgccagggatgagcaacacatctactatttcttctgagatggtgacacactaaaaagaaacactcttccagtgttttgcataacatacttggagtttgtttcagtatgtagcattagacaggatatttgaattgttgaataggatttgtaacacaaagtactgcatatatcagaaaaaattgaaataacttcattttgaaacagatgggaaactaaattgagtttggaaaaggacagatatgcaaatgttgtgttttttttttcctcagtaatcacttctgccctcagtttaataacttggtacagatcattttgtcagaagtgataagagtcactaccattttttgaagcatttcaaagctcagtgtgctttgcataaaatacgttactttagcccaataaaaacctgcaaattatgagtcaggaatgctacctgttctacatgtgaggaaaacgtggattggggataatgcagtttattgtatacccctattctatatatggctgggaattcaaattactggaccttataatctgtgttcttctactactttccccaacagggggttatcaagacctatgttactaggtttgcacatagctaatgaagagtattgaggttttatatgtagtctgtggatagagattataatgttggttgagtcagctttgctttggtctgtagagtcttctacaaataagcaaaagatgaaaaatctaagatatggattaccatatctaaaatactgactaaattacaaataattataaaataattccatttcctagatttgtcagtaagtgtttctctcttattaatcatttagatggctcttctggaaagatccaatttgtctaattatcagcacactaatcatttgtgttggaattaaccaagagtggtgtgataggaaaaagggaagagttgacactaaaaaacaattgtgcctgactcactgtgcttcttttccaaaagtacttctactttctcagatctccaacttgggtatcatcactaagcagataattgagaaaggatatatgtggtaagctctcatgaatatgcatgtgagaaaaccacaaatttctcttgaaattaagtttttgttcagtttatattttattttatttgttattaattatactaaagaaaacctatgctaattaaaaaagagaactagagaagcagtaaactttaaatagaataggtagtagatagatagatgatagataaatagatagatagatagatagatagatagatagatagataatcatattgactcattaagataataaaacatggattttcattttgcctttgaattcagggcaaacccacttaaaaagaagtataaagactccttttcttgggtatttatatcggatgaccacagcacctagaaatacatctcacctaaagatgttctggcaggaacagcatccttattgatccagaaggacacccaggacaggaccacgatgagtgtgcagggaatgtaagtctggatggtgaagtagcccattcttctgctcagatcgaagtacacagacatcaccacatagtcacctgaaagagaaggactgagctatggacacagacatcaccacatagtcacctgaaagagaaggactgagctatggacacagacatcaccacatagtcacctgaaagagaaggactgagctatggacacagacatcaccacatagtcacctgaaagagaaggactgagctacgggaatgttcactaaacactgtgcatatgttcaactcttacacatacacacttggtttcagactttacaggagagctaacttgaaagctcttttcaaactacttgggcaaaaaggcaataacaaaagtatgaaatacagtccagcctgagatgaagcccagctcttctaacataaatgatactttcagagagaaaagaaagtatttttgaatactaaaagtattccttcttctggatgcttctggatcttgaccttctatatgtaacaacaatgtacaagggttgctgttgggtgtgagtggtaggatatcctctatgccctaagccttgcttgtgggtcatgtactgcacattaagtagcatttccacatattacttctatatattcagacgactagagagtgtcttggtgaatgagacttacaaaataatattttacttaaaaattatagttcctttctcacaatgagatatttccttatggtttcactgaatcatatagtagtttcatagcaattgtgttcgttcatgactataatttcattcgagtgctgttgttattataagtgctgtcatctgatttcatgtgcatgcatgaatccctggctagtgcctatttgccccaggaccatacagtcagtacttagcatagtgcttgagagaaaatgggcagtccttatatttgatgatatattcataaaattataaagaatattttaaagttcaagaagcatattatgaaacatttgggttttaaaagtgactgtggatatagtatgacatttagactaacaaagggtgatgttaggcgttgagaaaaaaatgaaattcaggaaaaggacacatgaaacatgaaaggctgtatacagctattgttttgtttttcctagttttgactattatagtacttcttttctccattggtgaagtaattcagtgaatacatgtaacagataacgaaacagtaaaactgaaataaagatccattgcttctgaatggcaattctaatggaacagaattctactgacacatgtacactctgagatgatgcaagtgtgtatttgagtgactaccttactctcagcatgtgatatttgtatttgtgagtttcttgcaataggttgacttcgtatttttaaaagattcacagacagccagtgttatatagtaaagccctatattcaaccaacaaactagcaagcaagcaaaaagtcaaaactaaactaaaccaagccaaaaaaaaaagaaaaacacaaacaaaaaaacccaaaaaaccaaaaaataaccttcctgtgtaatagtttatatgaaaaattcaagaaatacactttaaaaactctaatgaattaaataatagtcatatagctattcctaaaaataatatactcaagacgatctaaagtcaatggatttggaaagtgaacatgaataaattgcttgtgaaactactgtcaccagcttgtaccattcctataaaacaaactattgtacctctcaaaattacaagatacaacacagcttatctaccaactaatctacatctataccttcaaaataaagaattttgaagaaataataaactattttttgtattttgtgagcaagtgagagcctatacgtttacatggtctgattcctcaaaatttaactttaattttgttcaccattaacaagattctaatcttggtttgattctccatttccctgaagggtctagcctctcacagtttgcttatctaccagcctctattataagttgatgacttctgaacacctacattccttgcttacaaactctatacattttttagtagtggattatggatgcaaaactaagaccaagccacttaaaagcaaagcagcttcagagaaacagcatgatgcctgtcttatcgccaagaccacatcacattttatatgctttatatgctcctcttatgccaaggagccctgaaaatctaatcctcttaaaatgctgcatcagtgagttccccaagtctcaaaggttaaatgctaagcaagtcaatgacggtgacacttaaatctacctgtgccattgataagtcctgacacttaatatttaaagtcataatacttcataagttaaccccatctctgtttatacatagagagatacgttctataattaagggcatgaaacataaaatttgagttaataaacacaaatgttattcctttttcttatttttttaggaagttttctatgactggtttgaagaggcaaaccttcaatgacactgaagaatgaggctctggttactgtttatctatggtaataaacagtcatatgaaagcattgaacttctgtagttagtaagtgtttgacaaaagccaatggtacaaatagcacaactgctaagattcactggattttagaaaagactgctgaattagatcagcctataaacatcctaattaaaaaaatggaaaaaaagagatatgttatggcgggaagaaaattttacatttgttacaacaggaaagaaaagctgtatcttccattcaaattattgaaaataaaatttgaccaaggaagaccatctgaaaatcttgactatagacaaaaagatggagattggcaggatcaacaaaacagaaaatatattcactgatcctatacattgacaacagctctgagactggctgagacataaaaatgtctttgcatagccaatagatattgttgaaaacaaaatcttcaaaacttttcatacccttccttttcttttaatttttgtttttaattttttggacaggatttctttgtgtagtcctggctgtcctggaactcattctgtagattaggctgtccacgaactcagaaagttgcctgcctctgcctcccaagtgcaggaattgaaggtgtgcgccaccactacccagctcatacccttcttttaaatggtataaatgaaaagtgatattacaatctgatatataatccaaactaacttttaaagaaaaacagatgtattttatctgctcaaagatcagaaaaccatccttaattgatctgttaagtgaaccatgcacattatgtacaaatatctttatggaacaatgtattgcatctatggtttatatgttacagaatggaaagccaagaggacaggcaacctttggagattctgagatgctaggacttgctgttccagctccctgccttgatcctacctcaactgtactgaaactgtttcctctaaagacttgattcctggacaacctcaaaacagctaacgcacttggtccagattcttaaactcttccaattggaacttcatttaagcatgtactttctcagcacacagagactggacatgtgctataactcactttcttaaaactaaccatttttctaattttttttggatccccccaaaagaatttcttggtcttagttcagcaggaaacaattatatgaagtctgtcatcctgatcccttaagttgaggtagatctggtcattttagaagttatagatatgttgtcactttaggggatgattacaaataattctggtcttggatatggcgtaactgaaatagagaggttagaatcaaaagatttcttttctgtttcctttccctttatctttcttcctgccttgggtaaggaaatggtggttgaaaacaaaaggagaggatgtagaaatattataagaaattagacaaagtggggtagattatttaatgtactctcaagcccaagaaaatttttacatgtataatcttacattgaaaaagatctttatacgttgatgcaaaattgagattatattttgtgacattggtacagaattttgcatatttatgtaggtttaaggtttttattcgtataaatctttgtaggtttttattcgtataaatctttgtatacattgatacaagattgtaaatttaatttcgttccaacatgattattttatgtttcaactcttgtatagctattttatgcctatgcaacccatttaaattacaaggtttaattccagtccttattaccttctattacaaactctttaattaaggaaagcaagttaatagtcagtcaataaaactcttagggttgcggactagatggtcattgttttactcttagctgaagttgtttgggatttatgatgatgctcttggtctaaaaaagatattttcagattgataatgcaagttaagatagaaactgttttagatacagaactctgaactcactagaacaggatacaaaatagaatactttttcctgagttgccaaatacagactggacttttataatgtgcctcttatctaataattttcataattgtttcataattgtacctactgtatgttgttctcattgtaagagaaagagcctttttatttagatagaaaaaaaggaaggaaatggttgaggttccgtttgttgcagtgcacgtacgataatgctacactctgaacccaaaggtctaggccagtagtgaattctcagttaccagctttttcttgtgcaaacgttgttccttaatttaaaactattggtgaaataaaaatggctgcagccaattactgggtggattataggtgggtaggtttttgagttacgtgattgaagtgagagagaggagagtactgtgaggtgaggagaaggcaccatgagaggagatataccatgggcacatggataggaggaacagcaagtatttgggaaacaccactggggaggtagcagggccagcagttagaaaagtgatttactctaggtctcatttgtaagctagtcatgaataagcctcaattggttctacttcatttcaccttgtcttttatacacaacactgtttactctgaaaatcttaatggttttatggagagaatttgcctctctaggagctctgtggtatttagaaggtaccgctaacttaccattagtgagggtaagcactcacttcatgtaagcactgggttgaagagttgacatgtgttgtactattttgtcataataatgaaaaaataaaaacaaatgagtttcaaatataccttcactttcttcatctctcgtagtgcttaatctgcttccatatagtagaactgagcatatctattaggttagtggtgaaagcaaataatgatcaacctgtatctgttttttcatgtatgtctttcttaccaataaacctttgtcaccactgctctgcaaagatcacttaactagaattagctataccaaaattaaggtttgcatgatgctacacctggtcctattttaaatgggctagatggaaaggaagcgactggaagccagcaataaaagtgatgagacaccgcattcagcctgcctttatcatctccttccacattgagattgaggacatgctccatggcaggagagttgattgactaactttcattagataaaattgttttccaaaattaaatctgtccttcacccgaacacacaaatgccatatacacttcatatataaactcagaagtaaatctaaatgcaacacagagagaaacatcgattaccttcataacacacaaataaaataaatagactacctttataacctaatgtagaaaatactgtagatgtgtcatgaaatataggggacataaagaagtgtaaggaagtctactacttaaaatgagaacttctgattataatgaattccataagttttgtgcaaggcaaaatgacaaccttgaatagattatttcccaaataaataagacattaaggctaatatctttaatatataatacagaatccccaatagtcattgaggaaagaaacttttcatgtatctgtatttgtcaaatttataacttaattttaatccaagtatttctcgataattccttttgtgttctccaaactccagctcaatgaatacattagatgcatctgtgatttctttaactttgttctcctttgtatcatcttcctagatagagaaatagtctctcactccttcactcaattcaaccttctaaccatgcaggaacaagcaacatatctctctgtctctctccctctctctcacacacacacacacagagacagagacacacagagagagagacacagagagagagacagagagagacggagagagagaaagaggaggggggagaaagagaggagagagagacaacacagagacaactctgggacaagctgagagttaaatgtctttgtacagccaataactctcattggatacaaaatgctcatgacattattacatatcatcctttaagatagcgtgaatggtaatttatattatagtttgattatgtgatcaaactaacctctaaggaaagacagttgtctttctttattgacctttttttttttattgatctctacaacctacactttctatatgaatgtcttttcagagtcatgtattgcttgtaaggtttgtatatttcagaatagaagaggagaaagacaggcaggcctgacaaaattcacactcagggatactgagattctgggactttccattccagcgtcctgcatgatcctacctcagctacatcaaagctgtttcctctaaagacttgcttccaggacatctccagaaaggctagctttgcctatccagcctttcagactgttataatcaggacttcaacaacaccatgaactttctcagcacatagagacaaatggatgacaaatgataccaactagctgtcctttgacaaaaccaattttcctatttctctttaagccccccaaaaggattttttcaccacaattcaacaagaaacaaagaaaagaaaaatatcatcccagttccttacattgtgatggagggttctgattattttatgaattatggatgtattataactttaaggaaaaatttacatactatagctttagacacagagttaaactagaaagcttagactcaatgatttctatctttcttttccccttctttatccttctttcttatgtaaaggaagagggcgaaaaagagggagacatagtaatattatagaaattaaacaaatagtcaaataaggataggattttaaatttactcttaaaacattctatagccatactcatacattagtagaactctttatatttgattcaaaattgaagttaaattttttacaaaaaattaattttttacattgacacagaatttgcgtattgatataggtttaaggttttcattggttttaagtatatactgatatacaattttaaattaatattgctcctcttagataggcattatgcctatagaactcatttaagaatacaaggcttacactagaaccttttaatagatgttagtacaaactgtttaggatgattaagtaatgcaagtttaatactcagtacaagtgtttccaagattattcaaataataaatagttaagaataatcaatgcttgacaattcagttatgctacatatagagacagtcttcaaaaatcagagaatcacaaaatatgacactgttacttcattattaaaagatcttttgaatataagacatgtttgctccttacagtacccccattccacttcaaagaagatattaagcactattacctccatatggagttgctccaattgtggcaactaagccagtgggcaaaatttgccacagaaaaatgttgtgccaaaaaggacatattagaggcaggatagtggattgaaactaaactaaataaaaagaagcagtgtcccagcaatataaagtacactttaaaagctcagtgatacaactggctaacaactagggaatgctttgcagtgtaaaccttgtcgaacactttcttaactgtagcaagttctggttcctactgacctagttcaatcttgactcttcctactttatgaccagatgtctagatctactttaccctttcccacagtttgcttttctagccattgttcctgttggtcacatattgtcctttccttttagaggtattctttgccctctgatcacatcatatgagtaccttggaattgaccatctatggataccagtacacactgcaagcctttatattcaaaggcttcatagtctcttttaatgacttcagcctcatttgaatattgtttcttccctagaaggagttttttcaataccttaaatacctcacctgattttgggacttctcatcttaaagactggccttaagactatcttgttacatctctaatatgtccatcattgtaaaaataaatccttttatttaacaaattacaatttattcctgtaagctacaaaagtctttagttttccaaaaaccatcagaaatgtttcatagtaatatatcaataatattgtaatgaagggaatctgagtaacataaattctttgttaccctacggatcccaattaaatcttgtttatgaattcagagggatatatagtttttatctattttgtcctataatttattcttctgcaacatcaatgtgcattatacagaaagaagtcaacaattttttttgttaatgaataaatgctttagtttaggaaatcttgcaatacatgtagcttttaaaatactgaattttaattaacaaagcagtgcactgtaaacacatatttgtagaagttgctagatttaatcacctgtgatgtagatacaagagcacagtaagtttaaataatgttatctctgctttccaagaagaaaaaagaacaggaatattaacttgaccaggtgctctatgcaaagattgttatagtaactcaatttattggctgcatctatttagtgaatgaggtaacaaccccattctttcatgttacgtctgataggtgtgtttgctttgcttgtttggttagtgggtttggggtttctgttcgtttgctttttgttttgttctctctctctctctctctctctctctctctctctctctctctctttctgtgtgtgtgtattcattcacactgatagaccgattttatttagtattctgctatttagcttctaatgttgaagcaaaagaacaaataagaaactacagaagataaaattgaaaattaaaagtgtaattgatataagttttcggggttcagtttgccttttggagactccatctgattctctactgagcgaaagaacagggaacaatagtagaagcaggcctgattaaattcaggctttctaaaagagctgggtccatgactcttgtgagtgatttgttagtgtttgactctcagggtagaagaatgaggaaatcaagagatgagagagaaaagccaagtgtgtatttgccttagctcacagagagaccctggagattcaggatcaaaatttgccacagccttggtctcacctaagtcaaggctatttctggtaaaataagatatggcgggcccactatccagatatgacactagttttgaccagagaaagaaatctatcctgggatgataccagcaaaccattaagcatccaggagattgagccctgagcccaaggaacaaaaatgcagactgtggcatgagtggtacaagggtgcttcaagggcctcatcaggtaagctagggtgaaaagtttagtcgtttcataaactgtcatgtgacttcaggcaacttctttatttccctaaaactcacactcctttaaaataggagtaataattgggttcctgagaacatgcaaacagctcatacacacttgtgatgctcgacacactttcaaacagataagaaaaagttcattaatgctaggaattatgaagtagggtaacatttataacatcattaaacacctttctgaaccataagagaaaggttgttagacaggcagtagaaaattgacatttgaaaggacattgggaggtgtctctaccactctaccactctgggagattaaacctgtttaggcacatgcatgaagacatattaatccaagacacaacttagcactggcaaaaccaagactcttggttcctaaaccctaatgcttgctgcagaaaaaaaaaaaaaaacaaaaaaacaaaaaaacaacaagctctctataaccagtggttatatagagagacgtagagaagggacaggggacagagtcggaagctgagcaacagttgaatgcagttctcttattaagctgatttgtgtcaccagagcttctgattgctgacaaaagttgtcttaatttactatgcagccttctatggtacacattctaccttaagaaggcagtctgagtaaaccctttagagttttccctttagaaaaaagttttagatgaaaggaatgcagtgttcacaaactcttcagagcgcagtggcttttctgtagagtcacaccatgagagacttgctaacatcagttctccgcatttctttaaccaaagcttctctcattaacgctatagcttctttctcattttctaaattcccaccacagatgcccagcccgatgttgatctttgtagtgcaattcattattctgaagctgtcatccaattccagaaccgaagccaaggaattcatccagggatctacttaaataaaataactctggctcttatgtctgaaactgtaacttgaaatgagtatgttggtcactgttatctatcagaagaggaggtgatttcccagttaattaagtctacctcctgcacacatatgactagatattaaaatatgttttacagaagtgcagagtagttcccaatagcaaacatagtcccagaatccaagcacaagcaacaatggtagcaagagataagcaggataacaaggtacctagacttgactaaatcatctaaattcccagagcaaaataatgagacccagactgctgttagaagtattatgtagatctcatttgctcatggaatagaagtattttgtaatctttcaaaccaatgtccaaataaggagctgtttcctgagcataagtgtttggggaaataacttttatgacattaataggtaagttacttgatgagtggcaaaattttttaatattgttaaaacactgcatgtaattcttgggaatagtagaatagcaagatatcctattattcttgtttataggagtatgactgcatccatgaacaccattaaatatattcttatcttaatgtaactgaagaatttgagtgggtaaaattatgttagtctcttcagctcagattttcaatgccagactaatcatggatcataaataatatttaatatacagctactcattgttttatatagtgtgtgtggcagaaatgaatcttaatttacctctaacaggagccctattcaagagaaatttagaatcataaattcttagactgctattaactctaggaatgcaaaggaattattttaaataattaataaatactgtaactcacttagtaaaactagatgttaataaagaaaagagaatctaaagaggtattggcgacaatctgagaaagcacgcagtcattaactccgaatcaacttcacagttaaacaagtgcttagactctatggactctatggactgttgagttagacatgatgattaatttgtcaaagttgttaactcagaaacacgatgaaagcatgaacatattatgtggagtcatgctggcacaggaataacagattgcattaagtggacaaagtgaaggcaaagcgacccttcacaggcctttcctgaaaacatctgcaaccacccacagacccttgatccatcctctcttaggataaaagctccttcaagaaagctccttattgcccatcacttcataaaatacaagaaagtcagcattaagaactgagtttgtatcccaaaattagtccgggaatatttttgtgatatcagaagattactgggccttgatttctcccacatttcctatcttttatctgatcagtcaagagccatttaggtttcgctacattgatcctgatgatctgctctttgttctccattagagaggccatttctgtgaagctgcagactaccatgaagggatttcactaatggtctggatccatttgtatcttggatatcagacagctacactaagcaagcacatttatcttgcaagtccgcctcctttttcagttagtggagatcaaagaggagcctgggaggagaagtattaagtcgccaatctttaatttagctaattctctaaagtcatggcatcatcagtaggaaggtacttgagctcagccacaggagagaaatgttcttcatgattatatccctgagcccagaaactattctttttgagaaataagcatgttaatagacatgctttatttttcctgctcccaatctctccttcagtgagtttcttatgattttgcatttgaagctgtgctgaggggtggaactcaggcccggatgttttcttaaagaagaggttctactgaggttgaaggacctgatgtcagcaaaatgccaagccttctaaaatcacttgcaaggcaactgggaaataaaactacgagtgttcaaatccaggcaacctcaggcactgcctgcaaaaggccaagtagcaaactgaagcctgagatgtcaaattatttttcaggatgttctgcaaaattataggcttaaaaacatggccttccatggcctttagtcctcagcactcaattttaaattctccccaactccgtggaattctttcactcaagaagctttctgactcatgattgggatatttttaagatagctgctaaagagatagccttccccagggaagaaaacacaaatttgttctaataccaagttgtttgctctcaaatcatgcatacaactagcattgtataggccgagcaggttatttataggtatgtaacacacacacacacacatacgcacgcacgcacgaacacatgcacgcacgcacgcacgcacgcatgcatgcacacaagcatgcatgcatgcacacaagcacatataggtatatataaatgtgtaataatgattactgaaaagactgaccacagatttgataaagagcaaaaagaggaatatgagaggggttggaaggaaggaagtgaagggaaaaatattgtaattacataaaaataaataagaaaaaatcaccccccacacagagttctgtgtaaatgatgacatattttaggcaattagtttcatagagcttaacttctctccttaattttgtaggaaaacacatgactatcagaagtactataatttaattccaacttagctttacataaagctggataaataacttctcctctctacttctctttactctttctaaaatttacaaattcagtcagatgatagatttcgtgaaaatagtacataaatattgattatattcttagtagctttgtgtcattttgatatttaagttggcgcatttggaaaacatgtcaaattactaatgaaagttttaaaaaatatttagttttaaatgtagaaataaataaaaccacttggcagaggagaattagaaaccagctttttaaatttatttttttaagtttgatgttggagtcttctcccatggaatactagtcatcctccccacttagacctttggtaaagataacagagatgggtttctgtagagtggtagaatggcacagaggtgaaacagtcctaatggaagaaggtgaatgtttctatcaatggtttccctttcctaaaggtgaaaacattcaacgttaaaggtcttctgatctctaaacaccaggtgtgggttatgccttgtttggatttacactgaggaggaatctatttgcatttttccatattgtgacaggatatgtcacaaagttaaaaaatcatagtcacattcttctgtgatccaagataaacctgctaaacgcctggttaggacctcctctctcatgctgtcatgtatgcttttagtcccagacaagattccatggtggatggaaacttaagaggcatgtgcgccaccctggttatgggacgctccttgtgaggtgtaaggggactatatgtgtacaggggcatttcagatctctgctgctattagataacatcatcatcttctgcccaccaaaatgtctttgctgcatttgactttaagtatttggtttttgaagttaagtgagtaaaataatgaggagacagagaaatatgtatcctctaacattttcacattacatttgactttcaagactcaaagttgtttatgttttcaattcacacattaaagattaagctatactgtcaaagtgtttgcctcatgtgcattatatgtctgtcattttctaaagaacagatctggaaagggtctattagcatgcattttcttccagagggggtttcgatgagtttttagcagaatatgctctaagtgcaacctctcaagagaagagacgtgtgagtcatgaagtgtaggcatctctcccacaccaagtttccacccttgcaagattcctgtacaggatcaccaaaggccatctctccatttcttcgcagttggtacctgtcggttggtttgtttttgtataaatgacattctgttttaccttattatcaagaacaagggcataatgttctgcttatctacacaaaactttatctggcctcactgtatagaaaatctgctatgttttctttgatgctgttagaatttagacttcatgctattataatgtcagagctcaagcgagacatagaaaggaatatgcccttgattttaacaggttagaaagtggagccctaaagatctgctaacagtcaccaattacaccacagaatttccatctacaattggacttttcattttatccaaagtgagttgtttttccgaattctgttacttatgtaaataagacttgaattataaaattgaaaaaagattaatacatttaaattttaatataccttatcttgcctttcctctgcttaatttcctgatttatcttcagagtcaatgaattcttgatgtggaataagtacttatatgatttggaaggaagagggtgaagaatggcttttaaatttgaaagaaccacattagcgtttgctacatttctgtctcagcacagagacaaccatttgctgactgggagctatctctctaggaagacttgatgcccactttaatgcatttgcagcctacttgaaatctggttcttcaataatggaagaattgaggttcctgtcttcctttcttcagtctttcactcagaaaatggaaaatcttcttcttttctagcatttgtgcatgctgcagggtctctatgtgttaacgtagctcctttcaccaacctatttttcaacagcatatagaattctgtttcaagaggttaatcatgcaacatttgtgaaaatccgtaggttttggcctgagacaccagagaaaagaaaatagctgctctcatttatattttactgtgtcatattttcctctaatatgaaagatgaaatcaatgctgcctaacacttggatcttgaccaaagcaaaaatccctttattctgatgtttgcacatatcagcatctgtggacaatttttatttttaatttgtctcactgttaatctcaacaagtatataggattcatcttttacaataggaaagtagattgaggctgggctatagatgagtatcttattagcaaattctgggcctgaggttttgtccatacacacacgtgtgagtgtgtgtgtgtgtgtgtgtgtctgtgtgtgtgtgtgtgtctctctgtgtgtgtgtatgtgcatgttaatgtgtgaatgcaggaggaagagtctattaacataagatgtcttatgccactttgactatgataagtgaagcaacccctaccccaccccccaccccacccccacgtaaacaaatttggaaatcatttatttaaactaacatcattgtaaggtaagttaaaaatatataccaattagaaaagagaaagtatacaatttagactactttcattaaaataatattaagaaaagctgagtatggtggcatacttcattaatcccagcacttgggaggcagaggcaggcagatctctgtgagtttgaggccagcttggtctacataagcaagtctaggacgcccagggttctgatacaccaagaagccctatattgaaaataaatcaaacaaaaacaagaaaccacacaaacaagccaaaaattaaagggaaatatataacttagctacaattgaaaaactggagaattaagataagccagacataggggtgcaccaggtaacctcaaccttcaataaactaaagcagatgtattttgagctcaaaaccaaaaggacacccttgcatagcaagacattgtctccaaaccagaaatacagagcaaagagttagagtttaaactgcatccatagagtcaatatgttaatttgtcccagttctgtaccattgactttcacttgttgcttctgaacttaaaatattctggttgtagaaactgccccacccaaggatccatcccataaacaaccagcaaacccagacactattgcatgtgtcagcaagattttgctgacaggactctgatatagctgtctcctgtgaggctatgccaatgcctggcaaatacaggagtggatgctcacagtcatctattggatgaaacagaggggcatcaatgaaggagctagagaaaggacctaaggagctgaaggggtttgcagccccataggaggaacaacaatatgaactaaccagtacccccagagctccttgagactaaaccaccaatcaaagaaaacacatggtgggactcatgtctctaggtgcatatgtatcagaggatggcctagtcggtcatcaatgggaggagaggctcttggtcttgtgaagattctatgccccagtataggggaatgccagggtcaggaagcaagagtgggtgggttggagagcagggagaggggggagggtataccagattttaggagaggaaactaggaaaggggatagcatttgaaatgtaaatgaagaaaatatctaataaaaataaacaaaaaaaaccaaaatatcaaaagaaaaatattctggttgtgaacttccattaaaagcactgtactgcacctatcttgatagggggaatgtacttggccgtacaattaaaataacacagcacctatgagcacagaacctgggattgtaccacaaggttgtttaattctttcaatgtgtaaataaaacaatgagaatccttcatgtctcagctttagtctgggaaaatttgaaatgcaggtgctcctgtggctgagcagaaagtgtcgaactgtggaaagagaggagccagaggagccactgcggtttggcaatgggagatgttgcttatgtacctgctgagaactaagcttggggcaaggatcattttgcaatagctcatgtttccctccctgatgggaagaagaagaagggaagccagggcagcttctagcattgttccctgaagagttgtggtatgtgattatgtaaaacaaacccagacaagcaagcagtgtccccacacttagtcagctcttctcaagggagaaactgacagtgtctccactcactgccacttccaatgaaagaactgtgcttgctgaatgtgagttgaatgacccagatgagaacctgagatgaaatcaatatactctcacagtatctctgccaaagaacaggcttgcagtagctaaaacagaaagatgctcgccttgatctattgccaggctctgtgatctccagtcaaactaatggcatgcagaaaaatggactggtacataaggaaaagtgggcttttccacttcttaattgatcactgagtaaatcatgacagaagccaaattaatatatcttatttccactaccccagcgctcgctctctctctttatctctctctctctctccctctctctctctctctctctctctcttccatgaagcacagatttccccttcctaccttgtttcacacagggtctttgaaaagcctgtttatctgaacaatgcctgagcactcaccatgccagttcatgaaaaatatgtggaatttgaaatctaattggcactttggctcctgccagatagacaactttcacagaactatttggaaagtaagctctgcatctctgttcgagctattagtgcgtgacattccctcccttcccgctgatcttgtggggaaggggcaacataagggcagatgtgtaataattgcttttcccaggtattttcattttatggagaattcttagacagtgttttaaactatctggataggttctttcctgtgtgttttctagttccaggggatgaaggaaactagaaacatattcagagtccgtgtgacttccatttaacaagatttactctcattcatatattgcaatcacagttgtttatgtctgtagatatttagtggtggctgaactccacaatattaacaaagccctcaatgtgataatcctataaaaccttaagattagttgtgccttatagtattttccttttgtgttgtctgtggcagtgttagcatctgagttttaatctttctctgtcccatcatttggctaagaaaacatcagttgtagaaaggaaaagcaactgaagctcatggaattgaagatttgttaaaggacacagggccaaaatatgctcatagatggtcttaactttatacctggtattctttacatcatgataatattatctagcttgggattcatgtacaactcagttaaaaaaatgcttccacaacaacattaacacaactttaaactaccatcccattacactttaagatacctactaccccttactcccttgcatagtccttaaaagaataaagacacactccaagtctcctaaatttctagattctggtaggaaactatcttcattccctctcaatctcaccatctgtactttcccaactttatcaatttgcatttattagattttatttaaattgttatttttaataaagcagacttcgactaatcaagctttgtaacaatactcccgtgtctttcattgggttatttctctggttaaataaatacatgagatcagagtctttattactgctaaaccctggacttaacattaaaggagaagtagaaattttaataataatgtctttaaattggcttagcttttcatctctttcaattttcctacctttaaattttattttaatgttcttcacttttaaagaaaaatgaaaaccataaaaataacaacctctcaattacttctttggcataaatgccctaattttcttttaggattttactgaatttttcccttagtcactaaatgtgaatagaatttggatgttttataacatttctgaagctaatgtgaagatatagaaacataactgtttccatgtctgagttgtttggttcagggatggttatctaatcacatttaactccatcaaggcagatgttagggctctgatgagataaattcttgctaagagttgataatatgggtaagaaaatataagatctggtctcattcaccacaggtgttatatttattaaaaatcgaagaagctgaattgccatgatgatactgttttttggggggaacacatgcagaagatggagaaaatatgtattcatggctagatgttggatctgaacgaagtgtgtgactcattcattttaaaaagagctgcatatgtatcaaaagatggcctagtcggccatcactggaaagagaggcccattggacacgcaaactttatatgccccagtacaggggaacaccagggccaaaaagggagagtgggtgggtaggggagtgggggtgggtgggtatgggggacttttggtacagcattggaaatgtaaatgagctaaatacctaataaaaaatggaaaaaaaagaaaaggaataaaagaaaatgaaacagataaaaaaaataaaaagtggtctgagaaattaaaggaggagaatagagttgtagggtaatggtgttagcagaagtgacactattcatcattaccctgtatcctgtttcaggctagacccatgtttgcccatctgtaattattgataattctagaatgtatgcagacagattcataaaccatttatcaccctttcagaaggttcaagtaggtagtaaaagcccacatgtcatgggatactactctaatatttaccagttttgcataattatacagaaacatgctcttttcctatgtttttgttttgttttgttttgaacatcattactttgtcataaatagcacaccagaaggaatttttctttgtcagtatagttttatgaatgcaaaccctgaaactttgatctcagtagaaaaagagcagctttattagcaactgcacccaaatatcaaaacaaaaatgaaaatcccaggccactgctagtacaaaatacctagaaagtcaccagtgagcctgaggcttgcagtaacaaaatatttctatacatgactattaattgaagtcttcaatgtgccaagaaccccttccatccttccatctatctctctctttctttctttctttccttccttccttccttccttccttccttccttccttccttccttccttccttccttccttccttccttccttcctttctttctttctttctttctttctttctttctttcttccttctttccttccttcctctttctttttccttccttccttccttccttccttccttccttccttccttccttccttccttccttctttccttccttcctctttctttttccttccttccttccttccttccttccttctttccttcccccctctctctttctttgcatgtgtttaaagcaattttattatcttaacttggctctctttgcaaagcttggaaatagaatgcagggagaactgtaaagatctttgaatcagagagaaaaccaacaggtatcctctgccagtgagtggtctaagttttgagcagaaactaatggcacaaagcactaaatgaaacagaagagcccagcatgtgctcagtccatcagaattcaaaattgatttatgaattaagttagtattcactgggcacctatgtgcaggcatgctttatgccacctctgagaaaagaaatgtaagtgaccacatatatttttcatgcatttatcttgagacatgattgatatataataggctatataggtttagaacatgcaatccatttagtttcatatctttacaccttgaccctatctgttttaattatagttattttgatggattcactgaggaatcatgaattagctttaaatttcatttttctaattgctaattattttgagtatcttttcatgtacttgtttggcagccattacattttttctctgtgatataagggatcaaactcagggccttgagcatgccagactaaattctgtgtctccaactagatctctagtcctcagctacttatattattgaggaagtatggttgtgtctttaattcattaattgcattttgaaagccttgggaattctgcaaaatagttgtctctctaacgaatttttcatagcttcttcctatgtgtagattgaattttcttttttgttgttgttgttatatcttaaaacagggattttacttcatataaagtataatttttatggttgcagaaaataagagaaaagaaattcaattagcatcccctacttccctctcacaaaatctgtggcattagatttttttttaaattctactatctagatttcatgtatttaaacattattaacaacaaatctagatgtgtcttttctttgagttttaaaatatttattttatttttgaggttatagtagaagtatttaactccattccctttcctctttccaaaacccttcatatcccctccttcttctctttcaagttaatagcatatttttcactaattgttgaaacatacatatgtgtatatgcatacacaaaatctctccctctctctctctctctctctctctctctctctctctctctctctctctctctctctctcatacacacacacacacacacacacacacacacacacacacacacacaatgctcatctaaaatattagtgaaccacaagaagtccaacatgatgcaatgttacaccacaagggtgtagtagtggcagtcataccatcatatttagtattggaatcttaaccaacaatacagacctactgaaggcatggatcttggagatgacttataaactaccactttactaaaccatcataatcccttagtacaatctttttgtccttatattcacaggtaagacttgtttagctattcatttttgtctcttttctttttctctttttttctttttgtgtgtatgccatattgcctatggtaggtcaatgtagcacaggtacaggtgatatgtacaggtgatcacagaagcatggaaagggtggtgaagactctcgatctagggttttaggtatgtgtaaaccatcatattattgctgggaaatacaactgtctcctttataaaagcagcaattccttttaactaaggtatctcttctgcctatcgttattttgtacaagataatttaatcactaatttaaaaatggtgcaatttgctgtagtttctgttttctttcctctgattataatttgatgagattgaatcttaatgtttctcttaatccatgaattatttggttattttcagctatttttttcctcctcctacttacgtctgctgcctttggggaggtttccaaagtgagctttgtgccattagctggatttggctgcctacttttgttctagagttgatgttgctttcttaacttctctcatgttttttcccctgtgtttcattttgaaacatttctgttattattgcttcaaattgctaacattatttctatagcatctaattctcaattaatttgtacctcgtttttagcttatgccacctactctaacctaaatttggagaagtacaatttgttctttaaggtttaagatataagccataaaggtgcaagtgttttaatgatcatctttgaaaattataatatgtgtgtaaattctgaattgattcttagtgacttaaaatttcagaatatagtatttttctattaagtactgacttggaaccttctggatatttttcagtttttttttcagcacatttccttctaaaattctgttctgtacactctttctatttagcacttatgattttctctgatcaattcactgaccttcttatgctagagagtctaacacatactgccaagggtttgtataagcatgttcacataaattcaaatacattgtaggctcagaaagaagattatgaacaaaagtagcagaggtagctcatataaatatactggtgattataggatgactttaagtactaattgagatctttaattatgaaagtttttctttttgaattattttccctggctcagagagaaagagatagatagatagatagatagatagatagatagatagatagatagatagatggatggataggtatagatatacagacaggtaatagatgaatggatggatggatggatggatggatggatggatggatggatgcatggatggatggatgcatggatggatggatgcatggatggatggatggatggatagataatcctggaggagaaaggaactcccatagatcagaacttgcaaggcaaaggcagttaaaagacaaatagaaaccacacagcatccaacttagtattaaaatggtaccacaatggaaaaacctgttctggtcattatttgctgtgtaagaaaatactcttcaaagcaacggctgctatggatttctgggatggcaactgaacccctcagataatgctcctgcagcagctgagtctggaagatactagtcattgtaagcaattgatgtaagactcccaactgccaggaagaaaggtgggtggaggcaggcaacttcctaaaatgagccgtgtagtgataattaactacaatagctcttaaacaagataatgactgttctgataccttcaaattatatttcaaatatatactgaggtattttaagcatttgcagtatttttagaataatgatttttttttttcattcagaaaagtaaaagtgaagatgcatactctggaagcacatttgatctgatgtgctctcctatcataaaaaatatgcagttaggagattattagtgatattatgaacatagggtgctttgtagatgcatcacatagactcatataaaaactatttaaaatctaactaggtatgctcatctttattccaattaacaatagtttgctctagggaatttatctttaggaaattgttagtgatattatgaacataagggtctccacatagataatcaaggtgctgaactgagctgaattgagatttggaccgttgtctgtagccccttggatcatcctgcacatgaatacaggcaggtttgaaggatctagcctttacttaatagctacgttacttagaccagtaactttttgtttcttagcatcatacattctatctacagaactgtatggctactcagtgagtggagtagttgaagacaattataattgatactataaatctgttagttaaatagcaacaagggaaatttctttcgtatttaagaaaaaaacaacttttcccccaaaaaaactggtactaattcagattgtgtttgtgtgggggccaggaaaatcctgggaaatttaagacagtagataaacagcctgcccacctaagatgatttggatgggctcagccactaagccacacaaactcttcacagatataaaaactgctgactattcctcatgtcagtgaaattccatagtaaacaagactttaggaggtaagaaagctggtacctggaaatatctgttagttgacctttaatttttttcctcagttaacacctggggagtattatgggtgtgagattgcctgccgggcagcctgttgctagctactggaagcctggcaaggcccactcagaaatgcatgtgtgaacgtagagtgtttctacagcaaactgttccgtagtgaattctttatacccttccattccccttcttcctttcttcctctggacataatttcacagaatctgacgtagtcacagaaaatcccgaagagcaaatcttctctcaccttgcttggccattgtggaggactctgatttcacaactttatttttcctaatggctgtgaagaggtggcactagttactaaattttcttgagtcaaatatctaggaaaggcagacagtattaatatctattttcagatttttgtggtaaacaagagaggctctttggggaaattcccattgcattttgctgtatttaatattcactcaaaaataaaataaattattaattatcacaacaatggtgaactaagaaatctgaatataaatagcaattatcctgggagaagtatataagtaggtttttggtttttaaaaacaataaataaattgaagatagaatatggactaacactaatgccaaattttatgatttttcccttacacagcagttagaggctagagaatgccattattgttttaagataaaaaaggataatgctttaaacctatttctaaatctctctggagaggttaatttctcatttttttctgccctgcattccttactgtaagtttagttttgattccccaaagaggtaaacgaatgtttttaagaggtacaggcaaccctttctcataccactggagacttcaaaactatgtcagctggcaagtcctttattggttttagggagaaatgcaggaatctgaatgccatctaaactgtatcttcccttagattgatcttaatgtaacccttctccctttcctctccacaattagtcttcattctttaatagcaacaaataccaacgtgtaaggaaaaagctgaactctgccttctgagtcgccttgataacaaactggctgtgtttatcattgctctgaagtcctgatgactgagtctaatagcaggaccccaggagtgagaagcagccatttcagacatgttcagccttcttcctctggatttttgatatttttcattgtttttatgcttgtttttattgttcttgtttttatcttcatgcaacaatttcccactggacaaacgtatgtgtagttttggaatcttaaccacaaaatcggacttcagaagatcaaaccagcaaatcttacagataatgatgagaggaagagcaagaacaatggtgtagcgtttcatctgggaacacctgcagtatgctataaggacttttggcatcattatctcacagagtttctctacagctttgtgagtaagagaggccatcaataccatcacatctggtatgtgtgcttctgtttgtcagagttacagggagcctgtgtctcccaacaagaatttatgctttctacatgaatttttgatttttctctaagcactacttaacattctgatggataactaataattacataactaccaagaagcctaaccaattataatatccttcagaaaaaatcattgtctagaccttccagttaatgcagtttctagactgtatttgtcattgtttttcactcttaaatttatttttaattgttatgatatgcctcactctctcatgaaacagagacctaaaaaaatgaatgtttaagtaattctagatctggacatggaggacagagagagacttatgggattggaatctgggaattgatttttataaactacctttcttatgaggttttttttttgagggggggaaatgctgtatacaaggcaatgtacttttttattagatattttctttatttacatttcaaatgctatcccctttcctagtttcccctccaaaattcccatatattcccccccatccccctgctccccaatctacccactaccattcctggtgctggcatttccctatactggggcatagagccttcacaggacttagggcctctcttcccattgatgaccgactaggccatcctctgctacctatgcagctagagccacaagttccaccatgtgttttctttgattgttggtatagttccaaggagctctggggtactggttaattcatacatgttccttccatggggcttcagtccccttcagctccctgggtactttctctggctccttcatttcagactgtgtgctccgtccaatggatgactgtgagcatccacttctgtatttgccaggcactggcagagcctcgcaggagacagctatatcaggctcctgtcagcaggctcttgttggcatctgcctagtgtctgggtttgctggttgtttatggggtggatccccaagtggggcagtctctggatggtcattccttcaggctctgctccaaactttgtctctgtaactccttccatgggtattttgttccccattctaagaaggatggaagtatccacagtttggtcatccttcttcttgagtttcatgtgttttgcaaattgtatcttgggtattctaagtttctgggttaataaccatttatctgtgagtgcatatcatgtgtgttcttttgtgattgggttaccttttccaatctgttggtgacctttttgtcttattgacagtgtcttttgccttacagaagctttgcaattttataaggtcccatttgtcgattctcaatcttacaacacaagccattgctgttctattcaggaattttccccctgtgcccatatcttcaaggctttcccccactttctcctctataaaggcaatgcatttttaaacactttatttctaaaaaaagagcaagtagtggcctgtaacataactcattaggtaaagttgtatcttctacaagtctggcaatttgtaagaatttgacctaagaatccttgtgtcatagtttttgttaaggtgacaaagttagagtcccctggaaagagaaaacctcacttgaggaattgtgtctgtcgtactggtccatgggcatagttaaggatctctagttgacatagagaaggacagcccactgtgatatgccagcatggagcatgtgggcatgggtgatgtagaaaaggtagccgagaaagtcagagaaagcaagccaataaacacgattgctctgtggtctctgcctccatttctaccaccaggttctaccttaagttccttatgttcattgacttctgtcaatgatggaattttaggtagaaatgtaattcaaatactttacctcccgagctggttttcgtcaatcatagcaacagaaaaacaaagctaggagaagagaacatgcttctcaaagttatcttctagcttctaaaagttgtccttgcagtgtcctccttcctatacatatgtcatgcatacagtaaccaacatcataaaaataaacttaacgtgttttaattatagcaattaaaggcattcagctaagaaattcagggttgctcctgatttgcacacttttgtttgtattatatgaccaggatataacatggtataatcatatgaaatggaaaataaaatcagatattaaattgtgtgtattaggcacgcagagccactcagagttaatcaaaaatcaacttagccttgacaaagtagtgcatgtgtgctttaatctaagcagaggtaggtcaacccggtcttcacagagagttctagcacagacaagaaaacacggtgagaactttttgagagagagagagagagagagagagagagagagagagagagagagagaagaagaagaagaagaagaagaagaagaagaagaagaagaagaagaagaagaagaagaagaagaagaagaagaagaagaagggaaggaaggaaggaaggaaggaaggaaggaaggaaggaaggaaggaaggaaggaaggaaggaagggtgaaaggaagggagaaagaaagaaagtcaagcaagaaaacaaaaaattctaatccttcaatattttgacaatttctcaatcactactcccaaagtcactgtatgagtcaggctttaaacagcatccacatccacagccttttttctgctgacttatctttttcatttatttattggttattttatttatttacatttcaaatattatccccttcccaatttacccctcacaagccctctatcatctccccccacctgctgcctgtatgagggtgctcccccacccaccacccactcctgcctcagcaacctagcatccccctaccctgggtcatagagcctccagaggaccaaggggctcccctcccagtgatgcccgctaaggcatacctctggtacatatccagctgaagccatgggtcccccatctgtactctttggttggtagtttagtcccgggagctttggggttggggggtgtctggttgtttgatattgttgttcttcctgtggagttgcacaccacctcagtttctacggttcttgccctaacttcctcattgggggccctgctctcagtccgatatttggctgtgtacatccatatctgtattggtcaggctctggcagggcctctcagaggacagctataccagtatcctgtcagtatgcacttcttggaatcagcaatagtatctggtttggtgactgtatatgggatggatccccaggtggggcaatctctagatggccttttcttcagtctctgctccactctttgtccctgcatttccttttgacagaaggaatcaatatttttgagatgggtgggtggccccatctctcaaccgggggccctgtttatccactggatatggtttctgcaggttctttttcccccttgatgggtattttggctaatgccctccctgttgggtactggaaacctcttgagtccctgacatctgggactttctagtagcttccccccagttccccctcccccactgttacatacctactttcaaattcctgaccctctgtacttctcccccatctcctcccatatctgaactggctcccctttttccttcaccctcccctcttcctcccagatacctatctccctctacttccctgagattattttcttcccccttctgagtaagactgtagcattcacactttgccaggcaacaataagacaattgcatcaatcactaacttctttacactttcaatatattatgaatcacttctctttttttggaaccattaaatataccagagggtttttaggaattttcatgcaaaaaaattttttaaggaataaaatggtgaaaataaatacagttctgatcatatggtcgtctgttttcaagtatttgaaatactcaatgcattttcattattaaggttatgtcacttagcaattctgacagagtaataataattcttattcatctaataagcaaagtaatatccaagatgttttttgtgacttgccctgctatatactaatcttgataaatatatctggaatgtcaggcccatttattttatgttacccagtagtctttctttaaacttcttactgtaagggatgcattgctaattttgtaaccctgtgactatacccagagtgttccattgagtcatagataaaatatttcaattcttgggaagcatttaaactatctttatttgggatatgcacagataaggatatgccaggttaaaaatcagctgtagtactctaaaaattgctctcaacttcattatcatatttaatggtttataacattatgcagttggcatgtttacattggaaaagtattctttgttttattcatacatacagcgaggaagagagagatagaggtggaggcagacagagacagacagagaatgagcacagcaacttttgttcacataaatagtttgtgtttctttaataaaactaagttataactctacctaccagcatggcccaatgcaaactctgagtttaaaagcatgctctgacagttattagttatgttattttgaagatgaacttgagatctactttctgaagtgattaagctttttacagtaaagactctggtaaaatatgtagcatacctatagcacctgtatcgagcatcagcataccactcactgttcacagaactcatctgtgcgtagatttacattggcagaagcttaaagcctcagtgttcctctgtactcaggtatttttcagccaatgaaatggaagttctcttctattcttatttgcataacccagtggacaagagcagctgcagctggagtgcttgttgattagctctagtccctgctttcaggttaccatgtgctaacttattctgaagtcattgataaaacagaatttaagaatgggggctgaaatgttggctcagcagttatgagcacttgatcctattgctgaggacttgggcttagttcccattgctcacatggtgactcataacgagctataagaacttcaactacattgttctcatgattctggctcccaagaacacgtgggcagagagagagaattaaaagtaataaaagtggggattgagggctatggtcacagatcagtgcttcatgctgcccttgaagagaactagggttcggtttccagcacataataggtcacaatcacagattgtgaactccacatgaaggaatccaatgctttctcctgacctttcacactaggcacacacatggtacacttatacatgttacatacatgcagataaggtacacatatacataaaataaaaagaaaatgatccaaatcttttagtaataaaagtaacttaaaataatatttcatgaaggagaagacaatatctatatcattgttaagacccactacaacaaagtctttaattttgtttaaaccacttaactacattcttattgtacacaagcagcttaaggtatttttatacataaatcatgcaaaaacaagccatcaagataacctggccctttcattacttttgaccattatatattagattgcattcaattattccctgctactgacaagaagataattctagttcatttttctaacacattaccactgaataatatctgtaaaattaaatttaacacggtttgatatatatgagtttgcttttggttataattaatgaagctatatcaagaattcagcagggatagcttacccatatttataacatatgactattctcaccaacatacaatggtgctcataaaaacatcctgtattcttaacttgttctgtatgaagctaggtttctgtaaatcacaagtcctttgccaggttaggtgtcttggaccctacattacctctttgaaagagaatactctgaaggtgagagacatttttgtcatgggccctacgttccctcacagttacttattttttcatttttcaaggacaattgatactaagatgtgacctctaagatttgaagtcaaacagaaagtgaaagtaaaaaattaccagcaaatgttttgcctttaaagtataaaaaatttgaatactatttgctattatggtctcgtctagttcatgcttatcagtgcagagtgactctactataccagcattcaagtagctgataccagagagagagagagaaagaaagagagagagacagagacagagacagagacagagacagagacagagagaggataagatctagagactcacaaagacagatttataaatatatagagatatggcagaataataacaaggaaacaaatttgaagataaataaaggaatagaaacatctttccgcaaacacaagtttaacagtttctttaccttaaatagaaactgacttgctcaaggtcactagaccatatggtgttatgattaaaatgacaagccttaaacaggaattatacggttttgccctatcccagctgtcgcattgcattatagaaaacaaataataggactctgttgcagatgttgtagatcttctgaacattacaaggagactatgttaattggctatgtaagattgctgatcagtaatatgctggaaagcagcaacaaagctttcagctttttacacaagagctgggaagtcaacacaatgcctgtgggcacagatggccatgcatagaactgcacggccctatttttatctaccctccatctcctatgaatgtggataccaaaaggaagtcaactgaaatgaaaatcaatttagtctttgatggtggatgcttatgctatataattccaagcataaagatgaaatgacatgatacctagaaagaatatgctctggcatttctttgggacccatttcaatgctcttcttcaagcatattttggtcgtgtgctttacatatttgtctcctgaagtgtttttctatgaagtaattctctttgtcttttaacaaacaagattgtttctttcacaatgtatgtgctgtcacttgggatttattatgtttcattttcccacagtttcaataatagcataggttgattttgaattcaaaaggagaggaacattagattgaaaacaaagccaatacccctgaggggcaaggagaaggcgtgctgagggtttgagtaaactgaattatcttatattcttcatgttaaggcagttgctgactcctctctattcaacagtatgcctgtggaaatgaactcagatatttaagatataagaatgtttagctgtcctacacactttctggttgtctaatactgaaatgaaccaaactctgatcagatcccctctcctctctttaggaccttactattgttgctacttcctaacctccctcactttatctctttgtatgaatttctttctgagtaaaattataattaccactgatccttaaaaccttgttttgtcttcatttcatttctagtcaagaatatgctggtcataatcaccaaccaagggactgcgattgtttgatattacaattgtttcccctgatttgctctctaatttacaacatgctgttacacagttcatgagttagacatcatttttcatatttcagaactcctcactattcagcagtgaacaagagagataattgaagaaaatgaaagcatttggccttgatagtcacatgagtgtaagcagactagaaatcctgtaataaagtccacatgggtaaaggttttatattgtgcattagttgaaaactgaacattaaggagatggtactttctagtgtatctttgtgtcattctgaaagaaagtttacttcaataaacttataactttagagtagatggagattgaattggaagagaaaaacatctatgctttaagtttattgttattggaagcactgccaatttagtgtcttttcattatccattttcaccaaagctcagtctatgttactattggggaggggggtgaagggactttaaagagatcacacctaatatagggaatgggctattgtgggtgtgcccttgaagggatatttgagacctggccacttctctcctctccagatgctcccactatgacattctccctcaacgcacactcagggaaacaggaccaaggagccatggattcaagtttccaaaagtgagtgaaaattcaaattttcttctcttgggttgatctttggggtattttaacacagcaatggaaagcaaagagagaagcacacaataaactcaacaaagaatttcatttttactcatgattgacatatttgtcagtacttttattacaagagattttctgaacttttaaagatctttttattacgtgtgtgtgtgtgtgtgtgtgtactatggtacacacatagaaatcagtgaaaatcttatgggaattgtttttctccttccatgatatgggcctatggaatcaaactcaagactttggttgagtgacaagtacttttatacaataagccaactcactagtcctgatatatttttacatagttattttgacatttttgtgaagtaatttatatgaataattagtgataatagtaaactttgttttcccaggcagaaaatcattttcgagggtacattgtggtctggagtgatacaatcataaaaaccaaagttcaatctccataactcacatgaaattcaaggtgctggtgttaccatttcttctagactccaccccacagttacctgacaacagccaggtatgactaacagtataaaaggggttgcttgcttactcctcattttcttgctttcttattcttcctctcttccctctctgccccttctctctccattcccttcccaatctctctccaggtgttcatgaccagcctctctcctcctcctcctcctcctcctcctcctcctcctcctcctccttcccctcctcctcttcttcttcttcctcctcctctttcttcttcttcttcttcttcttcttcttcttcttcttcttcttcttcttcttcttcttcttcttcttcttcttcttcttcttcttcttcttcttctttctctctctctctctctctctctctctctctctctctctctctctctctctctctcctgtctctctaactttctctgtctctactaacccctcagcttctttccccacaccctaaataaactttattctatatcatacccttcatgtggatgataaatcaggggaaaagaatgcctcctcccacccctgcctctgtaccataccatgcctctaccaaacatatcccttgctctcttctctttcttttttataaaacacaacagtcaggacatacctttacaatctcagaattgagaaggtagagacagagggatccctagaattcatgggtcactgtagcatttacagttaacctctaggccagtcaaaagccctgccacaaaaattacaagaaggataattactaatgaatagtacccaaggttgttttttgacctccacatactggcctacacatgggtctgctacatgtgtgcattcatacccacatgactgcatggacattaggcacgcacatacacacacacacacacacacacacacacacacaaacacagagatagattgagagagagagagatgcacacacacaccaaataaaattctttccaagcttttttcaaaggcaaaatgttgtgaccttctcagtaatattcttttaatgaaataaagagaaagaaacattgttttctccaggtatttgcttttctttgtatgatacatacctaagattttaggtctgcaacattgagcagagcattctataaaggcaaatgtagcacagatgaatcacccattcacagaaaataaacatattcattgcagttaaagtactgaccctatgttcttggtcacattttctccctcacatttaattttcacgaatcatttgatgttttttatatttacttcaaaacatcacatgtaataggagacattagttttatatactgacactgatgtgtctttaagaattctactgactaagaagacaatgtgtataatctcactggttttcacttactgtccaaaacaagagagtaattcttatatttatcttaaatagtaatcataaaaatttatattgcatttattcaaataatatttttcaaggaacaaacttatataaacatagtgaattctatgatatcttgtgacacctacctagaaattatgatgcagagatttctttagctagtaaattatagtatcacattaggtgttaatacatttctagaactgatagaatatcatttaattaaatgtattgcaataattactgtttataaacacttcacaggttactagtgaccataactggttgtcataggaagaattttatgtcactaatacatgtttgtaatgttagccatttttatgaagatatgttttgttaaaaattagccaacatagtaaaaaaatgaaatctactgcaatatgtgttgtggcttcatattaaaataatgttttaaatactaacaaatttaagccataaacatataaaggttaatattatagaaccaagagggtatgtaggagaaatgcaatgctcataattggtatggtataaaacaccataataaaattaaataatttcttgataatatcagtagatagtaaaaaaataagaacattccacattaaacattttattgtctcagaaaaatgagaaaaatggaagcttgcatggtgaaggacatttaaaatacaaaacaaaatagtattaaactttattgtgagagaatgaatgccttctatcaaagactaagacataggatgccctctctctacactacagctctttttgttccaaaatgtcatatttaagatttgtttcaggtcaataaaacaatatattatgttttaaatttttatttatctcatttatcttttagttataccatctatttttatagagtatgtggtttaggaaatagttttagtttaagtattttgtgtggttttcttaaaacttctgtctccctcattgaaatgtcaaatagtcccactagaaatatcttagtcccttgtgaagattccaggagctttatttgtgtagttgtattactgggctgtttatttagtgtcctacttctttttattattattaattgattattttattttgttacatttcaaatgttgcccccctacgtggtctctccttctcaagcccccatcccttccctcatcccttttgcttctaagaaggtgcttccctacccacccacccgctcctgcttcactcctatagcatccctctaagctggggcaacaagcctccacaggaccagggcctccccttccattgatgccagttaaggcaatcctctgccacatgttagcaggagccatggacctatccatgtatactccttggttggtgatttagtccctgggagctctgggtggtctggttcactgatattgttgttcttcctttggggttgcaatccccttcaactccttcagtcctttccctaactctgccattggcattcccaggctcagtctgatgatcgcctgtatctgcatctgtcttaatcaggcaatggcagagcctctctgaggacagccatactagactactctctgcaagaaattcttgacatcagcaataatgtcagggtttggtgtctgctgataggatggatcccaaggtgggatggtctcagagtggcctttccttcaaagaatcaacaaaactaggagctggttctttgagaaaatcaacaaggtaaattaatcctagccaagctaactaaagagcacagagacaatatccaaattaacaaaatcagaaatgaaaagagagacgtaacaacagaactgaggaagttcaaaaaaatcagatcctactacaaaagcctatactcaacaaaactggaaaattttagtcattgttaaattcaacaattggcttcttttttaaaccaatgtgactctccatgtaatacactaatgagtcatgagggtaaaaagctatgtgtctggtaaatgagtccatttaatatctttgaacagaatacataagtctgtaaattctcatatctacatttatcaaatggaaaatagtgattttatactcagagacctgtggaaataaaactgtattgtgcataatttccagaggctaatgacaataagactttttgtcttttgtctcacaaagacatgagtttctggtcatgctttgtcttcctgggaacacacaactactttttgccaaggaacacatgtcatcttgaatccaatcattgtttgtttggaatttataagtagtttctcctcacctctgggaccccatttccagaaagtttccacataatatcagaacaatattggaacttaaaaatcaaacatacagtgtgtaaagtagcagaatcattcagtattacagctgataaaaagtgaattatcatttttagttaccatctttaaatgtgtgtgtgtgtgtgtgtgtgtgtgtggtggggggtgggacatttgtgtgctagtatcccagaaaacaaaatagatgaaggagactatcattttccttatactaatcacctacatatcaatacacttgtttgcacttgatttctcttcaaaatcatactgaaaactcagaaaagaagcagcatcctaagaaaaaatctatcaaggaagaaagtagctactgcatttacccatcggctagggacccttgcttacagcaggagctgtggagtgctcaggacaagggctttagagaaacatcttagttaagtgcactccttttatagataagaaattttcattccggagctagaagagcgtctcctggatgctccaggccactggctagttacattatttaatattttcctcaagtgaaatgaaatttaactttttaaattgaatattaaaaataaaataaaagtctatggttgtacagtcattcaagaatatatttttagatagtatgttactatttcaagtactttagaaactatgtactggttaaaatagactcatgactcacatcatctcaaaaatacaaagactacaaacgaatgttactgtagctgagtttccattaagtttcctctcttctaacttaattaatacaagaaaaccttactaacttttttttttcattttatttttctgcctctccccttaatatagtgcactataataacaatcctttgatctctttcatttctttggcaatctaaactaaccttaagttgggaacttggattgttactcagacaattatttcactataaatcaatgtgtgtgtgagagagacagagagacacagagagagagagagagaaagagagagagagaatgtaaaagggttgaacttgaacttgatatcaagtagtcaagtggaaatgagtaaagatgatagagtatgccaacatacatgctagctcatacagaacagtgttgcatactgggagatgatgtagaagttttaaagatgaagaataactaggaggtaattctagacctcaatcaataatgcatatactttatccatggactgttattcgaaattgggtctgtgtatcccaaatgattatcatgaacacacatttaacggcaagggcttttagaatatgtgtacttttgtatatattgcaagaaaaaaattaagaaacaaatatatctatgtatttgtaactttctggttactgtgacaaaaattgaatattagatattcagacaaggcagtttagctagggaagagtttatttggctcagaattaggtttgatacattatttggggggaatttctggttgcaggagctataggcagttgaacatcccctgtctgaaagcagagagtgataaaaactgatgctcacctcaatcattattattttttgtttttgtttttgcccttcccacttcaggtcactgttagcctgagctcaaacagtaggtgaaagaaaccaaataagtaagtaatcactaatctacaattttgacaaaatctgtataaaggcgctttatgacagaagcaatttcaaatgcattgagaaaaacaatgtggaaagttcagtagataagaagaatataataattttattttggttcattatgaaggcatttagttcataataatttaagttcctctatgagaaccacttgtttatctttttcatctcagagtgagaacatgggagaacaaagttacacacacacagacacacagcgagagagagagagagagagagagagagagagagagagagagagagagagagagagagagagagaaacacacaaattatggagagaatctgacaaccaaattctctgagtattaataatatgagcagaaagaatgaattcctggtttaaactctgtaaagtgggaaaaattaattctgcataacttattttaattcatgaaacagatatagttttatcaaagtaaattgtcacattggatgacctgaagggataggggttgagaataaaaattcctatataaagttaggcaattgtgttctcacagggtaatggggttcaaggttggaaatttatgggatttcaataatagttaaggtggtcatagtaactgtaatgaaatttctttccctttacaaagagcttcccacttttcacttggctttattttttcatgtgggtgctgccgatacaaaaatcatatccctgagattatgcagcaagcattctaacccactgaatcatctagattcttttttttaaagttaaatagaacacccaacttcattcctagagcaatcctgtaacagtggtgatgttgagctcagatatagtgaatgatttctgagaagaacatatgagtatcaagagtagaagcagttttgaacaattgagtgaccaggatctaagggtgcatgcacactgtcaaagaaggttccatatagttttagtgcaagcaacagtaaaaacactaaggggaagcatatacttgttaaagattttgtgtgacagaaataagatactgtgtgtgggatctaggagaagatagtcagtgttgtgagagtttgattctcaggacctacatgatgaaaacaggaggactaactccaatgggtttgaattgatcatcacatgcacagtgcagttctacacacacacacacacacacacacacacacacacacacacacacacaaaatgacatgtgcttttaaaaactctgttggagagaaagaaaattaaaattgaacttgagtatgggctaggcaagatcatttcaggcctatattagcagataaattttgtgacgagctgagaaaatacagaaaataatgctgaatgacactggaacctcaagcagtagagagaatgggttgagttcttggcatatgctggcctttgtataccaggggctcacagcaccagcatgggagcaaaatagtgtaataagaaaaaccaagctccttggagcaggccaaataaattcatactctgcacatgccctccatcctcacaaagattttaaacactcaaagtcactgaagagcgtgctatcagcatagttggtgattggttagtattgggaactaatactatgatggggaactgatgcacgccatatccatagagtgaattctggagcatgttgtactgttcaaggagttctgcttctctttgcttaatttacaaggcacacaccttcgcggagagaggctgacaacagggacatgccttaataagcagccgacatagtccagataagaacagacacatttgtgaactaggacagtggcagcggcaacagaaaggaggacagttacacaagagatttcagaggcataagtgccttcatgaatcattaagtgtgggaggcagagacatgactctgagtgttcatgcctgcctcacgggggccacggtggtgctgccaccagataatgaaccatcaagaagagatgaagtttggaaggaggattcttagatcaggattcatgatagtgtcgtaagtgaattgaaggtactcactacgggctacactaatctaccacccggaaaatatttttctccagggatcgcacagaggtactgagagtaaataagatgatttaagaactacgaagaagcaagcaatgacctaactggtgaggaattctttcctgtacaaacttccccatcatttgtgtgtgtgtgtgtgtgtgtgtgtgtgtgtgtgtgtgtgtgtgtggtattagttgtagtacatttagccttttcttcctctttttcaatatactcagttttgggagcacaaacatatatacacacatacatacataagtacatacatataaaatttatgtttattatacttcacagtaacttctattcatagtaactgattctgacttcttttgctaatttaaaaaaagcatcaacttagctataaatacagtaatctaattttaaaaaggtaacactgaacatatggcttccaatctagccatgacgagcaagggaccactttcctcaatctttccagattctacatgtgaacagcattaaagtagtacacaaaatgcccctctacaatcagggtgtcatccgttctgagaatgctctgggcatgtttgatgttagcttgatgtcaaccagaaacatactggctttgatatgtcactttatctaatcattcatttaccctcctcctcctctaaccaaagctacagataactctggtcttactgctgccatcgatgatgctatgcaatcactcagtttgcaatgcaatgcattccatgctgttctccgtctgcccatcactctcttcagactcacagcaccttctattagttattttacattaatagattttccaggatcaaattgttgcaagaatcaagccgtgctatctgtactgatattaattttcaatcctttgttttcaatgaggccattgaaatagaaatgcacaaaaaggaaggacaacgagtagaaagaaatgataagttttcaatctagccacccaccattaaacgaagccattgtaccaacctggtattttcctttcctactgcttcattgtggtttcttccttcgaaagattaattttcctatgggaccttggtaacttgtactgtgtgagaagtgattagataattctcttctgcacatatatcttaataagtgccctcaggcagcatccaagtgacactgagggcaggggattatactagggatttaggatgcagcatcagccttcgtcagctgccatttgtgctgaacatcttgctggaacaaaatgactaaacaaatgtgtgctagtcatgagtttgtgattctgttttagggtgctgggataaatatagaaatatggatatacagcagaacttaatcccagcttctctttctggaagagataacgactggagattattttagtattacttttacagatgggaggctttagtgaaaaggtagccttgagattttgttttattctgcctgaaacaaatgaaaaatcaaactggtgtagtacattatgatcagtatgcctgaaaatccaggaacagaaggtcacctttctaagcactgctttgacctttgtgcttgcttgtctaaaacaaaagtggctttagaagaaccttgtgggtggtaaaaacagtgcagggatcagagccctctctagtttggagagtgatgtgttgaaggccgatttctaaataccagttttgtttagtttctgaatctattcatctctgagcaacagataagataccttccatattattcaatacaaaaattatgtcctatgaatatatgaaaaggaatcattggaaatctgatagaaacttaagtacataattaaggcttgccttagtattaatagtaaggtgagaacataaggtttatgtctgaaatgggggtatttttttacttgacataacactgagttgttggaaccctatgcacagagcttgatttcagcttttcagagttcagactgactacatatatgtatagttggtttttgctactttgtggattcttccttttctcatcattgataccctggtttcaccgtctagagaggtaagaaagaaggataaaggggagagaaatagagagatccttggatctagtaactttcttcttgtttcttctttgtctatgactactaacaaactgcaatcaaccccattgaatgaccaaaactaccaccatcacctctcagggccctagtgtgtgtgtatactctgaaaagttcctagaattccaaatgtcatacaatcgcagaagctaccagcagctcgtaaaaccatgcctctgctagagcacaaagcaaatcatagtcagctgctgaggacagtctaaagaagccccacattcctacacctgggattaaatggaaaatacattcttaaaaatatttctgcatttttcaaagtaacaaaaattccagaattgtcaccacagatatgaaacattccttatctcaaaatacgtctaacttgttcccatggagggtttttaatctataaagcataccatctagattagctacttttatattactgtgctgagacactatgactaaggcatcttacagaagagtttactggaggcttacaattttagtggctagtcaatggccatcatgattaggagcaagcaggcaggcagcatgctggaacagtaactgagagcttgaatattgaaacacaaccatgaggcagagctgtgaatgccacaggcttttgaaatctgagatcccacccacaacagtgcacctggaattagtttgggttatttttgtccatgaggaaaaccaaagaggagaaaagggttcatttgacttgtatatcctgagttcctgatcactgagggaagccaggacaagaaatcaaaccagctggatactggacacagaagtggacaggccataaagagtgaatgttgtttatctttccctgctctctgtgacttgctcagtttgtttttgtatagcaccaaggactaacatccaaaggatggtaccagccatattggactggatctgcccacatctatcattatcaagaaaataccctacagtcttgcttacagcccaatcatattcaagcattttctcagttcagaccccctcctcgctgatggcttatcatgtgtcaaattgacatagaactttccagtatatatttcctccaagtctatacctcctgatcctgcttaaagagttcatggaactggggaccaaatattcaaacatgagtctgtgttaagcagtcttattcagaccatcccagcattaaaagtcatgagatttcattttcaaatattgactttcagcttattttaataatttaatgtcctgtgtgcacttaacaattgcagtgttagaagtatttaatgattgacagcttcctaaatgccagtatcattttatggtgtgtgtgtgtgtgtgtgtgtgtgtgtgtgtgtatacatgcatacagactcagtatttattttaatacatataaaatatttggaaatgttagtcccatgagagtttcagataatgtcacagtatctatagcttatcattgatgttattgtgactttagacagatctatctagtacataaagtttgttatcttattcagtttggagccagtataaaactattaaattgaacagtgatttctagacacactattcagttgcccatatgaactcacagaattgtgacagtaacagcacaaaggctgtgaaagctcttctggctatgccagaagaaatcctggcatagtgggtgagttaccctctagatgaagagctattgttgtttcataggctctagggaaggagattttggttctgtttgtttgtctgtgtcatgatgggacttctgatagactaatctttacacatcagaaagaccataatcccaatgctagttgggtcacagaaactgagtggaaagtggagaaaagaaaaggaaattctaagttcgtggaaagaagtgaaagaatgataagggttggggtgaagatggggcaatatgttaaaaatacattgcatgaagttctggaagactcaacaaacatattttgaatatgttgaattactcagcggtcaacgagtcctcacctacttcagctacttggatgattattagaaatgttgctgtttcaatatattatcaaacatgctcccgaacaggaatgaattaatttatgcctaataaacatgctattttcacaaagaaatgcaattcactttgagaaattagtacaaaacttaccaaaccattttaaatccaatttgtcttacattgatagagtacacttgaatttatctctgcaactagaataccagctatcattttgtctaaaaaaaaaaaccgaacctacttcattacctttttgaatgccatttgtaagttgtgcatctaaaagctttgcagactgtgtgtgtgagttaaaataattttcaagaatgtcttaccagaagttgtcttcactacttcagttgtattcctcaatccaacaaaggaaaattgatacagcctccatgatcttgtgtcacccacttcaacagaactgcgcttccattgataaacaatttcttcacgaggatatccatctaccatgagatgggaaaactcagccagaggtagcaaccaccttctttgaataacttgtaaataccaagggagaacaaaactgaaagtcatatgagcacactggactggccttgtggaatttgcctcccaggaaattaacaaaatatatatcaaatcctgctggaaaagactgaaagtaagaaagtcaaaactgccttttaaaaatctcgcttttagttgcatgtaatgtaaacaatgaaggatattctaaatgttgtatttgtactttatatcacttttgtaagatacaaaagtatctagtacaaagtgaaaattagatatgtaaaattagatattagatattgtaatgaagtaaattacatatgatcaattctgtcttttaaaattaactacggtcatgactattttgattttaggagtctctctgactctattgaagagaaattatgttgatgaaaatgcttgtttaaaatccatcattaacatttcattcattcaaaaatatctaactgctaaaccggaaataaggcagagatggataatctaatatcgatattgaacaaataggaattcatgtagaaaagtgaggcctgtttgctttagaatatctgtggaagttttaatatttaattggtggtagagttgtcaaaatccctttgatatgttgaaaatatcttctctgatgaaaataataagtcaggcttttacagtgttgacatatcatacatttttacaaatattataccaacaaaacagagttaatgtgaaatatactttgtttaagaatgtgttatataacattcttctgagtcccatgatgaaggatattggaggtatagtatcaaccatgtatacgttctattgagtcctggcctggccttacagtccacctcaatagtcagtctggacacattgtctattttttaagagttgcccattctatcaattcttcttgtaaagattgttttaattgggacagtttgaagtacaataaaaaatgatgtcaaaatcaatagcaaagctcagtgccactatgcaatttctcagattcactgcattaattgacaaggcaattagagtgactacaggtggcagggcacaatctggggagaatattacttacaactggagaactccagggggcaggagtgttcatccattgggaagttgtgtaattgcaactggcactcagcatcaattgttagcctaattagaacaacaataaacatacagagaaaaaatgctaacatcatttttacagtgcacactgacatcctttctagaacaatcttacactgtgattgataaaacaaagtgatcctctatgaataaaattcaagttctaggcaagaattatttccgagcatattttatttacatagcagacagaaccacccaattcacctcaactccattaattcaaaatatgtggatacttgttttatattttatcttatttatttttgcaaattagctgcacacaggagatttctcagtgaatatttttaacttatttaagagaacaaactgttttaggaacttaagctcgtttaatgtttgcatcaaatgaatgctgacagttctctgatcttatcagctaattaacacgaagccttctgttggcaagaacttgctgtttttaaattgccatagctgggttttaaaataccactgctgcacaagggactggtatgcacttttacaacagagatagatagatagatagatagatagatagatagatagatagatagatagatagatagatagatagattgaaagcaagctacattgataaaacaaaatagagactgcaacatcagccacatgcacatatatgaactagttttccttttaatttgcatttataaataaaataatggtttgtgatagttttgcatatgtatattgtttgctctgctcgtattaactcatttctctgtttagtactctctccccatgtttttggtcccttctgtctctccaaataatatcatatctacctttatttccttttattttctttgtaatgttatctttattgtatatatgtgtgtgcatatggagaataaaagttaacattaaatgaaaaaaaaagaaagcaagctacgtagatagataaaattattttcctatataagatgttataggagaggatatctaaaagttaacaagagatgctaaatgcacatacaatgagacaatgagaatgacttcaccattgagtctcagtttaaacaaagtttaaaacctcaagatgtgcagttttaagccctggactgtgactcaagaagggagtttaaatctgaaggattatagatgttctgactacctttggaaaggcatagaaaaaaaatagaatcaaactgtaatggtgatgattggtggctttcagaatgttcatgtttgtcagctacatttcttacaagctacaataccactgcttaagtgatagaaatgttattttacaaaaattaaatttaaaggattttctaattagcatgacttttcattgaggacatgttagatgttttgtggtacaagagagcaatgaataatctttatgtgtattttcaatggcctatgaagccttgatgaactgaactacttctgtactaaatgctgtgatggctccgttgcactgaaatgtattcaaggtcacagggaccaggaacacggttatgatttgtacttagactcttcactcttcgtcacagcaggagactttaatcactgtttctacgatcattcttcaaagaatagtttggctttactcccaaatgagattttaattaaatctggtttttattagaattatctctcaaaataaattgatattcttcttattaagataatacagatagattgcagatataagtatagattcagaagtattaatagctctacaaatacatgcacacatatattcagacatttatagcttagataagcaactaaattaaaaatcatctttctttataaatacatacattgtttcaagtcttaagcagatcataattgacacttaaaggagggttctataattaaacactgttccccaaattaataagaactcaaaattggcgacaacattataatatgataacaagacttgaggtagagtgaatgattgcagatttcacaagccaaatgaactctgatttatcattcagactttgattttcacatttctaattctagtcattaccttatcaggaatttaataaattcccactgaatctaaaataggcacaatgactttcttttgcaattatggtagagatttcaaatcatttgaaagtattatgccttatatgtttagtattaagcatttacaaagaataaatatattttactggtacatatgatatgttaacttagatgtatattgtttagatatttctaaaatataaataaatcttacaatataccatgccccaagattagcattttgcctgtcactaatttcacctgtaacaatcctgtggggcaagattcaggtaaagaatcactagctataactcatagatattaaagaaggggaggtaatttagtgagaagcagggagacatttgtactgcagagtgagagttccacattcgccatttagtgtatgtcacagttccatgcattcaagtgctacttaaacagagatttgtaatttcagtctccttacaatacaaggattctaaagatcacaaatggtcatgaaaatacagtagctccacctttcctaatacttagtatctgctttcacttcatatgcctaaatataaaatgtaacaagaaaaatatggtgcttgctatgtaaaagagaatgttgatatgtaacctagagccaagttcatagtcatataccttctagcaagttctgtacatagaaaaagtatagttactctagttcatgggacatcaagatagaaggcaaagagtcttaagaatccttttctatccctccttcttcccttcctgaaagcatagggttgattttgttcttattttcaacaagtacttcttccccaccccctcaagaagtaccttaaggtgtagagaactcgaccatcattccaaattctcagcatcctgttgggagtggtgatccagtgagcatcagcctttttggagttcctgaagaaagtgtctggaatccagattttccccaccatattgctattcaaccggagaactttaatggtactgttaaatttcaaacgtctgtcataccaggtttgggcaaaaaaaatatcaattgtatattcctgttttaaaaagaacagaagatttaaaatgtttatttatttattttttttaatcttgtgcttactgccagtatgagacatcatgggatagtgcatcagcagacaatagctttgctggtgaggtcgctacctcaactgtcttttactctagtttcagacatttatgatttctggccaaatctccaaaccctggtaactaccttccttcatacacatacaaaacaagaaggcagaccattatttgctagggagaagtagaggtgggcgcttccttatccactgtaggatatttagcatgacctctgcctctatgtcccaagtaccaatgttacctaaaagaataattgttccaggttcactactgtagagaaaatcgaagccctacgcatccaatatacttaaatagagttgtaggttcagctgccttacaataaaagaaaggctctaaagatgcccaatggttacccctgtgaaaatgtataaaatgctttgcccctgacaaatagcaaattcaaaagacaacatactagaagttatgactgtttattccatttctctagatacaattaacataattaaattgctcactttgcttagctatgcaatacttttatttatgagtggattagaataaagttattttattaagacattggtagtgattcttacgctgaattaatctctctcatgaagcatattcttaaatgtaataatgacaggtgaacataacaattcactataagagcctatcaaatataaggtgggtgacttcagacaaagacaggcaagtactgtgtgacatttagacctgcagggctagaattagaaaacagtgggtctggtgaggctgccacattcataggcaatcccgaggaaatccttctttattagttgtgctttgttacccctctttttacaaaagaaaaactaaccctaatacaagggtccaccttcaaggtcccggatacttgtcttagcattttgactttgtcatcagtatgagagtttttaatgaaaaacaaaatcttgctgacattttgtgtggtttttgttgttgcttttgtttatttgttggttttagtttttgtgattcttcagcacttcagaaatccttcctttgggtcagtttctgactgtgtgtttttcacttgtccactcatttaataaaccactgtacatctataat

SEQ ID NO: 189 - DNA, 6342 bp, Mus musculus
ttgtattctgttgcttatgctcaaatctatggttccagatttctttcctagggtttctatctccagtgttgcctcactttgagttttctttattgtttctacttccctttttacgtctagtatggttttgttcatttctatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttttcgggtgtgttggggtgccctggactgggcgaagtgggagtgctgggttctgatgatggtgagtggtcttggttcctgttagtaggattcctacgtttacctttcgccatctggtaatctctggagttagtagttatagttgactctgtttagagattgttcttctggtgattctgttaccgtctctcagcagacctgggagacagattctctcctctgagtttcagtgctcagagcactctctgctggcaagctctcttacagggaaggtgcgcagatatcttgtttttggacctcctcctggtcgaagaagaaggcccaaaacagggcctctctcagaatctgtgttgctttggcagttcccagaagctgtcagcttctgtggtgcagactctcacctgtgcagactaaaatcctaagttccagggagtcctggaaccaagtaggtgaccgctgctcctgaggccgaggccgtctcccgagccaggcggacacctgtcctctggtccggatggtggccggttatctgcggcccgcccaggctgctgcctcagcggctctgtgcttccgcccgtcccagaagctgtccggttctctggcgcaccctctaacctgttcagactaatttcctaggtcccgcggagtcccggaacccagatggcgaccgctgctgctgaggctgaggctgcctcccaagccaggcagacacctgtcctctggtccggacagtggccggctgtctgcggcccgccaagggtgctgcctcagcggctctgtgcttctgcccgtcccagaagctgtccggttctctggcgcaccctctaacctgttcagactaatttcctaagttctgctgagtcccggaaccaagatggcgaccgctgctgccgtgtgtgtctttcatttgagaatccatagcattggggtgagtagcaagaagcacatgctgttgcagatggggagcagaattacacaagatagaagcttttgttttgttttgttttgttttgtttgttttgttttgttttgttttgttgagacagagtttctctgtgtaaccctggctgtcctggaactcactctgtagaccaggctggcctcgaactcagaaatccacctgcctctgcctcccaagtgctgggattaaaggcgtgtgccaccactgcccagcacaagatagaaacttaatgtgatttttatgtcatttcccgaatggctaagggtgctaacattttttcatatatttatttggtgatcttatctttttcttcctaactttttctttactaactttctgtttaatgcatttgcacattaattaatgggaagaattgggtttctgttattcaatttttggagttagtgatatattctagacattattctccctggaatatacatcagacaacaatcattacccatgagcccctttgacaatctctttgttctgatgataattctgtgcagaaactttttggcttcatgtggtcctatctgtctgttcttaccttcatttccagtgctgggtgatcttatccagacattcttgtctatgcttacaccttagaatgttatcttctttggtccccaacagcagtttcaatggcaagtcttactatgttcaaacactgagtaccactaaatgcttgaggagttccaacagtagtgatgtgcctggcagtcacacaggtatcttcaaggagataatctaggaaatccttccgttcaaggaagtaaatttgtatatttacttttgttggagtccaccaaaagaccctcactcacaaagaccacagatactggcatcactgcaaaccgcaggaggtttattgttctgatgattggggttgctcagcctcgcagggaaagtcaacccagatttcaaaaagcacagctctttttatggtgggttattatgattggtcagcaaagcagcagtacattttgaacttatgggtcagctatcaatggcacagctattaatgtcatggggaattctagcaaggtcagggaagtttgtgatctttcttgggatttagtgcaaggcagggcaggggaatttttcccaagaactgttatttttgttatggctatttttctgagaacagctaatcttgttttggcagctgtagacttggtctggtcattttgaccactaaaactatatagtttagaaacttcagagtggggaaggggctgtgtggtcttgaatttattttggattttatactttctttttcagacatatatttagcaggcagcagaaacacaacattatcaatatcttcaatagtcaatacacaccaaatgttaagtgcaaatgaatgaaaaatatggcaaagaaggaaagcatctttccccaaagcatttctgaaaggtcaaagtcatgtcaccacagcaatattcctggtgtgctcgatagttttataacaactggatccaagccagtcattcacgaggaaacctcaataaacaaagtgcctccatcaggatttaggcaagcctatggggcattttcttaattagtaactcatatgggagggctgagctcattgtaggtgaagccatctctaggcttgtgatcctgagttctataagaatggaggtggaataaaccatgaggagtagatgggctagtaagtggcatgccctccatggcttctgcatcagctcctgtcctgttacattcctgccctgctttatcgtcatttcttttgatgacaactcactgttatatgaaactgtgaattgaaataactccctttctccccaagtttcttttggtcacagtattcatcacagctatagtaaccctaactaaaacacttgaaagtactgaaccagagttcctggggagatcatttaccctgtttgtcaagtgccatgcttactcatgcctaagtaacactctgctccttcaaaaaagaggctacctcacctggtaaccaaggttctgcttagactgggattccagatcttgaactgtgttcctacaattgtaccttgaaaacttcttactgtgctagtccctctacttgttcttgaccaggattatcatgtacagtgcaaatacttctccttcctcctcttagggagtcctccttaattcagggatcaccagaagcaagctaccaggtatccatcacattggtggtttctataggaattattttataccttcaaataacagtttcataaagttgtgcattttattaaaatagctataataactgaaggatactttttgtcatactaatatagacatgtcttgctattgcaaaacagattgctgatcagctgaaacccactgcgttactctgtgtctttgggggccatgaaaggaaaaacaagttaaaacatgggaattgtgtataaattaatcaaacagcgaatcaagatagcaatgtgttgatatcaggatctggatggccagatcctggtttgcactagcttcccaaggcagcacagcaacataaaacacaatgagcttcagaaacttacatttctgaagacttagattgtctgcagggtttgttcatgctgctgcttctccagaacaggtatactgtcttctccttgcatattctgccatgtttgtttctgtttctgttgtgacttcttgtgaggactctcgtcacattggatttaagcatacatcaataacctcatcttatatcatctctttatggctcccatctctggatataatcacatactacagtactgaggattaggacttcaacacaaattttaggagacaattcagccactgacatgggcactcattttgaaatgcttccaattttgttatatgtttcaatatttcaaaagcacaatgttgcagcaattcccctaggtggtttgacttgtttttaaaagtgaactttaagcgttttatggatttcatacacttcaggtcagaaaatagccctgttcttcctttcacagaaaagagagagagaatgattctgtgtttcatgtatacagacaactaaaaaaagtatcatacttagcgaagcatattcctatatgtgaatattgaaacagacaataccagctgatgttatagccggagatcacaagccttaatttatactgaagctcaacagataagatgcaactcactctctaacctccagcaccagcagaatgggaagacatttggaaaaggaacaactgagggaggggtggatagataagtaattggaatctgttcatagcacccactaaggtatcttcaggtggatgaatgcattatgggtcctactataatgggacttcttgagctccctaccatatgaacaaaatgtaaatgaacccaaagcaatctcaaagaatcacgttttagcaaaaatcacttgggcacagttatgatccaattagtatctagagcaatttacaagaagaaaattggcacttacgaattgcagcttcccattctgctattttaagaccatgggaaatgtaaatgatatcaaagagccagggtaagaggaggaagattgcctaaacagtctcagcagactgtccatatgaccaccaatttctaacatctgcacacagtagaaagaaaaagagctgcttcaatgtcttctcaattctaaagtaaaaaatagtaaaacaaggggaaatgaaatttaattgttattcctgtcttccatgtagatcatcctataaactaattgtatgaggcagatcccatatctcctacatggtttctgaagtctaagaaatgtatggatagtacaggaagttaagagtttgagtgttgccctagtcattagtgtgaactgtccttaagaaagccatgttttctgctgtgtctgaatttgctattaattgaagatgacagcttaatctttctctcaggagggctgagaggaagaaagcactaaaaatatcttgatgtcattgtctaaaacatcaaaggcaatgagagttgtgtgttattggggcatgcacaattttactgaaaataagagagattgctcaacgatgaaatatagtatcctactgtcaaggactttggaacatttttgcatttacttggtaccacatacagccatctgactttgtttcaatgaaatagaaacatagaaaacacatggatgagattggggtccccagtgtcagactgtggatctatggtactatcagactacaaatatcacactcaagctgtaccagtcagcagaatttaatatgggatcacctgcaaatatgtagtcatgttttcaggacactgaagaacaactcagtaattgggggaatttcgaagaggcaaaagaaggacagatagttaaaaagcagatagagcaccaaccaaagaagttttctggactgaaaaattctgacttctttggagactcagctgtatcatgtgatgtttttctggaaagtgtcttatgagagagaagctgaagcacacaagagcatggatatttggctgaagcagatatgtgagaggatccctgatgcttgaaaagtgtattaagtagtacccagggaatgatggttttgtattggttaaccttgcaacagttcccttttgatgttcttacactggttctccttacagcctttctcgggcctttgctgacaaagctcatgcattggtctgccttccagtgctttgctggtcttcgctgatcttcacttgtcattgtagagagaaatgtgccaaagaacttctcatggtattctggattctggctagattcttcccacgttgactcagtggagtttgtgttttcttctagatctagctgctgcttctgattcttgtttggtgtttgccgattggattggactgccactactgattcttatttggtggtagactggactgctgacaaagaagattggaatagtcccaaagaactacttctaaacaagtccacaactccaattttctatcaacatttcttttcctttaactatgattggtgtgctagaaagagaggttggagtgttaaggaaccctaataaaagtaggtttccaaagatct

SEQ ID NO: 190 - DNA, 3823 bp, Mus musculus
acttttcctttatgactggttgtttattggatatagcgtctgggttaggaatgtggatgtgcatccacctcattcagatcagtgctgggaccctatctggcttagacctgtgcagaccctgtgcttgctgcaacagtctctgagttcataagtgcatcagtcctgctgtgtctagaaggccttgtttccttggtgtcttgcatccccactggctcttacactctctgtctcctcttcttcagagtttcctgaaccctgaggggagtgatctgatggagacatcccatttaggactgacggttccaagatctctcactctctgatcattgcccagttgtgggtctctgtatctgttcccatctgctgcaggaggaggcttctctgatgacggctgagcaaggcactgatcatgtgtgatattgaaagttccatgactcactccgtatcactgttgtctcagaagagctgcttgagatgccgagtttgtctccaggatacaacatcgagaacttatgagctcagaacttgtctcaagtgggcaaagagatgagtgggattgagatttcccttaagacagaaggagcagggggaaagatgggcgctctgaacttgggaagaagatggtgtgctgtgttggtcatctcgagaaatccacttcattcccttgggtaggggtgtgttcttgctgtattaatagaacttctgtttgctcactctttatttgaattggatgggactggttcaaaaccatctcctctttctgctgtagatgagtacacttgcttgttttgtttctgggaacatttttcatacttctaaaagcattaaagtccaaggctcagggggaaaagcaacaggaatgctacatttctacttgcttaaggtcctgggaatttacatatgttttcttttatgacaaggtctcattgagcccaggctaaccttcaatgctatgtagcctaggatgaccttgaactcctgatcttcctttacagtcctggaaggacaggtatgcagagtgctccattctatgatgctaaggatggaactcagggactcatgtgtgccggtcagactaccaactgagctacatccccagaacaggagtaaattttaatgtgcaagttctgtgacatttgagaattctttctgggacatctctattgtgtttgagtttgttactgtgtccatacagcagggagactgagacagaatattgaagcaaaattcagggagcaaagctatgtatgacatcagtagaatttatgcttatttagctctgtgtgtgtgtgtgtgtgtgtatgatgtgtgtgcacgcgcatgtatgcatgggaatgtttgtgcacatgtgtgtctggaggtcagaggcctattgaggacgggtggctgaacatagcttgctgtggctgtaggggcccaggctttgaccctaacaatccaggtagtaccaacttcccagaggactcagggaaagaaaaatccaaaattaaatgatgaatgagtcactccaggacttataccagccctccttttctgtatgacccctctctatcctgttacctcaccctttctgccttccctggctctgccagtctcagctttcaaagtgtttttcatctcacatctggtctcccaaagactgtgacacaaagtggcatctagcatctggcactgccacagcagctcttaggtgtcttcttcttttgtaccctaggtatcttttccacagcttctggtgaacccgattgttgaatatcatccatgtagtcatttagcaggtgtcttttctgggttggctatgtgccagacacaggctgagagatgccatgtgatagcacccaggtcctgggctcagtaggaaacagtaaaatccagtggataacttgaagaggtggcactacaacaatcaatttctaagacaaagcttgaaatctaactttaggcattagacactgaatggtcccgagctgctaaggtccaggggttgggtggtagagataactgtcctttcaaaaatggagatttaagtggtgagatgactcagcaggtaaaggttcttgctgtcaagcctcgtgacctgagttccattctagggacccgagtggtagaaggaaagagctgattcatgtaagttttcctctaacataagaagtggaggtacagagtagctaggagatagtgatggctggatctctgcacacttctttctccttaggcaggaacttaaaagtgctggggaggtctgcataaccaagaggagcctgggtggaacaaagggtgaggcttagcaagtgggccactaggattctaataattaattgcattcaggaaggtggaacttgttagaacattggatcttttttttgtttgtttgtttgttttttgtttttttttttttttgtttttttttttttggtttttcgagacagggtttctctagccctggctgtcctggaactcactttgtagaccaggctggcctcgaactcagaaatcctcctgcctctgcctcccaagtgctgggattaaaggcgtgcaccaccacgcccggattggatcttaaggatgcaaagcaagttaattaagatctcaaggcatctctctcgaaagaactcacatgagagcctcagcagcagcggtcgccatctgggttccgggactccgcgggacctaggaaattagtctgaacaggttagagggtgcaccagagaaccggacagcttctgggacgggcggaagcacagagccgctgaggcagcagcctgggcgggccgcagacaaccggccaccatccggaccagaggacaggtgtccgcctggcttgggaggcggcctcagcctcagcagcagcggtcgccatcttggttccgggactcagcagaatttaggaaattagtctgaacaggttagagggtgcgccagagaaccggacagcttctgggacgggcagaagcacagagccgctgaggcagcagcctgggcgggccgcagataaccggccaccatccggaccagaggacaggtgtccgcctggctcgggagacggcctcggcctcaggagcagcggtcaccatcttggttccaggactccctggaacttaggattttagtctgcacaggtgagagtctgcaccacagaagctcacagcttctgggaactgccaaagcaacacagcttctgagagaggccctgttttgggccttcttcttcgaccaggaggaggtccaaaaacaagatatctgcgcaccttccctgtaagagagcttgccagcagagagtgctctgagcactgaaactcagaggagagaatctgtctcccaggtctgctgagagacggtaacagaatcaccagaagaacaatctctaaacagagtcaactataactactaactccagagattaccagatggcgaaaggtaaacgtaggaatcctactaacaggaaccaagaccactcaccatcatcagaacccagtactcccacttcgcccagtccagggcaccccaacacacccgaaaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaacgaacaaaaccatactagacctaaaaagggaagtagaaacaataaagaaaactcaaagtgaggcaacactggagatagaaaccctaggaaagaaatctggaaccat

SEQ ID NO: 191 - DNA, 6232 bp, Mus musculus
gaattgaggttctttttttattatttttcaaaactctatgtttttattcacaaatttgtataacatgaagaatttacattttacctatttttatataagaaataaacattatagtttttttaaattccaaggcatttttttggataatagttatataaatttatctcgtttccaaaaatatgtcatgtttgtatttctttcaaaatgctcttcgttggcagtaaacactcacattggcaaccattatccagcacttgatgttccaattcaaagtaattttattaactgactttagaattttctagtccctgtggggcatttgcccctaagattaatgaggtgtgacaccttatttatgctgcccttcccaacttgacaaacagtaggaatggttgttccactgagtggagagggagtgccaggcggggagagtcccatactgtaccctgcaattgcagccacttcaggcacttgccttccaagccaattaaaacactgcttagcagattttacacttcagtcgaacacataacttttttctttaattaaagtgtcccaaagctgcattagtacacattttaaatgtaacaattagaaagggattaaacttctgtcctccagatattttagagaagctactttctaagataaaagttgctgctcttccaagtttaaatacactaacactgaaatcacttcttataattcccaaaatggcattatggctttctttttaactattgaattctctctggcagagccagggcaataaaacccatcatattctaatttccagacagcttgatagaaccaatgttctcactatagataaagtgtaatgaagcactttctttcccataggaaactctttgactcatatgctttgatgccaagtagccttcacatctgctgcttctccattgatggctttaacttggcatgctaaactggtgtctgatgaagcagatttactcaaaggcaccattttatttcttgcaatgggaacgtagtaaatccctgtaataaacataggttcaggttcatatacaataagttgtgtgttagagaagaaaagagggagggagacattcttcttgggtaaaaataatttctttttatggaaatacaacagaatacatagtaaagaattagttttaatgttatttcaagggtaactaattaaaataaaaattataatagacattagtaaataagactgcaacattggtttaaacctaccaaactatttttattatcacattgtgtcttaatgttacatttaatgcattgcctataaccaatctttctatacaattaacaaagaaataataatcttctagggttagagaatacatatgactacaaaaatattcaattaggtattttttgttgaaaatgaaaaccacatgtcaatatttctgttatggtactgataaataagttagcacaactgctccaatgcatcagtgctcaaacatataaaatatttaaatttttttatgtatttaagtatgtgaaaataaaaataaaagttatagaatttcaaaatatttaactacttatgaattcatcactttcaaaacattgtcaaataatttgcagttttggaagccagaatatgttaggttttcatgtgacttcgttggaagagaatttaatgtctgacatacaaattgtttctatttaaaaaaagataccaagacattctcaagaaaggaaaaagaagcacaagttaggactgtggtaattgacccatcagttaaattggtcgtattattcctacaaaagaaaaaggagttgaagtagctcctggaacctcagtgcagggcaacaaacatgggaagaagactgcacaattctgcatctgaactctctccttcaaattctaattcatgacaaagccacatgtgagttaatgccacctctttaatttcaataactgcattccttccattttcttgcaattggcatgatattttatttcaaaattgtattctttgataaatctataagtgtacactgtacctagctcatatttatctttcaatcccttcctccaagtcctttcgacatcatctaatatatctcaaatccatggagatttggaggaaaacacacagtatcagttatgtgatgaatttgcttttgccttgtgtagagataaaaaaagagaatttaatgactcatcttaaaatagctagtaatgcatggcaatgatgtggaagaaagaactccacaggctagagcatctcaatcaacaaggctagtctcatgtgattcagtgtcatttgcttaaagaaatcatctctgcacttactgaagtgccataaagaatttctaataattctactgttgaataatgcttcccgcacaatggcagaaaatattgagaaccaaaataatcacagcaactatgtgcatacaagaaagcatgatttattttctattcaagtgcaaatatataatcattgagccttttatagtaaatataactggttttataatgctattatagtaaatatgctggctttgcactactattacaggtcatacaataagataaataaaggtcgcattcttattcgaaaatactaaataattatgactggagatttttttataaatctaactattaattaagcacatgttgtcagctaaaaccactttatatctatctctcaagtcaaaatttacttgtgttcctttacacattaggaaatgatatctgtagaaaatttttaattcagcaacatggctgctttggctggaatataggttaatcctaaacaatataggttaggttagtttgtagaagaaagcagccatatttgaaaatgatatctaactgaaaggtagacaaagtgacaaattacagaaagatttgacagaatgagtcagtgattatgatacacacaactctcacagaaagagaagcacagggaagagaagctatttaagagcagtgcagggagagagaatcagtcagtcttatacagagtgcttgaatgagttgggggttattcatgagttcatggacttcagtacaggttagtagagggacttgaagctagaaaataaggattcagtaaattacaacaaattgtcagagttagtttcatgccaagcagaacaattaactgagaagttgagagaggcccgattgaatcattcagcttggagaggagtttgagtcagaacaactgagttgaaccagccatacagactttagaaagaactagtaagggtgatcttatttagaagtaagcatctgagacaacaattagatcagatgaataaaagttacttttacaaatatcccttgagcacttaaatatttgctgcagaaatatgcaagctactcatgtttcaaaccctcagtgtgatttaatttgaggagatcactgaatttatgagtacagataacaaatgacaaaggacatgtgatggctgtatgcacccaaaaactaaatgtttaaaaacccaatttgagcaaagagttgagttagatcactgggaatcacaagatgaaaagagagtacctaattctcaccaaggcatttgtcagatctctacatgtaaacagggcatgtgaacaatcataaacacacataagcatttgcacaaaagcagaaacaaggtaaatatagtaataaaaagtgttttaaaattaagaaaaaaatgtaggtgtgtggtagtagggagcaaaatgtgtactccagcaccacaaaggatgcagaacaatagttgagattagccaaaatatcataagtgatgatgattataacaggatatcattgctactactgttactgtactgccataagcctttagtttcattgttaacgacttagcctatcaatatgcaagctactaatatttcagttttctccttttaaaaaagaatcctgatgataagttcttcttgtttgcgaagatttataagcaggggtttatactgtaattcaagttttcctaaagaagaagagaaaggggaagacagaaaaggaggaagaaacggggggaaagagaatgaaacaaaagacaaagaaagactactcttggtagatatggaaagttaccatttcttgtaccagaaaagttttcaaccagcttgaactcttaagttgtctatgcacagtttcaaataaattgactttcaaaatataaatgctgtaggatactagccattctgataaaaaaaatccatttatatacaggagaacaaaaaagaaaatatttaatgacaaaagtaatttttaaaatgcatttaattcaactatttgtcataagtttttgtcagtggctacattcatttcatttcactcatgaataactatataaaattactaaagtaggtacagataacaaaagaaagaagtcattggaggaggctaaaaactactgaagtctatgcaaacaaggaaaatattttgtattgtctctcgctctctctcagtgtgtctctttgtgtgtgtgtgtgtgtgtgtgtgtgtgtgtgtgtgtgtgtgtgtgtgtattcacccatgggaatgtagaaggcagagcactactacaaatgttcctctcttttattctctgctttgtttccttgagacacactctctcacagattttgaactcaccactttctctatgtacactggccagttagtatttggtatttgctcagtttttcccccattgctggggtttatgagctgaagctatgctttgcaattaatgagggtggtggggattgaactcattgtagtctacttgtagattaagtgctttcactctctgaaccatttccccagcctacaggtatattttcaaagaatgcagcaaagtaagttggcagatagaaaatgtaccaatagtattttgagtctagtaaaatatatagacaaacaaaaatatcaaaatgttcacagcactgagggttagctgtaactacacgtaatacaatagataaaatcttgaaatacataataatattgagaaaatggaaccagaagagataagacattaaaaaaagtaatgactaacctgcaaggagaatacagctgatgcaatgagaatatatttggaagtttggttaagaaaagatattctaatctttggcgtctctacccaatggaaaattttacagtttttctcaatgtagcctcaaactttcaaaattaaggattaagttaaccatggttatttaagactcaaaaataataaacaaaaagtatatccccagacacagactatctgaatcaaagaagtaatggctatggtcaagaaatacagaggacatcttaggaagaactgaaggtttctccttaagattctaagactcaattaaatacatttaaagactaaaatatttttgagtcaaagaccaatattctagcatgtataaggttcttgttagatacatagcacaaaaaataatttaaaatgaaaataagataattttaaaatattctcagtaattgtgtttgtaaagcaagtgtcatccttttgtagaagaaaacaattcctttaatattataggaaaatctgctaggtatctacctcacttatatgctaaataaaacacattaagagtaactaagggattttcattgttttaaaataatattattgagcggtcaccatcttggttccgggactcagcagaacttaggaaattagtctgaacaggttagagggtgcgccagagaaccggacagcttctgggacgggcagaagcacagagccgctgaggcagcagcctgggcgggccgcagacaaccggccaccatccggaccagaggacaggtgtccgcctggctcgggagatggcctcagcctcaggagcagcggtcaccatcttggttccaggactccctggaacttaggattttagtctgcacaggtgagagtctgcaccacagaagctgacagcttctgggaactgccaaagcaacacagcttctgagagaggccctgttttgggccttcttcttcgaccaggaggaggtccaaaaacaagatatctgcgcaccttccctgtaagagagcttgccagcagatagtgctctgagcactgaaactcagaggagagaatctgtctcccaggtctgctgagagacggtaacagaatcaccagaagaacaatctctaaacagagtcaactataactactaactccagagattaccagatggcgaaaggtaaacgtaggaatcctactaacaggaaccaagaccactcaccatca

SEQ ID NO: 192 - DNA, 5528 bp, Mus musculus
gttgctgatgctcaaatctatggttccagatttcttttctagggtttctatctccagtgttgcctcactttgagttttctttattgtttctacttccctttttaggtttagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttttcgggtgtgttggggtgccctggactgggcgaagtgggagtgctgggttctgatgatggtgagtggtcttggttcctgttagtaggattcctacgtttacctttcgccatctggtaatctctggagttagtagttatagttgactctgtttagagattgttcttctggtgattctgttaccgtctctcagcagacctgggagacagattctctcctctgagtttcagtgctcagagcactctctgctggcaagctctcttacagggaaggtgcgcagatatcttgtttttggacctcttcctggtcgaagaagaaggcccaaaacagggcctctctcagaagctgtgttgctttggcagttcccagaagctgtcagcttctgtggtgcagactctcacctgtgcagactaaaatcctaagttccagggagtcctggaaacaagatggtgaccgctgctcctgaggctgaggccgtctcccaagccaggctgacacctgtcctctggtccggatggtggccggttgtctgcggcccgcccaggctgctgcctcagcggctctgtgcttctgccagtcccagaagctgtccggttctctggcgcacccgctaacctgttcagactaatctcctaagttctgctgagtccctgtttgtcttttcatagatttctttaatggattaattcatttcttcattatggacccctaacatattcataaagattattttgaaatccttgtctcgtacttccgctatctttgcctttctcagttcctgctgtgatagggttgcagggctttaatggagacatgttgtcctggcttctttgattgtatttttacactggtggctaggcatctgagtttgtggtgattgtaattctagatgctaaaatctggtcttgtctttgttgggtggttgttttgttcccttagtttctgttgccttttggggtgcttaggagcatgtggtgccagtgggtcatctggtgggaaatgcttcttagatcctgctaggtatggcttctggatgctctgggttgagtgattgtcttggtattgggagctgacacttagggatggagacaaggtagaaggagtctacaggatggaagacaggagggtgtaccaccaggatctgcttagttccctgagaatgagaacagagaaggagtgggagccacagcaggtggtttgctccagaggtgaggagaaggaagggagaggagtgggcttgggggagaggagggagagtggggctccagactctctacctgtttctctgctggtttatttgtttaagtttgggatgagctaagattttatttccccatgagcacaaatagctcttcctgtttatccaaacctcctctctttctccacgtgctaaatagaatgcattacctaagtatatttattttttaaaataatctcactttacaaattcagaaacataagggtttttttttttaaattacatcattttatacataatgaagaacactgaagccagaaatgtacgagtgtacccaatgattctcaagcattttgctctgctggtggatgttgggaacacccacttggcccattccccctgccctcccacaccccaactgttgtttcaacagattatgagtctttatcaacccccaagtacaaagtttgtaaactaggaacatcttctgtataaagctatcatgacactcaataaaaatatgaaatcaatccatgtaaataaaatagtatacatctttcttcaaatgtatcaagccaagtaacattgtttttctctaagcccagatagggaagtgcattctatagtctaaagactggcaagtgttagtgagtaaggtatactgtgttaagattatggaaggctgggccaagctcacaagattgtactttctagttctggaatagaaagtacacatggcatgtgtctgtcttccctacatttttttttttttcaaaattctctcatgagattgacggcaatagaagtcggttatgtatgtgctccctctgaaggctatttctccatccatatgaccacttttgtgtgcatgtgtgtgtgtgcatagaactgagaccaatgctgtgggtcttcaattgttctctgccttaaattagaaagagcttctcactgaacctgaagcacagcaagttggctagcctggccagcaagccctagggactctcttctctctgtcttcccagtgatgagattatatactgtatcgtccctgtctccctgtctctctctctcctccatctttctttccttaattacatgctgagaatcctaacccgtgtcctcacgcttgtgcagcaaggtctgtactcattgagacactgcctcagcccttgatcactcttgatttttttttcctggaaaaaaaaagggggacctttattgtcccatttagtgtatattatagttaaatagagacaacagaaaatcaagggctgaaaatgtttactttgtatcagataagagtaatgtcaatagcacacttgaattcagtggtgaccaattaaagtagtttctccagagggacgcttctcaggacacaactgggtggccaaatgaaggtcatgaactagtagtatattgaccatattttccaggctaaaatcacaaaacgtaatcccataataatattttaaatgaatgactgaatttattggtagaaaggtatttgaaaagatattaaaattaaggagcattcaaggaattttaaaatgaattacctttgcaggaaaaaaagatatacaattatagtatattgtatttgggaacgatcccagaaaatggaggacggcttatttaaagagcagggggaaacgtgcagttgctgctctgtgatttctccacaggaaagtccttacggctctgccagagctgaagaactccctggacttgtgtagctcccttagcttccagctgaaatccagaggcaggagatggactgttccagccaaaaacatacgtttcactcctgaatgagatagctgtcagagcaaattgtttctagaagcaagaagaaatcactctctgagttaacgttaatttcagggtccctcacatggagattctaggctcttgccctcacggctgagacaccctcctctaatcacttgcttgcgcgccaatggagggtttactttgggtttagtgttctctggtgagttaggcaacctgctgttttcatgagtgctctgggaattcttcagcagagatgaattcttccaaattccaagtctattgtccttgcctatgccctttagccctggtttaagacttcatagtcttccgtgtttagcttcaggacattctgccagacccaatgcttcaaagccttttaagctttggcatcagtgatcagccttatccctggatgaccgtttgctctttttgctctaactagtagcaatgagggtcagcgtatttactaaggcagatccaaggtaaatcatacttacttctatgcccactggtaatttgatatttgggcttaacggttaaatcaaccttcctggctctttcatttgttccttctcttactcttttagactacatctaaagtcataatgctggatttgtgacgtcactctcaattgtttccagatggtttctcaggctgatcaaaaagaagatgaggccagtgaatgtgagtgggaaagtagatcttcaaacagaaagagggctcaggaataaaaagtataataataataataacatgaagatcacaaaacaaccgtaggtaaagtaaattgccttttccctctgtctcaaaacagggtctttgatcaattgttccagtgtataaaaatttgaactctaaagaagccaggcaggcttctaaaacccacacatcaaaagctttgcttccgttagagaaatttaaagccatgatactctgaatgggtttgaaattctctaaaatgagttctaataacacccttcgcagacagaaagggagaacagccagttacatggcttcatgctaccattttctctggtacattagttttccaaagatgccattttggcttgtaccaaataagagggcaaaggttaccaaatggaagcccggggaagccagaaaccagaacagccctcacaatggaaagggaatccaaactgtcagctctgaatagagagaaattgtatgtgtgaaattgacaaccagcagcggtctggcaccatcagagaggccaggaaattaactcaaccgggttcctacttactggattagagctggggttctgtcgagatgtactcaagattcacacctagacatctctagcccctggatcacactggcaatgtcaggttttagttggaaggcattctaaacaaataaagtatcagtgaacaatttttaatgatacagaaaaaacaagaagaaatacaaactacctcttaagaactgttaacaatggatgcatctgtcttttcatgcacattgctttaccagctggaagccaatttgtgtatataattgttttttgtgtttttgtgttttagcttacttagtactatataagttttttggttgagggagacaaaaatcacagtcaacaatcagggtgcaagtagatgaagttagtcagagcttgatggctggctccttctctacagaaatagcagagagaaagggacaatacaaaaaaaatggtggacactgcatctgggacagactgtggcatacattcatcatgacatacattgttttatcacaacagaaaagaaacaaaatgaacacagaccccaggaatggacttgctgagaaaggaatcacaaagcaattcattctcaataggctcaaagagaagaagtgtgtgtgtgcgtgtgtgtgtgtgtgtgtgtgtgtgtgtgtgtgtgtgtgtgtgtgtgttttaaaactagcccaagggggtgggggaaatttctactatgaagattgcaaaacacagaagaaattaaaaaagacattagaagacatacttttcatacttgtagagaattaatattgttacaagagcatactagcaaaagtaatgtacagattcagagcgattcccatagaagttctaataacattcttcacagaaatggggaaacaaatcctaaattcatatgaaaccccaaaaggccccgagtagccaaggccatcccaagtcaaaagaaaatgtcagatatccacagtacctattttac

SEQ ID NO: 193 - DNA, 248155 bp, Mus musculus
gacttgtaactctttagcagtgttctcctgtatttctttaagtgatttattaaagtccttcttgatgtcctctaccatcatcatgagatatgcttttaaatctaggtctaggttctcaggtgtgttggggttccctggactggacgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccaaagaagaaggcccaaaacaggacctttctcagacagtgtgttgctttggcagttcccaggtggtacagactctcacctaagcagactaaattcctaagttccttggagtcccgggaccaagatggcgaccactgctgctgtggcttaggctgcctccccagacgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtctcggaccaagatggcgaccgctgctgctgtggcttaggccgcctccccagcctggcgggcacctgtcctccggtccggacggtggctggctgtccccggcccacaaagggtgctgcctcagcgcctctgtgcttccgcctgttccagaagctgtcaggttctctggcgcaccctctcacctgttcagactaatttcctaagttcggcgggtcccggaccaagatggcgaccgctgctgctgtggcttaggccgcctccccagctgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtctcggaccaagatggcgaccgctgctgctgtggcttaggccgcctccccagcctggcgggcacctgtcctccggtccggacggtggctggctgtccccggcccacaaagggtgctgcctcagcgcctctgtgcttccgcctgttccagaagctgtcaggttctctggcgcaccctctcacctgttcagactaatttcctaagttcggcgggtcccggaccaagatggcgaccgctgctgctgtggcttaggtcgcctccccagccgggcgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgctgctgtggcttaggccgcctccccagccgggcgggcacctgtcctccggtccggacggtggctggctgtccccggcccacaaagggtgctgcctcagcgcctctgtgcttctgcctgttccagaagctgtcaggttctctggcgcaccctctcacctgttcagactaatttcctaagttcggcgggtcccggaccaagatggcgaccgctgctgctgtggcttaggccgcctccccagccgggcgggcacctgtcctccggtccggacggtggctggctgtccccggcccacaaagggtgctgcctcagtgcctctgtgcttccgcctgttccagaagctgtcaggttctctggcgcaccctctcacctgttcagactaatttcctaagttcggcgggtcccggaccaagatggcgaccgctgctgctgtggcttaggtcgcctccccagccgggcgggcacctgtcctccggtccggaaggtggccggctgtccccggcccacacagggtgctgcctcagcccctctgtgcttctgcctgttccagaggctgtcaggttctctggcgcaccctctcacctgttcagactaatttcctaagttcggcgggtcctggaccaagatggcgaccgctgctgctgtggcttaggccgcctccccagctgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgctgctgtggcttaggtcgcctccccaggcgggcgggcacctgtcctccggtccggaaggtggccggctgtccccggcccacacagggtgctgcctcagcccctctgtgcttctgcctgttccagaggctgtcaggttctctggcgcaccctctcacctgttcagactaatttcctaagttcggcgggtcccggaccaagatggcgaccgctgctgctgtggcttaggccgcctccccagctgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtctcggaccaagatggctaccactgctgctgtggcttaggccgcctccccaggcgggcgggcacctgtcctccggtccggacggtggctggctgtccccggcccacaaagggtgctgcctcagcgcctctgtgcttctgcctgttccagaagctgtcaggttctctggcgcaccctctcacctgttcagactaatttcctaagttcggcgggtcccggaccaagatggcgaccgctgctgctgtgattctcagctttgagttgagtttgacttcagatatttctgttttctttaaaatgttttgccaaaaagtgctacagatttaagatattagctatgttgttcagcaggaaagaataggacaaaaactatatccctaaatttcttctcagtaaatccatattctgaaagttggtatgtagaaattctaccaaaacataccaatggggaaactttgatcttatttatatttttataaaatttcttttttgtcaggagtgcaaatctagatacagatctttataatattacaacatacctcttcaactatgctgaatcctttattggacatttctttcacaaatatgtaaatcaagatgaaagaaaaacgctttaattatatgtggtacgtttatatatatatatacatatatatatatacatatatatgcttgtatatgtaggcacatgagtgtatgctggtgaatatttacatgtgtgtgcatgtatgtggagacctggggttgatggtgggtgtcttccttagtcactcttcactttttgtattgaagtacaattcttcactgaatccagagcttaccattccagctaatcagctattctggctaataagcttgctctaggaccttgtgcctctgtgctctgtagactgtgactacaggtggctaccacatccatttggctttatgtgcattctgggaatcagaactctgctcctcaagctagaggagcaagcattttacctaggtagctgagtcaccactttagcctctgactagtttttacatgtatgttagcttattggttaggttttttctttgtttctctcttttttattgatcctctctttcttataaaataatataatatcttgattatttaaaaaataaatttgatgttaattactggacatttggaagctggtgacattcaaatgtaatacattttacaaaacttccctggacacatggtagtatcaatctctgttttctaataagagggaagaaaggaagcaatagaatcaagagatggagctgatatattaggaatagaaagtaacatacaataccatggcagtgctaagtagataaattgatctagactctgggatcaggatgcctggtttgaaattttggactaaaagctgggaagatggctcagtgggcaacctgcttttatgggtctcaatatgcatcctcagcacccatgtagaagcccaaatgatgggtggcatctataatctcagtgttggcaagggctccctagacagttagtccagctaagttaccaaggcacaggttaaactaaagacttctcaaaggtaagatggagagaaattaagacagctgacaatgacgtacacaaaagatattctcttatcccctctatgtaatcagtttaatttctaccacaatcaaccagatctcatatctgtatttgttctttcacccacaagtgaaaaagtagacattttctagtctatttaacataaagtctccacatatttctattgcaaataagggttcatcacccatgaggaaatcccagcatataactctctgcaatggtacacagtataatcaaatattagaaaatagtacgttacagaaaggatatatgtcagcatcaatattaatttcaaaaattatttggagtgaaataacctgattaatttatgttcccaacggtggcagtggagacactttctgtctcagccttttcagtggatctgcaagggttaattcataagagctggtcattctctttgattttaagggacactatactattttcccggtgtaatctactagaagaggaatttgtagaaactggcatggtctggattatctgcttcttcatctcagcagctcccaaagttttaattaaactgagtgtagagtgatctcttgtacttaataaagcagttattgcatttctggtttcctcccaaacatttataaactcttaactccaagcagaacctctgcaacaagaatgctgttgtgggagtttttacaacatgcagcaaagtctggtaaatcagttaaaaagagagagagagagagagaaagagagagagagagaaagagagagagagagagaagtcaacagaaaaaaaaggctaatttgaactgagccatggagagtttgttctcagcaacagtagatgcctagcaaatgtctccagtgttgtatatgctatgaaatgatcataagctattggacttctacagaggtgcagtaggataatacagccacacttgaccactatataagatcaagtgaacggagagctgcatgtctgcaagcaatgccattttgacttcaggaatattaatttcacactcattttccaagttgtaaacacaattttaaaatgactaaaccggaagagagatatgtagatcttaacaaaaggagcatgccccccccaaagctgccaacattccttcccaaatcaggccaataactgacacccgtttctagaatattttcctgggaatgctacccttcatataggcaatgatatttcaaaccagttaggaccttagagaaaatagtatttcagatctcttataaaaagttagcatatggtggaatgtatctaaaagtcatatcacaactctagtttttaaagattcaatgaagagaagcctaagaaacgataaggttttgtcttcccagtatgtggacaatgacttaccagagaggacacactatgtttaacacagttcttggcacaaacaacgtaatctgtaattactcattgagtatgacttaccttgataagtaatattttcataatttgcgcagctcattcatgtggatagacagagaaaggtagaaattgaggaaatggtacaaaatcattcaactttttggggcacaacgtgtcaatagcacccaatgttgtactccctggtcaatataccatgggagctgagcattcagcagcataatccagaaaatgcatacgtacattttcaccagttatcattggatactctgatgatttgggaggtaggtttaaagtgaatggaggatataatagcttcttagtgttttatttcatttagcaaaagaatttatacaatgtgtagcagaaaaaaatatgagactcttttagatagttagaatccataaccaaatgtctaattgagtggtttgggactgaagattgtgaatgagatagagagaaaggttagacacatcttctgctatgactgcttccttgtgcttctgagaaagagtatccggatggtgaaaattcactggagataatcaaaagccttttaagattatttctgtttccataagtggcaagtatcttggacagaaggggactccctggttctcatgaagtcctacagtactaagatcacgggaaggactttagtgttagatggaacagttactcaatactaggggtttcccactttgtgtgtgtctttagttatctaggatgactaatacctccagagagcagcaacccacacactgtttctgcttctcttttttacacagggctgttttcaatctcgtgagccattgtgtctccttctaaatcttagcttgtgtttgttcctgaactttacattatggctcaatagttttgaaactcaaagtccatttgttgactggaggaaaatatctactgactgaagataaaattataaaaatgtttttttctgagtatatatgtaatgtatgatgatgaaaaaattaaatatgataggcagtgttacctgatgtgattggtttctattttcagtcactctgttgtgcagttttgagagattttcaccaagagagtaaacttatgaactttatagctcattctgggatcaaacattacttttacagggaatagtagaagtttctatctgagtagtgagaattaactgagttgaagcctatggactgaaggtaatagcgcctgaattttgaaaatattaaataagtgtggttgtcttttgaatgtgtccaagacacagagtttcacatataccaggccttcccttgaatgtactgtgtagctgagaatgacattggcctattctgaatatataattttattttatgtgtatgcatgttttccggcatatatgtcctcctgtgcactgctggaactggagttacagacagttgtgacctgctatgtggcaaagggagttgaacatgggtcctcagaaaaaggagtcagtgctcttagctattgaaacatctctccatctctgacattgaaccttagattctaatgtgtccaccttctaaattctccatctatattataggctaccatgtacggtttgcacggctctgggtctaaggcttctttgagatagccaagcactcttccagttgaacttcatttccagtctctgcttattagtatttttccccttagaagaaggatagaccaggaaatacaatgcaattattaataaatcagaattagttaaatgtaggttacaggaggaataagctaaacaagatttcagggatatagtgtactttcaatagaagtcattgttatgaggtagaaagaggtgacagaagattgataagcaattagtatgactatactgagtatgaccatatcaatggatgagtcaataggttaacagggatcagtaaatatttgcactcaaatcatcaggatggtctgtttctgtttgacgcttcagagcatcctctaagcatcattggtttctgtgttcaaaccattctccaaccccagttcagactctcaactcagacctagataaccctgagcaacctcatcctttagacatggacactcacatgcactgtcactttctttgaatgtgctctagtctaggataacttccatttagggtcaaaggaatgtaaagtctgctttgcttccttattgctgtgtttctcttacactatttttgggaatcttgagatttctattttttagcaattacatataatgctaactttaaagttcttttcagtctgcagtttataaaaaggtattctctagcctcagtatatctcaatagtagagtacttctttagaatgcacaatgttttgggttctattcccagtactgaaagaaaaaaaaaaaacattcgtttgttttcctccaatataaaactcatattggtctattcactaattcaattatatatgtgagattaagatatatgtaattttgtgaaaaaagtctaggaaatgatagatggcaaaggacaaatgcacaggatgattaaaatgaaacacaaaataaaatcaaagaattgatgcatgatatgctgctgggacttgaaaggaactaccaccctgtaggggagggggctatgtacttggaaggcatgccatttaagataacaatacatgcttaggatgatggcaagtggtttgtgaatgacggtgagggacaaaaaggacactcaggccattgccaagctgagaggtacaaagagataaaagaaacaactcaatttccacttgagtgaattgcagggaatagtgtctacaggagacatccagaattctgtcagcagaaaagtaaaaacactgactcccaaagacacaaaaaagagaagggacttttattggccattgaccttaacttcttggatgaacatgaaaaagttttaggaagtatagaagcaccacatggagtctgctggaagttatgcatgaccagtcttcttggtattgatatatcaggaatgcagatgcagagactcatcctgagtctaaaagagtagtccagagggcaaaggctgagtctgtcctgctatgagtgggcaggttgctcctttatctctcacattcaggagttgaaacagaattacctaaaggaaatatataaactgaaataatttgtcactagaatataatgtgttagactcatatgtttatgaaatctttattgtactgtatatgattttcttgccatttattacccttttcagctatggatattaaaagcctatatatggatacagaataatttatttgaagagcctgcattgttagagagttgtttccataaatttagagcctgtagaatttaccaaagcagtatgtcacttaaatgcttcaaaaatggagttatgaatgctggtgaagatgccagcatttactgtcagtttaagtaagtgcatgagattgaagactgttcagaggcaaaatattgaaatgagatctatagaaaccaaacacacagtggccagagatgagtctactctctgactctttgaagcctaacatatgtttacttccagaatgatcattaccgagaaaatgaatccccgattcttcaaggatcagccagggtcacaagtgaatgcagaggctcggagttagcagcactgatacccaaaggagccagactttagaagcttagtgagggtctgtgaaaagtattaaaatttcatgtcaaagacgctctttttgttattaccaccccatctctctctgtctctctgtctttctgtctctctctctctacacacacaaacacacacacacacacacacacacacacacacacacacacacacacacacacacacacagcctgaatgaattcattctgtattctataagggctttgctattgattagaagccatctatggtagagttgttgttttgttttgtttttggtttttgttttttacttatgtcgagtctggagaacactacgacacatttttcctgcttggaaaggtatgtagaccttgtctggcattacactatccatgaaagtttatctttaagccttaatctcattaatccttattccagattttctttttctttttcttttgtttttttttttcattcttttttttattagatattttctttatttacatttcaaatgctattccgaaagttccctataccctccccctgcatgctcccctacccacccactcccacttcttggccctggcgttcccctgtactgggcatataaagtttgcaataccaagaggcctctctttccaatgatgaccaacgaggccatcttctgctgcatatgcagctagagacacgagctctggggttactggttagttcatattgttgttcctcctatagggttgcagaccccttcagctccttgggtgctttctctagctcctccattgggagccctgtgttccagactgagttattttactgtatgtgaacatttgctcatttggtgaatgtaaactgtatagattgtgtctggtttagactttgcttatatatatatatatggacttagtgtattgaaatttaagaaaagatttcacttacacaagatttcacttacacaactagtgggaggtgctattgtcatgattgccatttcctgtgctgaagataggatgtcgaataacacaaaacaacctccacaaccacaaattgtccagcccccaatgccaacatcactgcaacctagaaagcgagaaatatacagtgagtcagctgatgaggtagtagtttctaatgtttagttcataacttatttttaaaatattttaacaattcttcataagtactttaaaggtaggtattacaatgacactgcctttctaaatgtgttttgtaaattgttcaataaatagtaaacctcacttgcaatgaattcattactggcattcacaaggatagaatttcccctctcctaagcatcccacttttacaacatatttcctgtttccataatcgattctaaagactgagaaaataaagtcataattcttaatttccaaaacatactttattttttctttactagtagagttttctttgcaactcaaaggtagattagtcatatttacatctggaagtgtgacgatttccatggagaagtttttgctaagaaattatgcgaagacctctcagtggcaggaaatagttcatatagaagagagagttcctctctgcctggtaggaaagaaggcaggcctaagttagtgcttattcttaattctctttggccccctctcatgtctgtttttctcttcatcatctaaacttcttactgttcagattgggtggaaattaataacaattcaaagtcagaagctcttaggataaaattgctaatgtattccgtgatctagcctctgcttgtgctggtctcctctgggcaccaatctcaattttaaagcagccattccaaatgtaggtgaactttgaagtaaaatgtgtaggggttaatgtaagcactcctgagacaatgcctcagatattctggctcttgtataaaggtatttcatacattttaaatgcactctcttggtaatggttcaaccccactagaatctgtgacatatggctctaaaatggcagactttcttctatgccttctatattagtgtaatataatccatcccatactcccctcagttccttagtctttgtgatctccactgaagggattggacaagacattcatagtatagggtagaagacagggtaagtttaacacagaatgaatggtatgaaatacttccaggagtaagaatcagcaatgggcagggagactactgcaaaggagacaatttcactaggtaagagtggacaattgtcagagagaacattgtgtcaccctatattttttagtaggtttatggaagagagggtgtcttctaaaaggcatcctctcttttctacctaacaggcccttaaggacaaggataatgatatctcaggatctttaccaccccaaaatctttggctaaataaaaacaataagatattcagtgcagttcagaatgtcatatctccatccaggaccagagagaagaaacgactcccattttttgaccagtagtcaaaagttctagtgtttcagtttgtgattttcaagctgctagttatgaggaatggagccttcaagcctactgctattttgcatagcatctcctcagtttagtttgttctctatgtgtgttcttcatcctattttgtgtagcttttgtagaaatatccaggctatttcaaatattctcatctatgcccttcttagtagcacagtatgtgcatttgtttttcaaaacaaatgccaaggaatgtgaaacaatccaggcgcccatcattttcctgtttggaattttagctacctaggggacaagcattcctgaaaagaatcaattaaaaaaacaaacaaacaaacaaacaaacaaaaaaaaacaaaatcaagccattctccctctcctaaatacgattcatacccaaagctgcaataaaatcttctacattaatgcttctaccagcaggaaaaaaatatattaaggcatgcaaaaccttcagtgatttgtcagttatttttacttttactattttacaaaatcaaagaaatctagaacattagttgaaagagaatgtaaaaattaaataataagcaacaagtaataaaaataaagagtttaaaatgttacactcatatgctcatattatcaatcattgagaaaaatatactaaaacttcatcatgagatcagagataaatatggcatactacaaagacaatccataagtagcataaaaggggtctaaaagcccttcccctcatcttttgcctagagatttttaccttagaaaatgtgcaattataagtactttcccatttctttgtaatgtatataaatccttttgaccactaggccttttgtcagttttatgacccattaagatctttctcaaaagcctagggagacatcagtttgatgctaacagcaggagagttagtttcttcctctcagttctgtggttcctgggcatcttggtcttacttgcaaagccagatcctgtcatgcatagatgaggaatgtattttctttctaaataaatctaattagctaacagatggtcatcaacacatgttacctggcaggatagggatgaatcacttgtaacaaatggtactgtgaactcatctgactgggatctcttgaggacctctctggggtctatgaaaaggtgggtttaactaggtgtgtaatcactcagcagttatactgcaatgcacatgtttttattcagtgcttattcaatgttaggatgtcttaccatcatggagcagatctctggattgttaatgatttacaaactatccaataatatatctatttcactcatgcatgctctattatgaaccatttctatgaagttagaaatttccttagaattatttttgtttattcatgatgaacaaaggcaggaagtgtattgggaaggggtaaggtctaaaacaattaattaatgtattttgttaaaagtccagtgtacttaacttatgatagtgtaggatggatgaaaaaaatcatggtacttacttcaattccacactatatattacacaatttaaagatgctaatttacatataaaatgatgtacatctatgccattctctattttaaaaatttattcataactctatgtgaaactttgagtgaaactttcaattgtcttttcccttaacagcagataattgatagtctgtattattctgtgaaattgcctgcccttacatatttcatacaagtgaaaaaagcaacatttctgcttcttatgtttctttcaactagaatgatgcattctagattttctttatcatataaatataatttcatttctttttgtggctgaataagttttcatgggatgtatgtcccattttatttatttgtttaatcattgatggacagttgagctgttgccaaattttggctatcctgattaacacttcagcaaacatttgtgtatttctgcctgtatgcctatgttgagctgtataggatttattggttaattcttatgaggaatcagcaaacagttttctacaccagctacaccattataagtggttatagctaacaaagaatggtcagccttcctcagatcaataccattacttcttataccacatcatcttcttctgtccatggttggacatcaaaccattcccttggttaccagtcagaaatgtctaactgactgatcatttctggatctttttttgtactagtagtgtctagacaagcaatgtaccaattttttaaattgtggtttgcattgtctgttagattgcaagatactttcttctttcttctgtgtttcttccttttttcatccttaaaatatgtcttagatgaaaaattttttaccaaaaacagagctaggaatttgagcagtctctttgcggatagtgtggcagttttgtgggctagcctttttgtctttctgttgctcctggattatgacactaggagttattatcgtattcaccacagccaaacgttgtctctttagtcccatcagactaccaaacctttcactcaatcttttgctgctatgttttagtcttacaccagttgtaaattggcggtccttgagaagagttctgaggggtgtcctgattccgggaacattctgctatctagtttcttgctccttcaaatcctagatgctttgctatgtcaccacatttcaatattcaagaaagttgtacctcaggacagccagggctatacagggaaaccctgtctcgaaaaaccaaacaacaacaacaacaacaacaaaaaaaacaaaaacaaaaaaaaaaccctcccaaaaccaaccaaccaaccaaccaaccaaaccaaccaaccaaacaaacaaataaaaaacaaaaaacaaatctagttgaaatcgtacctttgaaaaatggcataggttgccttccactagctgacataattttgctcaccaacaggcaacagtgcactgacttcttccttgaaaacagcatattctcatcctgtttaagcattgtcagtctgactgttaaaacactgtgaaccaatattgctagtaagctttttgtttctaatttaataataaagaatgtcccaaattgcccagaatttagtacatgttgagcacatttctaaggacattgttatttattttctctaagtttcaagctcatcttcaagcaggctttactctctcgctattttagaaaagaaaatctaaatagaaatttaaagttagcataaaaagttatggctgttattgtggcctcttcatacatatatgtcttttctatactttgttctcattggttccctctccaagtgtcttcgcctatgtccctgtccacatctggttcatttctttactgcactagacaatagcaccttcagcttttctctcatatgtatcccactaccctccctttctcaggactccttaaggtcccctcctcttgactcctgactaacaagaacccaaacaacaattctaggcaaaatttgaagctaataatagtttctataagataaaaataattaagtttaataaataattaaaaataaataattattttaattattctatttataatgatataattaaaatacaataaataataacaaaattaatttcatcagctatattgtctttctttgtcatcaaatgtattattagatatatcaatactcttattttattaatttcttaggactatcattacaaaagtctgccaatgaggttccttaaaataatagaaatacattacctgataattcagcgggaagaaatatttgcccagggtgtccttggcagagccaaaccatttctttcagctctagggctgggtaagttccttgtcaccttccagcttctggtggctgctgcctttgccagtggcactcattgaccttcaggctccatggtcacaccacttccttttctcatcttttacttgtttgtctcactctgctttcttttcacatgttaaaggtaaggcctacaggtatcctccatgttaagatgcatttgttttaatccttaatatgatgtcttttacagtagaagggacgagtcatcctctctgtataaagtcatagccatggattgtgagaattaatatcaggcaaacattttgggggggcaacatctgacctactatgcacattatccattgaactgaaaaacagtcacttcatttatgcatttattcaaaaataattagtaaaggcctgcatggtcctgacaatgcaaaggagaaacaaaaggaaagaaatagatgacaactctagcttcatggtgttcagggtttgaattaagaaataaaatagaaggccacctggcatggggtgtcctggagaggaacaaaaaagaagggggagaagagggactctgtagaggaggggaggtttctctgagagatggttgacaaactactctactactactacaaaaaaggggcatcggggtcatggaaatattattcaaaagtgtagctttttctatctctatccctgaagagcatgtcctgtagaatctacatgggtgctaaatggcatagaaaagacagggggcttcatatagagagaagaaggacaatgtgaccacagacacaaaggctactgtgatacagcagctagtccagttccaactaaaaagtagaaaagggatggaatgtaatggatccccctgtaatctcaaagaggaattttggcttcgctgacaccttgatttgggctcagtaaaaaacacacttctccagaaggaaagcatggaattttgttgtgctaagtcaaccaattaatggcaacttgctacagaagagaatagaatgccagtaccatggattctatgatttttattttttccaatttttattagatattttcttcatttacatttcaaatgctatcctgaaagtcccctataccctcccccctgctctgctccccttcccacccactaacagttcttggccctggtgttcccctgtactgaggcatataaagtttgcaagaccaaggggattctcttcccaatgatggccgactaggctatcttctgctacatatgcagctagagacacaagctctggggggtgggggggggtactggttagttcttattgttgctccacctatagggttgcagaccccttcagctccttgggtactttctctagctcctccattgggtgccctgtgttccattcaataggtgaacatccacttctgtatttcccaggcactggcatagccttaaaagggacagctatatcagggtcctttcagcgaaatcttgctggcatatgcaatagtgtctgagtttgatggctgattatgggatggatctccgggtggggcagtcactggatggtccattctttcgtctcagctccaaactttgtctctgtaactccttccatgggtattttgttccccattctaaggatggacgaagtatccacactttggtcttccttctttcgagcacagattctttttttttaaattttttattaggtattttcttcatttacatttccaatgctatcccaaaagtcccccatatcctccccccccactccccctacccacccactcccacttcttggccctggtgttcccctgtactgaggcatataaagtttgaaaaaccaatgggcctccctttccaatgatgagcatagattcttaaaggaagaaggaaagccttctggaaacaggaatggcaggccttggaagatttaggcttcaaataactggggtggaagaatgttcaacctgtctagggtagcttaaggaagtcccagaaacatgaatgctgtggcaagataattttagacactaaaatccagtgggttagaaggttctgagacttagtaatgatgttccctcatcttgtacaatgtgattaagttccagaaggtttcagatatgggaataatcttatctgttcctggctccaagaaactctatatttttactaacagaagtcagaatcttttacctgtggtactgaggataaactttaggggactaagggcactaaaaggaaaccaaataggaagttactgattagcagcagctgggaaactcacttttaagctgggacgtcagtattggataattacaactgaatatcggaaaactgaaccatgtcctaaaacataaaccacagtatattaccaggtattagcagtgtcactcatggggaagttagttttcccaataaacgttactttatgctacaaaagaattttagctatcaatatctctgatcaactctagagacattgcaaacagatctgagaagaggtttatctgtgctacattcatagacttgctaatgtgtgcagtgaatatatttgcaaagtatggggaaacttacttgcattgatatacataaccttggtattctatgtgaggctcacaccctggttgtgcagcacagtgaattcagaaagtgttttattcttcacttttcagtacaccattaaggctgtgatcccaaaactgttaggtgccacaatatttggtatggttgtgtcaactattaggttaataccaattctgcttctaaaatattgttggtttagagattggcttgtctcaaagtgctctgcaaatgtttccgtgctcacttacaattattaataatggcagatatagcttggtctgagttttgattttataaaaagctcattgtagcacagcaaaatccctgcctagtctttgatgctagctttgtttcaagtcaatatttacatgaaagctgatgctgacatgcctttagttaacaatgcaaccactgtgacacagaaagtactttggctcaagccaaaacataaagattcaaaatttctcttacactccttgatgcccagataatagctagcatgtcaactcctggattatcagatagctactacagtcactatcagggtcttctaaaggatatgttgtgtaaaatgtcaacaacagatggattcctttttgataacaaaatattttcttgaatagtattttaaggtaaagaaaatattttagatcatcttccttatcatgtacatgagttacagaaataaataaacatatttctgtggaaaagctctccatacaatttattcttcacagtatatcataaggtccatactgtatatagactaataatctaaacactggggaagtcaataatattcccaaagcccaaatgtgtgaaattattttggatcattttagtttccataaatggaactagctgctcattatctggtcttttggggcacatacacttagatctgagattgaaagtattgctggcataagggatgtctttccctccctggtctctcaaacatgcccagtaaatgacattactaatgctttaattagggattcttttgaaatataggttattttaagtatatttttattttaaacatatttacagtcattaatcctaatagtagacctatttaaacaatacaaattttcctttgtaggaaaattatattattctttattttaaattaaattattttatttatttacattccaaatgttgccacccttcctggtcctctcgcccagagttcttcaccccatcccccttccctttgcctctcagaaggtgttctctttcccacaacccccacctgcccacccacccaccaccctcccccaacccttccacctcccctagtatccccctaccctggggcaccaagtctctacaggattaagcacatcctctcacttaggccagaaaaggcagttctctgatacataccaatttaagtttccttttagtctattcattttttattagttattttatttaattacatttcaaatgttatccccttcccagttttacctcctcaaacctcctatcccatgcacttcttggcatcagcaatagtgatgaattatagtaggacacgccatccccgtgcttcttcaataggaacctaaagtaagagtctccataaagtaaaggaaagcgtatgaatgtgtggtgtatgattttctacttattgatttgttttttgtgggggtaaaagaatgactgaggagaaaaataaatgcacaaatagaacacactacatacaagggtagatcaacaatgtagaagagttcaggaaaacagagaactatagaaatatagaagacagcggaaacggaaaggacaacataagatatgtaccagagaccacatttcctacagatcatttgcaactgtgctctgggctctccagacctggatgatataaccaagaatcgccttctacacataagcttcacataagtctccctagaaattccagtttggtgtaggtacatgggatggatccttaggtgggcaatctctggatggcttttccttcagtctctgctccactactcagatattaaaaactatgactttatgaaatgaatagaactagaaaatatcatcctgagtaaggtaacccagtcacaaaagaaaacacatggtatgtactcactgataagtggttattagccaaaacaatagctcagaatacccatgatacaactcacaaaccatatgaagcacaaaaagaaggaagaccaaagtgtagatgcttcaggcccacttagaaggggggggcaaaataatacaggaagtagagggagggagggacctgggaaggagaaaggtggaggagggaaaaagaggagcatgatcaggagtggaaggagattgggagaagtcaggaaattgaatggaggcgtgtagcagtgggggatggggaactggagatagccactagaaagtcccagatgctatgatggcaagagtctctgaggacccattgggaactgcattaactgaaatacccaaaaaaggggagagataacttgtagagaccatttccagaggttaggcatggccccggttgaaggatggggccacccagacatctcaaaagtattaatccagaattgtttctgtctaatcggaaatgcagggacaacgagaagtatctttagaaccaggatggagtagaaaaatcttgaagcctctttcaattctaaatctctggtttcaggctcaggtctaacaaactcaacacatagcagtttacattgtgtttggggggtgtgagggtcctcaagttagacaacagatgcatccttcctactctggctactagaaacagttattagaaattaagttacctctagaggtttctccagggttcccttacaaagggattttaatattccaatgctttgaaataaagttacaaaatggtagatttttctgttaagaaactaaaaatctaacatataaatatttattaaatgtgccctgggtattgtcattgctctagttagtggaattatgatttgaataggttctagtccctagaaactcacaatgtatctggggaggcacatttaagcagattaatatttaacaaattaacaatacagtgctcatgcaaccaaatgaatcaaggttccttcttgttgtatgatctcttcattagagagtaaagcactttgaatttaacagaaaagtaacaggtaaactgatacgtatacaggtaaaatgatatggttaaccatcccatttaaggtttatattcttatggccatgaatttttaccttggagatatttaaatttggagagcttactagccattaaaataatgaaaatgatgttatagatgaaaacatggttggctaacattcaaaccctcaattgatgaggattttatatttctagagcaaatttcaaacatttggcaaaaagtgaaatgattacttcaattagaattaggaagtcaatattgtctgtggaactcaattagaatttttctgtactaaaaaaatagtttttatattgtttggatacaacagaagagagctggcaaccattacttcttcgtgtagccaatctgttcaatgaaatgttctactagcgaaaaatcatattgtggatttctagctttcttttccctttacaaattggttttgagaaaagtctaacataatagagatgtaatttattagagttaataatgattttcaaaatgttttgatctgtagtccttaagaattattacacaccttcatttatttcccaatatttaataactactaaattaataagggcattggactgtgctaggtactgtgcatgtcaatacatagattgttcttttgactttcaaatactttcttttactgaataatattcatacaggtcctagacttaatcctccttatgttaaatatcttgtaagtttgcttgaatgttctttccgaaggatgctgcttcttcatgaattatagtaggacacgccaactccgtgcttcttcaataggaacctaaggtaagagtctccataaagtaaagtaaagtaaagtaaagtaaagtaaagtaaagtaaagtaaagtaaagtaaagtaaagtaaagtaaagaaaagcgtatgaatgtgtggtgtatgattttctacttattgatttattttgggtggggaggaaagaatgactgaggataaaaataaatgcacaaatagaacacactacatacaagtgtagatctacaatgtagaagagttcagtaaaacagagaaatagagaaaactgcagaaacggaaaggacaacataagatatgtaccaaagaccacatttcctacagataatttgcatctgtgttctggactctccagacctggatgatataaccaagaatcgccttctacacataggctgcacacagtctccataggaattccggtttatgactgagcccttgactaaaacctttccgttagacttgggagatttaggcacagataatgaaaaacaaatcaaaaccatctatatcacaaacaggtttaaagtgaaattataagtccttgactagataaatattgctatagattcagagacgttggccacactgctgcttccagagggagcctctgccttcaccctgtcaccaaacactcagactgtgagtgactatttaagtctaagttctgtaccaagaatagcaacactatttattgtcatcccacaaggatcactaacaacacagaaaactgggtttagttaaagctacagaaacatgagggcttttgaggctaaatccacaaccagcagttcacagaacatcaggctgctctcttgtttacccacagttgtaactcgaatttgcaaggtatcttttgccaaaattctctagttcacaatccctctatccacaaactaaagtttagagaagatcccagaaatggctcctagcaaatggacctatgtggatgtatcagacatgtggggaggacttggatatgtttttcaggcaagttactaatgatgacaaataaaattttgacttttttttgtccaaaatcgtgcttcacaatgatgaatatttgaatagacacgataaaaaaaaatgatgaggtggcctcaagctatttgtatgctcagtttggcattataaatgtgtttaagatttctctcattggtaagatagtggcccaggctactcttttaaataagtacactactcctcaaacatgtggagtctctctttctagcccctagataccactggcagtgtagaccatgtcatcatttttcctctgtggtaatagcacactgtttgtgttgggctcactgctcctgctatttcccacattctcacacttctctaacactctttctatcaaatttactttaaaactattctctcaaactcctctttctctttattttctcctgaatcggcacaacaatcacaacttcactgaaactgtttttgcaggtcaccattgatgggcagtgttattatatccaatgatcttactgatgtatcaacactcataacagcggtattcccttgaaatattttcttcactggctttcaaggcccattccatgttgttactctcctcttacatcatcaccttcccttttgattcttagcatgtctctttttccttttctgcttttgaatgttgttgtgtcccagaaatcagtcgtaggagctctccttttagttctttattggcatgccttagggactgcattcagtgtctggctttacaaactctcttcattctggcaaatataaagtctatgtttcttagacttcctcctccttcaataccagcaatcaattgtgtgaaacctactgtagtgtgatgtctgccagtccaaacttctattctcccttctgcttctaaacatgactgacttcagagtacttggtttttttccatggccactccattgcctggtgtgccatgttccatggcacccagattctgtattttatatttacattttctgggttaacaaatttttagtagatattgaagacatcatttgaggtcatttttacatttttgtctccaaagcttccaaggcattttttctgcttctgattttattcatgttagtaaccaaattttctccctgaaaactttgatctatacacatttctccttatcatgcccatacaatgaaaggaaacatcatatacacaacttgcaagatcctcacctctgatttgcccctccttctcacgcatatattaccatgggctctttctcatcatactagccttggccccacctccaagctttctgctcacttattgctcacttggaccactcttacaaagaccattaaggtgtgttcaatccatatgaacctctgcattccaacaaaatctccacagaagccctagtatcaactgctaataactaatacctgagagcttcctcactattctcctttagttgctctaattctctaatttcctcaacttcttccttccttccttccttccttccttccttccttccttccttccttccttccttcctccctccctccctccctccctccctccctccctccctccctccctccctccctccctccctccctcctttctttctttctttctttctttctttctttctttctttctttctttctttcctctttttctctctccctcccttctctctctctcattccctccctcccttctctccccgctctctcttcctttcttttctttcttttttgccagtgattatcatgtttatcctgaagtggaatgagagttgcacagaaaattcattttggggcattagtatcatatcttcaatatatactatatagcaccattgccaaatatttaacttaatattccacatttacttaattgattagtatttctacattttcaccctattagacttattgagaaggtattttacattgttatttttatattgtactagctggttttgtgtgtcaacttgacataagctggagttatcacagagaaaggagcctcccttgaggaaatgtctccctgagatccagctgtaaggcattttctcaattagtgatcaaggatgatagggcccattgtgggtggtgccatccctgggttggtagtcctgggttgtataagaaagtaagatgagcaagccaggggaagcaagccactaacatccctccatggcctctgcatcagctcctgcttcctgacctgcttgaattccagcagtgatttcctttggtgatgaacagtgatgtggaactctaaggtgaataaatcctttcctctcctacttgcttcttggtcatgatgtttgtacaggagtagaatccctgactaagacaatatatttagttatttatttggtgtgtgaattgtgtgtgtgcgtgtgtatatgtgtgcacacatatacacatgccagagcaggtatatggtagtcagaggacagcttgtgggagtgtgacctctctttctaccctgcatcaaactgaggtcatgaagcttggcatcaagcatctttgtccacagacatgccctataagccctgaataagatatttttaaagatatttactctacccactggttttactggttgcctgtagagtcttcttatgactttcatgctgtctttgcagttatacagaaatgttggaagttacctagaaatataccatgtgaagctttaaaaagatagaggcaagtcttttgaagtccataaatttcacttcctgctgtgtttaatttcaggaccgcagctatgattaaacttttaaagatgtttgttcttttatctggggatcatattgtaaggtacttattattttgtgtgtgtgaaaaaaattctaaaatcttttcatcaagctgtatacttggcatcctgtttttgggatgctctctatcttacttcctgctgtcagttgagtacagatggatatgtgccatggaagaagcaagtggaatattttagggattgttttaccaccttgttcccaaagatgcctacatctccctggtactatttatgaaaggtcctggcacacagagtagatgatcctgctgtactgtgctgctgggggcagcaggaatgcctaggagcaagtttgtctgtgttgatttaccaggtgcaagagaatgtgttaaatgttgctgctctcagcatgttcctggtcatttaatgcgggcaggcaagactgcatttaggtcagagggagggttttgtttggcttgtagagtggagatatttatccccaactctgtaaacttatgtcacttattattgtgttcaagggagttagcataaggtggtgaggttgaaagatcaccttcattacattgcttcattccagtgcgcaaaccatattgagaaactatgacctccttgagaacttttaaaattcagtttaaatctgaacattttctgcatgatgaatttgaagaaaaatcatttttggtagcttttctcatgactctttacacataaacaaccccaaattctgtgtaaacagttgagaactttgcaaattcacctaccagaaagggcggtataaggtttggggttgcagtgcagcctgtaattacattaaagggcatccagtgcaaatattagtgacttgctagctcttatactttaagctttataaagtggaaggagacagttgtgaaaataatgtttgctcttctagaaatattgaataattattttatttttcttttaaaatttatttggggcagcatttgatgtaaataaatgactaaataaataacattttcaatctatatcttttcatttttaaaatttctatttattctggtaatgcataccatcttactggtatttgaagatgccttcagaagacttggctcaacatggttaaaagatttaacatgtaacttgcagaaattttatgcaccattccttagcactcaccatttataaattatatgaaaggattagttttaggttactagaacttcactctaagagtaggtatgttgtcttatctaaggtggtgtgcatagctatatgaagttgtaaaccatgagattttcttacactctgtgtactcattgaatgtagggtagagataaacttaagaaactgtgtttaaatatgagcctgtgtcaaagaatacacatttggggggggttgctttcaatagtttaagacaggtttggaaaaatagatggatagtacaatcagaggcaaccaaattgaaatccataacactatatatgtctaacaagattatatattaaaaacaaattcattaactgtcacattaaaacatattagatttaacaaaagtaatattcatgtagtccatttcttcttgtagtaacttcatctggttaggactcagtcatatgggagaagctatatgaaaataagtaaaaatgtgtatctctgcatcatgtagcttatatcaaaactctagacagcttggagtttgataacctgcctcacaagtaaatttcttttgataatgtggatttaaataaattagtatttctaggcaaacaactcattttggagctgttttgacctattatataacattcagaagagttcaatggtatttgattctagatatgtttctatgttaataatataaatgatgcaactcaaatattctggagttcactttaaaaccactctggaaatcagtctggcggttcctcagaaaactggacatagtactaccggaggatccagcaatacctcttctgggcatatatccagaagatgccccaacaggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaaaaactcttaaggtaattttattctctttgtttctccctccacactgtaaaacaaagttgctgtgttgctgttgtttgagaatttcagaatttaatagtctgcaggtaatcaacttctcaataaaaacttcagaaagccaatcttaaatgttcagttgtactaaaggccaatagacatgggcttcattatggtggagcccttcttctgttaaggcaatattgctgatctgctttacctaagacacaacacagcaatcacagaacattcagtctatctcagaacacacatttgcatcttccacgctttgagaactcaaggccaacattcatccaccatctccccttttagcattttatacactgatcacctatatttgttttccttgtttttttatttttaagactgattcctccaacattgcatagaattcctcgaaacacgggattccctttatctcagcttcctaaatattactcaaagtgccacctcccctacctctgatgtttaaagaacataatgtatttcttctccactcttacttactcttttattttatttttctcatctaaataactgaacttttgtcccccttacctgtgcatctcttacatttttatttggtttggacatgatcatcaaaactttaaagttgcttttattttatttgtagaagattattggcaagggatcttctccttcatctattcctataattacattattttgtccttctcctgtgcccccaaattcctaaatgttcttttagagtatttaaagttttttcatattctttgtgtggtataattgtttactcttgagtcctgaaatgtgtcttctacttgaatgtgccatgcatcccaagcttggggtttgggaaaactgtgactgggccttacaagtttcagctggaagtttacttgtaaagtttcctcttgagttttttaattgggttattgagtttttcagctacattttcagatcttacactagccagttaacagcacacctgagagctctagaacaaaaagaagcaaacacacccaagaggactagactgcaaattcagggccaaaatcaaccaactagaaacaaagaattatacaaagaattaagaaaaacaaaacctggctctttgagaaaatcaagaacatagataatccccaagccaaactaactaaagggcacacaggaagtatccaaattaacaaaatcagatatgagaggggaaaaataacaactgaaactgaggatattcaaaaaattcatcagatcctactacaaatgcctatactcaacaaaactggaaaatctagatgaaatggatggttttctacacagatactacataccaaagttaaatcaagagcaggtaaactatctaaacagggccataccccctaaaaaaaatagaagaagtcattaagaacctcccaagtataaaaagccaaaggacagatggctttaatgcagaattctaccacaccttaaaagaaaagctaataccaacacttcttaaatgattccataaaatagaaacagaaggaacactacctaatccattgtatggagcttgagttttttttagtatttctgtttattaacttgagtttccaaatcctggattattttccttgtttcattcagccttgtttttgtgttttcttgggcattacttacttggtcattgttttctttaaggtcatcctctttaagttcactgagctgtgtgtctgtgtgtctgtgtgtctgtgtgtttgtgtgtgtgtcttctttgaactccatatgtccgttgatgacaattatactttgtcttattaaaatctgtgtcctgaagtttaaatagtttttttttgtctgtttgttcttctttagagaccctttctgtagaagagtgaatcttttagggaatagatacactgtccagatctttcattttgttttggaaatgagacctaggtaggtggcctttttttattgatgatgtgtcatatggttatgtgtgctgatggataggatatgccacccaacccaaacattgcagtttggaaaattgcaagcagggcttaccagtcttaactgccaactgttggtagggtatgtttggggattaggagacattactcagccttacttcctaagcttggtaaatgcacagaatttttctcctttcttagaacaacccagaataatttgataagatagcaatgaaaattctgctttgcctatgttaaatatgagacttcggctaacatccaagtgtaaataaaatatagatggcttaaatcagagaagttggtgttgggaaaacatagatgttaattatagatgacattgaagtccttgagaatggataagatcacttacctattggtggagacgagaagagaaacaagccaccaagagtagtagcactaagctactgaaacatgaatgtctggaatagaaaatgcattaaagatagaaatcaatgtcattcttgaatctggcagcaaagaaagcttcatgtagggcatgcctttaagtccaggcctaaagaaatggcagcattttcacactaatgttcataaaatggactcaaggcagcaagaagctgcacaaaaatctcatgtagattaggtttgggatgcatttaatagaaacataatttaaccaccagcaaagcttgagtactcattcctctgagtggtgaaacccaatcgccttcactgtccttttgtttccatggtacttctcaactggtgatatatggtccccatgttttattccttttctgctcctggtgttttggtggcagtagattagagtcaataagctgctatttattataggtgacacagctcctgctttcacaattcagagaaagctctaggtttagccataaagtgtcagatgaaagtgatgtactgattataatttaaaacaagtctatctatgaagaactcagtgcagtcaccaagaagcactggatattatcaaacaggaacttccatagttttctgtacagtgttattcccagcctatatgcacaaattttaagaattcaatatgaattaatcactgtccatatcttcagcatgttcacactaatgtaaggaatatgttgtacacatctgatcattgctatttaaagttgattatgttttcatttattttgttcagacattctatctaggatggaggtctcttaagaatcagaaagaaaaccgaattgcctgtctcagtaattaaacaactgctatctcaggcagaagctcatgaaatttacataattcataggaccacctcctcaagtatgtataaatagtaaagacatatacagagaccaggcgctacagacctgtggagttatagtcatctacaggcatgttgctttcccggattgtcatccatgctgggttaggcttttctgtaatgaagctattcatcttcacatagctcatgctcctgtaaataagtgctcatatccctatgaacaaaccaaataaactaatagattgaccaagttgaacttaagagggattgttactgtagtctgtcatcaatttcctatctggggtgaatagatgtttttatacatatcttcaagcaaaattacaggattcagtatctagcaattgattaatttttgagtagctatcaacttttcctgctgatctcacgttggttggagtatgccttatgcatgcaatcctaaatctagtgtatttagctggaaacctagaattgctctttttagcactgttgatccaggagtatactgctgttggatgttttgttttgttttgttttgttttgttttgttttgtttttacattgttggaacaactggcccaatagctacttttcatactctaatgtcctattaactgccactgatatctctcaccctgatgcattcatgcctttccctgtacacatccatactttcctgggtgatctactgctaatgagcttaagtctacattgctgttactatttgataattacatgatacaatggatccctgatctgttggcatcaacagcaatactgccttcattttcttttactcagtcttgactcgcttcttccttgaaattccaggacgtttctgctgaagtggcagtaagcatcatagcacaagcacaaaagtgtctaagtaaagggcagttaaaagctgagaaaagttgttaatgaaaacgtcattgtcttagagctctgttggcatgagaaatgatctttctcatggttttctgactcaggataatgaaagccttgggtcttgggaggtagggttaaaattctgtggtgataggtatctgtgaaaactattcctgtggatcccaagtgagatattactctcctttagcacattctagaaccctgcacttttgctactattaatacataaggacctccagggaacaggcacaagtaagagatgatgccttgtggtgctagttcaccatctgcttatttgagtaaattgagtttgcccagaagaaaaccaagaaaacagctcttgtcaatcttttaatctagttttcttaattatatgcaatttgaaatggatacaattataacaacactgagcataatttcattccaacatctaattgcttgaagctattgtgtattttgccaaatgatgcccaccatctttctattttctgttcatctcagtgtcattaattagatgttcatgttttccattgttgcttggtgtcatgttacccacatgtcacttacactgtacctatctctgttttcactttgctatgtgatttgtggcagtcaatgccatcactaccattctttactattatcctcataagtttaacttttttaaatcttgttttataattaaatataattttattgtcacccacttgtaatacttatcaaacttttcctatataagttgagaggaaaacaatggtcacagagaatgggggcagagaaaaaagtgaagatgagagaggttagtatatgtataatgttaaaatttgatattcatcctttcaaaattaataaatgtaaattcacacataaaatatacaatattacaagtttaggtgctacaatgtaatgttttgatgcatatataaatatgtagaatgaagtcaggctaaacataactcattagacactatttctttaagtttttaaaaagtttattaatatgtatatttatttctgtgtgggtatgtgcacataagtgcagttgcctcccaaggtcagaggaagccattggagttcctgaacctggagttactggccgttgggaaccatctcacatagaagcattacttgattgtaaccggggagccctttctactagttaaacattctttcttaatggtgcaaatgtttaaaatacttttctataactattgaaacacccagtacaatatcattgtctgtgtttgcccttctgtataatagcattccagatcacactggttctatttaactaaaacttaccatcattttttagtcctctcaccatctcttcttttccactactattcacagacttttgtaacacacattctaccctcaattttatgaggttaactttattatcttttctttaagagagatactatgtgctactagttttcctttgtctgctttaatttattaaactcaatgatttctaattccatctgtgttgttacagttgttgattggatattagcctttgcatgacttaatagtattacattattgcataaattacattttatttattaatctgtggatgaagaattaatttgctcacatttctcacctactatgagtaatgctgaaataaacataggtgtgcagaaacattttgcagattttattattttatgttatgtgtgtgtagtgagaattctggaacatacagcagttctgattttaattccttgaggaacctgcatgctgcattccatactggctacactaataacagtatgcaagtatttcatcttttactactaccctgtgatgctctcttcatggttgtggttttgatttttgttttcttgatggttaagtataactacctacttgctagtcattttatttaagtcccttgagagatgtttagttttactattcacctttagtctctctttcattcctatcttctcattcttaagtctactatatcttctgactctttgtgccttgacaggcatgaacttgtaataatttctattgtgctataaacctcccctttgctcttttgataatttcttgcattataagtcagatttagttttctatcagctgtttttctattctcactatctctcctgtgtttttcaatttacttcaaaacatactaattcacttcaactatctggagtgtttctccagcttccgactttcaacaaatttattagtttcaggtcatcagtctgttgtttgctggctttgtcactgctgagacagacggctaattgcattgttctatatgtgaatagtgagtttttcagcactgtttgaggaaaagacagtcttttctctaataaacattttccttcctttgctgatattcagttggttgtataggtttatttttaggctttagttcttttactggtgcctttgtttttatgacaaaacagtcagaagctagtgcgattcctaaactgtcattttatattttgaagttagccagtgaaatctctcttgcttttttctttctgtccacaaaaacactatgatttctttctttccagagaataatgttaataatattttagtaggaattgtatcaaaattttagatctctttggcaggtacagacattttaccaacattgaatcctccgaaccatgaaaaccagatgtttttccttataaacatgtttgcatgtatttgagttcgtacttgtatatgtgtgtatataaatttgtatgtataagcatatattatgtgtgagtgtgtctatttgtatccatctatgtatgcattgtatatgtatttgcttatgtatctacttgtgaaatacgtgtgtatatttttattctttgatttatttcatcaatgccctataatttgcagaaggtcctatacttctttagttaaagttacttctagaaatttcaattttggtaaactattgtaaatgatattcctattttttatttctgtttcagtaaatgactattaataggtaaagtgctactaatttttataattgattttacattcagaaattttgattaatccacttattatttctcataggttccttgctgaattctttgtgggtaggtttctacacataatatattacctgccaactatgacattgttatttcttctctccacctttgtaaccatttattatgtttcttccctgttgctctggattgaacttcaaacaatatgctgaactaaataccgtgaagattgcatccatggaatctcaacatctatgactgtatttgcaagttctgcacaagatcatggcagtcaacactctgtcctgaacaaatgaagggatttcatggcctatttctggctgaggaaccacaggacactaagaaatgtgagccggttttctttaaggaatagttccttgttagcttacccatgcccaaactgtcagtcttacacacattcttatgatctatttattgattgatcaatctggacaggaagaggggctgggggtcatgaaaggagatagaggatgggataaagaaataggcataactaaaattctttacacttatatctgaaattccttaaaaaattagtgaaagcacattccttttctgttttagagctcaggcagttctaactttaccctagtgtaaggttagctcttccttagtaaatgtgacatattatattgaagtactcttcccccataccaaacttgcttagttttttcttttccttttcatgactgaatgttcaaatctatcagatacgttttctatacctgtataaccttgtttttaaccctctttctgtagatgttgcacaccagtttgacttgtgaatgatggactgtccttcatctttaccatgaatctgactcaaatgtaaatcatttccaaactttctcactttgttttccaaactgatattttaatttaacctctggtacagaatatttgaacctgctcctagttaggatgtggctcagtccttagcacacacttttagtttctctgggtggaatacaggtgtgtccttagtattcatctttaatcccagacaatgaaggtaaaattagtttatagaaggaagcacccatgtttgaaagtgatgcctatttgagtggcaggaaaagtgatgaatcagagggagatttgatggggtaggatatacccaacactttcaagaagagagaggaaagggaaattacataagggagagacagacagtacaggaagaagagactacagtacaggaatacagtagacttcttggagagcagttcagtagagttgagtcagagtagagtagcatagagggaggcagttttactggtctagatttacagagacagattgaagagagaacaagctagacatgggtaaaaacagaatgagctggagaagaagaagcctgaagattagaatatattaccaatgtaatacgaagggtcaagcagagattcagtgactaagagaaaagtcagattgaataaatcagcgaagagaggattttcagccagagcagctgaattgaaccaaccagcaagagttaagaaagaacaagaaggggcaagtttagtcagcagcaaatttcggaagctgaaaaccttctaggcatagttaagattatatggaggctagaagcttccatgactaggatgaggctatcagaatggaggcagtcagcaagcatcccagtgtacaattacaacaggaaaataaaagttaattttacaaacctctaatgagtctttagagaaagactgctctctctcttctttctcttgccatcttgatactgtctcattgacaaggttgtgtgcatcctttaacttacaccagtgatggagagtgaaccatgaaaatggaagtgaatgtgtgcagaatggtattagagtagaaacatattttttttcacattatagagatagaaactttgcatcttgcttaacagatattctgtactctttgaataggaatctcctatttccaccttcctcatcccataaaaccactattctctggtgtttccatgctttttaccctttcagtaacatttgtgagtgtagtcacgctgtgcctgtttctggaacatcttaccatatttagggccatgtccacaagggagagatatgtttcacgtgatatcatttcctgtcttatgactgagtgccatttcactcttggtatgggccacatttcctttatccatttgtgttgtttgggtctgcaaaaaaaaaaaaaaaaagaaatctacttataaatatggcatacagaattgtcacttttatatgtcaaaagagttgtgtccagtaatttaaatttaacatggctcagtattctatatttacagcaacatgaatgcaaagctgtgagtgaaaaatgaaatacctcatctcctggtaactctggcatttctgtctccccatttgattaagcaaaggcattggatctcagattctgctatattatagaattgctaagaacaatagacagatgtcaaggcagtagttgtatccccacacaagtaaactaatgcttgggttgtataaacttttaatcctaaaataattccaaaagaagaaactgacaataaatttcctttattaggcacatctggattcagctaacaaatgaggcttgcttactgattttacattatcagttcctgttatcaaagaaggatgactcattcctacatatcattgtttcaggggtgggtcagcaggtatttgtccagtgattgtcagaggatttagtcagaagacacgttcacagagaagtctgggatcctgtcctactgttcttcatttccatgtttctcttgggaaaactgctgtaacaacagataacttggaggcctatgctaatataatgcatttaaattaactatgtgatcttcatatatacaatgatatagctttaattattgctctcattttgcagatgagaaactaatgcaaccagaaagacatttaaagtgataaagattcatgtatgtaaccaagcctgagagtgtgagctgggacccactaactttcaatcaaattaaaatacattgtggtacttggcatcctcatccttatccttttccttctattcctccattgcttgtttgatcagtccaggaggatgcagagagcctgctgagctattttcaattccaggactgtaggaaaataaactttaagttattaaaacctacaaaatttgcagtagcctgttatagaaacaataagcagctaattacacttgtcaaaaaagagttgaagattaactagatgtataattaaataaaaatattataaacaatataagtgtaattaataaatgataaatattgactaggaaagcaagttatggccatggcaatagtagaagatattttatggggttaactgatcactttttggttggatttaagatacattccataggagaaaacacgtgcattgtattgttaatctgtcaaaaacctttgggtagaaagattacaggttccaatagtgaaggtattactattttaaatatgaaaaactattaaatttatgtttctgtgtgtttgatcgccatgtaaatgtaccacatgcatgcttgttgtgcattgaggtcagaagagagcctcagttcccctgaactagatacagataattgtgagtcacccactatatcagtgcctagaattgaaattgagttctctggaagagaaacccatactcttttttttgtttgttttttggttttttttgtttgtgtgtgtgtgtttttttttttttttttttttgagacagggtttctctctgtagccctggctgtcctggaactcactctgtagaccaggctggcctcgaactcagaaatccacctgcctctgcctcccgagtgctgttaataaaggcgtgcgccaccatgccaggcacgagacccatactcttaatggctgagccatctctctttccatatcaaaactactattattctgctaaatgaatatagcatcaaactaccctctaaattgttgtctctatacccatacactagtgcagactcagaccactttatagaagtctctttgtgtataccatggttaaggcagaaactcatactgtgcaaagtgtctgtgaaatgtccaactatgaatgtacccacctccctaagcttcagggtctgtctttgaagaggaggatgaacatatcataggagtctgagcttgggaagatctggagtaaaacagtatgttctgaacatgtcatcactgctgtaatcatgtactcatagacccacagtagctgttgttacctcacaatatatgcatatatcaaggcaataagcattgtagaatgatctctgaatctccatcatttacttatttaggaacttttcacaggtgatggctcctgggaaattgaaagccacttttctttaagggtattgctcccagtagtcctaccattctgtgttgattgactccatactcctgtgtatataggcaacacagattaaactggggttattaaaaaaagagagatggagttgagaggtagggtgtgtatatcaaaaaattgaatggaattctcagtgaatatatagaatattatattttttactaataaccttgatctttattcatttcctgacaataacattttataatggcaatatatattttaaaaataataccatagaatacatttcaaatgatgaaataatttataataagctacatcattgtaggaagaaacatgttctgataaataaatcatttttaatgttttagaatttcttaatgccttttaagagaccagatccactaaggtgtggaaactttctgggacaactgatgctttttatctggaactgagaaactagaggtgattaagaagaaaccaatgtccctgatgtgattttgggaaatgtttctgtagggtcagcacataaacactgtggttggagggcaccaatgctcagtaagccataaggattaagtcagtaagcacagttcatatggtctcagcttcagttcctgcctccaggctactgccttgagttcctgacctgacataccattatatatggttacctggacgtgtatctatcttcccaaattgcttagatcatgaggaacttatcacagcagtagaattaactataacatacatagtccatgaagcaaaatgatcttttttctttttgctgtgctgggggttgaacctagagatttgcaaacaccaggcaagtgctccatcactgaactataccctgagggttaggtataaaatttttatctttagtcatgatctcaggtagttcctcaagttggccttgaatttgtgatccttcttcttcagtctttatgtctatctgtgttatgcacatgcatctacaatttacctttgttatattattaaaaggcacttttttagctgttacctagttccttgatacacaattctaattgagctttcactctgacagtctaatataccccactttggagtgtatcattttagaaccactgataaatcaaaactaaagtgaacatttatagttcaaaagaagtaaatgttgatccttgggcccaaaggatcagtgggttaacacacttgccactaatatacatagaccagaattctgtatctgggacacacatggtgaagtgagaggaccaaattttataagttgtctactgatttccacatgtatgctgtggtgcgcacacacatgtcctctatatacatatagctacacacacaaacaaaaaggaataaaggggtataattttaaagtagctctacaagaagtaaatactcatcccatttactaacaaatagatgtctttgttaaactacacatgcaagtaggttcttccttgaaagagaaagcttgtggctttcctgaaaactggcatgctttcagcacgttgatattactaccatacctgcactactctctctctctctctctctctctctctctctctctctcactatatatatatatatatatatatatatatatatatataatttccttaagaatttcaggatgcttatagccaatcattggactgagcactgggtccccagtggaagaattagagaagggactgaagaaattgaaagggtttgtaacccctcataggaagaacaataatattaaccaaccagagcccccacccctgagttcccagggactaaaccaccaaccaaagaatacacaaggagggacccatggctccagctgcatattcagcagatgctggtcttatctggcatcagtggaagggggtccttggtcctgtggagtctcgatgccccagcataggggaatgctagggcggtgaggcaggagtaggtgggtgggtataggagcatcctcatagaagcagagggtagggggcataggatatgaggtttgcagaggggaaactgggaaggaggatacaatttaaaatgtaaataaataaaagaaccaataaaaagtaaaatgttttttaaaatatttgaaaacaagaaagaaagaaaaaaaaagaaagaatttcaggtatccaggtgattctatagatcagtggcaggcagaatgctctcctgacgctatctgtggattttggacaaatttctcattcttttgggtgagaaaaaaaaagaaatcgcttttattagcctggaattgtggttacttgtggtaacccctcatacatgtgactttacttgtttgcagaaagattaatttctctatgataataattgtttaaatgtgagcatggtaccattacattggcaaaaattattttataaatataaattatttggtcaaacccaagataaactaacgtgactgttttttgtttgtttgtttgtttgtttgttttaattaggtattttcctcatttacgtttccaatgttatcccaaaagtcccccataccctcccccccactcccctacccacccacaaccaacttttggccctggcattcctctgtactggggcatataaagtttgcaagtccaatgggcctctctttccagtgatggctgactaggccatcttttgatacatatgcagctagagtcaagagctccgaggtactggttagatcataatgttgttccacctatagggttgcagatccctttagctccttgggtattttctctaggtcctccattgggggccctgtgatccatccaatagctgactgtgagcatccacttatatgtttgctaggccccggcggcgtagtctcactagagacagctatatcagggtcctatcagcacaatcttgctagtgtatgcaatggtgtcagcatttggaagctgattatggaatgggtccctggatatggcagtctctagatggtccatccttttgtctcactcctaactttgtctctgtaactccatccatgggtgttttgttcccaattctaagaaggggcaaagtgtccacactttggtcttcgttcttcttgagatttatgtgttttgcaaattgtaacttatatcttgggtattctaagtttctcggctaatatccacttatcagtgagtacatatcgtttgagttcttttgcaattgggttacctcattcagcataatgccctccaggtccaaccacttgcctaggaatttcataaattcattctttttaatagctgagtagcactccactgtgtaaatgtaccacatttttttgtatccattcctctgttgaggggcatctgggttctttccagcttctggctattataaataaggctgctatgaacatagtggagcatgtttcttacttactatttggaacatcttctggatacatgcccatcagaggtattgggggatcctccggtagtaccatgtccaattttctgagaaaccaccagactgatttccagagtggttgtacaagcttgcaatcccaccaacagtggaggagtgttcctctttctgcacattctcgccagcatctgctgtcacctgaattttgatcttagccattctgactggtgtgaggtggaatctcagggttgttttgatttgcatttccctgatgattaaggatgttgaacattttttctggtgtttctcagccattcagtattcctcaggtgagaattctttgtttagctctgagccccattttttaatggggttatttgattttctggagtccaccttcttgagttctttatatatattggatattagtcctctatctgatttaggataggtaaagatcctttcccaatctgttggtggcctttttgtcttattgacggtgtcttttgccttacagaagctttgcagtttcatgaggtcccatttgtcaattctccatcttacagcacaagccattgctgttctgttcaggaatttttcccctgtgcccatatcttcaaggcttttccccagtttcagtgtctctggttttatgtgaagttccttgatctacttagatttgaccttagtacaaggagataggtatggatcaatttgcattcttctacatgataacaaccagttgtgccaccaccatttgttgaaaaggctatctttcttctactggatggttttagctcccttgtcctagatcaagtgatcataggtgtgtgcgttcatttctggatcttcaattctattccattggtctacttctctgtcactatacaagtaccatgcagtttttatcacaattgctctgtagtaaagctttaggtcaggcatggtaattccaccaaaggttcttttatccttgagaagagtttttgctatcctaggttttttgttattccagatgaatttgcagattgctctttctaagttgttgaagaattgagttggaattttgatggggattgcattgaatctgtagattgcttttggcaagatagccatttttacaatgttgatcctgccaatccatgagcatgggaggtctttcaatcttctgagatcttctttaatttctttcttcagagacttgaagtttttatcatacagatctttcacttccttagttagagtcacgccaagatattttatattatttgtgactattgagaagggtgttgtttccctaatttctttctcagcctgtttattctttgtgtagagaaaggccattgacttgtttgagttaattttatatccatctacttcaccaaagctgtttatcaggtttagttctctggtggaatttttagggtcacttatatatactatcatatcatctgcaaaaagtgatattttgacttcctctttaacaatttgtatccccttgatctccttttgttgttgaattgctctgcataggacttcaagtacaatgtttaataggtggggagaaagtaggcagcattgtctagcccctgattttagtgggattgcttccagcttctcaccatttactttgatgttggttactggtttcctgtagattgcttttatcatgcttaggtatgggccttgaatttctgatctttccaagacttttatcatgaatgggtgttggatcttttcgaatgctttttccacatataatgagatgatcatgtggtttttggctttgagtttgtttatataatggattacattgatggatttccatatattaaaccatccctgcatccctggaataaaacctacttggtcagaatggatgactgttttaatggattcggatagcaagaattttatttagtatttttgcatcgatattcataagggaaattggtctgaagttttctatatttgttggatctttctgtggtttaggtatcagagtaactgtggcttcatagaatgagttgggtagagtaccttctacttctattttgtggaatagtttgtgcagaactggaattagatcttctttgaaggtctgatagaactctgcgctacacccatctggtcctgggatttttttggttgggagtccattaatgactgcttctatttctttagggatcaatagatccttaacttgatcctggtttaactttggtctctggtatctctctagaaatttgtccatttcatccaggtttcccagttttgttgaatatagccttttgtagaaggatctgatggtgttttggatttcttcaggatttgttgttatgtctaccttttcatttctgattttgttaattagcatgctgtccctgtgccctctagtgagtctggctaagggtttatctatcttgttgattttctcaaagaaccagctcctcttttggttgattctttgaatagttcttcttgtttcctcttggttgatttcacccctgagtttgattatttcctgccctctactcctcttgggtgaatttgcttccttttttactagagtttttaggtgtgttgtcaagctgctagtgtgtgctctctctagtttctttttggaggcattcagagctatgagtttccatcttagaaatgctttcatattatcccttaagtttgggtatgttgtggcttcattttcattaaactctaaaaagtctttaatttctttctttattccttccttgaccaaggtatcattgagaagagtgttgttcagtttccacgtgaatgttggctttccattatttatgttgttattgaagatcagccttagtcgatggtggtctgataggatacacgggacaatttcaatatttttgtatctgttgaggcctgttttgtgaccaattatatggtcaattttggagaaggtcccgtgaggtgctgagaagaaggtatatccttttgttttaggataaaatgttctgtagatatctgtcagatccatttgtttcacaacttctgttagtttcactgtgtccctgtttagtttctgtttccatgatctgtccattggtgaaagtggtgtgttgaagtcttccactattattgtgtgaggtgcaatatgtgctttgagctttactaaagtgtctttaattaatgtggctgcccttgcatttggagcatagatattcagaattgagagttcctcttggaggattttacctttgatgagtatgaagtgtccctccttgtctttttgataactttgggttggaagtcgattttatccgatattagaattgctactccagcttgtttcttcagaccatttgcttggaaaattgttttccagcctttcactctgaggtagtgtctgtctctttccctgagatgggtttcctgtaagcagcagaatgttgggtcctgtttgtttagccagtctgttagtctatatctttttattgggggaattgaatccattgatattaagagatattaaggaaaagtaattgttgcttcctatttttttttttttagagttggcattttgttcttgtggctgtcttttttggtttgttgagggattattttcttgctttttctagggtgtggcttccttccttttattgcttttttttttctgttattatcctttgaagggctggatttttggaaagataatgtgtgaatttggtgttgtcatggaatactttggtttctccatctatggtaattgagagtttggccaggtatagtagcctgggctggcatttgtgttctcttagtgtctgtataacatctgtccaggctcttctgactttcatagtctctggtgaaaagtctggtgtaattctgataggcctgcctttatatgttacttgacctttctcccttactgcttttaatattctctctttatttagtgcatttgttgtcctgattattatgtgtcgggaagaatttcttttctggtctagtctatttggaattctgtaggcttcttgtatgtttatgggcatgtcattctttaggtttgggaagttttcttctattattttgttgaagatatttgctggccctttaagttgaaaatcttcattctcctctactcctattatccataggtttggtcttctctttgtgtcctggatttcctggatgttttgagttaggattcttttgcattttgtagtttctttgattgttgtgccaatgttctctatggaatcttctgcacctgagattctctcttccatctctgcattccgttgctgatgctcgcatctatggttccagatttctttcctagggtttctatctccagtattgcctcactttgggttttctttgtagtgtcttcttccctttttaggtcttgaatggttttattcaattcatcacctgtttggtcatgttttcttgcaatactttaaggtatttttgtgattcctctttaaggtcttctacctgtttagctgtgttctcctgtatttctttacatgaattattaaagtccttcttgatatcctctaccatcatcatgagatatgcttttaaatctgggtctagtttttcgggtgtgttggggtacccaggactgggtggggtgggagtgctgcattctgatgatggtgagtggtcttgttttctgttagtaagattcttacgtttgccttttgccatctggtcatctctggagttatttgttgtagttgtctctggttagatcttgttcctcaggtgtttatgttagcctctatcagcagacatgggagactagatctctcctgagtttcagtgttcagagtattctctgcaggtaggctctcctcttgcaggaaaggtgcccagatatctggtgttcgaacctgcctcctggcagaagttgtgatccactcacagaggtcttaaaatcccatggagggtcctgtgtataccttacgggtgtccgcagactgtacgcccaaggtacccctgtgctggcgtgaactggaagggacttgtgtccctgatcaggtcgggttttctgcttccctaattaatgcagtctcaggttccgtgagagattggattggagcagcagctgtgttccactcaccagaggtcttaagatcccgtggtgggtcttgtgggtagctggtgggtgtcagcccactcttccgtttgtttgttttaataaatagctttttttaaatttattcatttggtgccatgccaatttagtttaaacctaggacctaagaatttcttggatttgtttgttttataatatgagacctggatttatcctaaagaacagataacaattaaaataagaaaatggttggttacttctatcatagttaggccaatagggccccagtaggtacatattgcctaacaggttggggtttatatgtagtctatgctacatatagtagatttcatcaccatgaatgatggcaaagctacccatcaaggaaaatgtatccagcctagttccagttttgtttcactgtatcttggaacaaaaatatgttgtgcagataggattatatcagctggttctgccgacagttaaaaacctgtattgttttgggcgcctttgaccaactctttatgaccaacaaattttatggagcattagtgagtcttccaaggtttttcatttcttcctgttttccttttataaggttacacttgaaaattttatatatgtatgggtgctacttttacatacatattttatataatacaaataatgttaattatcatattcatcactttaaagattcattatactttatggcaaggttgtttgtgatggattcttatgcataatttagaaggagaagcaattctaggagagtgcaaaatgaacccacagagagtcctaccagggattctcagcctagagaactcttatcaaggttcttggtcttcaagcatgtattttagtacattctccccttccacacaatttgcatttaaaaagaatttcttatgctcaatatatttactagctatctccagagtttaaattgagaaacaaatccttacttaatgcttggtagagtctcttatgccctaatattttccctatattattgaattttattgttttgttaaaatatgacagcattattctagaggagattttaaacagctactggaaatgtaagatttttatttattatagtagtctgccacattttacatgtatcatacaatctgtcatattaacccatgtgcatataattcagagaattttatacaatcattaattttcataaacagaactcatctatgggataattctaaggtcggatggagcatcattatattatgatccttctaagcaaagcctcctgtggtgtttctatcagtatcattctaaaaagttataacatgtattttcaatgtaagtttaaaagattttaagttgtgaataaaagctaatgataattgttggatcaataatttaattagtaacatttaaaatagatttctcttatgataatataattaactttggcttggatagggagtttcaattctttccactgagtgagtttaatgattgtaccaaatatttaaaaggcattcagagctaaatgtagtaatgtacacctgtagtctcagaactgaaagatggcagaaaatggataaaaggtttacaactacttcccattaaagaacaacctccaggtaaacagcggctctgtgagacaatgtctcatataccaaattaaaaacaagaaaaagaagaaagaacaaaaggagtaaaaatatgagtttcagactaaatattttggctagtaattttccaaatttaaagctaatgatctggaaatgagttgttttatgctataatcaagtaacaagtcttttaaaataaaagacagctcaacattagtacaaattctaaggaattcaacttattgataatatgaagaaaataaaacacattttcaaaataaaatagagcaatatttaataaagttctacattattccctagtttaagcagatatctgagagtaattgcaaaggacatagcttttaagttaataaagtattctgcacttgattgataccaataaaagctgtctcataaataaggtatatgtgtatgcatcaacattttaataatgcatacagcccaactcaacaatatcaccatcaacattcttcttagtgagtcactatatcaggatgcatatatatagacatttgtttataagatatacagctacatataaacccaagtgggtttagatgaaattagaaggtaaatcataattcattctaaaatacaagtactatttagccattaaaatgatcactctgggctccatttaaagttgttatattaaacatatgtatcttttcagtggtgtaaaatgttgtgagagaaatatattttacaaatacagctatagtgagaaccagagatgaaatataggggagcaaaaatcggatgaaaactaataattgactgaatatagtgtgtgacatcccttttattgtagctgctcctatctgcagatggtcctttgttgaataatacacttgcttaaattgcagaatcactgagaagtaacaggcaccacagaagtcaaacttgtgtttggaactgaggacagggctattctgaaagtgtgtgaagaggtatctgaacgcattcctgcctttttgctttgtgtagaaagctctatctccctgactaatgtaaagacagatttataaaaattgactattgcatacatcttacctaaattccaaaagacaattaatatgaagactcagtcttaaaaaagaaggagagaacaacatgctaagttaaagtttgcaatagcggaagcttttacaaatcatacagatgttagcatttcagacacatgcacatcctgttgtggaaggctatgatttctgactatttataatgaataatataggtgttgatttctgtgaaccactaatgaaacagcatccaaggaagtcattcatatttgttcgtgattccgcgttagctcaggtctaaccttgggaggcagctaaaggagaaactttaacctgctcagaaaagacagaaaccaacacccctagaacaaggggtgtagctctttggtagtgtgtgcttagcatgtacaaggcagggatttgattccaacaaaaggaaaaagcccaatggatgaatgaataaatgagtgtctcaaagaaggaagataaataaattaaaattaaaagaagttggagtatactgttttgaataagaacaatccccatagactcagatgtctgcatactttgggcccacttaacagctttgtttgggggaaggcctttgtgggggtttcagccttcctggaggatgtcactggaggagggcttgagacctgtgcttgtggttcaggttatgagatcataccttcctgctctttctgcctcaccatcatggactctaacactaggaacccttaagccaaaataaacttttttctacaggttgcttttgttttggtgcttcactgcagcaacaggaagtaaataatacatagagagtaggaaatagtgggaataattagcagtaaagtgtttacagtctaaggagcatgacttgaatgaaaggaccaatgcctgtcctgtttgataaatccataatgtataccttgaggcatgtgagaaaaattcagcttcagagcaagaaaggctatgcacattgtgagggacatgattcagtggaaagtggggttcgcttactgagaattcaggagaaagtgctttaaaaagtattaacacatcaaatattctcttgattttgccatctctcagatttttgtggtgcttgtggaagaatataaataatgccttccttgagtatgatgcgggcatatgctaatggttatctggaacacagtcacttaatgggacagttcacatttcttgctagggacacaatgaatgtatctcattctggatacttaaacatataacatcgatgtggctatggctatttatagaactattgctacagaggagccatgatccctgggcagaagcagggagaggaatataatcagaatatgctgtgtgaaatgtgtaaggagtagggagctgaaattctctcctaggaaaaaagctagacttcactcacaattgccccattatcccatctgtcttagttagggttttactgctgaacagataccatgaccaatgcaagcattataaaggacaacatctatttaggactgacttacaggttcagagattcagtccattatcatcaaggtgggagcatgacagcatccaggcaggcatggtacaggaggagctgagagttctacatcttcatctgaaggctgctagaagaatactggcttcctagatgctaggatgagtgtcttaaggcctaaacctacagtgacacacctactcataaaggttacacataatccaaaagggccacaccttttaatagtgccgctccatgacctaagcatatatgaatgattataccatcagaatttagttttttttaaagcaggaatattaaaaataaaaggaaaatatattacaaaccaagcttgtgacaacatacatgagcatcagaccacaactgagtgaggaatttcataaattcattctttttaatagctgagtagtactccattgtgtaaatgtaccacattttctgtatccattgctctgttgaggggcatctgggttctttccagcttctggctattataaataaggctgctatgaccatggaaggagttacagagacaaagtttggagctgtgacgaaaggatggaccatctagagactgccatatgcagggatccaccccataatcagcttccaaacgctgacaccattgcatacagtagcaagattttatcgaaaggacccagatgtagctgtctcttgtgagactatgccggggcctagcaaacacagaagtggatgctcacagtcagctagtggatggatcacagggctcccaatggaggagctagagacagtacccaaggagctaaagggatctgcaaccctataggtggaacaacattctgaactaaccagtaccctggaactcttgactctagctgcatatgtatcaaaagatggcctagtcggccatcactggaaagagaggcccattggacttgcaaactttatatgccccagtacaggggaaagccagggccaaaaaaaaaaaaaaaaaaaaaaaaaaagggagtgggtgggtagggaagtagggggggggtatggggactttgggtatagcattggaaatgtaattgaggaaatatgtaataaaaaaaaagaattgctattataaaataacccaaaaaacaaaagctaaacaaacaacagacagagtaacaatagcagcaaccatcaaaaatgcacaccactggaaagatgcagagaactgagagctttggaccagagagatggctctttggttcagtttccagcttatacatgacaacttctgggatccagcattgtctttgagtctcctcaggcatcagaatacatgtggcaaatatcaaatataggcatacacaaatactcataaaataaaaataaataaattttgaaaaccaaaatagggactcatacaatcttgtggaaatttaaagtaatataggaattatggaaaactgaatggagttctttaaaagaaaaataaaaacagaaaatagcataaaatctagcaaatatactaacatacaatagatatttatgcccagctatttattaacagttattcctaatagccaaacacaaagctgagccagataaccaccaacagataaggcaaatgcaatgtcttttgcaaaatggaatattactcagaaaataaataaataaataaataaataagtatgaataaccaatcccgtgatttgcaagagaatggagagaactcagaaacatttggagtgaaacaatccacatgaaagtcatacatgcctcatccacatatgtaaacaataagtcaagcttggaaggaatggaatagtggaaactagagatgaggagaaaggaaaaggggaagatgcagaaaacttaacatgagcacaagccactagggaccgtgaaggatgctctagtgagggcttctcaaatgaaaaggggggaatgcatgtgattgatgcatacagtacacaagcttggaaagatcacactgagtcatattaatttatacaatcgataaatgttagaatagaaataaaagccaaaattatacaagtaataataaacacgatcacttaaaatatatccatactaacgtaaaattgacggccatttaaaagtaaacactgaataaaaatttctcaatacttaaaaatgggaagaataaatttatagtaaaccagaaaaactatatacagaaattgtaggattcacacacacacacacacacacacacacacacacacacgcacgcacgcacgcgttcacacattcgcaatgataacatttttgagggagggaacaaaattgctgaaaaataaaaataataatcctttgtttacattttcatcaaactctacagaataatcataaactatcattttgtgttattataacatatgttaagtataagaaacttagttttaatcactaagatttcaattttttaaaaaaattatttgatcaagcattttcacagaatggggctctagacatgctagatagccatcaagcctgtgtccacaaacgccatttttgacttgctgtggccataataatctcaaattttggtgtacaggaaaatctctactaactattcagataaatacagaaaggaatattgcatgaaaaaggaaaagacagattttataggttataaaggacatcaagaaatggataactccctgagtatataagactgtactactgcattggaaccattagaagtgttaggtagctttttatttcatttttttccctctgttagtcagaggaagattgtaatagcactgcagtttctattagaagaattgctgtctaatagttgctcttttagttctgtactttgaaaaattctcatacatgatagcaattctctgactgtttcccatgatgcattgctgtgtggtaggatgataactgacataggagacttgttataagtcacataaatttgatggcaatgaactgaaaaacatttgggagctggacaagtatgtgacaagtctgggctaaagaacagacaaaagatcagcttacctgagatgaagctttggtccctcttgctgaggcatcctttattgcagtgacatgtaagatgtttgtctgagaaccatcacctatgatgtggtacacatgcccaagaagggtggagattcacttattatatttctcttggatagtggatgatagtttgctttattagtcagtgaagtgacaccactccttatatgaagcagaaagaactccaggggttaaaacatgactcaagattcagtagatagctgagggctatctactaaaatatgtagcaccccgtgtgactgaagcactctcccttaataaaacagtagcataaaaaagtcattgagtagaattttccttgtaccttgccaaattacccgtccctgcctttgttttgtttatgtaagttaaaattaataaattagagtgacatattcttcagaaggtgaattttggagatgcaagtagcttaaggatacattttaatgtcagtgtcaactcagatagcagagtcacattacaaacagccagcactgaagaacacttgtcttccttgtggccacagaccctagagagaatttgacatagataaagtttgggggtttaaaaatgttgcctatttaatttaaaaattatatcagatacaaaatgttaccacagaaagaataaagttttctgggaaaaatgtgctacatgcaacaactgccccttatcctttgcagactattattaggttagttaaatttattatttcatttggcttatgtgaaaatgtattttatcatatttcatgtttcatgaaatttcacatttaaatttatttacaaagtatattgattcctacatcaaattaaattgaatttgaaaagtctgtaactcaatattgacctacattctccagacagtatataatgaatgtagacttaattgcttctaattattttaacaaatggaaaactttcttgaagataatttgtgtgtgttcacaaagctacctctgaccaaattctttcagcacacttatactctaacaatgaaggttaaggacctttccacggagacatttatttttaaaacaaacaaacaaacaaacaaaaaacagaaatgtatactggttacatgatagaaagtttggtactagctatgtatgtcagaccactgagattaggagaaagtgaagacaaaattatgggaaccatgtacttcttcagcatcattgataccaataatgttcttaaggagttatgtaagctgtaactgtgaatgtgtgagtgcactctacatgtgtttagatgtgtgcaagtgtgtgtacattcctgtgtgcctgtgtaagtggaggacagagaactaacctgggtgctgttccttgcttctatctgcctttttttttttttttttttttttttttttttttttttttttttttcaagacagtgacttttactgactcggagaaccgcatctaggaccgtctgattggaaagcaagctctaagaatccacctatcactgccttcagagaacaaattcatgccatcacacccatctttttaaaatgtagtctgggagatcggactcagtttcttgtgcttgagcagggagcattttacaaatgtggtaactatccatgccagccccattaacagctcttaaaacaaaagatgttatcaagaattctatctatctgctggggctggagagatggttcactggttaagagcccttgtttctcttgtagatgatctgagttagtttctcaggaaccatgggaggtgatttacaactgcctgtaactccagctccaggggagcccatgccatgtctggctttcaactgcacctgcatttatttctccacacagacaaatttgtatacacttaattaacataaacatttaaagattctatttctaattataccatagtagctttttaaacccaacaattaccttgaaacagtaagaaagtctacattaagaaacaaaaatggaaaaagaagagatgtatgtggtaggtagatatgaaaggaggtttgggaattgttggagggacaagtgggaatgtgatttaaatatgcctgcacatgatctaagtatattaagtaattaattagacagatggtagttagtgaatatacttcatagatattaagaatataaaaggtgagcaaaggtgtccacccttccacaagagctggtgagactagaattgaagagccagggttcaatggagacagctcaaacaattagccaagacagggatgaaagggctaaaaaaatatggatctcttttcttgctggcttcagtgcctattcttgcttttactcttcagactttaagccattgcttcctgtagtctgaacagaagtgttaatcttaatcacagaatatggaaatttcaattggctattcactgtagggagatttgagatgttttaaatctcataccatagacagtataagcaagcctcagagggtcatggtgtttaaagatggtttccagaactgaatgaggcttccacactctgaaatattcctctctctcagtaaatacaacacagattgttaaaactcattctttttttttcatttatttattcatttatttatattaggtattttattcatttacatttccaatgctatcccaaaagtcccccatgcacccccccagtcctctacccacctactctcaacagattttaatagaactttgaatgaaaatcttgcttctatttcagtgtggagaacagttcaatataggctttgattcaaatactaatttgttgacttttccaacaaaaacactgttgataaaatgatattgtaaatttgaatggcaccactccttgtcaagtaaatgtcctccaagctttcaacaaactttatattttacacaccgtgtcatgaatcattttttgtgaaactcttttattatgatatatctagcaaaagtttgtccatacatatataatcaaaactgccttcctgaaataaatattcaaatttcttcaaaaataaaattaaaattttataatcttttcaagttactaatgcatttatatttgatgatggcaattctaactcttagcattacctgaacatagttggccttctttataaaagcaatcaagagaactacgacaacactgcgccaaatctttcttttggaattctcctactctacaaaattgccacttataagaataaaattgaaactcaaagatttaatacataacttatagacagtgaaattcacaaagttgcaagtattcatcttacattttgcactactgtaatcacaaaatgtataaaagtgtcatgcgtattttgcaactaataacttgtgtgatgatgaatcaagattgaatgatgctaaagaaaagcactgcttataaaatatcaaccactctggaaatccgtctggcggttcctcagaaaattggacatagtactaccagaggatcctgcaatacctctcctgggcatatatccagaagatgtcccaaccggtaagaaggacagatgcgccagtatgttcatagcagccttatttataatagccagaagctggaaagaacccagatgcccctcaacagaggaatggatacagaaaatgtggtacatttacacaacggagtactactcagctattaaaaagaatgaatttatgaaattcctagccaaatggatggacctggagggcatcatcctgagtgaggtaacacattcacaaaggaactcacacaatatgtactcactgataagtggatattagcccaaaaaattaggatacccaagatataagatacaatttgctaaacgcatgaaactcaagaagaacgaagaccaaagtgtggacactttgccccttcttagaattgggaacaaaacacccatggaaggagttacagagacaaagtttggagctgtgacaaaaggatggaccatctagagactgccatatccagcgatccatcccataatcagcttccaaatgctgacaccattgcacacactagcaaggttttgctgaaagaacccagatatagctctctcttgtgagactatgccggggcctagcaaacacagaagtggatgttcacagtcagctattggatggatcacagggtccccaatagaggagctagagaaagtacccaaggagctaaagggatctgcaaccctataggtggaacaacattatgaactaaccagtatcccggagctcttgactctagctgcatatgtatcaaaagatggcctagtcggccatcactggaaagagaggcccattggacttgcaaactttatatgccccaatacaggggaatgccagggccaaaaagtgggagtgggtgggtaggggattggggggggggggagggtatgggggacttttgggatagcattggaaatgtaaatgaggaaaatacctaataaaaatatttaaaaatatcttacaaaaatatttatttctattaacattgtaacaggaaggtacatgttaccaaattatgatctcatagagggtagtttcagacaatactcagaggctcctctttctctccatcttgtttgaattctttattttcagcttcttcttctgcctcccctgtgttttcatcattcccatcacctgcagcatcctcttgcccttcttcctcctttctaccctccgcttttccatcattcttctcctttccatcttcctcactctaaccttcctttccatcttccttgttttcctcctctttgcatttcccatcatcctccttgatttccttgttctgttctttaacttcttcctctgtttcagctccccctctttgtcatctttcttttcttccttctttccatcaccttcttctttgccatccttttgtttttttcattgtctcctttctcttcatcatctttggcttctttgcattttcacttttggctgcacctggtttctcatttaagctttcttcttcccctttcgtcttctgcctcctcacctgtatttttgtgttcttttccatcttcatttttctctacatcttgaatgtttgattctagctcatcatctttgccttctgctgccattgcctctttcttttctcctccaacttcccttttatctgtccctttacttcctcggcttccattttaggaatgggtgcctcaataattttggtttctccattttcagcgtttcccatgctgcattctttaatgtcttctgggttagtttcaggaattgttacggtggtacttgcatctttgttttcgtctacaacatttatggtcttcattttccttgaagttgatgctcttttaggtttcaagtccagtgtacaggatacaggcatagcagacagtcaggctgatcttctatttggcgcctggctacatcaccctcagccttttttggggggcattgttgcagctctgcataggagatcctcaggcaggagggtgaagagaggaggctctgcctgacccatccaattgactgagttttcaattgtcatatataatttttaccctccatccttctgtctctccctctgtccctctcttcctgtcccttcaccctcctcttctccgtttcttttccctcttttctttctttcccttccttccctccccttctatcttttccctcctcctttctttctgtaaatctttttatcatcacttattaacttattgattgaataaaacaactgagttcatcatagcatttcatacatgtatacattttcatcaccttcaatctctgttatgttctgctcccaacccccttgattccctttccttcatgagctcttcttctgctttcatctgttatctcaataattccctttatttttattattattgtatgtatgcatacatgtagatatgtaagtgtgaccatatgagtctgtatagtattgcacacatgtgtatatttttagggatgtccatgtgatctttaatatccaattatgggactaatatttggggaatattgattctccctctctcagctctcattaattgcctgtgacttttcatctactagaagcaggccttgtgaggtttctcccatctactttggcatgacaattagtgttttcattgttcagattttgtttcctttattgtgtttctgagatttcatgcttacctagaagagtcagtattaggaataagaaataccttttttgagttgttgatcaagggattctaacagaacccaaaagcagtatggcttattgccatttcttttggttatttcccagaactttaagtcaagttcatattggtgaagacagcactcaatttagacaaagaactttaaggaatcaagctgcctttaaccaagaagctttctccatgaggactagttctcctagtactagaatatcttatgcaagttacttagagaaagacaatcaatatccatactcattgatgatgcctatgaaccaaatcaatgaccagcagagcaagatatatcacaaaagggcaacagtgacacttatatcttgggggtaaccacaaactctctagtggaacccaagaagcattcaataggaagaaactttaactgccattttcctaaacccatgaaatttgtaactttactttaagtacttatccttacatttaaggtaagtgtaggtctcactcttcatgaaagaatcttaggttttcaaaagataccattagaacaaatcacaactggtcaaaatgcaggtcacagatgactatgggtactcagctcctgttgatgtccctataatttcaaacctatacccaatgttaaaaataaaatccaggaggggatggaaacattttaaaagcaaaagaacaagatgtctgctatgaggttgttctctctctctctttccctctccctctctctctctctctctctctcctccctccctccctccctccctcccttccttccttccttccttccttccttccttccttccttccttccttccttccttccttccttccttccaaccccctctttccctggccttccttttcttccttctttgttcctatatatcccatgctggcctgggactcagcaaccctcttgtctcaagctcctataatactggaattacaggcatgtgccacagttcttagctcatggtacacttttaacatgaaagtgaaattaatttaaaattggcattcatattataggaaagatagaaacgtgcgctagaccatagcatctaagaaagaatttctagaacatgttgtgagactgaaagacacatactggagaaagctacattgaatctaaggagagtgaagaagtacctctcacataagatgaccacatttgtacttgagcatccactggcaactttccttctctaggaatactgtcatctctgcagaaggaaaactgcaacaaaaactcaatttccagggagtttggagtaggaggccagacagtagagagatggaaaatgcagagttactaaaaaaccacacaacactaaatatggactagaatctgagagagttaacaaaaggacagcagcaccccaaatctctcatttggaagtgttttaatattttctacattaaaaacatggcaaagctaaagctataacagaaacaattagagtagcctcaaatctaatactgaggacctcaaggtgctgttcaaacttcgaagtgtaaggagtggaaaatgtataatgtggattttgtctctttagattgatcttcagattaattggcaagttctctactatgaaaagcatgaaagcatatatcagctgcctcccagagaactggttgtaaatgttgattctttttatatcagagcaatatttagtcagatttttatctcagtgcttgaaaacagaaaataaaattttcttatgcacaagaaatttttagacattgataaagatctttcattggttttcaaatgtaaaagctaacattttttaaccccataatgatgacttgtttgtgactgactccctctgcaaggcattagaagtgttgattccagttgctacaaagttgaaggagtcattgagaagacatttatctttaagtgttgacttaaaatctgactatgtctgggaattaacaggtgctcaagcattttgttgcggaagtcatttctggtctttatttcaacctattatttccaaagttcttttttcctgtcctgctgtggagagttttctgaggggggaaaaaaacaaaagcctcctgattgtgtcagggttatattatgtctgatcacttctatttttggttgtgagcctagcctttaacagctcagctgtttctccagccttgcctgatcactcagatctcttcaatcacaagagaggggaaactggttctttgtgtgaggaaatggtagtccttaagaggaggaatgcaggcagaggaagcatgtatttttaatttggtgcagtagtacaattgaggagttgcctacttagagtctcttctagtctctgagtaaacataggccgagcttattgtcttttgtgcctgctaacataaataaggaagagaagaaatgaagaaagaaaagagaatctagtttattctgttaccttttagcaaaatccaaacatgtatttgaagaaaaacaagaaaaggtattgttaagttaaatatagtcactcccattcttcaggtttacattagaaaagacacagctgttctgccatgaatattttaaaaattcattgaggctcaggaactgcagccttcctaggaatataagtgatatatctgagtagaggagaaaattcaaccattgcttcagtgaggtgtgtgtgtgtgtgtgtgtgtgtgtgtgtgtatgtgtgtatgcctgtgtgtgcatatgagtgtgtgttcacaaatgcatctagtgtactatggtttgtcttctatggttccctaatgagagactaattcttagggtaatttcttcattcctcttcatagcaactatcttttataagtgataaatatcctctcacattaagtagtttttcttatcaatgtaaattcttcaaagtctagcatgtgtcaataaaatcaaacagtttttaaaacaaaggcatttcacaaatataccattggtctgctgcttagtatactataatgacactgatggcagcataaacatagtaactataaggtggttgtcaattgagatgtgggtcattgtaaatatttaaattattgtgaagacctaagctagatctccacgaaaataatttaaaaagtatctcaaaaagaatatgaatagtttgcaaatataactattacttttttatctaaaatctcccaactatagaaattgttataagcttaaattcaataataatttccacaactctacttgaaacttttatttagattactatcctattgaattaattttatatatctgtccaatttctaggcacatgtagataccaacataaatcagttacaattcctgtataaaatagttttagaaggataaagaaaaataaataagcatgtaaaatgtttactagtaatatcccatttcaattaagaaatcagacagtctgtggaaaaggtaccagtttgttaatattcattacaaagataacaagatagtcttgtctgacaatggacagatcatggaaacagaaactaaacagggacacagtgaaactaacagaagttatggaccaaatggatttaacagataaaccatctacacagtctcatattccctaaagaaatagaagagaagcagcacctgaaaaaatgttcagcatccttaatcatcagggaaatgcaaatcaaaacaaccctgagattccacctcacaccagtcagaatgcctaagatcaaaaattcaggtgacagcagatgctggtgaggatgtggagaaagaggaacactcctccattgttggtgggattgcaagcttgtacaaccactctggaaatcagtctggtggttcctcagaaaattggacatagtacaaccagaggatcctgcaatacctctcctgggcatatatccagaagatgttccaaccggtaataaggacacatgcgccagtatgttcatagaagccttatttataatagccagaagctggaaagaacccaagtgtccctcaacagaggaatggatacaaaatatgtggtacatttacacaatggaatactactcagctattaaaaagaatgaattcatgaaattcctaggcaaatggatggatctggagggtatcatactgagtgaggtaaccacacaaaagaactcacatgatatgtactcactgataagcagtaattaacccagaaacttagaatacccaagatactatttgcaaaacacatgaaactcaaggaaaacgaagaccgaagtgtgggcatgtcaccccatcttagaattaggaacaaaacacccatggaaggagttacagagacaaagtttggagctgagaggaaaggatggaccatctagagactgccgcacccagggatccatcccataatcagcctctaatcgcagacaccatcgcatatgccagcaagattttgctgaaaggaccctgatatagctgtctcttgtgaggcgatgccagtgcctggcaaacacagaaggggatgctcacagtcagctattggatcgaacacgggacccccaatggaggagcaattgctcctgtctaaaggaaatacaagtacaaagactggagcagcgattgaaggaaaggtcatccagaaactgccccacctgtggttcatcccatatacagttaccaaacccagacactgttactaatgccaagaagtgcttgctgagaggagcctgatacagctgtctcatgagaggctctgccagatcctggccaagagatatgtataggtttgcagccaaccattgaactgagcacagggaccccaattgaggagttaggggaaggactgaagaagctgaaggggccttacctagcatcaacggtaagggagcccttggtcctgtgaaggcttgatgcctcagtgtagaggaatgctatggtggtgaggctggagtgggtaggtgggtcatgaagcaccctcatagaagcagggtaaggagggatgggatgggggtttgcagaggggaaattgggaaagggattaacatttaaaatgtaaataaataatttaaataaaataaaaatataaaaccttgaccataagatgcttacatggttactgaaagagataagacttttcctaaattctagaaaggcatacataggtacacagctctctgcaggatcacggttgagtggttgctctgaaaagaattgagacagtcctatgttttcacttggttactgttgaacatttatttaagtgagaaagccaaaagcagactcaggcagagctgtaatattactggccttgaagacacttgaggaaacctatagccaagtactagctgatcaatatactagcagagcagagacttcagtggccatacctcattccacacctaaaagttaattcaagatgtattagagggggctttaacatcccaactaaaattatacaagcaagaatattgacaatgagttcttagctacagcatcaggactgtcaaagctgagttggtttttagaaacttaaaagcctctgtacttcactgtgtagtctgcagagaatgatcagattggccacagaatccaacaaaaatacaaactagtaaaggtctagcttccacagtataaagaattttcagaattcaacactatgaatgtaaacaacatgttaagagtagggaaagaatttctatacatacatctccaagaaataaatacaaactttaaaggatgttcagtaccattaatcacaactcaactcaaaagccacagtgagatactatttcaaatgtttcaagatgtcagaagtgttggaatggatctaaaaaaaacaaacaaacaaacaaacaaaaaaacaacctgtagtgagactaagtggacccaagaaagacgtgaataacgttaacagtagagagatgaacatatgtctatatacaactattcatgaatgcttacttataaattaattatacataacaatcattcactgggaaatttgtacatgcccatgcaccaatgaaaatatgctctattcttatatgtattcatacaatataatatcactcaaacatagtgaaacaccaacagttttcatggtataggtaaacttgaaaatgtgttaagagagatcctgcatcagggacccagaccttagaatgagtgatgtcctgttagagtaactattctgacctgaaaatccatagtataggccccaacacctgtcagagttgtttcctgattctataaactgaggagagaactttcaagttccagtttttctagcatgtgaaaatctgttttttcccacagtctcatgtgtgcctcctcctccctgccctgcctcctgacaggaccccaaggaatgttttagttccatgggacctgacataccgcgcggacatattcctgaagcatggtttcctcactcatagcattcctaaattacccccaagtgctctcaatcacatcaggctctcatggggctgtgaagctggtgagtgcatcaattggctgctgctgctgcaccttacccccttgctgctttgcatagctctttgcagctgtactattgtaagcttcccagttgatgcctggggacaatcacctcttacactttgggaggcacatagcaagcttcccagttgatgcctggagacaatcacctcttacactttgggaggcacatagcatattggcccaaattttcctgaggcaacctgcttctttatctgcctggggactttgtgccagagctttctgcaagctatcatcacgaagtcctggtgtccatgattccgtggcctcactcgtgtgcagatagtgttcagtctggatttggatttggatttggataggcagggcccaatgattttgctgagttggtgcaggtgtgtgtcacttgtttctatgtgtgcacttactgcaaaatctgcccccccccgccatgactgtattgtgtcagagatgaactcagccagcattttcaccagtgacttactgacacaggaacgggactcaggaagtgcatacgaacacacaggctgtgatctgaagcaaatctctctgcgtggtggagcagtacataaaaagcttctgccatgctgctctgctcacttggaactttgtctgaaagcattcttggtggcttcaaaggaaagaggcagagtttaacatttgagtgagcttgttccttgtgatctatattctaatcttcctgtaggtctctaacccttctcctcaggttaaactacctcaggagcacctctttccacaagcagctgcacacccttggtattgggctccaggactaggaggatagttttaaagggcttgctttccttatctgagcactgtggaattacagcttgggagaaatagcacttcttagtattgagagtaaatttacaacgacagtttccttcagagggagaataacaagccttgtgtaccagcacacaggtgttcataaatgagaccactggcttgagatggctgagtcacttcacattagccttccagggaaacatgtcagcatttataactgcccaaatgttaagttatgggaaagctgggataaataagtaccagttattgttattatcagtaggttacaatcacagtgagttttaactgatcttccttgaaaagtaatgagtgaggtgttgacactcctagtttaaacataggaatcagtctctaccagctgaagtcatgtgtctgcggtaccacacaaagcaaataatacaaagatgaaacactaataaattttgactctatttatattcccaactttattgaaataatgaataaaataaacacaagtaggaaaaatattaagtcttttcagaaatagtatttgaaaattatctctttctgtataattgccagatttgaatgtcatgaataaaatgcttgacacagagaataggaagactagaaaagaccatgaagaataccatgagacatacctggagctgattctgtgctacagatctacatacacaaatacctccaggagagagctagtttcctaagaatgcagaaaagcctgtaagcacaggtaagaccaccactgatgtttggaggaaccctcaggacacaggaactgaggagcagcctgggacaggagcattctggtttctgtctgcaccccagagttgaccttgtgccatggctctccaaacctaaattcctcctgaagagaactggtctccaaagacactgacacattgcaggagggacttagcagtcagaaactgcaaggacagataacaccagagataacatgatggagaaaagtaagggcaagaacacaagcaacagaaaacaaggttacttagcacattcacaatccagtactcccacaacagcaagccctggttacatcaaaacaccagaaaagcaagactcagatttaaaatcacatctcatgatggtgatagaggattttaagaaggacataaataactcccttaaagaaatacaagagaacacagatatacaggtagaagacattaaagaggaaacacaaaacgtcccttaaaattataggaaaacacaaccaaccaggtgaaggaactgaacaaaaccattcaggatcaaaaaaatggaaataggaacactatagaaatgacaaaggaagacaccactggagatagaaaacctaggaaagagaccaggagacatagatgcaagcatcaccaacagaatacaagggatagaagagagaatcccaggtgtagataccagagaaaacattgacacaaccgttaaagaaaatgcaaaagcaaaaactccctaacccaaaacatccagaaaatccaggacacaatgagaagatcaaacctaaggataataggtatagaagaaagtaaagattcataacataaagggccaataaatatcttcaacaaaagtatcgaataaaagttccctaacctaaagaaagagatgcccatgaacatacaagaagcctacagaactccaaatagattggaccaaaaaaaaattcctccaatcacataataatcaaaacaccaagtgcacaaaactaagaaagaatattaaaagtagtaagggaaaaagttcaagtaacatataaaggcagacctatcagaattacatcagactttccatcagagacaatgaaaactagaagatcctggggagatgtcatatagaccctaagagaacacaaatgccagtcctgactactatacccagcaacactctcaattaccatagatggaacaaacaagataaaaacaagatattccatgacaaaacccaaatttgcataagatcttctacaaatccagccctataaattataatagatgagaaatgccaacacaaggaaggaaactataccctagaaaaagcaagtaagtaagaaagtaatctttcaaaacacccaaaagaatatagccacacaaacataaaaataacatcaaaaataacagaaagtaacaatcacttttccttaatatctcttaacatcaatggactcaattccccaataaaaagacacagtctaacagatgggatacttaaacaggaccctgaattttgctgcatagatgacatgcatacctcagtgtcaaagacaaacactcagagtaaagagctggaaaacaattttccaaggaaatggtcccaagaaacaagctggagtagccactctaatattggataaaatcgactttcaaccaaaagtcattaaaaaaagatatggaaggatgcttcattatcaacaaaggaaaaatcaaccaagaagaactctcaattctgaacatctattctccaaatgcaaggccatccatattcataaaagaaaatttactaaagctcacacaataatagtgggggacattaacacaaaactctcatcaatggacagaaacacaaatcaaacagagacacagtgaaactaacagaagttatggactaaatggatttaacagatatctatagaatatttcatcctaaatcaaaagaatataccttcttctcagcacctcatagtaccttctccaaaactgaccatataatcggtcacaaatcagacctcaacagacaaaagaagattgaaataatcccatacctcctatcaggtctctacagattaaggctgatcttcaagaacaacaaagacaacagaaagcccacatacacattgaagatgaactactcaaagttaacttggtcaaggaaaaaagaaagaaagaaattaaagactttttggcatttaatgaaaatgaaggtacaacatacccaaacgtttggcacacaatgaaagcagtgctaagaggaaaactcatagttctgagtgcctcaaaaaaaaaaaaaaaagaaaaaatgaaaaaagaaactggagagagcatacactagcagcttagcagcacacctgaaagctctagaacaaaaagaagcaaatatacccaagaggaatagacagcaggaaataatcaaactcagggctgaaatcaacaaaatagaaacaaaaagaactatacaaagaatcaacaaaactaggagctgattcttttagaaaatcaataagagagataaacccttagccagattaaccagagggcacagggacagtatccaaattaacaaaatcagaaatgaaaagggagacataacaacagaaactgaggaaattaaaaagatcatcagatcctactacaatagcctatactcaacacaactggaaaatctggatgaaatgtacaattttctagacagataccagtaacaaagttaaatcaggatcagataaaccatctaaactgtaccataacccctaaagaaatagaagcattcatccaaagtctccaaactaaaaaaaaaaaaaaaaaaaaaaaaaaaaaaaatcccaggatcagaggggtttagtgcagaattctatcagatcttaaaaaaaaaaaaaaagacataacaccaatactttgcaaactattccacaaaatagaagcagaaggaacactacccaattcattccatgaagccacaatttcgctgataccaaaaccacataaagatctaacaaagaaagagaacttcggaccaatttcccttatgattatggatacaaaaatactcaataaaattcttgccaactgaagaacacatcaaaataatcagtcatcataatcaagtaggctgcatcccagggatgcaggaatggttcaatatatagaaatcaattcaatcccgtatataaacaatctcaaagaaaaaaacaccacatgatcatttcattagatgctgaaaaagcatttgacaaaattcaacattctgtcatgttaaatgtcttggaaaaataagaaattcaaggctcatacctaatcatagtgaaagcaatatacagcaaaccagtagccaacatccaactaaatggagagaaactagaaaaatccggcaaaaaatcaaggactagacatggctgccctttttctccctatctattcaatatagtacttgaagttctagctagagaaattcgataagaaaaggatgtcaaagggatacaaattagaaaaggaagaagtcaaaacattactgtttgcagatgatatgatagtatatttaaggtgatatgatagtataatttaagtgacccccaaaactccaccagataactcctatatctgataaagaacttcagcaaagtggtcgcatataaaattaactcaaacaaatcagtagctttcctctactcaaaggataaacaggctgagaaagaaattagggaaacaacacccttcacaatagctacaaattatataaagtatcttggtgtgactataaggaaataattgaaagatctgtatgagaagaactttaagtctctgaagaaagaaatcaaagaagacctcagaagatggagagatctcccatgctcatggtttggcaggattaacatagtaaaaatggccatcttgccaagagcaatatacagtctcaatgcaatttccatcaaaattccaactcaattcttcatagagatagagcaattctcaaattcatctggaataacaaaaaaaaaaaaaaaaaaaaaaaccagggtagtaaaaactattctcaacaataaaagaacttttggggaaatcagcatcttggacctcaagctgtacaatagtgataaaaactgcatggtattgtacagtgacagacaggtagatcaatgaaacagaattgaagacctagaaatgaacctacatgcttatgttcacttgatctttgacaaaggagctaaaaccatctgggaaaaaagacaacattttcaacaaatagtgctgatttaactggatgtcaacatgtagaagaatgcaaattgatccattcttatctccctgtacaaagcttaagtccaagtggatcaaggacctttatataaaaccagacatgctgaatctaatagaagagaaagtagggaaatttcttgaccacttgggcaaaaggaaacatttcctgaacagaataccaatggcttatgctctaagatcaagaattgacaaatggaacctcataaaattgcaaagcttctataaggcaaaggacactgtcaatcagaccaaatggctaccaacagattgagaaaagatctttatcaaccctacatccaacagagggctaatatccaatatatacaaagaactcaagaagttagactccagagaaccaaataaccccattaaaaaaacagagctaaacaaataattctcaactgagtaaactcgaaggactcagaaacacctaaggaaatgtacaacacccttagtcaccagggaaatgcaaattaaaacaaccctgagattctacctcacatcagtcaaaatggctaagatgaaatactcaggtgtcagaagatgctggtgaggatgtggagaaagaggaacactcctccattgttggtgaaattccatgctggtacaaccactctggaaatcagtctggcagttcctcagaaaactgagcatagtactactggatgacccaactatatcactcctgggcatatacccagaagatgctctaacatgtaataaggacacatgctctgctatgttcatagcagccatatttataatagtcaggagctgaaagcaacccagatgtcccttaacagaggaacggatacagaaactgtggtacatttacacaatggagtgctatccatccattataaacaatgacttcatgaaattcacaggcaaaatgatggaacttgagaatatcagcctgagtgaggtgactcagttacaaagatcaaacataacaggtactcactgataagtgcatattagtccaaaagttcagaatgcccaatataaaattcacagaacatattaactctaaggataatgaagacttaaatgtgtatgcttcggtgcttcttagatgggggaacaaaatactcacaggaggaaatatggagacaaagtgtggagcagagactgaaggaaagttcatctagagactgccttacctggggatccatctcatatacagccactaaacccagaagttattttggatgtgggaatttgcttgctgatagaagcatgatatggctgtcttctaagaggctttgccagagcctgacaaatacggaggaagaagcttgcagccaaccattggactgagctcaggcgtcccaaatgggggagttggagaagggactgaaggagctgaggtggtttgcagccccatggagggagcaacagtgtcaacaggccagtacacccagagctcctggtgactagaccaccaaccaagacatacatatggagtgaccgatggagctggccacatatgtggcagaagatgcccttgttggagtcagtgggaaagaccctgagggtgttcaatgccccagtataggggaatgccagaacagaaagatggaagtgggggagtgtgggagcactctcatagaggccgggggaggagagatgggatgctggtttccgaagaggagacctggaaagtgggtggaaaaaagaataccatgagaaatgtgaactgctgtttttgaaattatgttccttactgacaaagtaaagttgtaaccagagcacaaatccaggaaaaaggctaatgctgggaggaaagttaggaagatcattccatgatgagactaagtccagtgttcacctgaagcaaagttccttgctagaaaataaactggtaccagcaagagaatcagggtgattctcaattacaaaacactaaagtgaataatcaacactatccttgctagtgcatttacagtgacaatagagaggagctgtgatttatgtgtttgtgtgagcaaagtaggttgtagcataagcaagggaggtctgcgtttaactgcctgtgcagggcagattggaaataactgggtttcatgggctactgaggttgagctctgtctggaagatctcttctctgatttaattttacctcttcacagaacatttaaactcatcccttttgggcatggattataaatgcagtgatcatatgtaatatttagggtcctcctggcagtagatacatttattttctttttagaactagttaaaatatggtatgaggtaagggtgccagtttaatttttctctctttattgataccatggcaatttgttaaataatctattatctttctaatggcattatcagatactatgtgttggacatgtgtaggtatggttcttcaatttgtgccctgtatcagtgcttctaggattggaaaacatcaacattctaatgatttctttttatcatttaactggtgtgctatggtttcattgctgtgaacagacaccatgactaaggtgacttttataaggacaacatttaatcggggctggcttacaggttcagaggttcagtccattatcaaggtgggagcatggtagcatccagatatgatgcaggaagacctgagagatctacatcttcgtctgaaggcacctaggaataaattgactttcaggcagctagaacagacccgaagtgacataccttctccaaaaaagccacactgactctaacaaggccacacctcctaatagtgccactccctgggccaagcacatacaaaccatcacaactggtgaggaaaacttttagccattttgcttacagtttataagtttcggaataaattttaaaattgtgtttctatttaaatatagaacttttaagcactgttactgttcaaaacccaaagactgaagggtgttcagtgaagatttttctatctgtttttgtttgtaaatcctcctagatcccatgacaacttccaaactttcaactgtcatgtcaaacatattccaggacattgttttcctgcataaaaagaatgactttaaaaggtccctttgacacattaccatatactcaaaatgcaatcattttaaaatatgagcagcttttgtttcaaggtgcagaatctaacctagagcccatgtatgctagtccactggtctactgttgacacttcttctggccttttcagtccatattatggatgattatgattcatttaactggtcctctatggatggacagttttgcattccaaagccagatgaaggacaggagagcactacccatatctaggacagttctcagagagtatggcagcagtggggtcactccttactcaaatgaggcatgggcctactcaactgcatagagacaaatgccatgtcatgataaagcctgttaggctctgtttccccagcagagaactggcttgtcataaatcatgtgaccaggaggtgctaatctaactgatattctttgaaagtttctatctccttgagcaagcttgtgtgtgtgtgtgtacacatatagatatatactgtatgtgtgtatctgtcttcaatcaggtttgcatatgcaaattaggtgcatgttctcttgttcttttaccctctcctccctgtgactccagctatataaaccaaccctgtcattccaatgaatgagctgtcctctgacagtcttctgggtcatctttacttgcagtactcactgccaccagagaccgtgttctccagctcctgtgtatcctgagatcaccagtgtgcatatcaggggtagaggactcacagataatcttctgctcttataggcaattacactaagaaaagttttaagtacagagaagatcccaaacaactgcaatagcagattggcttaatagacacagagtcattgtgtaaaaatgcagcagcaattgtaattggagtcctcagcaaattgccttctacatggagtagttcagttttacaatctttagaaatatttgaaaattgtgtgcttttattctgtcttgccaacattttaatagtatcaagatttaacttggctaatatggttgttagaatggactcccacttgcttgcatggttttttgtttggttgctttttgggggggggaatgttgtttgttatagttattttgtttgttaacttcttaaatattatgtatttgagtacactatcactctctacagacatatggaagaggacatcaaatcccattacaggaccaatagaagagcagccagtgatcctaatcactgtgctctctctccagctcccaagattttaatcttcccttgtaccaagtgaggttacgaaccttttcacaagtctgaatgttgtgtgacactattcccaaggagttaggaacctggagtaagaagaagataaaaagagggaaattgtaggacacagtaaaatgggtgagggagatttgcctggtgagggaggagagtgggaaacaaaaccccagtgccagtcatgggaaggaaacctttaaagttgttggccaggggaatacaagagactccatggaacaatactggctattattatggcctttgctgactcacagaaaagaaagcaagatcctattgctgaaaataccacacatattagacacaggattttgaattgacctgaatcctacctgggagatagtccttcttgctgaggagtagcccttatagcttcaaaaagagtcgggcaaatggtagccaagtattcagaaggagtaaagcaatcaggagtcctctcgagctgtaataatgaccaattgcaacaatgactactatggcaagatacctgcaaagtacagtagtggtgcttacatgctggaggtaaccaaagacacatatttggaattaaggcccatgtaataggaggaaattcatccttggcactgtaaatgtagccaattacctgtggtttgtgaagccttggaacccagaacagactacaactgccagtttcctaaaccagtataatcaataactacattctgaatatcacttttatttccatagataagtataggtctcatccatcatcaaataagcatcttattgcaacaaatgaagaccattacaaacaaacactgtaacaaaacaaaacaaaacaaaacaaaacaacaacaacaacaacaaagccactcaaccaaacaaccaacaagcaaaaaacacaacttgtcaaactacagagatcaattcactgtggggtgcctgcctccaaattatacatttacaaaacagcctgttcacttaagactaagagaacatcttggaatatggggtggaaatattttaagagcaagagaatcaaggttgctgctaccaaattgattcttcttaaaaaaaaaaaatgactgcatgaagtgaaggatgaggggtagatctgggaggaggttggcagtaaatgatcaggtacactgcaaaaaattctttaagacgtaataaaattataaaaatactttaaatataatgatttaatgttaagactttcaaattggaaaagtatgttaccgatagtcactaatttcccctgccttttaggaatatttaaaattttttacaaaggtttaaacatttatagtaaattcttttcctggtaatctatatttttgtaactattggaattgatatttttacattaaattttaattggttatatataaatattgctctctgtatactgatattatgacttctgacttgccaaaatttcttttataatcaaatgtataaagttttatactctgttgacttttttaaagctttgctatatctcattttatttctagtaaaagatgagaaataacctttttcataacttaattgggaagcctttaaatgcttcttcactgaggataatgccagaatattaatttatctccttttctctctcagctctctatgtgtgtgtgcacattgtacttggtgaaaaaaaaattaatctgtaactttttgtaccgattttcaaagtaactgttacaactctcaatgaaattgatgtagtttaataggtttatctcaggaaatgaactctccttatcaagaaatagacattcctattggttcctatcagttgactcgttgaatgttctagagctttcttcaggtaggcatttcactcaagtgacctttatctcttcatcacatatctagttcttgtatttcaaccattttactgcaattctgagctacttttgatggtgctttaaattttgtcttaataaaacaatgatttctctttgatcagatcatacattgctttctgaaggttttcttccagtgcaagctcctataactgttcaggtaaggttttaagcaacaccttcatctttgagccaattgcttacatgactgagctctctaattttttttgacaacttgtcacaaactagagtaacctgggaaggggaaatctcagttgagatattgcttccatcagtttgacctgagggaatatctgcggagcacttattaattgttcattgatgaaggtgagccaagcccactctcattaataccacctcttgacagatggacctgggctatataaaagcagatactgaacatgaaagtcagcaatccacttttttcagctcctacctccaggtttcaatttgaattattatcccaagttctctcaaagactgactgttaaataggaggttaagtaaatattttctctaccaagttggtttttgcagtatttcatcaaagcaatgaagtatcaactaggacagaaattgttaatagattcactggtgtgcataggccccctcatcctatgctgtctatgttttcagaacagtggtcagattattttaatttttacatatttcttcatgtaaaatttacagatgagctgttaaattatatagccactcttgttttcctacatctactttgaagctaattcagtagcattctcttctatctctatgtagtatatccctaaaatcttcccattacttaaatacacttcagttgccctttggtacttaaagcactgtcccagggaacctgtaagactgtcaccatagaatctcccttttggcctacatcttttgtctatttgtttgtttaatcacatattttctgagtcctattcattcccttgtttttgtttgagtttctttttttaggaaggatccattaaaggtaagattctaggggtaatgcatgtctaaaagcaagttcttgtcactctgaattttttgtatacattctgtgcaaaaaaccaaagaggagcagagactgaaggaaaggccatccagagactgccccacctggagatccattccatatacagactccaaatccagacactatggtggatgctatgaagtgcttgctgacaggagcctgatgtatctgtctctggagaggctatgccagagcctgagaaacaaagatgggatgctcacagccaagcattggacgagctcggggaccccagtggagaagccagagaaaggactggaggagtagaaggggtttgcagctccataggaagaacaacaatgtcaaccaaccagatctcccagggactaaactacccaccaaagagtatacatggagggacccatggctccagctgcatatgtagcagaggatggctgtatctggcatcaatggtatgaaaggcccttgttcctgtgaaggataaatgccctagtgtagggtaacagcagggtggtaaggagggaatgggtggttgggtaggggagcaccctcatagaagcaggagaaaggggtatgggataggggtttgtggaggggaaactggaaaggggataacatttaaaacataaataaaatatcccccaaaaaacccaccaaagaagaaataatctttattccttgaaaatattacaggtgtgatattaccattaccatgtcattgtttcggcttctaatcccactatcctttattctggatccctaaatctatgagtggccctggctttagttttcttctatgtaagaggctgtttttccccgtgttgactcttccatgggtcacttcctgatcccaatcctggtaaatttccctcatgagtccctctatcattctgttttctttctagaattctggtaattccttttagtacatttcattattccccttttgactgtttcccaaaacaatgtcctgatttatctgccaatcattttgcttccttattttagtgaacgtgtttatgtcttcctaaaattcttttaaaaaatattcatttatcaaagagctttcttgtcttgtggatgcacaatttagacatattttataatattcttttctaaatatattcttcattttatctgctcatttgattgtttgttggttttggattctacttactatgtttgaggattttcacagacatttttcacttgggagaaaaggacagagggaaactgagtgagatctccatgagtgcttggccttgtgtatttcctgtagatcttgtcttttcaaaataaagtcttgagaaagaatgtgttattttcggtcacacccatcacccaaatatacaaagctagtactgttgtatatgcagagaagaaaaattaattcttggtttacagcagaagtcctagtgctgtagaacttggtttttctatggtctgggaagaattgctttcattctaatgttttttgttttgctttgttttttcttcagtaagatgtattccacagaagttgatcttcttatcaactgtcttgagggtgtgaaataataatagtttgtagagatcataccaaaatgttcacactgaagtcagtaaagttttcctacagcctctatttactgagtaagaggccctcttcccgaacttagatggtggttctcagactagaggaaaccctcaatgtgtgtatgagttagggtttctattgttttaatagagtcaaaaggtttttgggaaggaaagggtttatttcttcttacacttcccagtaacagttcatcacttagggaagtcaggactgaaactctagcagagcagaaaccatgaggcagtaactgcagcagaagacacaggggagtactgcatgctgccctgctccttctgtctttctcaccttgctttttcatacatcccaggactaccatctgctcaggggcagggatgagggggacagcccacaatgggctgggtgcactcatatcagtcagtaggaaaatgcactagacttacagacagcaaatcttttggaggtattttctcaaatgagagtcacacttcacgaataactacaacttgtgttgaattggcaataaactagtgggaaagttgtgtgcttaaggagtgaagtcctggagtctcctatctgtagccggaaaggagattcagctaactattgcactttaaccactgtttctgccttcatttcttttcatgggccttgtgatgccctgacttccaggctccaaaactccctgcagcacagccggacttcaccagagcctactcagcattcagttctggagactgttaacttatttaacacttatacacttagaatatttctttcagatattatttctaatttcttcttcttcttcttcttcttcttcttcttcttcttcttcttcttcttcttcttcttcttcttcttcttcttcttcttcttcttcttcttctcttaaaaacaaaataaaacaaaaagaaattcttcattatttcaaggagttcagtaaggaacagaagaaaatctactatttataaccagaaagctaatcatttagacttcaaattaccttgtagtgttctatatagataagatggtctcattcttcactctcatagaaaacaattttactcctgttaattctttatcaatgaacttcaaagtgattaattctctatatctatctgtctatctacctacctacttacctatttatatatctggagtgtatttgcaagtgtgttgaatagttatacatatttatagaaaatactctagcaatattatagcttacattttcaagacaacaaatgcatttcacatttttatgtcttcttgtaagacttcttggcagaacacgtttagttatttgttttcttttacattcatgtcaagattgctacatgtcactttaaataccaatacaattttagaaggcaataatttattacctttaaactttctagagtataaataaactttaacaaactttaatttataaagattccttttgtaggcttagagctaactatattttttgttcttataaaaattttatatactacttttatgctttggcaaacagatatcataaatgacaactttctcactctttgtgataatcacttttaattttgaatctctgaatgagtctccttaagccctcccctcccctttcctcccctcccctcccctcccactcccctcccctcttctcccttcctttccctttatgattttactcacttaactgcccttctactctctacaatgccaatgttacttcattcaaatagtttttactttaatacttttatggaattattttaataatttatggaataattttgtttttgtttaacattgacttcataaaccaccatctctctaaataatagcattgttatggcttttggaattattatagctgtttgagtcttgagccattagtgcataggaacagagctctgttctttttaaagcaatttggaatatatatttgaactttccttattacatttgcaaaattactttgtggagtaggtgtcttagatcagtggcctcagagttacatcccacctacagattattatgtttagaatcttgctatatctacggctatagtctctttaaatgtaacgtagctatgtaggtgtgtaattgattatatctcaagaaactcagcacttattgtattaccaaatttacttaccctaaacaaataatttcccttttaagctgtagtttagagaacacattcgtaatgacctcatatttatactcacaattatctcatatttattggcaaagccagccaacttagaacttgttcatgaataatcaatgcataaacttagaagaatttgtttgtaagagcccaaaattctatgaatttcttgcaaaatgatgagctaaataatgttttaacacatctaacttttatttaattatgcaagatgaaagaattgataataaaagctcaagccctggttttaaatgcaatatatagatgcagtgtgtagttttaataaattaaccgcacttaatctggctaattgcagtctcacccacctccatggccagccccaagtggtagtcttgccctggttcccatgaccagatgctgccgtgttgcttgcacttcccaggccattaacccactgtggctagtcttcaggaagctcagatccctcaagccctataaaatgacaacactagagacttgtaatatcctagccagatttgtaactgcaaatttccaacactaaaatgcctgctcaaagaacacacaacttagttgatataaatacaagctgcacacctagattgttctattgtccatctatgaaatccctcgctacttgaggcttgtctaggcatgtagttctagttcatcttccttttcctccatcttctctccgtcctctgtctcatctcctcttttcttcctctctaagaatttcagctttgccttttcctttcactgcccaatcacaggctctagccttatctgaccaaaacaatattaaacaaccagaccccccccctcccacctgagctcccagggactaaaccaccaaccaaggagtacacatggctccagctgcatatgtagcagaggatggcctggtcaggcatcaatggtagaagaggttcttgatcctatgaaggctctatagatgccccagtgtaggggaattgagagaagggaggcaggagtgggtaggtgggtagaggaacaccctcgtagaagcagggggagggggatgggataagaggtttgggggagagaggaaactgggtaaggagataacacttgaaatgtaaataaattaaaataataaataaataaataaataaataaataaataaataaataaataaataaataaaattattaggaacaaaaaatatgattttacctgacctcacctgagtatgggcaccactcttgagggagcagaaaatacaaactgcaatccacaacatatagatgtaaatattttgaggtagatgtaaaacaaaggttactgagcaggtgccacacagtttttaattgccacatggtccctatgacagcagcacaactgtgctgttttgtaaatgaagccatcagaaacctgtaaataagtatactcagctgaattacaaaacacttgtttttgcctttgcttttcttaaagtgacatactaaaattggcccatggatcatagtttgccaatccttggaatagaatagtttgccatatagagataaaagtcataaaacccttaaacccagagcttatccatgtgctccaagatgactttgtggttagttagctgcccattctcatggtgactagtgatggaaagttattaaaatatgattaaaatatactaaatatgatctaacttttgttctccccttccaccaggacttatgaatctttaaaatcatatttatatatttttatgtgcatgggtattttgtctacatgtttgtgtaccttgtgtatgtctggagcacagagaggccagaagagggcatcagatctcctaagactggatttatagatggttgtgagcattcctgtgattcctgctaattgaacccaaatctctgaaaggcagccagtgctcttaaccattaagtaatctcttcagtctcatagtttctttttaactttttgcttctagtgtaagaataatgactttcatctaatctttagtattttcttcaaatcaagggtgaattaaattttggcttctcattcatatttttatgtgaacttttctttgtgggtaggagtgaatcttctctctctctctctctctctctctctctctctatatatatatatatatatatatatatatatatatatatatatatatatatacatacatgtgtgtgaatatgtatgtatatgtgtcatatatgtatgtatatatgtgtgtatatatgtatatatatatatatatatatatatatatatatatatatcataagtaactcaaaacacacacacacacacacacaccccaccaccaccaccaccaacaagtaaaaaatatccccaattaaaatgggctgtagacctgaatggaaagtttccaaaagaagatatgtgtataaagtatccaattataattatgtaaattcaaattgaaaattcattgggatttcaccttaatccagatagaatggataagatctagagaacaccatcccataatcagccaccaaacacagacactattgcatatgcgaacaagattttgcagaaaggaccctggtatagctgtctcttgtgaggctatgccagtgtctggcaaatacagaagtggatgctgacagtcatctattgaatggaacacaggacccccaatggaggagctagagaaagtacccaaggagctgaaggggtctgcaaccctataggtgggacaacaatatgaactaaccagtacccccagagctcatgtctctagctgcatatgtaccagaagatggcctagtcggccatcattgggaagagaggtcttgcaaactttatatgccccagtacagtggaattccaggaccaagaagtgggagtgggtaggtggaggagcagggaagggggagggtttaggggacttacaggatagcatttgaaatgtaaatgaagaaaatatataataaaaaaattgaaaaaaatctaaagaccaattaacaagtgctggtgaggatggggaggcaggaaaactctcattcattttgttgctgctatacaaactcctgcagtcactatggaaaccaaagtatataatccctataaaactaacaatgtatttggcatatatcataagaacatgattatctcctgaagagatacttgcttagccatgtttattactcttgtactcacagttgctctgacatggaagcagcctaactaatgaatgagtaattaaaatgtggtacatacatacatggaattctattaaatcatacaaggagaacatgaattttaatgtaaatgagtagaactgaaaaatattatacttagtaacataacccagacccctgaagacaatgttctctcttatttgtcaatcatagatccatatcctcacattagagtatataccttggagtacctttagaagccatgaacaaaaaagtaagagatgatgtaaaatggagaagttctagagagggagatagtaggtaatataaagaggggatagtgtggtaacttaggtggggagagggaaggagggcaatgtaaaggaatagggaggaaagagaggcaaataacacctctctttgatatttgaaaaaaatcacagaaaaagaaggaggaggaggaagaggaggaggaggaggaggaggaggaggaggaggaacacacttgccatgttgtctaaccactgactgtgtgaagtgattcttagagcattattgcgcagagtcacccacagcctgatttctaaatacagacattgtaattcagcaggaaaaaaaaattccaaaagacattttctgtactctggggtcagatgaaaatttccattctgtagaaatatgtctctgtatctaatgaatgctatctgccctttgccttgaacactgaaaagcagagttgttggcttaattaaggaattctaatgaaatatttacagtaatatgaagtaatcaagttatcattatttgccttgacatttggtcttttccatctaagatctttggctctgttcttccctcattcttttcatattatgtgaaatgcctcacaatgccaggataagaaaaaaaaatctttcttctttctcaggaacaacttagaaacaagaactgaatgtaactatatcgatgtgatgatgatttgtatatacttggcccaggaagtggtgctattaggaggtgtagccctgttggagtaggtctgtagtaagtgtgtcatcatgagtgtgggcttcatgacccttatcttagctctctggaaaccagccttctcctagaagccttcagatgaagatgtagaactctcagctccttctgcaccatgcctgcctggatgttgccatgtttccatcgtgatgataaaggactgaacctctgaacctgtaagccacccccaactaaatgttgtgcttaaaagagttgccttgctcatggtgtctgttcacagcagtaaaaccctaactaagacaatcaacaaagataaaattttagaaataaaaacaaaataatcacacgattcaataacacatgtatgtaatacagatttatacttatactatggtgtaagttttctataacacagggtgctgccaattagtcatggctgaggttatataaaccattgctattctggcagaatgaaaatgacctacatattctctatagacattttctcaggaatattacactagaagtatttagtgactttgtctatcttcatgtagagtgtattacatagtggaatactgaaataattgaagcaagaaagaaaactagcattttgaaaagttagtgaactagcaatcaacaaggcttcattttacaaacaagttattgcaaaatggcactcaatcatcaatggccccctgggttggtgtgtgaatatataattatgaaatattctcgcagacagagaacatttactaagcaaaaatgtttaataactgtaatcagaataaaattgttatataacttcatagttcaattctctgtgacagacaagtatttgtttcccacttaggaaacaggcatttggagttgaggattaggcagtggtagaacaatttcctagcaaaatcaaggcctttagttggaaaacccataaataaacttttaatagctccaagcaatacagacatttgacattttttttcttgcttaggtgctaagtaaactaaatagtaaaatctaattgctgaagacacactctctctccatatgatttcatcttatagagctagaagctttctccttgctagctagttttgatactcctggaagatgttatctagtttacttacccagatgtaagccatgtggactgtgactgccatgccaataatatggatctacagggacaatagttattttattgttatggaagtaaccaaatgctctccaattaaatttttaagtcctactccacaggaaaaatccatccctaatatgtagatctagtacaatattcctgacccctctgcatttctctcatgtctcttctatatctgatctggtcccccttttatctatcccctcccattcttcctcacaggtccctctctctctgtacctcccatgattaattttttccctcttctaagtaggattgaagcatctacagtttggtcttccttcttgttaaggttcatatagtctgtatgttgtactgagggtattctgagcttttgggctaataccttcatatcagtgattatataccatgtgtgtccttttggttctgggtggtgttttctagttccaaccatttgtctgcaaaattcatgaagttgttctttgtaatatctgagtagtgcaccgttgtgtaaatgtaccatattttcagtatccattcctctgttgaggaacatctggtttgtttctagtttctggctattacaaataaggtttctatgaatctgtgtccttgttatatgttatatgttggatcctatagcccagtagctatagagctgggtttcaagcagaactctttccagttttctgaagaacagacagatgggttgcaaaactggttgtagcaggttccaatcccaccagcgatggaggggtgttccttttttcacatccttgccagaatctgctgtcacctgagttttttgatcttagccattctgattggtgtgaggtggaatctcaatttgatttgcatttccctgatgactaaggatgttgaacctttttaaagggctttttggccatttgagattcctcagttgaaaattcattgcttatccctgtaccccatttttaatagggtcatgtggttctctagagtctaacttcttgagttctttgtatattttggatattgccctctatcgaatgtagggtagataaagattttttcccaatctgtgggttgccattttgttttttgttttttgttttttgttttttgttttttgtttttttgacagtcttttcttttcttttcttttttcttttcttttctcttcttttctcttctcttctcttctcttctcttctcttctcttctcttctcttctcttctcttctcttctcttcttttcttttcttttcttttcttctttctttatttgccttacagaaccttttcaatttcatgaggtcctatttgtcaaatgttgatcttagagcctaagccattggtgctctgttcaggaaattttcccatgtgccaatgtgtttgaggctctttccaacattttcttctattagattcagcgtatctgtttttgtgtgaaagtccttgttccacttgagctttgtacagagagataaaatggatcaatttgcactcttctacaggcggaccaccagttgaaacagcatcatttattgaaaatgccttatttttttttcactgatgattttggcttctttgtcaaagatcaagtgaccattggtatgttggttaatttctcagtcttcaattcttttccattgatctacctgtttgtttctataacaataccatgtgctttttaatcactattgctctatagtagagcttgacatcagggatggtgatttcccaggaacatcttttattgttgaaaaaaaattttttttgtttcttgtttcttttttttgagacagggtttttctgtgtagccctggctgtcctggaactcactttgtagaccaagctggcctcgaactcagaaaacttcctgcctctgcctcccgagtgctgggattaaaggtgttttgctatcctgggttttttttttttttttttttttttttttgttatgatgaagttcagaattgctctttctatatctgtgaagaattgaactggcattttgatggtgattgcattgaatctgtagatggctttcggtaagatggccatttttgctatgttaattctgcagtcatgagaatgagagatctttctatcttctgatgtcttcttccatttctttctttagaaatttgcagttcttgtcatacagatctttcagttgcttggttagttacaccaaggtactttacattatttgtgactattgtgaagtgtgttttttccctaatttctttctaagactgtttaacctgtggggagtttgtcaggctcacatttctgtatcactcttcatcacctaagtaagtcaggttaggaactcaagcagggcaggaacctgtaggtaggagctgatgtagaggccatggagaggtgctgctcactcacttgttcccatggtttgctcagcttgctttctcatagaacccagagccacatgactagagattgcactgcccacaatgggctggaacttctcccatcaatcattaattaaaaaaaaaaaaattcttatcatcttgcctacagcctgatcttatggatgcaacttctcaattgaggtcacccctaacttctctggcttgtgttaagttgacatgattagccagcctcccctccccaagaaagggcacaaacatcattattttcttcaagaaagaatgtcaattgcatgctgtgagaccattagtagtgtagttcattataatccaatttaaatttttttcagttatatcaataatctgacatagctgtgctttgttcagagactattcttcattagttatacccttgcttcctaaatatgccgcttgctcttctctggatggcacatgttattcaaataacttctttccaagtagtttgttctagatcctatcatctacttttgacactcaatatgcaaaaataccaggctcatttctttttcaactacttttcatcacaatatcagttcttaaataactcctaggaacttctataatatacagttttttttccagatttttgtagaacatcatttgattcttattttctgaagtccatgtgctttatgtgctatatcctgtgctattatatatgtgatttaattctttactgtagattctgcatagcagtatcgctaaaatcttatgcttaattacaagttttatttttttttttgataagtggctctttgaaccaggataaatctatttgtgttccagtttctccatctgtaataaagcaaagaaactgtttcatttgttaatattattttcaagccactaaaaatatcttctgactgtagtgaatggaacacattgttttatgcatttttttttcttgacacattgatctattggccaaccttacatcacacttttatttgtaatggttgtccttcataactaatgaaggagttgttaagaatacttaaaatcaagaaggatagagtttacattcttttatcctatccctgtacctgcatatacatattattatgtagtattccttttctgtcatatgtaaaatcagagtgccaaggctggatgaacatttcaatggaatgattctaggacaccactttagcttcaccagatgtagtaaagtgttttatgaaaattatacttgggtacttttcccatagcacagttagatgcatcaaatctggaattatttataagagcagaaatctaagtggtcttttcaacccactgaatctttcttctctaccttaacccattgctattaatacagtcctgatatcagttatttttagactcagaatgctatcttttctcttatcatgtggagagaataattcatggtcattctcaagatatcataatttacttttcagaactgttgtgcttatgattctttaagctgtaaaatggagggaaattttattcaaatattggtcttatatttaatgtatctgtgctgttagtgactcctttacaattttaaatggttctaaacaaaactttattaaaaatatttcaccagactcgagccccgggcttccttgccagcggagttgcctgacacccgcaagggcccacacaggattccccacgggatcctaagacctctggtgagtggaacacagcgccggccccaatccaatcgcacggaacctgagactgcagtacatagggaagcagactacccgggcctgacccggggcaaaagccccttcctctccactcgagccccgggcttccttgccagtggagtcgcctgaaacccgcaagggcccacacaggattccacaagggatcctaagacgtctagtgagtggaacacaacttctgccaggagtcctgttcgaacaccagatatctgggtaccttccctgcaagaagagagctttcctgcagagaatactctagccactgaaactaaggagagtgctaccctcccagttctgcttatagaggctaacagagtcacctgaagaacaagcttttaacagagacaactataacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggactttcataagtcacttaaagaattacaggagagcactgctaaagagttacaggcccttaaagaaaagcaggaaaacacagccaaacaggtagaagtccttaaagaaaaacaggaaaacacatccaaacaggtaatggaaatgaacaaaaccatactagaactaaaaagggaagtagacacagtaaagaaaacccaaagcgaggcaacgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcttaactcaaaacatccaggaaatccaggacacaatgagaagaccaaacctacggataataggaattgatgagaatgaagattttcaacttaaagggccagctaatatcttcaacaaaataattgaagaaaacttcccaaacataaagaaagagatgcccatgacatacaagaagcctacagaactccaaatagactggaccagaaaagaaattcctcccgacacataataatcagaacaacaaatgcactaaataaagatagaatattaaaagcagtaagggaaaaaggtcaagtaacatataaaggaaggcctatcagaattacaccagacttttcaccagagactatgaaagccagaagagcctggacagatgttatacagacactaagagaacacaaatgccagcccaggctaatatacccggccaaactctcaattaccatagatggagaaaccaaagtattccacaacaaatccaaattcacacaatatctttccacaaatccagcccttcaaaggataataacagaaaagaagcaatacaaggacggaaatcacgccctagaacaagcaagaaagtaatccctcaacaaacaaaaagaagacagccacaagaacagaatgccaactctaagaacaaaaataaaaggaagcaacaattacttttccttaatatctcttaatattaatggactcaattccccaataaaaagacatagactaacagactggctacacaaacaggactcaacattctgctgcttacaggaaacccatctcagggaaaaagacagacactacctcagagtgaaaggctggaaaacaattttccaagcatatggtctgaagaaacaagctggagtagccattctaatatcggataaaatcgacttccaacccaaagttatcaaaaaagacaaggagggacacttcatactcatcaaaggtaaaatcctccaagaggaactctcaattctgaatatctatgctccaaatgcaagggcagccacattcattaaagacattttagtaaagctcaaagcacacattgcacctcacacaataatagtgggagacttcaacacaccactttcatcaagggacagatcgtggaaacagaaactaaacagggacacagtgaaactaacagaagttatgaaacaaatggacctaacagatatctacagaacattttatcctaaaacaaaaggatataccttcttctcagcacctcacgggaccttctccaaaattgaccatataattggtcacaaaacaggcctcaacagatacaaaaatattgaaattgtcccatgtatcctatcagaccaccatggcctaagactgatcttcaataacaacataaataatggaaagccaacattcacatggaaactgaacaacactcttctcaagtttgataccttggtcaaggaaggaataaagaaagaaattaaagactttttagagtttaatgaaaatgaagccacaacgtacccaaacctttgggacacaatgaaagcatttctaagagggaaactcatagctctgagtgcctccaagaagaaacgggagagagcacatactagccgcttgacaacacatctaaaagctctagaaaaaaaggaagaaaattcacccaagagaagtagacggcaggaaataatcaaactcaggggtgaaatcaaccaagtggaaacaagaagaactattcaaagaattaaccaaacgaggaattggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggttatactcaacaaaactggaaaacctggacgaaatgtacaaatttctggacagataccaggtaccaaagttgagtcaggatcaagttgaccatctaaacagtcccatatcacctaaagaaatagaagcagttattaatagtctcccagccaaaaaaagcccaggaccagacgggtttagtgcagagttctatcagaccttcaaagaagatctaattccagttctgcacaaactatttcacaaaatagaagtagaaggtactctacccaactcattttatgatgagactattactctgatacctaaaccacagaaagactcaacaaagatagagaacttcagaccaatttctcttatgaatatcgatgcaaaaatcttcaataaaattcttgctaaccgaatccaagaacatattaaagtaatcatccatacttaccaagtaggttttattccaggaatgcagggatggtttaatatacgaaaatccatcaatgtaatccattatataaacaaactcaaagacaaaaaccacatgatcatctcgttagatgcagaaaaagcatttgacaagatccaacacccattcatgataaaagttttggaaagatcaggaattcaaggcccatacctaaacatgataaaagcaatcttcagctaccagtagccaacatcaaagtaaatggagagaagctggaagcaatcccactaaaatcagggactagacaggctgcccactttctccctaccttttcaaaatagtacttgaagtattagccagagcaattggacaacaaaaggagatcaaagggatacaaattggaaaagaggaagtcaaaatatcactttttgcagatgatatgatagtatatataagtgaccctaaaaattctaccagagaactcctaaacctgataaacagcttcgttgaagtagctggatataaaataaactcaaacaagtcaatggcctttctctatacaaagaataaacaggctgagaaagaaattagggaaacaacacccttctcaatagtcacaaatagtataaaatatcttggcgtgactctaactaaggtggtgaaagatctgtatgataaaaacttcaaatctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattagaaggagcaatttgcaaattcatctggaataacaaaaaacctaggatagcaaaaagtcttctcaagaataaaagaacctctggtggaatcaccatgccagacctaaagatttactacagagcaattgtgataaaaactgtatagaaacagacaagtagaccaatggaatagaattgaagacccagaaatgaacccacacacctatggccacttgatcttcaaaaagggagctaaaaccatccagtggaagaaagacagcattttcaacaattggtgctggcacaactggttgttatcatgtagaagaatgcgaatcaacccatacttatctccttgtactaaggtcaaatctaagtggatcaaggaacttcacataaaaccagagacactgaaacttatagaggagaaagtggggaaaagccttgaagatatgggcacaggggaaaaatcctgaacagaacagcaatggcatgtgctgtaagatcgagaattgacaaatgggacctaatgaaactccaaagtttctgcaaggcaaaagacaccgtcaataagacaagaagaccaccaacagattgggaaaggatctttacctatcctaaatcagataggggactaatatccaacatatataaagaactcaagaaggtggacttcagaaaatcgaacaaccccattaaaaaatggggctcagtactgaacaaagaattctcacctgaggaataccgaatggcagagaagcacctgaaaaaatgttcaacatccttaatcttcagggaaatgcaaatcaaaacaaccctgagattccacctcacaccagtcagaatgcctaagatcaaaaattcaggtgacagcagatgctggcgtggatgtggagaaagaggaacactactccattgttggtgggattgcaggcttgtacaaccactctggaaatcagtctggcggttcctcagaaaattgggcatagtactaccggaggatctagcaatacctctcctgggcatttatccagaagatgccccaactggtaagaaggacacatgctctactatgttcacagcagccttatttataatagccagaagctggaaagaatccagatgcctctcaacagaggaatggatacagaaaatggggtacagctacacaatggagtactactcagctattaaaaagaatgaatttatgaaattcctagccaaatggatggacctggagggcatcatcctgagtgaggtaacacattcacaaaggaactcacacaatatgtactcactgataagtggatattagccccaaacctaggattcccaagatataaggtaccatttgctaaacacatgaaactcaagaagaatgaagactgaagtgtggacactatgcccctctttagaattgggaacaaaacacccatggaaggagttacagagacaaagtttggagctgagatgaaaggatggaccatgtagagactgccatatccagggatccaccccataatcagcatccaaaggctgacaccattgcatatactagcaagattttatcgaaaggacccagatgtagctatctcttgtgagactatgccggggcctagcaaacacagaagtggatgctcacagtcagctaatggatggatcacagggctcccaatggaggagctagagaaagtacccaaggagctaaagggatctgcaaccctataggtggaacaatattatgaactaaccagtaccccggagctcttgactctagctgcatatgtatcaaaagatggcctagtcggccatcactggaaagagaggcccattggacacacaaactttgtatgccccagtacaggggaatgccagggccaaaaagggggagtgggtggttaggggagtgggggtggtcgggtatgggggacttttggtatagcattggaaatgtaaatgagctaaatacctaataaaaatggaaaaaaaatttcaccagtttggaatcctataaactattttgtttccacatataaaaatatcaatcatagttgcatagtgattaagaacatctttatatattctattatttgttgttagcttatttttgttcattgtcacattaaattggatgcaaataaaatttacagaatcatagaaaacagcctccccccaatgtataaacattgacagatatttatgtcagtcctcttaagtcattgtctagtccctaaatgcaatttatggggtatatgtatgaatgtctatgcatctgcgtgcattgctttaattttgtttgtctatttttgctaaaactaagaatgatttaatgagagaggaagcagtcttactaaatgttccagataggtcttgtcttttccactttacttagtgactttaactggcagaaaattctataggatacactatcaccaataaaatatatttacctgcatggctatattttttgtttttgtttttttaaattaaaacacccaatatgctaagaaaatgaaggcttagcttcctttgagcaacacacatccttgggccagttaagcatcccatatattatatttatgtaataaacaggtatctttttccttttttattagatattttgttcatttacctttcaaatgctatcctatttcctggtttctactctgaaaaccccctttctcattcccctgcctttgctcactagccaacctactcccactccccagtcctgggattctcttacactggggcatccagtcatctcaggaccaaggcctctcttcccattgatgtccaacaaggccatcctctgctacatttgcagctgaaatcataggtccatccatgtatactctttgattggtgatttagtccctgggagctcttggggtactggttggttcatgttgttgttccttcaatggggctgcatgctccttcagctcctttggtactttctgtagcttctccattggggatcttgtgctcagtccaatggttggctgagagtatccacttctgtatttgtcaggcactagcagagcctctcagctatatcaggttcctgtcagcaagcacttgttggcctccacaatagtatctggatttggtgtctatatatggggtggggctgactctagtctttcctttagtttctgctacatactttgtctctgtacctcatcccataagcatttcattcttcattctacaaaggaccaaagtattcatactttggtcttccttctttttgagcttcagttggtctgtgaattgtatgttgggtattccgagtttctgggctaatatccacttaaaagtgaaggtatcatgtgtgttcttttgtgattggattaccttgctcatgatgatattttctagttccatccatttgcctaagaatttcatgaattcattgtttttaacagctgagtagtattccattgtgtaaatgtaccacattttctatatccatttctctgttgagggacatgtgggttctttccagcttctggcttttataaatatggctgatatgaccatagtagaacatgtgtccttatttcctgttgaagcatattctgggtatatgcccaggagtggtattgctgggtcctcaggtagtactatgcccaactttctttgtgtggttatcttcttttgggtttttgaaagaagattattttcttgctttttctagggtgtagtttccctccttgtattggcggtttccatctattatcctttgtagggttaaatttgtggaaagatgtgtaaatttggttttgtcatggaatatcttggtttttctatctatggtaattgagagttttgctgggtatactagtttaggccagcatttttgttctcttagggtgtacatgaaatctgcttaggatcttctaactttcatagtctttgctgagaagtctggtgtaattctgttaggtctgcctttacatgttaattgacctttttcccttactgcatttaatattctttctttgttttgtgcatttggtgttttgattattatgtgactggaggaatttcttttctggtcaaatctatttggagttctctaggcttcttgtatgttcatgggtatgtctttctttaggctagggaagttttcttctataattttattgaagatatttactgacccttttatttgggaatcttcactcttttctatatctattatttttaggtttggtcttcccattgtgtcctggatttcctggatattttgtattgagaactttttgcatcttgtattttctttgactgttttgtcaatgttttctatggtatcttctgcacctgagattctctcttctatctcttagagtctgctggcaatgctttcatctgtgactcctgatttctttcctaggtttttctatattcagtgttgtctccctttgtaatttctttattgttcctattttcattttttttttttgatcctggatggttgttcagttcattcacatgcttggttgtattttactgtaattctttaagggattttttttgtttcctcttaaaggtcttctacctgtttacctgtgttctcttctatttcgttaagggagttatttatgtccttcttaaattcctttaacatcatcatgagatgtgattttaaatcagagtcttgctttgattgttgttttagggtaaccagggcttgctgttgtgggacaactgtgttctgatgataccaagtagccttggtttttgtggcttatgttcttgtgcttgcctctcaccatctgattatctctagtgttagctgttctttctgtctctgactgtggcttctctgtcctgaaatctatttgacagtactcctgggagaccaggtctctcctagaggaatttacatatggagagttgtggtatagggtcagctctggtgtgcagagagagtccagaaagattctgtccccagctgatccttggttcctgtgtcctgatggctctttggggtgtcccttgggccaggaatttgaagagaagtggtggtcttttctgtgctcacaggtgtttaggcacttctgggagaccagctctcttctggcggtatttatgtatatagctcaggatcagatctggacacagatggaaactggaagattcctgtctcaggcagctccttggttcatatgtcctgagggtcctggcagtttcctctgagtagcagtggtagttctacctgtgctcacaggtctgcctgcactcctgagaggctagcttcctcctggcactacttggttatggagccctgtggcaaaggatctgctccaggcaccataaactgctattttggtttttttaaatcataaaatgaagcaataattctgcctattttacaatataaggtaatcaatattcagcagaaatagttattatcccgagttaaggcaaattatttcacactattgggctgatcaattttatgtcaacttagtataaactacatgtcaatttggaagaaactcagttgagaaaattcccccactaggaggtgtggccaagactgtgattcattttctttattgatggttgatatgagaagatccaggttactaagctttgctctatcctcctgcatgtagtcctggttgctataacagagctataatgagcaagccagtaagcagccctcttctatggcttctgcatcagtccctgcctccagatctttggactgcttgattttctgccctcactccttaccatgatggactgtgatgtagaagtggaagtgagataaaatgtctcctttccaagttgctttgtgtcatagtgatttgtcacaacaacaaaaatattaactaagacaattgtaaatatagattgctaatgaatagagttaacttcaaatatcttcaaatcagaggggttgattatctcgtctatgcatttatcacatttatgagatctcaaacattattcctgacaataattagaagcagtacttgaacaaaagaaaaattgatttcggtgaaaacagcacacatatcactccttgaataatcataacagctaaacttataattaagtaggcagttcagaagcatttctatgcagtgtcactaacccagactggtcttctatgctgattatctcattgtctatttatgaaagcaagatgtaaccttcgaggcttataattagtcattaaagttgaataattaattcttcttttgcaacagaatctttctgtagaaaaaggataatgatgctgctcaacatgactaagaataaaagttgaatctagtttatgacattttgtcattgaattcttgcccattgaataacagcacacttagacaagactcaagactaatatatatttatatatacaaaaatagtaaacacatatgtgtacatactagatcaatttgaagagttgaaaactattgtttcatatgtcagctgtctagaggatactaacagctggttctaaagacacattcatcttattgaaggaagtattaccagcatggggcaaataagatggagaaattattaaatagtccttcttttatactgatatggttctgaaagttttgtgtgttttatatccttaactaccctaggtttcattgtttccctgtgtagtagacattatcataaactctgtgaactgccagaagaaatgcattgaatggtcattaaacttgcctaatctagccatgtctgaaaggagtgaagccaaattccagcctgcaagttgtctggatccaacacaactctacccatgaacacttggaactttgcctttctcagtcaccagaatgtgtccagctcatattctcatggtgtccattctcagtaaatgtttgatggcctcagtgttaatgtttaaagtgtcttgtaatataaaagaagcagaaatacgtggatagtatgatgataaagatatacttttaaaccatgctaacatatctttgtttttgtatggatttaataaatcctatggatagttttaaaaaatctttaatttcatcttcccagatacacacagagatttgctttctctgaaacaagctattgattttatcttcagttttctgtttattaaatgtttaccacacacatgatttatatttttgaaatatttacatatgcttttggcctgttctgttaattcctttgtattttacttcatttttacatatttccttgaggtcctgggtactgtatataggacttcatgcatgttagccaaggtaagtctctaagctgtagcctagtcctcacataccttttagaatatgaaacaaattctcactaagtcactgagactggactttaacttactctctagactctattgttgtctttctattttttaaattggttattttatttatttacatttccaatgttatcacccttcccattttaccctccacaagccttctataccctcctccaacccccagccattatgaaggttctctcccacccacccaccccctcgtgcctcagcggcctagtgtttccctatcctgggtcttcaaccttccacaggaccaaggagctcccctcccagtcatgtcagataaggcagtcctctgctacatatccgtatgaagctataggtatcccctatgtatttttggttggtgttttagtccctgggagctttgggtaactggttggttgatattgttcttcctatgaggttacaaactgcttcagctcctacagtccttgccttaacttacccattggggaccctgagctcagtccaatgtttaactgcgtacatccacatctgtattgattaggctctggtagagcctctcaggggacagctataatgggctcttgttacttaccacttcttggcacaagcaacagtgtctagggtttgcgtcagcagatgggatggattcctaggtggggcagtctcttgcaaactaaatccaagaacacatgagaattatcattcactataatcaagtaggttacataccaggaatgcagggataattcaatatacagaaatccatcaacataatccactatataaacacactcaaataaaaaaaatattatgtggtcatctcattagatgctgaaagaaaacctttgacaaaatacaacaccccttcattctataagtactggagaaaataggaattcaaggtccatacctaaatataaaaaaaaagcaatatacagcatgacaatagccaatatcaaacaaaatggagagaaatttgaagcaagaccactaaaatcagggacaataccaagttgcccattatcccctgatctattcaatatagtcctcgaagttctagacagagcaattaggcaacaaatggagatcaaagggatacaaattggaaaggagaaagtcaagatatcactatttgcagatgatatgatagtatacataagtgacccaaaacaatccatgacttttccccactttctcctctataagtttcagtgtctctggttttatgtgaagttccttgatccacttagatttgaccttagcacaaggagataggaatggatcgattcgaattcttctacatgataacaaccagttgtgccagcaccaattgttgaaaatgctgtctttcttccactggatggttttagctcccttgtcaaagatcaagtgaccataggtgtgtgggttcatttctggatcttcaattctattccattggtctacttgtctgtctctaccagtaccatgcagtttttatcacaattgctctgtagtaaagctttaggtctggcatggtgattccaccagaagttcttttatccttgagaagactttttgctatcctaggttttttgttattccagacgaatttgcaaattgctccttccaattccttgaagaattgagttggaattttgatggggattgcattgaatctgtagattgcttttggcaagatagccatttttacaatgttgatcctgccaatccatgagcatgggagatcatcttctgagatcttctttaatttctttcttcagagatttgaagtttttatcatacagatctttcacttccttagttagagtcacgacaagatattttatattatttgtgactattgagaagggtgttgtttccctaatttctttctccgcctgtttattctttgtatagagaaaggccattgacttgtttgagtttattttatatccagctacctcaccgaagctgcttatcaggtttaggagttctctggtagaatttttagggtcacttatatatactatcagatcatctgcaaaaagtgatattttgacttcctcttttccaatttgtatccacttgatctcctttttttgtcgaattgctctggctaatacttcaagtacaattttgaaaaggtagggagaaagtgggcagccttgtctagtccctgattttagtgggattgcttccagcttctctccatttactttgatgttggctactggtttgctgtatattgcttttatcatgtttaggtatgggccttgaattcctgatctttccaaaacttttatcatgaatgggtgttggatcttgtcaaatgctttttctgcatcgaatgagatgatcatgtggtttttgtctttgagtttgtttatataatggattacattgatggattttcgtatattaaaccatccctgcattcctggaataaaacctacttggtcaggatggatgattgctttaatatgttcttggattcggttagcaagaattttattgaggatttttgcatcgatattcaaaagagaaattggtctgaagttctctatctttgttgggtctttctgtggtttaggtatcagagtaatagtggcttcataaaatgagttgggtagcaggcttcctggccagcggagttgcctgacacccgcaagggcccacacaggattccccacgggatcctaagacctctggtgagtggaacacagggccggccccaatccaatcgctcgggacctgagactgcggtacatagggaagcagactgcccgggcctgacccggggcaaaagccccttccactccactccagccctgggcttccttgccagcagagtcgcctgacacccgcaagggcccacacaggattccccacgggatcctaagacctctagtgagtggaacacaacttctgccaggagtccggttcgaacaccagatatcggggtaccttccctgcaagaagagagcgttcctgcagagaatactctacccactgaaaccaaggagagtgctaccctcccaggtctgcttatagaggctaacagagtcacctgaagtacaagctcttaacagagacaactataacagctagcttcagagattaccagatggcaaaaggcaaacatacgaatcctactaacagaaatcaagaccactcaccatcatcagaacgcagcactcccaccccacctagtcctgggcaccccaacacaaccgaaaatctagacccagatttaaaagcatttttcatgatgatgatagaggacatcaagaaggactttcataagtcacttaaagaattacaggagagcactgctaaagagttacaggcccttaaagaaaagcaagaaaacacagccaaacaggtagaagtccttaaagaaaaacaggaaaacacatccaaacaggtaatggaaatgaacaaaaccatactagaactaaaaagggaagtagacacagtaaagaaaacccaaagcgaggcaacgctggagatagaaaccctaggaaagagatctggaatcatagatgcgagcatcagcaacagaatacaagaaatggaagagagaatctcaggtgcagaagattccatagagaacatcgacacaacagtcaaagaaaatacaaaatgcaaaaggatcttaactcaaaacatccaggaaatccaggacacaatgagaagaccaaacctacgcataataggagtggatgagaatgaagattttcaactcaaaggaccagcaaacatcttcaacaaaataattgaagaaaacttcccaaacataaagaaagagatgcccatgatcatataagaagcctacagaactccaaatagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggaaagatgttatacagacactaagagaacacaaatgccagcccaggctactatacccggccaaactctcaattaccatagatggagaaaccaaagtattccacgacaaaaccaaattcacacaatatctttccacgaatccagcccttcaaaggataataacagaaaagaagcaatacaaggacagaaatcacgccctagaacaaacaagaaagtaatccctcaacaaaccaaaaagaagacagccacaagaacagaatgccaactctaacaacaaaaataaaaggaagcaacaattacttctccttaatatctcttaatatcaatggactcaattccccaataaaaagacatagactaacagactggctacacaaacaggacccaacattctgctgctttaaggagacccatctcagggaaaaagacagacactacctcagagtgaaaggctggaaaacaattttccaagcaaatggtctgaagaaacaagctggagtagccattctaatatcggataaaatcgacttccaacccaaagttatcaaaaaagacaaggagggacacttcatactaatcaaaggtaaaatcctccaagaggaactctcaattctgaatatctatgctccaaatgcaagggcagccacattcattaaagacattttagtaaagctcaaagcacacattgcacctcacacaataatagtgggagacttcaacacaccactttcatcaagggacagatcgtggaaacagaaactaaacagggacacagtgaaactaacagaagttatgaaacaaatggacctaacagatatctacagaacattttatcctaaaacaaaaggatataccttcttctcagcacctcacgggaccttctccaaaattgaccatataattggtcacaaaacaggcctcaacagatacaaaaatattgaaattgtcccatgtatcctatcagaccaccatggcctaagactgatcttcaataacaacataaataatggaaagccaacattcacgtggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctctgagtgcttccaagaagaaacggggaagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattgaccaggcaaggagttggttctttgagaaaatcaacaagatagataaacccttagctagactcactagaggacacagggacaaaatcctaattaacaaaatcagaaatgaaaagggagacataacaacagatcctgaagaaatccaaaacaccatcagatccttctacaaaaggttatactcaacaaaactggaaaacctggacgaaatggacaaatttctggacagataccaggtaccaaagtggagtcaggatcaagttgaccatctaaacagtcccatatcacctaaagaaatagaagcagttattaatagtctcccagccaaaaaaagcccaggaccagacgggtttagttcagagttctatcagaccttcaaagaagatctaattccagttctgcacaaactatttcacaaaatagaagtagaaggtactctacccaactcattttatgaagccactattactctgatacctaaaccacagaaagattcaacaaagatagagaacttcagaccaatttctcttatgaatatcgatgcaaaaatcctcaataaaattcttgctaaccgaatccaagaacatattaaagcaatcatccatcctgaccaagtaggttttattccaggaaagcagggatggtttaatatacgaaaatccatcaatgtaatccattatataaacaaactcaaagacaaaaaccacatgatcatctcattcgatgcagaaaaagcatttgacaagatccaacacccattcatgataaaagttttggaaagatcaggaattcaaggcccatacctaaacatgataaaagcaatctacagcaaaccagtagctaacatcaaagtaaatggagagaagctagaagcaatcccactaaaatcagggactagacaaggctgcctactttctccctaccttttcaacataatacttgaagtattagccagagcaattcgacaaaaaaaggagatcaagtggatacaaattggaaaagaggaagtcaaaatatcactttttgcagatgatctgatagtatatataagtgaccctaaaacttctaccagagaactcctaaacctgataagcagcttcggtgaggtagctggatataaaataaactcaaacaagtcaatggcctttctctatacaaagaataaacaggcggagaaagaaattagggaaacaacacccttctcaatagtcacaaataatataaaatatcttgtcgtgactctaactaaggaggtgaaagatctgtatgataaaaacttcaaatctctgaagaaagaaattaaagaagatctcagaaaatggaaagatctcccatgctcatggattggcaggatcaacattgtaaaaatggctatcttgccaaaagcaatctacagattcaatgcaatccccatcaaacttccaactcaattcttcaacgaattagaaggagcaatttgcaaattcatctggaataacaaaaaacctaggatagcaaaaactcttctcaaggataaaagaacctctggtggaatcaccatgcctgacctaaagctttactacagagcaattgtgataaaaactgcatggtactggtatagaaacagacaagtagaccaatggaatagaattgaagacccagaaatgaacccacacacctatggtcacttgatctttgacaagggagctaaaaccattcagtggaagaaagacagcattttcaacaattggtgctggcacaactggttgttatcatgtagaagaatgcaaatcgatccatacttatctccctgtactaaggtcaaatctaagtggatcaaagaacttcacataaaaccagagacactgaaacttatagaggagaaagtggggaaaagccttgaagatatgggcacaggggaaaaattcctgaacagaacagcaatggcatgtgctgtaagatcgagaattgacaaatgggacctaatgaaactccaaagtttctgcaagggaaaagacaccgttaacaagataaaaagaccaccaacagattgggaaaggatctttacctatcctaaatcagatagggggctaatatccaacatatataaagaactcaagaaggtggacttcagaaaatcgaacaaccccattaaaaaatggggctcagaactgaacaaagaattctcacctgaggaatactgaatggcagagaagcacctgaaaaaatgttcaacatccttaatcatcagggaaatgcaaatcaaaacaaccctgagattccacctcacaccagtcagaatgcctaagatcaaaaattcaggtgacagcagatgctggcgtggatgtggagaaagaggaacactcctccattgttggtgggattgcaggcttgtacaaccactctggaaatcagtctggaggttcctcagaaaattggacatagtactaccggaggatccagcaatacctttcctgggcatttatccagaagatgccccaactggtaagaaggacacatgctccactatgttcatagcagccttatttataatagccagaagctggaaagaacccagatgcccctcaacagaggaatggatacagaaaatgtggtacatctacacaatggagtactactcagctattaaaaagaatgaatttatgaaattcctaggcaaatggatggacatagagggcatcatcctgagtgagataacacattcacaaaggaactcacacaatatgtactcactgataagtggatattagccccaaacctaggatacccaagatataagatacaatttgctaaacacatgaaactcaagaagaatgaagactgaagtgtggacactatgcccctccttagatttgggaacaaaacacccatggaaggagttacagagacaaagtttggagctgagatgaaaggatggaccatgtagagactgccatatccagggatccaccccataatcagcatccaaacgctgacactattgcatatactagcaagattttatcgaaaggacccagatgtagctgtctcttgtggactatgccagggcctagcaaacacagaagtggatgctcacagtcagctaatggatagatcacagggctcccaatggaggagctagagaaaatagccaaggagctaaagggatctgcaaccctataggtggaacaacattatgaactaaccagtaccccggagctcttgactctagctgcatatgtatcaaaagatggcctagtcggccatcactggaaagagaggcccattggacacgcaaactttatatgccccagtacaggggaacgccagggccaaaaagggggagtgggtgtgtaggggagtgggggtgggtgggtatgggggacttttggtatagcattggaaatgtaaatgaggtaaatacctaataaaaaatggaaaaaaaaccaaaaaaaacaaaaaaaccaatccatgagggaactcctacagctggtaaacaacttcagcgaagtggttggatgcaaaactgactcaaacaaatcagtatctttcctctaaccaaaggataaattggctgagaaagaaattagagaaacaacaccttttacaatattcacaaataatataaattactgtggtgtgactataaccaagcaagtgaaagatctatatgacaagaacttcaaatccctgaaaagagaaatcaaagaagacctcagaagatggaaacatctcccatgctcatgcataggcaggattaacctagtaaaaatgaccatcttacctaaagcaatctgcagattcaatacaatccccatcaaaattccaactcaattcttcacagagatagaaggaacaattctcaaatttatctagaataacaaaaatcccagtatatcagaaaccattctcaacaataaaagaacttccgggggaatcaccatccctgacctcaagctatactgtagagcaatagtgataaaaacctcatagtattgatacagagacatacaggtagatcaagggagtagaactgaagattcagaaatgaacccacacacctatagtcacttgatctttatcaaaggagcccaaaccattcagtggataaaagggcattttcaacaaatggtgatgtttcaactggtggtcaacatgtagaagaatgtaaatggatttattcttatatacttgtacaaagctcaattccaagtggatcaaggtcctcaatataaaaccagatatggtgaatctaatagaaaaaaaaagtgggaaagaatctcaaacacattagcacagagaaaattttctgaacagaacaccaatggcttatgctctaaaatcaagaattgacaaatgggtcatcataaattgaaactcttctataaggcaaaggacactgttagcaggacaaaactacaatccacatattgggaaaaaaatctttaccaatcttacatctgatagagggctaatatcagaaatttactaagaactcaagaagaaagactgctgagaaacaaatatccctattaaaaatggagtatagagctaaacagaaaattttcaacaggggaatcttaaatggctaagaatcacttaaagaaatgttcaacatccttagtcatcagggaaatgcaaatcaaaacaaccctgagattctaccacaccagtaagaatggctaagatcaaaaactcagataacagcagatcctggtaagaatatggagaaagaggaacactcctccactgcttgtggaattccatgctggtacaaccgctgtgtaaatctgtctggtggttcctcagaaaagtggacatagttctacctcaggaccagctatagaatgttagacgtagttctatctaaggacccagctgtatcactcctgggcatatacccaaaagatactccaacatatcacaagaatacatgctctactatgttcaaaacagtcttatttataatagctagaagctggaaacagcccagatgtccctccacagaggaatgtatacagaaaatgtggtacatttatacaatggaatactactcagattttaaaataatgatttcatgaaatttgcaggcaaatggatgtaccccaatctcccttacttcacagtcttcctatgtctgctccctatacttgtggcattcccttgccccaacaaaaacagtttaaaaaggagaataatttgtgctgttcatataatcaaccattttagcatggtcaaactcccagggacagcctcttaaagatagtaagttcttcccttctcccacccctgccagttgctatctattgtagagagctacacctcagtttcttcatcacaattttttttatgtttgtttgtttttttaattaatattttttattacatattttcctcaattacatttccaatgctatcccaaaagtcccccataccctcacccccacttccctacccactcattcccattttttttggccctggcgttcccctgtactggggcatatacagtttgcgtgtccaatgggcctctctttccagtgatggccaactaggccatcttttgatacatatgcagctagagtcaagagctccggggtactggttagttcagaatgttgttccacctatatggttgcagatccctttcgctccttgggtactttctctagctcctccattgggagccctgtgatccatccattagctgactgtgagcatccacttctgtgtttgctaggccccggcatagtctcacaagagacagctacatctgggtccttttagcaaaatcttgctagtgtatgcaatggtgtcagcgtttggaagctgattatggggtggatccctggatatggcagtctctagatggtccatcctttcgtctcagctccaaactttgtctctgtaactccttccatgggtgttttgttcccaattctaaggaggggcatagtatcgacattatgtttgtttttaaatctctcctgtgtatttcaaggaaaaatgtttaaaaagcaactagacctaacattttactaatggtgctgtagaagaaatggagcttgttctactcagcattagagctgtgatcagaactattccaacccctgcacagcatgatcacctccatgttcatttaaccggggttttgataggagtccacgccatatttaagatgcctaaaataccaacattaaaaaaaaaacaattttctataagtttaaaaaaatttttatttactcttgtgtggtaaattgtgatttttgatgccttcctgtttaggtagttaatttgagaggagggcttgagtcttgtcacagaagccttctaaatccctctttctcgactgtgagtttgcagtcattgttactactatagaagcttccttatcttttacacccagaaggaacatcctgcctcacctcctgtttcagctggtgccttagctctcagcatggtccccagtggcagcactggccacagacaccaacatgttcctggtaatagaccagcccacatatcatgacttcagacagtagcacagaccacagacaaatgcttgtttattggtggcaacatgggccacagacaactcagctccaactgcagcaggaccacagatgtcaacacagcatttggcttcagcacaggctactcatatctgtatggctccaggatggatcacagcccatggacatcatcagggaagacaaagcaccctggccccagtacttatatttttatacaaatatgtttaacaatatacaaagtgccattgccaaatagtgagatagttagaaacattccttgtttgtaatttatatttcctatttctttctgaaatgcggagccatttctgcaataggagaaataaatggataataattcaataataatatttcaaaaatatgttacataatcttaaatattatagcaaatattaaggttagatacaacagctttcaaaggacctcaaggatacattgggatctattccaagaaactttcaaatccagtgggaataattgttcctgttgccacaggcatcctgctctgttgttgtaggtttcatggaattatatgtaagtacttgtcaggatgcatttcataatagtaccataattgatctttagagccacaaataacacatgtttattctttacataatttaatatgtcactgaaattgtttagtacttcagaaccagtttaaagaagatttttagaaaacccagtttgctttttatcaagcaaattattttaacagaaaatatctactgggaataatttgacatgtttgctgaagagttgtttaattttctcagaatatatatcagtatatggggaaaaaactctatttaggtgatagtaagatccaggagacaaaatggagcaaagtcaaaatgttcagggtagtaaagtggctttcccagagtggcacttgcacaaactgaagacatcagaaactcagtagtttcaagttccgcttgggattgcagaaaggtgttgctgatgtcatgggactttcattggttgactatgtgccatgaaagcacctttccccatgcttagtttagtgttgttattgctctccccttatcacagagaagagtgagccttatttcaaagataacacagccagtaatatcacaacccttgatgagtacccaactggacgttgaagaagctcgatttgaattttggaaatattctcttaatcatcttgtctgtagtttgcatgaacaatggggaaatgaaagaggagttggaagtgagaaaggatgtacagagtccaagagcacagggcatagtgtcctctcactcttctcggagctttcctgggctcagaatgtcagtattttttcagatactctcatttgttacgggcagtgaaaatatttcttttccttttggcagatttgtctgcagaacaaataaacaagcaagtacaatccacctgttaatccttcacataaaagcattttgcctgtgttttgcaaagtttaatccttccaggcctggaggaaatcctcttcagggagctcaactttcccagggtctaagaactgtttttgaaaatctgaaatgcccttagaaagctagtgtggttttgtcagaatcatatggtgatattggaggctaaaggcatttatgtctctttggctgttttcttaaacttgaaaacttacatcaagcttccaggagtggaacaatgcttcatattatacactgtttgcaataattaaaaaaaaaactgtctggttgaccctggaaatcttcccactgacttcttctagatccaagggaagcaggtgcaactgtgatatgatgcaaagatataagatagagaagataggctaaattctcactgttgggtaatgtagattaagaagactaaatatgtcctctgctttacagagaggaatttatatgagggaactattgtttgttttgcttttgttgcatagtttctattgtgatcatttgattgcagcctcttaaatacaataaataatacaatagatatcaaaaatttgaaaatttgctttttatctatttacaaagtgaatacttgttgtgtagatactgctaggcaatataggataataccaaaactgaaaaaaaatatgagttctctcttcatgaaaatctctcttagtggcagacagagatgtctgcatagatgatggcacctgtgccatgatgaactcagtctgtgagtgtgaggagaggtatttcccgagaatcaaagtcaggttcaaaagagtggaaagtatttaaaaccccaattggcaagatcatatggttccacattggcagggagttcatggagtttactacgtgattctcagctgtctggaaacttaggctatgtcttagctgatgaagacccctctgggtttacaaaggtcccattatagtaaaagggaggtataaactgtgtaacagcaactttcctggttgttacatgccttgaaattgagtttgagctgagaagagaaaatatggataattttatacggaataatttaaaagcatagtgatttcatctcagtttgacaaagtccacgttttccctcaaggtctgagtttgcagttccacaattctcagtttgaattcttgagctcttgctggtttatggtcactctgttcaccaccaagcattctgttggcccatgcagtagcttccatgtgagccttttccacctatttttcttccagtagaatggggttattgaagcactacaggtccaaataaggccataatggaaaggcggtttgacattttttaatgtgctttgacagaccaggtagtgcttttgaagtgaatttgagaaagttatgaattttttatggttaaactgcatgcagcatgctctgactaccaaagacaaacacacagaaaaaccactagtgaaatgggagaaacgcctgtcatataatccaagcagttaatagtatactctttatcactgcatcagggcacagatatagtacatatgcatttgaaatgtagaacttggggataatagaaaaatgtcaataatctaatatggccctccacttagtactaaccatattatagtatcgacatcagtcaaatgagtaaatcaatagccatgcataagcaccggagatgtgatggatccacagccacacatccaatggttcacctaagttctctgattctgtcctcctgcccatgctggtgtgctttggaagacggctagtacacatgttttgcaatcatttttatttatactgactttcctctgaaaattcatctctttgcctccctccattagccacctgcaacacatctccctcaatatattgtcaacttttagacaaggcttgttttatctgctatatataggaaaacaaagacatgagttcaactatttgaggctagtaataataactattttcaaaaactatcagaaaaaaacaaaaacaaaaaaaaaacagaaccatcaatttgtatagccataccttcaggttttgggaaaatttttcctttactgttttattaattaattaatttattaattaattaatttagagatggaaaactcactttattcaatgctatattttcatggtctggcaaggactttatttctgaataaaaacttcataatgttaaatgaatagacaaggtataagtggatgaatataagaaaggatggatggactaaaggatagaaaaagaaatggacagatagatgggtgtatggattcacagacatcattttatcctgattgaatttagataaacttgagtttctatggcataatggtaagctaaccgtgtctacccttagggaacaattccttttcctgttttttcttttatctctcttttttttccatcaatagtaaaaaaaaaagaaacaaagtcattcctgtttttattagttccctacaatgtaacaaaccactgttaaatggactagtctactttaacagttaattgtgagtattctacatatcaggaccggctttgagttgggctcatttgtgatctgctttgagatatcgctctcctgtgaagtgatgcttgggtcatgagtggtatgaaggttggtatgtccacatctgtttcttcttgaggccaccagtgtactacatagcttaaatgtgtaagtaacataatgtccaatgtctcggtgtgtaacatctgtcttttcaatggagataagaagcaggcgcagctctcattgtggactgtgcctagagaagtacccctcaattaacctatttttgaagaagtagtctagcctggcagtggtgctgcatgcctttaatccaagcacttgggaggcagaggcaggcagatttctgagttcgaggccatcctggtctacagagtaagttccaggacagtcagggctacacagagaaaccctgtcttgaaaaaataaaaaataaaaaacaaaaacaatcaaccaaccaaccaacccaaaaacccaaagaagtagtcacatactttacatatgactttaatctgaccctattagaatacatattatttcagtcattctgtatcagtattattctgtcatctgtatcagtattctaaagcttaaatattgtcgggtgtgtaatgagtaattattcaatcaacatgttataatatttattaggctaatgatgtatagcggatattataatagatgggttattatgatttactctttatatctcttctttaatacctcatggtagcttttggagaatgactaaaattcaggataaataaggcagtttaaaattagaagcctgtcttctgcaaccatcagtccaatactaggaaccaaaagtgacagtgtaccaataaatataaagttttgaaatgcttaaaataaaatactcaggcttatatcattacagaataatagaagagggggatactatagtagaaaactttctttggaaagattttttttttttaaattgagagaagaatcagaggaagaagaccgctgattcagtttggactgaaatgtctccatatggctaggctctcagccacattctattgtgaattgaaaaggcatctaggagataagattaatggaagttttttcatgtcactggagatgtcttcttcaagttgaaacagatcctcatttcttcctcttcatctgatctccttcctgaccacaggctgtagatgactttcctatgtacaggctgcatcgtgacagacccaaacaataaagcctaccaattatttactaaaacctctgaatcattgagcccaaaatcacatttgttcctatatgtcaatgttgttaggtgtgtgttatagctactcaaagcttactaataccctaagcatgcaaaagggccaggagcatttgcattaatctcagagcaagtgcaaagaagctgggacatggtagatggttgcaagaaataaaagaagccagtgaaactgataaatcatttgttaagatacaggaagttgtatggagaacagtctgtaagcagatcgtgtacttcgtagcatgtttgtactatgtgcagccagaagcctagcaactgaaaactttacgtgcaaatgactttttttcaaaaatatcactccagatgctttgtggagaatgggttgagggcatagaaaggaagcaatgagaagagttagaacactgtcagcattgcctaggaaggaaggaaggaaggaaggaaggaaggaaggaaggaaggaaggaagtatgagttgcatgtaagtaaagaaatagagagataagccaaaaaattagaaaatgcttgattaaaaaaaaaaaaaagagggagaaatagtatggttctctctctctgtttctctgtctctctgtctctgtctctgtctctgttctctctctctctctctctctctctctctctctctctctctctctctctgtgtgtgtgtgtgtgtgtgtgtgtgtgtgtgtgtgtgtgtgtataggtaagtaagtacagtcagtttcaggtgtcattccttagacactagacactagatatctgccaagaatctcttggatctgcttgtctccttaaaaagctagctttcataatatggaaaggttctgtgcaagccttctgccaagggagaggagtaatcattggccctagtaagctattaagcctgtgaaccataacaattatcatccttgtaagatatttcaaagttgcagcaatgacacttataccttagggcaaccataactgtctaattgatattattgtatgaaaaacttttccaagggagatacacacacgtagtcccctactaactgcaagtagagagcccatgaaaaattaaagtatgaatacatcaaagtccagattagtggaccaatgagttttatttaggtcacttgcaggaacatgcagaaatgattcagacaggtgattcaccaaagcctagccaacatggatgacaattcacaaaacctgggaacctgtgttacatatcattctggaggcagctgaactggttttagaatgtcctttccaggtacctgggttggtttgagcttcttcaggcagcctctcggatctttgtttttttctaggcagttagtctactatctgttactttttaaggctgtttttctggtctctgcttctttcaggatgattggctggtctatgcttcttcattgtagcatggatgcaagtgtctctatctcttggacatatatagtgatgaggagggtctagtgattctggtcagcttcaggtattttctgaagctattttgagttgcttgtatgtgtctggctgtctgagtggtgattctctgtagagtgtttcacctccttctaaatatccagttctaaaatattgtgttgtttcactttccatttatatcttggcttagggtgtaattttttaacctaagaggaaactgctacatgaccgaacttaatgtccagcctgctcaatactaaagaattcatgccttacattgcaaacctagccaactacccatgactggaaaggtcatagactttagaagaggaactactatcaccattttactgaataaatacagcttctaactataaatttcaaaatatattatataataacagcagttattaatacataaatattgacaggttcttctctttctaactgtaaaattcactatgtaaatatttccactctttccttattttagaaactatcaaggttagaaactactaaactataatggcaagagatattaaaattgtgaatggaatgtttccttctcaaatgggtcatatttggttatctgcaaagacatgaagagaaaagcagagatgaaagggaaaggagaagagtgaaattactatatgagctgaaattttaaggcagtaactttagagaacaggttacaagacagagaaactcttaaaaaatatatagtagaagataaaacatccacaaagcaaggtgtgaggttataaggaaggttgtttattttagtttattttagtctttgttttaatacattcttcctataatttccttcttagactccacctgtctcagattcatccttcctccatttccttcagaaaagatcaggccttccagagattacctttgaacagagtataagaagataaaataagattggatacaaaccttcatttcaagggagggtaaggtaacccattaggaggaaagaggtctcaagaacagacaaaagattcagaaatacctccattctcactgttaggagtcccataaaaataccagttagaccctcctagtatatatacagagacccttgcagacacctgtgcaggttattgattgctgcttctgtctctgtgtgcccctatggccctacttagtttatgtctctgggccatgctctcctggtatccttgaatgttctggctcccacaaacctttttcactggattctcagagctccaagaagagggatcagatagagatctccaatttgagcagtctacctaatgttttgccgtgtatatatgcatctgatcccaccggctataagcagaaacctctttgatgaaaattgggctaggcacccatctattaatatataagcatatcatcattagggatcacactattaattcttttacaagtctctgagttattcaatttctgattcatggacatctgggcagtatgagttccctctcctggaacaggtctcaaatgatcctagtcatatgttggtcactctcacaagttctattgcccctgcaagtcttatagatgggatagattgtaggtctaaggttttgtggtagggttaatgtcatagtctctctactgcaagccttacctgtttacaaaggatgatcagctgaggctctaaatcttccaggaatgttcttagggtcacctttatagaattctgagagtttctactgctctgggttttttccatcatgttcccttgtcttccaattccatttgtctttccgtgtattttctccatccatctaatccatgttcccatactcacctgggctcagttccctcatgaattctattctttttgcccttcccaaagaagtccatgcatccacattagagtcctcttgttacttagcctttctgtatcattcctttaacctgtccataaggctggcatggagtttaaattcttttagttactattttgtgtatgctaaatgcaatcttcattagaaagtagaatatgatccccagaccatagctccgtgtgcctcttgggaggtctgctcccacaccccaattatctgcttactcatctccaggcaagtccagcagccacaaggtctgttctaaactttcctagctccatcttctggtccacacctctaccccaacccacagctctgcctgccttttgggaggtctgctgctacctgggataaccagtaccagaggccagctactcccaggaactactaggccagtcaacaccagagataaccagatggctaaacacaagcacatgaacaaagtcaacaaaagccagtgaaatatggcactatcagaacacagctcttctactatagcaaactctggatattctaacacacctgaggagcaaggtcatcatgttaaatctcacttatgatgatgataaggcctttaaagaaaaaccacatacatcccttaaagaaatataggaacataaatcaatcagatgaaaaaatgataatatttaagacctaaaaacagaaatagaatcagtaaagaaaatataaatagaaactgagctgaacatggaaaacccaggaaagagaagaggaactacagactcaagcatagcccacagagagcaagagctggagagagaatctcaggcatagaggatacaacagaagaaactaatacattggtcaaagaaaatgccaaatctaaaacgtttctaactcaaaacatccagaaaatttgggatgttatgaaaagaccaaacaagattaatagaactagaagagaaagaagattcttaaggttctagaaaatatcttcaacaaaatcatcaaagaaaatttccctaacttaaagaaaaatattgtgataagcatacaagaacaaaacagcaaatagattggaccagaaaacaaaatcccactgcgatgtagtaattaaaacaataaatgaataaaacaaagaaagtattattaaaagctgcaaggtacaaaagatcaaataacatataaaggcaaacctatcagaattacacctgaattctcaacagagactctaaaagacaggaagttttggaaagatgtcttgcagaccccaagagagcagagatgtcagtcccatgactatacccagcaaaaattgcaattaccatatatgccaatatagtgcatgacaaaaccaaatttaaactatctttctagtaatccatctctacagaggatatttaaaggaaagctccaaaacaaagaggggtactacatccaagaaaacacagaaattaatcatcttacaacaaaaccaaagaagagaatctcacacacacacacacacacacacacacacacacacacacacacagtaccaccgacaacatcaagtcttacttcaaaaacttctactctatataattggaaaatctcaatgaaaatggatgtttttcaagacaaataccacttaccaaagttaaatcaagttcaggtaaactatctaaacagtcctgttacacttaagaaaatagaaactatcattaaaattctcccaaccagaaaataaacacaaaaaccaaaaagaatgaacattaaaaggtcaagggtcaggtcacatgagtttagcacagaactctatcagacttccaaagaatttctaataccactactgctcaaaataaaccaaacttattccacaaggatacactcactctgatacacaaaccacacaaaagctctactaggaaagaattccagaccaatttttgcttacacacattgctgcaaatatactcaaaccttgcaaactgaatcaaagagcacattaaaaacataatgcaccatgatcaagcaggcttcatctcggggatgcagggatagtccaatatctgaaaacccatcatataaacaaacttaaagaaaaatatcacatggccatctcatcagatgttgaataaacctttgacaaagtctaacaccccttcatgttaaaagtcttggagacatcagggatacaggcagcacacacctaagcataataaaaccaacatacagcaaaccaatagccagtatccaatcaaatggagataaatggaaagtatttccactaaaatcagggacaagacaaggctgcccactctcttcctatctattcaatacagcacttgaagttatatcaataaaataacaaaaggagatcaaggggataccagttagaaaggaagaactcaaactatcactattcatgaatgctatgccaatgtacacaagcaatctacaaaattctaccacaaaactcctacagctgatcaacacctttagcaatgtggctggattcaaaattaagtcaaagaaaccaaaaacccttctttattcaaatgaaaaatgggctgagaaagaaattagggaaacaacaaccttcacaatagccacaaacaatataaaatatcttggtgtaagtcttacaaagcaagtgaatgatcatcatgagaagcactacaagtctctaaaaaagaatttgaagatgtcaggagattggaaatcccctatgcagatggaccaacagaattaacacagtgaaaatggccatcttcccaaaagcaatctacagattcaaggtaatctccatcaaaattctgacacaaatttttacagaccttgaaagaacaattctcaacgttatatggaaaaacaaaacaaataaaaaaccccaagatagataaaacaatcttgaacaataaaagaacttctggatgaatcatcatccccaatctctagctatactattgagcagtaataattgaaactgcatgatagaaccttcacaggatgcagggcctctcctcccattggtgacggactaggccatcctctgctacatatacagctagaaccatgagtccctccatgtgttttctttgattagtggtttagtcccagggagctctgggggtactggttagttcatattgttatttcacctatggagatgcaaaccccttcagctccttgagtacctttctctagctccttcactggagaccctgtgctctgtccaatggatgactgtgagcatccacttctgtatttgtcaggcactggcagagcctctcaggagacagctatatcaggctcctgttggcaagctcttgttggcatccacaatagtgtttggtttggttcttgtttatgggatggatccccaggtggggcagtctctggatggtcattccttctgtctctgctccacactttatctctgtaattccttccatgagtattttgtttccccttctaagaaggatcaaagtatccacactttagtcttccttcttcctgagtttcaggtgttttgcaaattatatcttggatattctgagcatctgagttaacattcacttatcagtgagtgcatatcatgtgtgttcctttgtgattgggttacctcactcagaatgatatcttccagatccatccatttgtttaagaatcacataaattcattgtttttaatagctgtgtaatactccattgtgtaaatgtaccatattctctgtatccattcctctgttgagggacaactgggttctctccagattctggatattataataaggctgctataaacatagtggagcatgtatccttattacaaggttctatgccccagtataggagaatggcagggccaggaagtgggagtgggtgggttggtgagcagggggaggagaggaggagataggagattttcagaggagaaactaggaaaggggataacatttgaaatgtaaataaagataatatctaataaaaaaagaaactacgatttttctagtaaacccaaacctaaatttctttcataagtaagcaccaaatatataaacataatattagcaagagaatttgactatatgcttcatggatattgttttaataaaaaattgaaaattatttaaaaaaagaaaatattggtagagaaacagacaggttgatcaatggcatagaattaaagatccaggaatgaatccacacacttaggatcacttgatttttcacacagaatccaaaaccatacaatgggaaaaagaaagcatcttcaccaaatggtgctggtctaattgaatgtctccatatagaagaatgcaagtagatctatattgatcaccctgcataaaactcaagtccaagtggatcaaggacttcaagataaaactggatatactaaatctaatagaagagaaattgggaaacagccttgtatgcattagcacaggagaaaatttcccgaacagaacaccaatggttcaggcactaaggtcaaaaattaacaaatgggacctcataaaactgaaaagctttcatcaggcaatgaatcttgtcaacaggacaaaatggcagcctacaggttgggaaaggatctttacttaccttacatccaacaagggctaatattcaaaatgtataaagtacttaagaagttagacctcaacaaatgaaataacccaatttaattatgggttatagagctaaattgtgccagagatctggaattgagaaagattccaagagtcaatgtaggtgaccttagctgaaaggctaatcaatcgataaaaagactacctcctgtagcccagcagaacccctagtggagggacaaggacacaaacccttccacaaaactttcaagccaaaatttgttctgtggcaagacaatgtaggaacaaagatggaagagacactgtgagaatagcctatcaatatccatctgaacttgatattcatcccttgggcaagcaccaatccctgactctattaatgatactctattattcttgcaacaggaccctaacataactgtcctctgagaggcaccacccatgatctgactgaaagagatgcagatacccacagctaaacattgaacagaactcttatgaaagagttgcaggaagaattgaaggcactgaagaggacaggtaccccataagaagactgacaaagtcaactaacatgtatccttgggggctctcagagactgagccactaaccagaacatgcataggctggaccgaggcctccaacacatatgtagcacatgtacagctcattctccatgtggatccactccaacaactggagtcagggaagggtgtctccagagctggtgagtctttggaatcctttcccctaactgggctgttttgtttggcctcaatgggaaagggatgaaccaagatgggggatgcctatgggtgtccctactgttcagaggagaagtggaggaagatgaaagagaggtattgtgtgaggatgggatggggtgagcagtgatcaggatataaaatgaaaataaattaatggagaataaaaatgaaagtagaatatgaacagtgctatgacatttatattattattttttttttactttttccatctccaatagctgagctgagcattcagtattgcaatgaatttgtgctagatgactcagaaatctgaaatatgtttatgaaccctagttggagaaccaaaaatattcacagttagggttcagttaaatcttttttttaaaccatgaaaattatagaagagtgatattatagttttatcacaaatattaatatctattaattcactttttgttatttggcaagacactgaatgttcctctgttatgtctgtatgataaacgtaagagaaagtgaagagactgtgtaaggaatcaaggtggtcaagagcacaaagtcgctggacccaaaaatcatggaagcatgggatgaggcaagatcttgggtaataagatcaatttatttcaaaggtaattaagtgaattgtttgtttttaaagaatttgctattttaatattaccaattttccatcattatacttcattttcctcctttgactataattgcaaaatagtacaacacaaaataaaacattgatagttaaatatttttaaaatttttcatttgttaatattcctttacttgcataatttctgctctttgtgtgtatgtatgtttaagatttcagtttaaaaatcaagccagcaagttgaatgaactgagagcaaactcccaactctatgccagcaaaagctgacttatcaatgtgaaattctgtctcaaaactttcttgcccttcagattcaattgggaaaatatttactcttctgcttactcctaacaggtgaaaagaatgaagaccaggctcacctattagagtgcacattaattcaacttatctaaataggcacttgtgcctgctctatttttgtgctgttttctctcatccttttcttatgaaagaaatgctgttttaaattatttttcctatttatatagataggtttgttgccaagatttccaggcctataactagttctcatttatcaaagacacagtcaagactagcaaaccatgctattcacagtgttaaaacagttgcccttacagcctaggctctatgtaagcaccatcaatagacaatgcctttccctcttctaactgaaacagatgtgacatatccaaggttggagaccttcctaggcctgtgctatgtaaactcagcttgaaagttctctcaaggccagctcagtcatataccttctttgtcccttcttgtcagtgatatttattgaacagtcttgatttactagtatacttggcaatatagtgaatatatgacatttctacctgcttactactcttctgactacagcaaacattaaaagtttaataagaactttgtatgatacttcactaagagatacttttatttagttcaagaagagtatgagtatgtacaattgtggaagccttcatgtagagtaactcactagctgggaatctgtaaaaatctggaagaagttaattttgcttctatttcttgaaaactgacccatgctacgagtttgaagttgggctagctcaggatcccctagcaacagccttctgggagatagaatttaaggtatacaccatgctgcccaggttgaacatcaatcttaaggaggaggcagacataatcaaagaaagaagcaaggcaaaattgttgccagaagggaaagagagcttcctggaagatagaccgatcttaggttcactgattgggacatttcagcccagcacatcctcaagggatcagcattagtagaatgaaaacccccatgcaggctttcccagatcatttattattcaccatgtaatgtaagaacctgacattaaaataatcttcttatttttcctattctaagttaaccaaactaaaaagaaaaaaagaatatcctagattattgtttagaatggtgtaatatttgtctccctgtggattgccttttgtaacaaaattcaaataacgttgttgtctttgatgtgacactgtactctgagactaaatcccccaaataagcaatgcgtaatagagatgtgctttgcacaattctaaaagttgtctgttgtcttaaaattttggcaagagacatttttcataatatttattcatttacttatttagatttttacttatttactttatatccagttcgctgtccccctctaggttggtcaaaccctatcgcaatctttcttccatctgcccttctcttctcctctgagcaggtgtggggtgccctggatatctctcctatcctagcatatcaaatctctgtgagactaggcatgtcttcacctactgaggccagacaaggcagtctggctagaagaatctattccatgtaccagcaacagtttttgggatagttcctttggaggagacatttttatgagggcagaatgattttaataaatttattttttcatgctctgatataattagaaatgaataataagtttttgaggctactggtataactaagaagatacaaaacaaaaccaaacaacaacaacaaaaaaccaccaaaacatgctgttattgcagagaaccctagtacagttcccagtactgacacatggagacacacaattgcctagaactctagctttagtggttctggcctcagtaggtactgcacatgcatacacacacccacaccaattagacacacagacccgcatacatttctataaataaaatacatttttaaaattgtcttcaaagaatagttttgcttgcactggaattttgattcactgagcaatagataatattttttccaaaacaagaatttattttgcaacagattatgatatcatttccaaaaagtatacctaaatttattgaaatataatttgccactgtatacttaaccaataatttaatgatttatttgattgtgtctaaataattttttatacctgataccaacacaaggtcttgtgttacttagggtggtataattctcaactaatcttttagactactaactcttctgggttcagctccaaagcactaagattatagattacagatatgtaccatacacatgattttaagaagaactatcaattttgaatgcaagtacctgaagaattgtgcacttattggtgttcaatatttgcgtctataagaaaattaaataatcttgaatgtaatttaattttcaattttttaaatgaataaacttaaaattgaatatttcttgatgaaaatcttgagtcgttgattgaattttaatagagcattaattttaaagttactcttttctcagtaacatttataatttttctgaaactgtgatataattttagacaattatatgtaaatttaaaaacatttaatatctgaattttctttccaaacacactaggctatatggggaagtctactgacaatgatatattacttctttatttttaagatttacttatttattttatgtaaatgagtacactgtagctgtacagatggttgtgagccttcatgtggttgttggaaattgaattttaggacctttgctctctttagtcagccccactcattcaggcccaaagatttatttattattatacataagtacactgtagctgtcttcagacgtgccagaagagggcatcagatctcactacgggtggttgtgagccaccatgtggtccctgggactcgaactcaggaccttctgaagagcagtcagtgctctaatctgctgagccatctcaacagcctgacatgttacttctaaattttaaccacactagggtattataaagtcagtaaaatttatcaccatgagaatattcaggctctacactcctataccttattaattgctgtgcacaggacattgggcaggcatattctatccgtttggaatttactatacaagactaacaatgctgacacaaattctgtgagccaattcatgcttaaaagtactcacaagcattaaaaagtctaatacataggtgaaagttcaaaacaaattattctagtaatgtaacttatcctctgattgttctaatattgaccttcagataactcagcctcagaagatctgtgttaggttatatttaaagacataggagcacaacagaggctgaagtggcatgctaggctagatggggtgtaggaaatttcaaggaagaaaaggagaggactcagtgacttagtgatgaagctggattaggtctgagaatgtctcttcagattcaaagaggaggtacttgtaaagtcattattaactattctcagttcctattgaatgttattttgttttcgaagaattaattaaaatggtaaaaaaaagaaaaatacagttctaattcaaatgaagatgctagagcttgatctgtaattctcagtctttctacacaaatcagaaaataactaggatatccatgatcccaaagtggtgaataacatttattttattacacactgaaggtggttataatacaacaatatagtaaacagcaaacatttgcttcttttatatgtcttttattttagtggtatgcttcctaaacaatataattctaaattggtcaggagaacacaagcatgctcatacaaaaaatatgtgggttagataagtaggtagagagataaatgataaatatacaacagataatagctgatgtattttgattgatatatatttcttgcatgaaacaacagattgaacaagccaggagtagcaagtcagctaacaacaccccttcagggcctcctattaaatttcttactccaggttcttgcttgagttttcagccctgaatttccttcataaaggactggaatatggtaaaatgaaccctttcctttttcaagttgctttgatcacagcaaaagagaagcaatgtaaagcaaccaggcaaatggcgaaagagtttaaaatgtatgtgagaaacctggttatatgctggatgacagtgtgtaaaggcttactgctcactttgctttgagtgagagtgcctatgtcctttgaaggcacatgctaaagcataaagagatgaaatgatgacatggctgaaacaagtatccagaaagaagatgaaagccagaaaataaatatcataaaatattagggtttattttgctgcatactttatttatgtgtaatatctcttgtttctcactattttgattacatattttaaagtttttcttaagagagcagtttaggatgactttttttttctcctgccctagagctgtcaacactcaaatctagaaatcaagtcttagtctgcatgctttagaaagatatttgaataaaggaaaccaccttctcaacagaattgtcaggcaaactcagagaacaaattctaccaggagttatattcaaaacatttaccgtccagtttggtagaaaaataattctaatgaatgttagttgtaaacacctggtgtggctcagatacaaataccatgttcacttttaccatccattaacataaaggaaggtcaggaaagcaaatggcaccagtggaatgtaatttttttctcaccaaactaagaaaggaagcactttgtagtgatgagatggagagagctgttaataatgtaattctgcaagctccacatcctcgacagcatgtactgtctctggagtttttgatcctacccattctgaggggtgtgaggtggaatctcagggtcgttttgatttgcattcacctgatgactaagggctttgaacatttctttgagtgcttctcagccatttgagattcttctgttgagcattctctatttagctctatactccatttttatttgggttatttgggttcttggtgtctaacttattgagttctttgtaaactctggatattagccctctgtcagatgtagcattgatgaagatattttcccaatctgtaggttgctgttttgtcctattgacagtgtcatttgccttacaggagcctttcagtttcatgagatctcatttatcatttgttgatcttttagcctgagccatttgtgttctgttcaggaaattgcttccacatgctggcaaggatgtggatcaaagagaacactctgtcattgcaggtaggaatgaaaacttgtacaattactttggaaagcaagtttgcagtttctcagaaaattgggagtagttttcttcaagacccagatatactactcaggggatatatctaaaagatgctctatcatcccacaaaaacatttgttccactatgttcatagcagctttattggtgatatacagaaactagaaacaatttagatgtccctcaactgaagaattgttaaagaaatgtggtacatctacacaacagaatactattaagctattaaaaaaaaaaaaaaagaacatcaattttacaagcaaatggatggatcttgagaatatcatcttgagtgagataacccagtcccaaaaggcatgctgttatatactcagttataaatggatattagacataaaatacaggatagccatgctacattccacagacccaaagacactaaacatggaggaatgcacaaggattctcacttagaggggggaataaaactatcttaagattagtgattgaaggagagaactgggagggagagggggtggggagaagaacggaggggttttcaggatcaggtgtggggacagaaaggatggccaaatgccatgagaatgaatggaaatatgcaactgacaggagtggggagttggggggtgtcgctagaatgagacagagacctggcctaaagaaaacaccccaaaatcagtgggatagatcttagctgtgacccacagaattagggacatagaacttgaagaggccacttcctgtcagcaggcagaaatccagtggagcaagagagatttcaactcaaacacaaaactttcaacccaaaattcatcctgtctacaagaaatgcatgcatggagatggagcaaagactgagggaatggccaactctcccatggtcaagcaccaatactattaatgatactctgttatgcttgcatacaggagcatgttgtcctctgagaggctccacccagcagctgactcaaacagatatagacacccacactagatggatcttggagactcttatggaatagtatgaggaagaatcacaggccccaaaggacataggaacactacaggaagaccaacaaaatgacctaacctggacccttggagatctcaaacactgaaccaccaaccaaaggacatacacaggctggatctaggcctccctgcacctatgtagcagatgtacagcttggccttcatgtgggtcccaaatcactggagcaggagctataccaaaagctatttcttatatatggagtatgttctaggtgggctgccttctctggcttcagtgggagaggaagagcctaaccctacaaagacttaaagtgccagggttggaggatactcagagggccccaacatactcagagagaagaggaaagggggatgggggaaagattgtaggagtaggtgacctgtggggtggggggtgggggcagagagtgagatgttagtgaacaagtaaaaatttaaattaagttaaaaatataatgggttttcttactttgatttgttcattgactgtgaatggtcatttttggtttatggaagcaacataaataaaataaaataaaataaaacaaaagtttaccttgtcacagtaaaagaaagaacattaagttagagatccctgaaagaacccgagagagtcacatttataatcccgttatttgcctgacagaagagatgagattgacagagtacttggtagtactgccataacttaagtaacacagaaagcagagcacatttcagaacaataagtcaggagccaagggaaggcacaatgcttcatagaactacacacaaacaaacttctttccctttgggaaaagtccttctggtgtccaaatcaaaatcagaaagagtaatgcctatctaaccagaaaattctgtcttaatactcaattcccttgtaggtcttcggcttcaacatctttattccatcttcccttgttccagtatcctcttgtcgataacatttcacaatatctgtatttcagcactccaagcattatttaattttattgatcatatgcatcctgtttctagtaatgaaacctctctgtcttgcttaatgttttgccacatactaatgcatatagcatatcttccttaaattatttaaaatattggtcctttcagttggaagtaggaatgctagtttatagctagcataactagtataacttaacaaatagagaatgagataaaattcaacactcctttttaacctcctgggattttagtaaaatcaggaaaaaaacaaaaaacaaaaatcaaaaaccattcatcacacaaaacaggaatgctaaaagaaaataatgcagaggcaacccactcaaataaccttcataagaaaccttcaagtttagagaacagccttttatataaatcatagaggaatttatactagttaggacaaaaatcatttattcaactgcttgctaaattgacctttggaagatgttttatgatgttcttgttccagaaaattaatataaatataccttaagtatgaaaacaacttcagaggccaaaggacaagtgagagtaggaggtgagtgtgacgagtccctgagctctcactctatccatggtgattagaggtgaaccagagacaaggattatatttaaaatgaggaacagccttccacaacaatagtaaatccacttaaataagaaaataaacagttctcaagtttgctttagaaacccttaagggaataattacttagctactatatttaaggttagaagaacaaacttaaaatctgattcctttataaaccagaggcagttagaaatggaaaccaatgtgtttcagtcacctttagtagagtaacctttaaaaagggtttgcaacaaatattttatataaacataccttatttactaaactctccaccttaatatgatatataatttgtttgtaatttgagaattaagcttcatcagttattaaagcaattaactaaagttcattgtatttctgtttgttagggttgatactgattcatggtaatcacttgttttctaggtccattcatactttgattggtcatttatccagtagttttgactaagattttaccatgataaaatgctgttatgtgaatctactaacaacacacagacgccacattgatgtcattgcccagtgtattaagatattttcacatttctagattcacattgttatggcaaaagcatcaactacgtgatcaagtattttgtttatattacaaaatacaacaaacaggcattatgtaatctagaattaatcatcatctcacacctggtattttaagtatttaacacttagtttactgttatctagttgctctccctcccagacttcaaaacttctcagcattaagtcatgtcttcatttcaattaatttagcccaatgatattgatagaatttttaatttgatttgttctttggaaatgtacctaagaacatgaacttaacgttggctgatagtgtaattacagtgtagctctcctatgttcttgtcatggaaatgtcaaagtcatactgtgttttggtagaaaccttatagctttatctctgtttcttaattaatccccttgctgcttttccctttatagaatttctgtatctatcactaacagcagcgaatggagagaattcactcttcatttggcagttgcaaccatgagccctctaatcaatacacatgtcgatttttccaattcaacgttaagcatctatttacttaaaatccccagtgatttaattagaagtgtagtgtgtggaggaacatacaatttgctaattactccaggcttattctgtaagtgagtagatggtttctgtactacactgtcatgatttctagacaaatgttttctaggctgaaagaatgtgtttccctttgataattctctgtgtaatcccttctctctggtttttttacttcctctcacctcaccaagtcttttgcttcttagccttggttttcttccagttaaaagttaacatcatagataccagatatccatgcaggaaaaaaataactaaataatctacattgcaagctctagaaagctaggtatctcttgttttctaaggaagtaatatttatttctaggtaagccaaagtcacatttaaggaaatctaatgacttcttcttaaagcaccatgatataaataccattagcattagcctgtagtcttgttttttacttgttttctgtttaaaaattagatacccaagatataagatacaattgtgaaacacatgaatctcaagaagaacaaagaccaaagtgtggatactttgccccttcttagaattgggaaccaaacagccatggaaggagttatagagacaaagtttggagctgagacaaaaggatggaccatctagtgactgccataaccgtcgatccatcccataatcagcctccaaacgctggcaccattgcatacactagcaagattttgctgcaaggacccagatatagctgtctcttgtgaggctatgacggggcctagcaaacacagaagtggatgctcacagtcagctattggatggatcacagggctcccaatggaggagctagagaaagtacccaaggagctaaagggatctacgaccctataggtggaacaacaatatgaactactagtaacccccagagctcgtgtctctagctgcatatgtatcagaagatagcctagtctgccatcagtggaaagagaggcccattggtcgtgcaaactttatatgcctcagtacaggggaacgccaaggccaagaaatgggagtgggtgggggagggtgtgggggacttttgtgatagcattggaaatgtaaatgaaataaatacctaattaaaaaaaggtgtgtgtcatcacaaaaaaaattagtaatattaagtgtgcatatttggctcattggttagtagcactttttgctcttgcagaagactttttgcttccaagccccatgtgatgtctcactaccatctctagctctagtcatagggaatttgctttttcttccgattgcagccatcagtcatacatgtaatgaacagacatatacacatgcaggccaaaaactcatgtacataaaagaaataaatataaaaacataaaagtgaacatagaaaaaagaaatgaaagaaaaggagctaagtccagaaagcttctgtttgaagcccttccagtgcacaactcacacccaaccagactattttgctctgatgttctctcctcagctgtgttcttgagagaggtgctcctgacaagcttggaagatgcaagaggagaggatgcagacagcaaagcagtggctgcaatctggagctgtgatgaccttgggttttctatcttctattttatcctttggttatcttgattatctagatagatcaaaattatcttaaaagcttcaattaatctcttgtcaggggtgcttttcatgtaaaagtcacagtcctctgggcattgtaaaatctaccccatcatgttcacagaatcccaattgaatgagatagacttcctgaccttgagtctttttgaagctcttttctgttaccttgcctctgtgacctatcctgcccatgaaggagagaggcttaggggttctttcctctgcttttgttgacagctggatttgctgtattgagagcttgaaatatatttttaaaagttttcttctaattcttttacattgcagaggcctgcattggaggtcaacacacacacacacaagcacaaccatacacacacacacatccccaaaccaaatccacagaagatattttgtttctttttcttcttcccagagaagaggttatgtcagtgacagaacacaaaatagaaacttatacaatggtggtggtcaaatttgaagaaaactgcttttgtgtgctgactatttaaaaggacagagtcttagaaatgacagcagtctgagccccaagtctaaaaataaccagagccctgaacaagaatagaccttgacatgttagttacatgggctacaaagagcatagtctctttttagattgatatgctattgagatattgtattgtatttactcctgtaacgtgaatgctcatcaatatgttcctatattgataaatatatgtataatttgtggataattttataccttaaatttgtctgcaaagtcagaaatacataaaatctgataactggatttttagcagcccttttagtccatgcatattcttttagtggattgagatacagagataacataaaaggcctccaacctggatagaaactaattacacaaaaggaatgtttttaactgtgttaataactttttaaatgccaatatttatagtgcccatgctttctagggaatcttaatcatgagtcaaaagttccaggtttccaggcaaacattatcatactcacctgtcacattccaatgaaacaattccatagatgcaggctgtcctgctatctacagtcgcaaatgccatcagcatattttccagaaattcttcttcaagtttgttggcaagtcgatatggctgcaatgtctctctttctctgagattaaggggaacagtgaatgtcagtctcttcctaactttctgtttcacggaagcagtgacaggcactgtgccaatggcttctcatgtgtcctttcacttgctcttcacagcactcctgtgacacctgtcattgtattggcttttcctttggagatgaagactctgatgcttttaatgagtcaatagttcttttatcatcacagggataacaagtattgatgttggatatcaagcacccattttcagattggaaatttacatctctggccatgagctttctgataattttgttaagaaaattctaggactgacttctcctataaagatggagtatgtgtacatctcctacatatcaggattactaaaactaggagttagagcactatatagaaagcaaatatatgtgacttgagaggttgttcagtggttaagaacactggttttcaaagaacccagtttaaatttccagaatctacatggcaggttacaaccaattctaactatagttccaggggatctgatagtctctcatggcctctctgtgcaccagacacaggcacatatgcaagcagatcacatataataaataaataagattttttaaaaattaaaatgcataaaagtacctggatagagggaatatagagcaactagagagcttagattagaaacatcatgagggtagcttccttggggtattttgttttgattattgtctgttatatctcatactaggtaatgaaaagccatcagtccatcttttgatacatatgcagctagagtcaagagctccagggtactggttagttcataatgttgttgcacctacagggttgcagatttccttagctccttggatactttctctagctcctccattgggggccctgtgctccatccaatagctgactgtgagcatccacttctgtgtttgctaggccccagcctagtctcacaagagacagctatatcagggtcctttcagccaacgcttgctagtgtatgcaatggtgtcattgtttggaggctaattatgggatggatccctggatatggcagtctctagatggtccatccttttgtctcagctccaaactttgtctctgtaactccttccatgcgtgatttttttccaattctagtcggccatcactggaaagagaggcccattggacacagaaactttatatgccccagtacaggggaacgccagggctaaaaaaaaaaaaaaaaaaaaaaaatgggaatgggtgggtagggaagtggggggagggtaggggggacttttgggatagctttggaaatgtaattgaggaaaatatgtaataaaaaaataaataaaagccatcagtctataagggtggatgaatcaaggagctaaagggatctgcaaccctgtaggtgcaacaacattatgaactaaccagtaccctggagctcttgactctagctgcatatgtatcaaaagatggactgatggcttttcattacctagtatgagatataacagacaataatcaaaacaaaataccccaaggaagctaccctcatgatgtttctaatctaagctctctagttgctctatattccctctatccaggtacttttatgcattttaatttttaaaaaatcttatttatttattatatgtgatatgtttgcatatgtgcctgtgtctggtgcacagagaggccatgagagactatcagatcccctggaactatagttagaattggttgtaacctgccatgtagattctggaaatttaaactgggttctttgaaaaccagtgttcttaaccactgaacaacctctcaagtcacatatatttgctttctatatagtgctctaactcctagttttagtaatcctgatatgtaggagatgtacacatactccatctttataggagaagtcagacctagaattttcttaacaaaattatcagaaagctcatggccagagatgtaaatttccaatctgaaaatgggtgcttgatatccaacatcaatacttgttatccctgtgatgataaaagaactattgactcattaaaagcatcagagtcttcatctccaaaggaaaagccaatacaatgacaggtgtcacaggagtgctgtgaagagcaagtgaaaggacacatgagaagccattggcacagtgcctgtcactgcttccgtgaaacagaaagttaggaagagactgacattcactgttccccttaatctcagagaaagagagacattgcagccatatcgacttgccaacaaacttgaagaagaatttctggaaaataagcttcaccatcaggtacactggcaaagtctcagtatcaggcagtataaggcagacagcatggtatagtgtgctgaagaagccagatgaggcagtctaaactgtaacctcatcaaaaaagtctaaagaggaggcatgaattatatccacacaaaagaagtctcagaagaagcacaggcactctcctcattgggatggggaaacatctgtcaatggagaccatagagaatgcctgctcttttagcaacatagacaagaatgatatagttcattcatttaacatttttatttatttatttttaggtatagggtttattttgcctatatctgtctgtacaccatgttgatccttgtgtttgcagaagacagagatctcctgggaccagagttacagacagtcatgtgcagccaggtgggtgtcacaggttgaacttagattctctcgaaaagtagtccttagtcttaacctctgagctcttcattttggccaaagcccttcttcaacattagaggtagggccaattaaaatcaggacttttaccacattatttgtatcaggggccaacagttcacctccacagggccaggtggaagcaatgcacttctactagtccaagcccctaatgtatgatggggacatgcttgggaatctattatttgagaccttaaggaataattggaagttctagattaagtatcaatagtggaggaaagtggtgagacctaatttataagcccaaagagaaataaaagagaaacactgtcacattgcctgccagaatagagtcagaaaataccatcaacaaagtttagtaaaacccagagtctcatactatagaatccataaatttcagatatactgtgaaagcccttcatcatgctaagtaccaggaagatctcaagcagtactgacaaggacaagaaataaatggtagcagagtttacaatgatttgagatttgtctggaaaaaaatatttaaaagccaccataaatttctttcaataagccattaggaacacatctgagacagccaagggtactggaatatacctatatttccagtattgttggctgagagacaggagaaacataaatagaagagcagcttgggttaaacagtaatactgtgtctaatacacaagcaacaaaatcacatatttaatgtaatataaaagataaagtctcactattatggtataaatatgagccatcaaatgggattttaaatatgaaaaaaacataacaattttaatcttaaaacttagtaagtaagggaaggagaggtagttcatagacctttgctgctgaacctaatgtcttgaattccaaacatggaactcatgtataggagagaattgacttcaaaaagttgttctacataggtgtggtggtttgtacaggcatggtccttatagactcatgtgtttgaatgctttgcattctttaggtttgaccttattagagtaaatgcattcttgttggaggatgtgtgtcactgtggaggcaggctttgaggttttatatatgtacgcaagtctggctagtgtgacacagtctcctcctggcttccttcaaatcaagatgtagaactctcagtgtctccagcaccatacctgcctgcctgctgccatgcttcccactacaacgataatggatgaaacctctaaaactggaagccatcccaattaaatgtatgacatttttataacatgtcaacttttataaaagacagcaatagaatcctaactgagacagaaggtgctaccaagaatggggtactaatatgatactcctccctaagctgttgttgggatgaatggatttttggactttggaagaatgtggctgctttttctcatgtctgaagaatctccctgagggtaaagagattttatattaattgtactgacaaaggaaatcttaaaatattctagcatttattcagacctgtggtttaacatccctgcatagaagctcagaaagaccattgtgtgaggtggccaagcctttaccttgtgctggcagccagacttggtaatgtgtaagaagaatcacccagatggtactggctttgaaagtatgaaagagtcatggagagaagctgaggcttggcactgtgagagcccaggagaggccattagtgaaggtgcagcctgtcagttgaaggctctggactgaaggtctcaggaaaagaacttgaggcttagcaccatgaagagaagctatgagaggctattggcgaaagtgcatcccaattttagcagaagaccccatcattttacacaatgaccctccaaaacagcagcaacagaagctgtgctccagaacctgtaaaggtgaaacttgcatccattggaggtctcaagaggatagagatgccagaattatgggatacctgctaaggaaagctgttaacagggactggaaccagtccaagagaaagaagtgcattgcagtcaacacagataaaagaagttgaagatctaaagagaattttggcattagacatgagatcccaatttggagtttgcccagctggttttctggtccagtatttgatcactgtgctttcttccctccattttggcattgtaataatgtatatcctgtgctgcatttcatggtgaaagtatgtgatctgctttttgatattgattttatattggattaaacttaagaaattgtaaacattgttgagactgtgatagaataaggagagatttgaagttggattacattatggttacaagcctatgaaggtcagggagtgggatgtggtggtttgaataggtatggctcccataaactcatggatttgaatgcttggcccataaggagtaacactattaggaacggtagccttactggaataggtgaggccttgttgaaggaagtagttcatgtggaggtagcctttgagtctcatatgcatgcccaagtctggtgagtgtgacagtccctttctggctaccattgggtcaagatgtagaattctcagccccgagatctccatgcctgcctacatatggcaatgcttctgtcatgatgacaatggactaatcttctgaatatttaaaccagccccaagtgaatgatttttttttgtaagagttgtcatggtcatgatgtctcttcacagcaataaaacctcaattaagacactgcatgtgttcctaccctacacatgacacagtgacacagtataataaattcttttaaaaagtattttatttatttatttatagatagatattttctttatttggtttcaaatgttatcccctttcatgatttctcctctgaaaaactcctatcccatcccctttccccttgctcaccaatccacccactcctgctgaaattaacgattcacaataaatggtcacaacagtaaatgaaaaggacaaaggtttggttaaattgaaggtaaaattaatcatttacctcatataacagataaaagtaggcttgaaccaatgctctcctcaaaaaaaaaaataatcaaaccaaaatttactagcaccaaaaccctgtggcctttagcaaatatatcaattctaaatggaggaaacaggtgtttagggctgaaaaggaattaatgcttcacattttccagatttagctaaagatgtaatctatatattaaaaaagctgcatgaagccaatgtatgaggcaaacaagaaatcaacagtagcccacactaaagcttacagaagtggatactcacagtcagctattggatggaccacaggacccctactgaaggagctagagaaagtaaacaaggagttaaaggggtctgcaaccctataggaggatcaacaatatgaactaaccagtctccccccctaccccagaactgtgtctctagtagcatatgtagcagaggatggcctagtctgccatcaatgggaggagaggcccttggtcttgtgaagatcatgtgccccagtacaggggaatgccagggtcaggaagcaggagtgggtgggttggggagcagggccgggggactttcaggagagcatttgaaatgtaaatgaagaaagtatctaataaaaattttaaatgtactattgaaattttatttgtgtatactgtattatttctctgtgagattcacccacaaaatcctgctgtgttctccatccctatctgatccttctcaaatttgtggctactttttctttaattattacagttacacacacacacacacacactcacacacacacacagagagagagagagagagagacaagagagacatacacacagacaccaacctgttcagttcatttatatatatatatatatatatatatatatatatatatacacttagacacatagacacatacacgcacacgcacacgcacacgcacacgcacacgcacacgcacacgcacacgcacacgcacacgcacacgcacacgcacacgtacacgtacacgtacacgtacacgtacacgtacacgtacacgtacatatacatatacatatacatatacatatacatatacatatacatatacatatgttttggggatgaccatttgataactaactaggaggatcatcactaggaagggctgatttttttcctctctcatgagtcatcaatttttgtaactcttcatctggaaatgtgtaagattttgaaacacaattcaaaatttattcagaaacttaaaaattaaacaaaatggctaaaagttgtcctccccggttgtgatggttcgtatatgcttggcccagtgagtggcgctattaggatgtgtagccttgttgtagtccttgtatcattgtggggtgtgggctttattgtcccagctgcctggaaatcactcttcactttaggttgcactttcaaaattggtctactggcctctcataagagaatccgaacctgccccatagtcttcagctccagtcttcctccaggacccattcaatcatggagttttcaatcatctgagactctacctacagcaacagtcttttctccaaaaatatcaagcctcagctattctccaataccccataaccctgcatctctcatgctgcccaaactagtggcacatggggaaatcattcatatttccctagtcaggctctgagcatgggatgcaggaatggtctcttctgaatgagaggttctgtgttctgactcttaaaaaggagtctccagaagatttttgccacaatgatgctgttctcttcttaatcacagttgaatttttagcctgagctaaccaacattgattgccctagtaaaacatatgttttcctttagtgtttcttaatgtcttattgaccacagcagattgtagagttccagatggctacaaatcacagaatcttaacacatcactctttcagctacttgttgggtctttcagaggacagtcatgataggtccctttttgtgaactctccatagcctcagtaatagtgtcaggccttgggacttcccgttgagctgtatcccactttgggcctgtcactggaccttcttttcctcaggctcctcttcatttccatccctgtaactctttcagataggaacaattatgggtcagagatgtgactatgggatggcaaccccatccctcacttgatgtcctgtcttcctgctggagatgggctctataagttccctctccctaaagtctggcatttcatctatgttacctcctttagagtcctgagagtctcttacctcccagacctctggtgcattctggagggttcccccaaccacctctttcctaaagttgcctgtttccatattttgtgttggtcctcagggcttcagtccttttcctttgcccaaaaccagataaggttcccctctctctcccactccacccccattcattttccctccaaggtccctccctccctccctccccacttgtgattgctttcttctctctcccaagtgagactgaggcagcctcacttgggcacttcagcttgtagtactttttgaattctatggactgtatcttgggtattctgcactcttttttttggtgactaatatccacttattagtgagtacctaccatgcatgtccttttgggtctgagttaactcactcaggatgacattttctagttccatccatttgcctgcaaaattcaggatgttctcattcttaatagctgatagtattccattgtgtaaatgaaccacattttctgtatccattcttttgttgtaggacatctaggttgtttccagcttcttgctatcataaatatggccggtatgaacatagtggaatatgtgctcctgtagcatggtgtggcatcttttgggtatattcacaagagtgatatagctgggtcttcaggtagatctatttccaattttctgaggaacctccagattaatttccagagtggttgtgccagtttgcaattccaccatcaatggaggaatgtttctctttctccacatcctctccaacatgtgttgtcacctgaggttttgacttagccattctgattggtgtaaggtggaatctcagggtggttttgatttgcatttctctgatcactaaggactttgaacattttttaggtccttttcagccattcaatattcttcagttgtgaattctcagtttagttctataccccatttttttgattgggttgtttggttttttggtgcttaacttcttgagttctttgtgtattttgaatattagccctctatctgatgtagtgttagtgatgaccttttttcccaatatgtaggttgacgatttgccttatagaaactttccagtttcatgaggtcccatttatcaatttttgatcttagaacatgaacaattggagttctctttaggcaatttcctcagatgcagatatttgtacccaaccaatggacagaagcagctgacacctgttgttgaattagggaaggcagaaagaagctgaggagaagggtgatcctgtaggaggaccagcagtctcaattaatctggacccccgagatctctgaaacactggatcaccaaccagacagcaaacattagcagatatgaggctcccaacacacatacagtagaggaattccaggtctgtgttcattaagagatgattcacccagccctcaagagaatagaggccccatggggtttaatggtcaggtagggtggtggtaggggcatccatgtggagacaggatggggtagggaggaggtgtgggatatagagcagtcagagggtggataggggggctggaaatggtatatggagtataaaaaataaattgaaattgattttaaaaatacaacatatcacatgaaataacctaatagagtctttgagggactttctaacttcacaggcccagcacaaattatctgcattggtcgctatattgtctaccaagttcccacagttcactagactctgaacactcactggcttttctatcctatgattccaaattccttaaacaatcctccccccaaaagcatggttagttttgttagagcagtagtctactcttttgaaccaatttatatcctaattacagagagggagagggagatggggaggggaaggggaaggggaaggaaaatggggagggggagggggaaggagggggaaggagggagagttgggtggggagaggaatacagattattatagctcctcatgaagtaatgaagagaagtcagggcaagaacccagaggcaggaactgtagtgcataccacagataaatgctacactattctatcctttgtgggttgggaaaaagggccctacaggcttgcctgatgaaagcatcctctcaattgagattgcagttaccacataaatctcatatgtcaagtagacaaaagcagaacagatagcaagtcctttgggcatatgaccagctctcattataagacacagtgacataaaagattattacaacacatcccctcaaaaacatatgccacttctatagaaatgttctatggaaatattggtggtgctaagtggggttagagcaaagaatggagggcctttaacaagaaaggagagaggaggacaatatagaaggagaggagggagaagggacaaataacagtaaggatgtttgaaaaagtcatagagatcattattttatattgacttaaggttaagtgtgtttgtgcatacctactactgccattttattacaacagtggacttctcatacccacagatcagagtagatctcactactcatcaaagaagcttctctttgcagcagaagacctttacagataagtatatatagtcaaaatatagagaacaacacaactcctgtagaaggagaagaagaaggaggaggaggaggaggagggggaggaggaggagaagaggaggaagaaggggaggaagggggaaggggaggaggaggaggagaggagaggaggagggggaggaggaggagaagaggaggaggaggagggggaggaggagaagaagaagaagaagaagaagaagaagaagaagaagaagaagaagaagaagaagaagaagaagaagaagaagaagaagaagaagaaggtcgaaaagacaatgacaatgatgaccaaccttacagagaatatgggcagcaatactttaaagagaagagaggaatgaacaaagttaagacaatcttcctgtagtcaaagatgaacaacttcacaaaaatagcacaaacagcttgcatagtattgctttctcatccaaagcacagagagacaggaatgtcgtagtctgcaaatgccgaaagggagatctagcccaaaatcctactgtcagtgaaaatacaatccataatcaacggggaatgtcaagacattatcagatggggaaaatataagagtttgtaacagaaaatttacaattgctggagtgatcagatgaagttggctaaatgcagaaattcatagtgaaacattaggaaaaacaatgacaatccaaacacatagagaaatactttctgttttaaaacttctagaataaatttaatgtttgaaaacaattaaatgtctgatgtggtcacaaatacaatcggggaaaagacttaagctacttttatagaagtatggtaataacggaaaggaaacagaagttgtaagcaggttggatttcaactgttctaacagtggtgccagtgacaagggtgcacacaaagcctcatcaatatctaagtgattcctaaagacagagtttataagcaaagagaagtaaagttataaagaaaagttcaaagaatctatagaaaacatgaaaatggaatcagggagaaaaaaatagaatgaacagaaaacaaaacaaaaatgtaaggattaaatcctaataattcaatggtgtctttttaaatactttctcaaaacacatattttaaaataggcatagtggattacaaagcgttatacctattaaatccaaagaaatagaaaatatatcatacaactaaaaaatgaagaaaaaaatgtcatgttaatgtcaaattaaacagatttcagaacaaaaaaaaaaatcagagacagagtaagacattatataaggatgaatagtttggttccctgaggcaagaaaaagcctaagcaacaaacaaaaggccttcaaaatatattaaccctaagtgaatgaacataaaagatggcaaaaatataaaaatcaatatttgcatttgaaagtttcaacattcctctaggcaactgaaagactactagagagtaaattacactaatatgtgtgtgcaaataagatataaaaaccttgactatagagtagctcaaaaccatcaaacaaaatctagatgacaataataacaattatcgctgtttttaacagcaccaaaatacagtcctccaggccactcgtggataaatttaagacacacagaacggagtgaaatgaaatataatggcaaaattgtgtgatcctgtttagacaatgctaaggggagaatttataatatttaaacagaaaaatatgtggaaattagaaataaagcatttcttaaagtgtaagctttgctgacaaaagctgaagctttcaggctggaaggattaataaaaaataagagcagaaataaaattgcaacacaaaataaaagtcagtgaaaaataatcttgttctttgaaaacaaaataaaatcaacaggtctcatgggacactggcaaaaaagctagacagcgagcacagttcttcaatattagaagtgaagcagagatcactccacagagtcttcagatatcaaactagtaggaaaggactctaataagaaacttcacacatgagcagaacaacgtataaaaaataaacagttcctcaagatgcacagactgtcacagtcacatggtgtaaacacacacaggttattattaaattatgtcaaaaccaagttgaacacaaaaaatatatatgtaaatttatttttattaattttattagtacgcatttattgcagatatgatagatttcatatagtctatttgatccaaagtgcatcttgtacttttattaaattgacccctaagtaatcctctttgacatccattttctctatccagttttgtcagaaccatgtgctggaaggctatcatttctccaatatgagtttttatcatcttgatttaaaaccagatgagagttgctgtgaatttagttgcaaggtccccattgtgtccagtcctctatgtattatctttactgtcgacagtttcatgctaccttcctctttttaaattctttacattaggaaactacaatttaattatacttcccctttccctttcttccttccaaaccctcttatacacccttccttgttcactttcagattcattgtctcttttttgttagttgtcatcaatgcatatatgttacctatatgtacatgcatgcatatgttcatgtaagtgtgtgtgtgtgcgtgtgtgtgtgtttatatgaactgggttggtttgcttcttcctcatgttgtctgtaatcaagacattgaaaagcctacatgtgtttgtttgttttatattttcatactttgttgaaaggttttcttaatcaggtttaaaagtttgggaggaagtcttaaggggctgttacatgacggtattatctgccaatagtgataactggccttttccttttccacttacatcaatttctttcttatctcactgctcttggtatggctttaagaactgtgttcaatgagagtcattgtattcggtattatgtatgctctccccatttagtataatgttggttttgggtctgaataatctattaagatgagctgtgctccctctattccttccatatttgtcttggggcttttacaaaagttcgtttcattgtcaaattttttctgcatctcttgagatgaccgtgtgattcctaccctgtgtacattaatatcatgcagtacatttcctgatttgtatgtgttggaccatactgtaactccataatgaggccaacgcaatcacagtgaaagaaatttgtgatggggtcttgaatttcatttgcacatattttattgagaactggtatttgtgtttatcaagaagaatattctatcaaacttcttagtacttaatgtgtcttaccaagtattgctataaagactcactagatttgaagagtgagctgagtagcatgtttttattttatattttttaaaatagtttgagaaggtttactgtttgctcttcaaatgtctggtaaaacaatccatctgggcatcgaatcattttagatgagaaccagtcttttttgttatatcttcattacattcggttgttttgtatataaaacatcttgatttaattttgatatgtcacatgcttctatgttttttttttaaaaattcttttagaatgcctttgttacagtttccattggtgtggtaaacactgtgataaaagcaacttatggtggaaagtgtttattttcattttatagtttaaagtctactatccaataatataaggcaggaactcaaaatatgagccttatgggatggtcgatacaggtgtcatttttgaggaacactgctggctagcttgaaccttatggcttgctcaatatatatatatatatactttggtataccttctgctcagggatgggactgcacatggtgggctggatccttcaacatcaaccaccaatccagaaaatgtaccagtggttttcccacaaaccaatctttagggatcattttctcaactgaggtttgctcttcctaagtgactctagcttgtttgtcaaattaacaaaatactagctagcacatagatttttcaaatttattgcaaattatgtttttaaagtatgcctgactgaaaatacatcttggccacaacagtaatgtcagggtttggtgtctgtggatggaatggatcacatggtaggggagtctctggatggcctttcctccagcctctgcttcatttttgtctctacatttcctttagatagggacaattctgggttaaaattttttagatgggtgggtagccttatgcctccactgggggctatgtctctttactagaggtggtttcctcaggttctgtcttcccactgttgggtgttttggctaatgttataaaattgggtcctggggaacctctcacatccctggtgtctgagactttctactggttccccaagttccccacccccttgctacttatctttatttgttctcctggccctctggacttctctcctgattcttcccatgcctgtcctgtcctccatttttttcctgctcctcccctctcccagccagagcccttcctccctctgcctcctgtgattgcagacaggagccttgtatggctgtcctctgagcggctctgccagcacctgactaagacagatgcagataatcaccgccaaccactggactgagcccagggaagttaggggaagggctgaaggagctgatagggattgcaaccccaagggaagaacattattagctaaccggaccctcagagctcccagggactaaaccaccaaccaaagagtatatatgggccagtccatggctcccactatatacacagcagaggactgcctcatttggaattagtggaagtagagatgcttggtcctctggaggtttgatgtcccagagaagagggatgctggaggggtgaggcgggagtgggagagtagttgggggagaacacacttgaggaagggaaggggagatggggtgtggggttcctggaggggagaccaggaaggcagataacatttcaatgtaaacaaataaagtgataaataaataaataaataaataaataaaaacatgattattgtagccattttactcataattcattgtatgcattataattaactataaaaaaataagtatgcctgagcaatcctgtgagtttaattgtcagtgtatacctctgcatttctaattttgttactctcagtgcttactctttttttctgtttcccttcttttgtttgtttttttaaaatagttgggtttagacttgttcattttcctttgctttggtgacaattcaagtgttttcattttatttatatttcaacaatttctaccctgccatgtattgtttttccttattcttttacttgaataacatgcatatctctgcttaaaggataagttactggaggcaacaagtaagagggtcctgtcattccgtgtaatccactaacttgttccctttgattaaggaagggacatcatcaacattcacactcactatgacaagtcatctgctcacttctgtgatttgttttcataatatttcgtccatcctatttttcattttataaattactgattgtgtatgtgttctttcctgaagtctcaggatatacttattattctcttcagtgtgtaggattctttcacatatcttctgtaattctatcttaacgatctgatcatgaaatcaattcctgatatttgtgtttggttctccttcaattctgaggggcagtttttctagttattcaaagtggtaactttcttttatgttactatctttcagtccactgtcagaccagatttctactcagggaacctgtacttttcacacccaaactctttactcatgggactagtgcaactagatggattatcatggtcatgtctcacaagatactcctgtaaaagttgtcctgaagccccacatgccttcttagtactgctcccgttgaataccaagaagagttttgtttgtttgattgttatttatgtggttcaagtactacatgatatctgtttagtattgcaatcagagatggtggttttgagccagtgattcctctcatctcctgtctttgagtcccactgctaccacagatgctctgaattgtgtaaccattctctttctgtccccttctctctttctcctttccttcccatctgctttcttctctccctgactttttctcctcaggaagaaaaagaatttggaaagcacgagagagagagagagagagagagagagagagagagacagagagacagagaaagagaaagagaaagagaaagagaaagagaaagagaaagagaaagagaaagagagagaatcctacttgagtcccaagatcagaggacccacctcttggtttttttgtttgtttttttgtttgtttgttttttaatattttttattacgtattttcctcaattacattactaatgctatcccaaaagtcccccataccctcccccccactcccctacccacccatccccactttttggccctggcattcccctgtactggggcatataaagtttgcatgtccaatggacctctctttccagtgattctgaaccagcatttcacaggtgcaaacagtacatgacagtttaccagtataatttatttgacacaagtgtgctgtaagttactttacagagtatggggccctatatgtaagacctcttagagcatgtataggggaacatgggtctaggcaatgctgtggtatgggtgggttttatgattgctgaaatgagtgggttattgaaacattatggccagcgtgaatatgaaggtcatgaaggaaccaacctttcatggacaacatcccagaagagacctctattatactgtaaacaaatgcaggggttcacctcttgctgagtgcaaaacccaaaacaaacattaccaagaaataaatggacagagattcatgacctctcacagttaagcagatcactaaattatttcaaaaacaactctttactaaaattatcaggtatttgttttcttatgtacatatataggaaaggtgtgtgtacataggagcatactttaaagataaacatatttctcaatgtgctgtttatcattaaagttcacaagagataagatatattttgaggtatattgagctcaagactctgcacacaatataaaggttaaaattacaaagaagaacacatatgtttaggattgcatagagtgcataataaacatgacggacagaaatatctctgggcatgctcagctttttctgaaaaagctttttgatggtgaactacagaggaacctcaaagtacctggagcacttaccagccaaaaacacatgtcaggctaatagattagcacacccacttcttggcatattcctcagcattctttactagtaaagttgatctttgtactctctgtgattcgaggtgttccatggacaaccatctttattattatatgcatgccaaagggaaatttgtatctaaaagacaatgtacttataattcgagtactttggggttcttgaattttcagcttaaaaccggtatagtttcaggccaaaacaaagtttgaaatgtattggttcatcgtatggagtttatactattatattgtaatatgaatacctctatattttttctgttaaattaactgtaaaagatgattttacaatatttttagtcggtttacaagtattgttttatttttcactttgaaatgttctaataccatgaaagataaatctatgattttcacaatatttatgtatttctataattttattcttaggcaacaaaattagtttccttgtcagaaagaaaattaaagagaggacgatgataagaacctttcataaatgttgatgcctgaagctgactcttgagatgcagctaaacaggtcttattgaggacacagaatatttggttcagacttaaagcatgcaaaactgaatcatgaagtattgctcaaaataggaaagaatccttaatgcagttatcagataaaatggcttaaaaaaaatcagtgtatctgaaccaggggccatttctaaattaccttatcttctgtatcaaggaaaatctaattttgtgtttggtatagaactatatgagatgcttatatatttgaagtgatattgtttgaagctctgttctttgtaagcttttgttcttttttaaaccaagcattaactgaacatactgagctcatctttaatgtctattgtaattattgattagatgggatcaagttaaccagttcccaaaacaaaacacaacatcctcctctccaaaacaagtatttctttcacatcagctcttaaaatcttactcaagtgaaactttctcttaccttctgtggtgcaacttgtatttcttacttgttaaatagataggtaattcttttagacaggtcattagcttcgacacagatagcactgttaggataatttatccaccatccaaacccaagagaaatgaaccctccaagaactggaggagagtaggagaaaatattgaaggatattgatttggaaggcgggaaaattgatagatttaaattttttgaattaaaattagagttgaaaattgttcctaaatcaagagaaaatgaaggtagaacaggatctttggtatcacctggaatgtctagagtgattcatcatagtaatataaaggcagtcttctaatattgactgacggtatatgactgattcatttcaagggaagaatgaaaatttcacagactatttcaagtccaagttcagtacttattcagagaaataagatcagagccccaccaaataactacagtgtatgtgtgtgtgtgtgtgtgtgtgtgtgagagagagagagagagagagagagagagagagagagagagagagagaaggagagagagagaaggagagagagagaaggagagagagagaaggagagagagagaactgtataatacatttttatagtcagcatctggatgacttctgtgtagaatcgttgtgttcagttattagaaaatggttttaggtgttgtccagcctatataactcactgtagctagaaataagtctaaagaatatctaaggcaagagaaacagtatcaaacataaaaaaccctaaatggattcagatggacctgttatcaaacagtagttggaggaaaaggagctacacttgtgaacttagaattcaagcaaacaaacaaacaaaatgtaggaaaaggggagggggagacttttaagatatgttttgtcaatggctgtcttagcatgatttggttatgtttcttattcctccacccaggaaggcattttcttctctgttttagctgtgatctcttggaaaaatttcctcctatcacacagaaatctatattcctatgaattttgctcatttggacaaccctgattaattattagtcatataaaataatctcattttcttcttcaaatattaaaaaggatctacgtgaatactttctgtgtacaaagacctgtagtgatgtctaaaagcttaaaaagaacgtaattctttcctgaagtcttatgaggtatgcagacatagggaaaatagtcctgaatgagaagagtgcctgacctgagccaatggctcttagctctgtaaaaagggtcagaagcttctagaaggattgtttgagctgaataacaataaaaacatatttctcaaaaatagtcacgtgttatggtaaatatcttcatcccaaatattccccggcaataacaacacaactcaattaatatgaatacatactgtgtgcctagttgggcagatctaccactacactaccatctttcacatcttatgagaccccttagaacttgtggtttcttcaggccatgtgcttctgctctgcttttcttcttcttcctccttctctgtatcctctccctcttccagtttctccttcttctctctccccgccttccactccaccttcccttttatctgcccaatcatcagctctcctttattttacaaattaaggtgggaagcaggcttacaggaaatcacctgagtgctgactaattcctttttccgcagccactcacaggagaatggaattaacatcaaataaaattagtcccagggctacccacaacagacatgccctatctttgttggattatattatctctttaattatatgtcagacatgctttggttatagtttgtctctactccattggggcactcctttcagtcaatatagcttgtccctccaccatccaggcagtgtttatcttagtaaacttaaatctctatatagagtagagaaataaaagaaatgtgttaatgtgtaggtctgggattagacagtagagactgggaaagtctatgggaatcagatgatccctatactgcttaaaaaatatgcattttcaagttccctttaatcttctgttattgtaagcaatgtgggcagggtagatttgactaggtctgttgtctgatagggataataatccatacagtttctagagcaaatgttcagaaacctgtgtaacatttgtgttgtgatctgaaaaaccagaaatatgtcttaaccattttcacactagtctacatttctgttaacctagtccattgtttaactaatagtatgttttgatatgtgagtgcgtgagttgtgtgtgtgtgtgtgtgagtgtttctattgtagagtcatatattctcatgatatgcaataacaagttgttttatcagacaaaatccaggatcccatcattttgaactgcaaaacctgacctgcagctctgactctactgtttataagcacaatgatcttgagaaaagagatttgccaaggagaagattatgtgtcattcagatatatggagttcaatgtagctacagaatattctaattgaagtgattatgtcagtgtaactatggaacactcagcaatttctcagcacattagcataaatttattttcaatgtctttcagatgtatttattgtttttattgtatcatagatcccccattaaggggctggagaataaatatatttcctgacaatagtattttcttgagtttccttttcttaaaggtttatttcatgtttgatcaaaataggaatttatcagctgagactgttgtaaaggtttgtttgacactgaaatgattcaaatcaatggaggggaaaatgtatatttgattggtgtgttcctcctttcaatcgtgagccagttgtcctcatgttatagtgcctcatagagaatattagagaaaaataataaataattagctatttaagcacctagtatcttatttcaaatatattttagggaataaaatgttgaagtcatagagattatttaaaataatgaatatctatttgaagtcccagaatggtgagtggcattctttctatagcatagtcaggaaagcaaaaccctgaaagcctctttctgcttagctcagtagaagggaagactggatactcagggttgattagttacctgcttagtaaaatatcagatttgccgatatttaagacaagattcaaggaaaagttattttgtaattcctaaattttaataatgccatactaatattcttggagaactttatacatgctatatactttgatcatgttcctttctcctccccaactttcccaagtcatcttaagtcttttgcagcacccaacctgcccaattccatgctatttctctttttttaaatgaaaacaggaaaaactagcaacaaaaggagtctaaattgtgtaggccaactactcttaagcatggagatgacactggagcgtggtgatttacccagtgctgcttcattgaaatgaaatgaattttcctcttcttgtagctaacatttataactagcttcctggctaggtgtggaacttggtgtctatgtcctctactctgggactgtaattttatctggcttgaccttgaacaggtcttgttcatgacattgtagtttctgggatctactatatgagctccgtgagtgcattctgtgagtatattctgtgggtgcataacccctttgtggctgggaaatgctgtttctttgaaatcatccaccactacagcttcattgtctacatagattcttgagaagatgaaagtatgacatgaacataccattacggctgcacagtccagcttttaaagctctgcccattatctagttgtaaaaattttaaattaattaccatcttctgtaagatgaagcttttctgataagggtcagacagtggactgatctatgagtatagcaatgtgtcattattagtcacttaattgctgagcttatttagcagaaaaaagtagtatgttttctgtaatggtgatggcccatttgctctctagtctctatctggcttcaccaatggtgtcaggtaaggtttcttatggagtgggccttacatttcatttttaaaaaggtgattggttactcccataaaatccatgcaccgacaataacatgtatagcttgaggaatctaggatatcccattggtcagtaccataagcaagggcaacctgttcttagtatcaaagggttttttgtttgtttgttttctttttggatggtgcattttgtgtaactgggatactattcttattatatgctaactttatttaagatcctgttacatgtgtatatcttaactgatttatacactagtaagtttctatatgactcttctaaagaccttttgtcttaattatctcttcctatactccttcctctgctctggcccattccacacctcatttaatcttcctgttctaacttcctattcatctccttataatacaatgttccatttccccttttcctgaaaattcttttcttccccagtcctttttgtgctattaatctttgtggctattctaaataaaagataatcctaaggcaaaaaatccaatcctaatatccatatacgagaagagcctgcaagtttctcctcaggggcctgggatactttgcttaaggtgactttttttttttttttctggccccatccatttgccaacacattttataacttctattttcctagaaaaccaatcatattccattgtgcaaatgtaacacatttgcaataactttatcagttgatggaaatctaggctgtttatgttttctggttattatgaatagaacaacaatgaacatggagaggcagtgtctctatacagtcccaagtgtgggaagctgtatcttgtagttgatctacttttagcttcatgagagccatccacactgatttccatagtggctgcaccactttattttccttctagcaatggataattgtcccttttcctgaatccattgagtttttatctcattacatgcagaaaagtcccgtgacaaaattaaataccacttcatggtaagtctggagagactatgcatgtgaggaacattctcaaaacagggaagacaatctataagaagcccacagtcaccatcattctaaagtagagaaattcaagcatttccactaaagtcaggagcaagacaagaatgtgcacactccattcctgttcaacttagtatttgcaattttaactaaatcaataaaaaagtaaagaaatgaaggttatgaaaataggataggaataacttattgtatgcttatgcatagatgatgtatttagctagaaactccaccagagaacttatacatacatttagcaaagtagaggggtacaacattaaggcacaaaagtctgttttccatatatacaaatgacaaatttactaagaaagaaatcaaaatgaatacttttcacaatagtctaaaaatatcctggaatgactctaataaagtaagtaaaatatttatttaataaagactttaagaagaaagaaagtaaagaagactttagaaaatgaaaaacatgtccatggagtggggcaatacaaaacttgtgaaaatggtcattctaccaaaacaatttacatattcaatgccatacctatcaatattccaatacagtccttcactgaaattgaaaaaaataatattaagtattatacgggatatataaaaaccaagaagagctaaaacatctctgaacaatgaaagaaatgctagaggtatcaacatccctaaaattaagatgtactacagagctgtagagtaataaaaacagtgtgatactggaataaaaatagatacactaatcaatggaataaaataaaagaccaggacctaaatccacacatctgcacacttgaggtttgatgaaagagtcaaaatgcaaagaggaaagaaaaagacaagattttcaacaagtggtattgaacaagctggatacttaaaccgaggagaatgaaattggatccccatctttttcctttcacaaaattcaattggaaatgaatcaaggaacctcagtataagatcagatcctctgaatctaatagcagagaaaacaggtactgggctttacctcactggcacagaaactagctttaaaacaagatcccaacatcacagacgttaagacaattctttttttttttttcttttagtgtgtctgcaggagaccttttaaatatttgcattagtttttattcaataaagtatcagcaaaacctaactgacagccacagagccagacactggggatatgctcacaaacagaacgtacaacgtttcttttctcatgagtttagaaagagttctcttaaaaccacgaacttcacatcagcaatctcactgatgaaaaaaggcacagggtatacattatataagctaggcaaatttgctttctttatgagaaaaggtctttattctaaatgctttacacttgattaattttcactctgcatgtatttgtgactatgtgtgtatgtatacacacacatacaaatgacagaaacatgcacacagaaacatacccagagacctatatacagcaaaataaacacacacagacagacacatagaacaacacacacacacccagacacacaacacacatacaaagagcaacacaaacagagacacacacacaacatacacacaaagagcaacacacacagagacacacacagtgagatagaaacacacacacacacacagacacacaacacacatacaaagagcaacacacacagagacacacacagtgagatagaaacacacacacacacagacacacaacacacatacaaagagcaacacacacagagacacacacagtgagatagaaacacacacacacacacacacacacacagacacacaacacacatacaaagagcaacacacacagagacacacacagtgagatagaaacacacacacacacacacacacacacacacacacacacacacaagaagacaagtttcagaagtcagttctctcctctcactatggggtcccttgggaagtgctatataaatttgctttgctcagtaagattatttctgccctactgtacatcagctctccacaaagttatagttataaacatagaccatgggagaacacatttggcacatggaaaattttaaggcagtgctaacttctaattttggcagattggcccaatcaacaaattccccatatagaaacaaaatgctcagctatccttgcaccaaaattaaagacaattcctaaatgaatgatagaaatatgaaatgagagtagaaatcatgggaaataatttaggcttcttcttcgatgactgaatgatacatgtaatctagaatcaaatcattaaagtggagtcatgataaggagttaaaacccaagttcttcataggtgccagcaggctaaagcctcttggtaaaatgattgcactctcctgtgcaaacacagagcctcttgttgcttccagtgggaagagacccatgctgagattctacatcattggctgtccaactgtattctggattgtcttttgaattcataaacccagaagaatgcatggaattcactaagctccatagtaatctatttaacggaaagaggctcttgatgagacatgccctccagaattttgctgtagaaaatgttgtcagtctaagcaactcattggacatctcaataagtttccataggaagctaaaaaggacattgttttatttgaaatgaaaaagttagaatataagctctataaatgagagctaaaacaatcaacagtttcaattgtcccactaatttcaaacatcgtagtatcggatttaaaataaatacaagatacaaataacattatacagactgaattcaatgggttatacttggatatatatatatatatatatatatatatatatatacatatatgtaaatgtttgtatacatacatatatttacacccatatatgcatcatatatatgcatcatatatatgtacacatatgtatatatatatatgtatatacatttttatctatctatctatctatctatctatctaatagcaactattgaaaaaataaggccataaatttgaaggagagcagtcagaattatatgagggagtattggagggagaaaatggtgattaaaacacaatctctaaaatcctactgtctttaatattgtgacgaaaatgcaaagagtaaaatacaatcagatagcaatgactacaaaatagaagtgaccaatcagtggtgagaaacaaataatggaacccataaaaatgcatgcatagtgatttaaatccttgagagcatagaaaagcttcaagcagatttggacttggggttatctgtgtctgttttcctcccttgaacctggcccatcattgctgtgctcaaccttgcctgcagctgcttttgataaaagctgtcattatcttcagacctgagctgagtctctaagtgcatctacctttctctgagtgcttacatgagtggtttatctaacaggttaccactaagaatctgagacagagatgactcaaagtgaccaaagaccagaattaaagcaaacctgtgggataattgccctatttcctgggaggagaatgttcatgctacataacttgacaggaactttccctcttgactctgggcagattgatttttgacttctgggacagagcactgtgtctgacctctggctcactcctgctcctgtgcacagtggtccaaatgtacttcactctctgctctatggtctgctattcagaaagaccaaataactagggctctgttggcggtcctaggatgctggaaaatagcagtttgaattattgcctaattttgtaatttacatgagttaacaattctcagagtacctgagggttgttagttcacattttctgcttttagaatctttattgtactgttatatttcatgtatccagaaagatgtagagacacttttaaaccaatgcaaacactcagattccaaattaagaaatccaaattcaatcagcataatactcatttgatacattcccaatagtgaagggcattaaaattaatttgaaactaatttaataagaatgctattataaagtcagtggattacagaaaaggatagaataatccatcagtttactgcatgtctccaaaataatattataatttggggttatttgtttctctatgatgatgttttctgttatgccaaattttggatagttctgctttaattatgaagtttgtgtgtgtgtggctaataattattgttttaataacctaactaaaagaaacattctggtgtttaatagttgaaagttccattatggagatattgtcaaacacattattaagtgttagtaacaaaaagaatatttaaaaactgtctcgaagtcttgctttaaattttgctatgtctaattcacctttcaattctatctccattgtaacccatgtagtaacatttggtccctacaggactcagccacactaagttcaaggcaagctgaatctgatgctaggccaggaggaaatacatactactactgtcttccttcacatcattgtttggatgcagggactcaaccttgtgatggaatctttgggaacattaagtcttttgtttctttaaatttatttattcatttacactccaaattttattcccccccccagcccccagtctatcctccaactcttccacataccattcatcctccccacacccttgtctccataaggatgtgcccaccccctatcacaaactccacctgatctcaaaactccccggggggcttccagtctcttgagggttaggtgcatctcatctgattgaatacagatagggcagttctctgctgtatatgaactgggagcctcatatcagctggtatatgctgcctgtttggtggtccagtgttagagagatctctggagtccagattaattgagagtgctggtcctcctacagggttgccctcttcctcagcttctttcagtctttccctaatttaaccacaggggtcagcagcttctgtccattggttgggtgtacatgtctggtctctttttgtgagcactccatagcctcagtaatagtgtcaggccttaggaactcctcttgagctgcatcccagtttgaatctaccactggaccttctttttctcaggctcctctccatttccatccctgtagttctttcagacaggaacaattatgggtcagaattttgacagagggatgacaaacccctccctcatttgatgccctgtcttcctgctgttggtgggctctataagttcgctctccctactgtctggcatttcatctatggtatctccctttgagtcctgagagtctctcaccttccaagtttctggtgtattctagagagtctcctcaaccttctacctcctgaggtttcctgtttccattctttctgctggccctctgggcttcagtccttttacctcactcaatactagatcaggttcccctctcccctccctacgcccatgcaggtccctccctccctccccacttgtgatttctttcttctccatcccaagtgggtctgaggcgtcctcacttgggaacttcagcttgttgaccatttgagttatatggactgtatcttggatattcagtacatttgttttgatttggttttttggttaatatccacttattagtgagtacatgccatgcatgaccttttgggtctgagttacctcactcaggatgatattttctagttccatttgcctgcaaaactcaggatgtcctcattcctaatatctgagtagtattttattgtgtaaatgaaccacattttctgtatcaattcttttgttgtgggacatctaggttgtttccagcttctggctatcacaaataaggccggtaggaacatagtgaacatagtggaacttgtgcctctctggcatggtgggcatcttttgggaatattcccaagagtggtattgctgggtcttcaggtagatctatttccaattttttgtttgtttgtttgtttaaatttatttatttatttattttttattagatattttctttatatacatttcaaatgctatctcgaaagttccctataccctccctctgccctgctcccttatccacccagtcccacttcttggacctggcattcccctttactggggcatataaagtttgcaataccaaggggcctctcttgccagtgatggctgactagaccatcttctgctacatatgcagctggcacctccagattgattaccagagtggtcgttccagtttacaatcctatcagcaatgaaggagtgttcctctttctccacatcctctccagaggttttgattttagccattctgactggtgtaaggtggaatctcagggttgttctgagggaaaatgaagtcttttcaagggaattcaggtggtcctttttccctgtgtgtggtttatttaaatatcaaaggatttgtccttgatcttttatgctttctgattccttgaactactaatctctatcaagacatttaaaaattatggcaaggacatcttagtgtgagacacttcctcagtattgagaggctagctatccaaagaaaaaattaaactacagtaaaaatacttgacaagagatgaagagaaccaaagaggagtgataaaaaggaagacatgccttcaatgtttaaaacaaaaggcacttcccatgatagacactttctgttccatctgcctagaagtgacaagagcctttccctagaggcatttgagtaggagccaagatgtcttcctatgccaggggtttcacagaaggcactgtataataatagtaagtagaaaactggatatgtttaatgtgtccctaaatcaatttaacctaaaatttaaaattgtttctttttgcaattatactacatttccatcatatctgccttgtttcctctattccaaaatgaaaggccaattagaaaacaagtttcctgtagatgtattcacctggcagacagtgttgtcatcactgggtctgtcctcacctgccaacattttggtgcctctcaaagacagaaactccatacacagagactttctcttaactaaaatgctgattttactagtgacaagcttgatatctgatcttaaaatttaatatgcaactctcaagacaaacagattagccacacattaacattttagtgtgtcatatttcattgaaatcaaccttatagtgagttgcttcctttgaacttggactttgtctctatttttctgtgacttacaatgtaatgcgtatgctaccttttcctcaaatcataaaacacaacttcataatttgatacacattataaaatgaaattattttaaaatatattttacattttaaaattgtgtatatgtgcattagtatgtgcatgtgagcatgggcacctgggtaggccagaggtattagataccttgtaactggaagtacaagtgttagccacctgttatgtgagctgggaaataattgtgagctctctgtgaaagcagtgcccatcttaactatagggctacctcttcatactctgagatcaattgtaaaagcagcaaccaacacattgagactaagacacagagtactaacctggagctcatttctgattgatagatgccctcaaaggctgattgcttctttgcgttccaattaatcgaatgtgagttcaattcctcttagaattctattcagactatttaccttcttgctccatgatgtacaatttaggcttggtattttataaagaaaggagaatttcctagttcagttcagtcagctgaaaatccatgatggaatccatctgataaaggcatcttggctgggctcagcatgcagatggtgtcatgtatgaatcatgtgttcaaaagggagaagtcacatggaaggaaaggacagcagaaagagcactgggggtcaagcttgttttctatacaaaaaaagtttgcattaatcatcctagagggtgacgtccccagttcccagtgactttaccattttcactagggcccacctcttaaatggtccatcatttgctaacgcttgcacgttggttgtctgtagcatacaaactttgggagacagtctgcatccttgccatggcagcaaacttacatttcacacacctccacacctttgctcaaagtactgaaaggagagcagcatgtgctgactaggaaaatagtcttgttctcagatcgcagtgtcgagaacactaaagaaagcttttgtaaagagatatattacatcgtagtcctcttcaccgaacccttgccattcaggagagtacttaactggaaagtttatatgtagaacaaagaaaaatcaatggaaggcttgggactaggaattgatttttcttgctgtgtttctaggggagaacaaaacactgcctatatccctgagaaagggacttcccaatgtgtgtgtctcctggtaggaattgtagtttatttgcaatggtcttaatttctttagagaactccatctgaaagcttgcagcactttagaaaatgtcaaaggatccagccttccatttgtaagagttaacagagaaaaacttcttaggagtttctcatcatactgtgttttctgaattttctaagataaggcgtcatctttgggtttattcttagctgtcctgattttatttcacttgtgtatcataactatgtctttacgtaatttccctaaattcctaccatttcctcttatttttgattcaattaagaattttaatgattagctgaaattataactttccataattagggtataaatacatttcttttaaaattctgacaaaaataggcctacagttccccagtagactgagcaaaaaggtgcttataaagctcctgagtgaccatttggtgaccttaggcaagttctgtagtcctcaaatgtcaaaggtactaattaattttactctttccatgatagaaaataatgcttactgtttaaaggtccattgcttgaagcaatcgatactgcatatgaattaatatcagggagaaattaatccatacaaaggaaaagaaagcttgttaagctatattgctaggtatgcagaaaagaagcaaaatattgagttaggaatattactactataagcctctctagcccatctttctttccagctttgttgtaggtaacacctttcctcgtcttccattggccagttgttttcatttgtgtatcccttattgttttccgcactgcgttgtacctctacattctaccctgattccctctcacagtccagttacactgttttagtccaatcctggccttgaagtagaaattttccataaccaacaacctatatgctggagcatggcaagctctctctcctagcgttgcttggccttcatcctagccatcatgctgacgaatgccttcagctacaaagagaaaacatccatccaacagagacttcagcaaatgcacgatttgtttttctcaccagtcttacctgtctgctcttctttctcatacacattacttcatggccacagacagctgctggaattctagatatttaaggcattagctccttccacagttgcccctggtgtttctagtaccagctttgcctctttttactgtaactccttattaagttaaactattgacatcgtgacagaaagctacccctttgtaagattataattgtatctatacatgcaggcattaaaaattgataaaagtcatactatttgattatgtccttgccagaaatgagacataaaagttctaaagacaaaaggtagtatttggaatcttcatttttgtatatgtaggtgtcttagatttgtaatatcacaacaacaacaaaaataattctagagggctaagttttcctgttactttttattttcttgtcaatatctaaaacctattggcaaagtgttagattgattaaaagcatgaacacatgcattgtttttcattagtgattttaattagcatttgccccaaagaaactagtttggcttgttcataagcttatgtaccacaagaggcactcttgtttctctgtttacagtctgggtgatatttttttatagacttatttcttatgatggacatttagctgctggcaacaacaaccaagccaaaccaaagaaaatccactgtaattcaaagattctctgtctctgaaactacatacacatgtaaaggaaaacctatgttgtcttctctgatagtcatagaccttaagtatgtaagttatactataatgaaaatagttaaaacatgagaaagaagatattcattttaaatgtcattacaaatgaaagctgcaaatatgttattgcgtaggcatctaaaatccttttaaattatcccaaagggtagaggcaattgtgaactataagtaaacatatttttattttttctctaacttatttattctctttaatcctgattgtgtccctcttcctcccagttcccccttacatagctcctcctccatcctcctctttacctctaagaagggggaggtcccttgtggggcaatgggctatgcacagacagcctgctctccagtcgagcttaggtcttgaacctcagtgggacccagtgggtggtaatttacacccacacgggacagaaggtattcgatcatgtctcctggcctcctggttcctgtcgaagttaccccccccagcccccacggcccccacaggagaagcatgtggctatcagtcatgtagacaatgtcacaagcttctggcattctggctagactcctccccacagttacctagcaacagcaagatagcccagctcactataagaaaggctgcttggccccacctctctctctctaagcttttgcccctcttcctctctagccttccttttctctctctctctctcttctgccttttgcccatgtggccatggctggtctctctctttttctaccttctctcctttctccctgcctttctacaataaagctctaaaaccatgatggcacgttgtgcttaaacgatgggataggctttctcctaatgagtcaagactaacctcccatcagaaggccttccttctggttccttccttcaggttcaatgcagccacgaaccacaaacgggactaaggactctcgcctgagtgggaaccacccagcaccccctctccccctgtcctctcttcccttcattcttgaggcctagtgctgccccagggcccctattctattctcagctgctctactgtatctggcgtgagatgcctaggctgagaacgtggtacctggggctgccccttgtccactacccactgtgtggggtcagtggcttcacacagccagatgcccacctggggccacgtggatggaaagcatgcagtcttcccacgtctgcccacccagagcaccggaactctggcaggacttgggttctgtcccactcccctcttgcccaacacccacagccccacagtccctcctccagcattgatccaccctggcacctcaggccacttctagactcagtacacccttggccactgaggacagacaaggcaacccagttaggggagcaggatccataggcaagcgacagagtcagggtaagcccctgttccagttgttaggagaccttcataaagaccaagctgtacatctgctacacatataatcaggagacttagatggcctctcagagaagagtaatgctaggctgtgaaaacaggttaataggtacaaagagagccctagggtccaaggtagttgaaagaggaaggcaggctaaaaatgtgtccatatagatcttctaaggacagctcagcacatccaccccacccccaaattggcagggttttctgctgcattcatttatgtctgtctcacacaggtaaatatattcatttgaaccctattgaccctttcttttcctagctatgtttaagtattatgtgtgtttgttaattgctggcaatactgaaattgttcgtattattaacaggatctcattcatcagtgataatagttttgagctgtcaaaacaagaaagaactaacaaagaagttaaaataaaaagcaaaaccatgtttgctcttgttcaggtagaactatattcaggtttgagattgtctacatagatattaacgagattgtctcatagtgtatgttttctaagaaacaaaatgttttagcttctgctttgtcagtagaatgtgattcagaatcctgaggacagaatattttgaaagatatcactcttataacaagattgtcttataccttacactgataattttgtcttttctttctgtttctcaaagcaaactgtgcatagactaccatgaacggagttgcttaataactcttggaagaacgccatgtttctgaaggtttactgggattgagtaattgctttttaagaagacatttttatttatgtgtagaactgtgtgtctatgtgagtgtatgccatgcgtgtgcaggtatgcacagaggtcataagtgggagttgggtaacctagaaaggagctagcagctgaaagcatcaggttggaatgttgggaagtgaacaagggccttctggaagaacaggaagtgatgttaaccacagagccacctctaaagactccctagttgccctttgaatcagtacatgagttctcagtaaaactgatataaacattattttgtcaggtctgtgtggtctgaaaatctcaagtacaaactgataaagtgaaatctcttaaccagtcatgggaaaaacaaagattcaaactcagcgctggtcttttagcgcatgctttgctaggatgagttacccaccaacaagtctactaagtagttttaggaactttcacattaagatcaaaaggcatttccttaaggtgatgacaaaaatacatttaagacagtggaatagaggaagcatgtatagtgttaatgctcatatatagtgtagaatataaatgtctataatagcagaggtgatttgcaagctaattacaatgctgagaagatgcagcccactaatgtggaagcctgttaatacatgacagagggtcatacatgagatagactagtgtttcaaaaccataccaatgtttgttaaatacaattttgccactcttccaacttgctaagcctaagataaacatgcattgcctggactctgcttgtttacgacacaaggctgaaaactctgccttctacttgttatcattttagaaagatatttcttcctatctataaatggagagaacttagcccatttttatagtgctctgcctattttaacacttatttctgatagatatgcaaggtgaatttatgttttcaggaaaattgtcacacaccaaaataataatgtaaaatccatgttactttagatgtcaccttagaaaaggacttaagactgaagcagcttgaaggtgattgaaaccgttattccagttgatttaaaggcaaaatatatatagaatatctttaaaattttaggattttcttcctcatataaatcaaagaaaacacaatagtaaccttctcctttttaaatgtttatatggtacttctaaagaattccaaagaatagagcaagctacacgcaaagttcagagtcagcattctgaaaatactccaaagtacctcattgtctgcactgcatgaagacctctcctgtactagaaaatcaaaaagaatcaaaacagaaaatgtagtttcaaagacaactattacactagactttgttaagaaagtttcataattagatatatccattagcctatagcctttacaagcacaggttccactgtcataaactggcatacaagattccatttgtttctctaagcagtgtgacactgattttcagttgaaaagagatttctggtttgtccttgttctttgctgtctttagtgtttggctttcttcccatgtttttatctcttcctggtgatgcccagaattcctatagcattgatgtgtttgaggtttgaaagtgaagcccagatccagccctttctatgaactccaagtcactcatgccttactgacatgaccacatgggaaactcattaggtttctcacagtagattattcaaagtaactttacttctgcccccaggaacttatcttcagtttttccatgcctgacatcgtttctagctttctctcaacctcttaactccattgctgctcttggctttgacatccatcatctccccttcctccaatatagtctggctttttaaaatgtttttttttttaatttttgttttttgcctttgaccacacttcctggagatgaataaattaactttgggtccacttagaattctagtccagtatctggcttgtcaattctttgcaagtgtttaatgagctttctattgtctactataattgttggtgattaacttcatgtgccagtactagaccctaaactacaagatggagcagaattgatcccttttaagttattgactttggtcatctactgaaaactggtgattctgtgatgtcctccatgtttcagattcctcctatcttccaactgtgcaatacttccagaataatttcagtacttcttacagcaccgtggtatcagaagctcaagccagcacactgtccttagggagatggggcacaaaaagaagagaagaaatgatggaagtgggaaaatctcccttgcatagttttcttggagactttgattgacaactttcttttacaaaaccttgctcatcctaatctccaagggacattcataaaggtttttatttgctgatacagtcaagccttaagtacactaagtcttttacattaaaggcttgattcccagcacaggatagagttgggaaatggtgaaaaatataggagaagagattctataagaaaattaggtcaccaggggcttggagtagatgggaagatgctggctccgtcttttctttctttgctttctggtttaactcttcagctacatgctccagctatgatgttctacctcaccacaggctccagaacaatgagatcatctcaactttagctgaaacctttgaaaacatgagccaaagtaaatttgacttttctatactggtttatttcacatatttttatagttatagcacactggctggccttggtgactgctcctttcaaactaatgtgtttcattagagaagagggaaaatggagggttcatctaatttattttaacaaagataatttgtgtttttcttagtataacatttttgtagcattaactgcactgagtttaatggcatatagtcatatttcattgaaaaccacctaaatgtaaattaatctggatattagattacctttaaatcagaaaaaaagttagagaatactttttaaatcctgaactttttcctcagaatgtcatggagtattgtggttgtaagcagatggttacaatgcagtaaatatagtgagggaaagaaaatgtcctcaaatgcaaggtcttttgagccctaaaggatagtgattaatcttctattggagaggcaatatatctgtgaagggggatgtttgtaacttccatgaggacctcagttacacacacatacagtactttactaggcacatagtaaatgttcaatgacattttatgttacagaggaatgaaagataggcaaagaaagggagaacatcattatttttgctagtctacgagaacttaatgctacggtaagaaaggatgagtttaggatgctcaaattgtaagtctagtagcttgcatttataatataacctccaagttggaaatatatagatctgaggctagagagcaggtagtagaaaaattatgacagaatttcagtaataagccatggtgtggaacattcgccataaaggaagacttagctccttgaccaagcctagacaaacaattgactgacttaaagatctctcacattacggttggatctgagctaagggaatggcagtgtggagatagaacagcatgctatgattcccagtgcttcatccctactgtaaatgttactttctacacacttctcaaacatttaattttacagttgcctaaagattactgaacttaagaactgtgtcttagtaatccacttccccagatctatggacattttcacaaatgccatgagcatttacttcctgtttgcaaatggaaagtgcatgatttcaccatctgcttcctgacgcagccccttctgttccgggtttgacactgactctgttgtactttcctgatcttggtcaggaagcttgtctttctggtcagtagcccgatgcataggaggtcatgatgctactctgtcctcaatgtgtttattttgcagtatttattaaacatctattattcattatgccagtttggggcatatttacaaatgtaaatctggcatgattttcaccttaagaggattttaatatgaggaacagaagatagaagcaaaaagttggggagagagaaggggcagtggagaggagatttagagttcaatgaaatagtatgaggagggaagtggaaacattggaatgaacaattgggtcaagcagagatactaatgtattgctagacattctaaagatgagatattagcaactcagtagaaccacaggacagcagagcagcatcattagacctcgtcacctggtaggatacagggacccaggaaccctggcaactagaatggactattggtagattctaaaagattcctaggtaaatccaagggaactggatttcctcttggtgatcatgagggcttcacctctctgcttagatgatttctagatgaaactgtgggacaaagtggtgagtttgtcaaattagtgtgcctcctctctctgttgttccttcggtgttccttctagtttccttcaagaatgtttttcactcagacacaaatgttaatacagtgatattaataggtgaacaattatattcttaatttcttcagtggtgtgtgtgtgtgtgtgtgtgtgtgtgtgtgctcaatatcacttcataccttataatttggatcttcattgtaatttcttataattttgaagtaatgtattttgattttgttctgttttcttaataacaaatcttagaaatccacagtccaataatcttacataaaacccatgaatataattggttgagtgttttcacatgattagactcaatatagatattttctaccattaattggacatcaaaaatacctctgaatatgtgttctccacagacatgtagggattttccttttgctttgtgattctttctgtttgtttatagcataattttataactctatcattattagtacatatcacttgaaattcccactcatagcaggcttctgtggatgtttcctcttttagcattaattttctagcaaagcagatgaaaaacactcttccacctcttagcattctaaagcaatactgtgcatgtaaacactgtatttatagaccacgaatatgtttttgtgaaaaaaattagtaacatagaggaaatatattatgtggcatgcagcttgagagattacagcactccacttccagttcactatttctgcttgctgcatgtggacaaaatgtgatatctcaccagtctgctcatgttccatgcctgtctactgttgctatgccagcattggcattataaactctatactgccggaaccatacataaacagaagctctgtcttaagaagtatatttaatcatggtatttatcacatcaacagaaaattaactaatacagtgatctgtgtgccttggagtatctttatcatgatcaagataagttaattagagatttttattcaatgagctttaagatacatttatactggagaaagaagttagtatccatggtagggtggatatagatattaataatatattgctcatttcaaaaatctagaaggaacactcaacatgcatacaaatgcaaacatacacacgctgaagaaaatgtctaaaaagtatatatcataaagaatgaatatatacttgaggtgattaatatgtttaacctgatttgagcattatgcactttatttgtacatttaagtatataatttaccatctaaatactgtgaacagttctcatacttttaacaatcaactaaaagaaaactaaacaaagagttaataaaaagataggaaaatatagactttttctaataaattaagcagtatatattttaataataaggccaatgaatagatcacaggcaaatcataaattattctaatgtattaaaataaaaaatagtaagttctttggaacacagtgaacaagaagcagaaggagattggttgctacaaatgtgttttaaaatgaagaaaaaaaattttattaattaatttatttatactccaaatgttgctccacctcctggtccccccctcagtgttcttcacctaattcccccacctctttgcctctgagagggtgcagtctcctcccctgaccccttccctgtctgcatcctgcttccctgttggagcctctgaccagcctgtgtattctctttggttagtggcttagtctctgggagctcccaggagtccaggttagttgacactgttggtcttcctacggggttgccaccccttcaaagccttcaatccttcccctaactcttccataggggttcctgacttctgtccagtgcttagctgtaatatttgcatctttctcagtcagctgctagtacagcctctcagaggacagccttgctaggctcctatctgcaagcacaacataccatcagtaatagtgtcagggtttggggcctgtccatgggatgatcccaaattagtccagtcactggatggccttcagtctttgctccagttttgtccctgcatttcttttagacaagagcagttctggatcaacatttttgaaggtagattagtaaccccatccctccactggaggccctgtctatctactagaggtggcctctacaggtttcatctcaccactgtttggaatttcagttaaggatacccccaatgagtcctggaaggctttcacatcctagatcttattgtaagctatcatttgacctacacacatgcacacacacacacacacacacacacacacacacactgtacaaaaatccttatatcttagacagaatagacaaactcattttaatataaaatataacaataataatcaaaaggaaattgaaaattcatatatattaaggactttaaacattttaaatgtttcttgtgcagttgaatttcatcttttgaaactattagaaagattggaagggatagagataatgtatgaaggcaaggggacttttctggattcagcaaggaagctgcacagatgaactcatagaaattgtgacaacattcacaagacttggataagacatagccaaaccaaatcacagcagagggaggggaggtggatacaaagccctgtggccaactaaggagacattgggaattgatagctgctggaaaagggaaaatcagtttcttataaaactatagctctcttctacactgcagtggaaggccacgcatatgagaatgtacaagcagcacaaactgaaactcatgtgtttaagaggaaaagaagccaaagaggaaacaatgttgggtggatagggaagggctatgggtctgtgaggagcagaaggaggggttgaaagttatcaacactcattgcagaaaattgtcaaaaaaactatttacaaataatttataaacggtacatagaataaatacagataaactcatacctagtaagacatttacatagtaattttgaatattctcagagtatgaatcagaaactggcttcaataagaaagtttaccaaacattgaaataagcaattccaactctttcataatatgaaagaaagtactttcagttttgttgcatgagggctttgatacaaaagccagataattgcactaaagaattctataaagcactgtctatgatgaatatggaaataaaaataagggcatagagttgggtgactagggagttggggaaaaatctgtggaaatggaaaaagcagtatcaggacatactttacgtaggaaattttcaataaaaattaaaattatacaatgttagaaagtattctgtaccacaaccaactgtgaatttattttttccaaccaaagatggttgaacgtataaacattaaccattttcctaggagttgtggttgcaaatctccctctccactgtgctgggatgtttagtggcttactcttgtgaatagtcagccacagctcattgagttagtgagttcaattatgctgtcttttccagaagacactgtttcatttcagtcatctctgaacctggctcttgcaatctttacagtcactcttccataatggtacatgagccttggtgaatggaagtatcacatagatatccaatttgtagctgagcattctacagatccttattcaaggcaatatgaacagtgtgtgtgtgtgtgtgtatgtgtgtgtgtgtgtgtgtgtgttgcacaaagttctctcatgatatctgagtgatgcactaatctatgggtattgaaaaatcaatctagtttgaaatggtgtctatttagaaaagtagtagtaacaggctcacacctgaagtctatgagctccccaactgttgagttcttggctaaatttgcagtaccagatatgctttttgacctgtgtagcagttggttaccttcatagcatttgtttcagtaattgtacatcttgccatgctggttattattgagactcacagcattgatggcttttcttcccagaaacatgtgtagagaaatgcagtactctgaaggctaacactcaggaaggaaagttcctgatcagtaccatctcaatttgttgacagttgatgtttctcgaggacatatcaacagttttctcaaagagtgtggatcacggtaggatgattacactccagtggctttcaccacaccctacaattcaaccttgagctctcaatagaaattgaacatggtgagttatagcaacaacaggacaaaagcacagacaaagaaagtactgatgggttagggtaggggtggatctggaaggagttagggagaatatgggatggcgaatattctcataataaattgtattcctacatgctcaagacattaattttatattaaacttttaaatttacaaaagaacaaaaatcatctagtatgcacaataatagaaaaccccatgatagtctcaatacattaagtgaaacttatataaaagttaaaaccttttcataattaaataaaagtagctagcaaactagggagagatgggtttgttttaataaaactgtatgtgaaaatttaggacacaacttaatttatagttgtatcaaaaagaataagaattggtatattaaatgaagtaaccacatatataatgaaattaataaaacattaataaaaaacaagttgtaaatcaatggaaatacatcctatacttactaatgagacatcattacaaggtgtctatttttccaacattttctacagatttagtttaaatatatcacagtctttcttaagcttctataagaaatatggaaaatccttccttaagattatatagaatttccgggattttcaatctgaccaataatattgagacagtagcacataatggagaatctctgacttttttatttcaaaattcctgtaaaatatatgtattattttgttatatattggttaaaaaaagaataatagatcaatgaaataaagtagaaagaccagtctttacaaaaactgatattttgggaaactgaattttcacattaaaaaagtatgatgatcgcttacctaacaccatttgcaaaaattgactaaaaattgatcaaaggcctaaatgtaagagctaaatgaaaaaaaaaatcctcagaaggaagatttaaagaaagtcttaagggaaagattcattacagggcatctaacaatgccttcttaaatatgggttctaaaaaacaggctgtaaaagaaaaaaaaaaaacggatttttacctaaattaatgtttctgtatcaaaggacacggaaaaagacaacttacctaatggggaaatgtctgcacattgcatgtttaatagagcatcattatctagaatataaaatgtgtccttgcactcaccattcacagaactcaagtgattgaaaagagaaaagaaacctgacaaacacatgtacaagtaggtccagggataaatgcacagacatgtcagatgcccctgacaagcttgtcaatcaaagcagcaatgaaatactatgttaaattcattaaaactattatcaacaagaacagaaatcatgaatgtaagctttgaaatgggttttaaaaaatcagtacctttgtggattgatggtgggaatgtaaagtgatccatgtgcctttaaaaatcaaacatggaactagcatatgttttaatgattctactttctagtgtacatccagaagaatcaaaagagtaaagagtttctgttgacctatgttttatatatatatgtgtgtgtgtgtgtgtgtgtgtgtgtgtgtgtgtgtgtgtgtaatgtatataatatttggaatacaagaaaaatagtgtgtgatttacgtacatatatatgtatatgttgttcagtctgaacagaaaagaaggcaagtctgaaatgctaaaatggactacctacagtatgcataaaccttggtgatgttagttactaagttggatgatcccatcataaaatatcatttctgtaccatttcacacgtgaagcacgttcgatacatagacaagaagtagagtgctatttattaccagggtcataggcagtattttctaatgggaatataggttccaggcagagaattgggaaggattctgctagtgattggtagcaagagttgcatagaaaatgtattcaacgccactttttaaagagctaaaatagttacagtgataaactttatgtttacattttaacaaggcttacaaagacaagctccctaaggctaatgatcttgactatgatgttacctctgcttctcacaaacaaatcatcatcaatgtgtccacttaatctatttcccttggtctcctgtttgtcaatcggtggtaataaatgacagtgacaccttgtctattactttgcagataatacgtataaaatatagtaagtacttaaaatgggtcattttctactgtaattgttcaaaaagttgaaaatcagtatcattaaattaatatttcaataaaaagcaggaaaagaatatatctgagtatatgaattgttttagtaggcattgttttattctacatttctgctatatttatgtagctgtttaggaaccagtatggattatctgtagcctctctatctcctgtgccacaaaaaatggaatgttctagatagaagcttttctacactgtgtgacatagagacggttggtgtagaatgtggttcagagctggcaaaaattgcagttttgataaagtcacagaacaacagaaaatcaggctatatggtatgtgatggaaataatcaggttatgtgactctgagtgttacatttgttctgtagggtctttgctttaatttcagcagtatcaccacacatacatttgcactgagaagtgaacgaaatataattttttagtttttaaaaatttatttgcttacatctcaatattacccctcctgcccagtcccccctcaaacagattttacccctttcccaatccctttatcctctgagagggagatttccccctggatatcatttctatcctactctgctcatcaagtccccccaggactaggtgcatcctctcctactgaggccagaccaggcattccagttagggggatgggatcaacaggtaggctacagattcagagacaaaacatatttcttattgagtataagtgcttttttttttaaagctacaaacaataagacagaattttaaaagtaaggaggatgtgttttagaaatcccagtaggatgtggtatattaacataacgtaagaaataccaacttatttcagacaaaagagtgtagtctaatttaattcatccactcatttctttaatgattgcatttttacctctgaatgttccaaatggattttctagcctctaagtgtccactttgtctcatggtcctcctttatgaatggttttcagagttacgcattgtgtgtcagagatatcaaagcctagcctgtcttccttcagtgcacatgttccttcataacctggctgtccttgaatttgctcatcagaagggatgcactttccagtgctaggaggcattggctgactttggagtcttctctctttacatccaaacattctatagggttgagggctttcatcagtgagcacttgaaggctggcttttcccttgacctctagcctcctgcatttctcattactgatatcatttgattttacatcttgatacggtttctaagagcctggcagacttccttgtcatctccctgaatccactttccacttcttagctatttaggacatgactaaattgtatgacgctcaggggagaaaatttaagggaggcattccatatgaggctgacgtagcagaaaaaacctagggcatagaaactaccaatctgggctgagcaactgtcaaactcattccctgtgtgcagcatgctgagcaggatgctggagagcccctcaccgtgaggcaacacttcacagagtggagatgcgggtctccctgtctctgtgacctagttacttcttcagcatgcaaggctggtcacctgcatctggaaatagaagcaaagcactctgctgtgcctgaggaaaaacactgaggctaacctagacaggagatgctctattatttatacaagcattctgatggcaaagccagcattgcgtgagttctaccacacagagaaagaagtagttcaagtctgcaaatatctctgtagggggttggagagtcacagagagattttcagtttcatagagtaataactaaacatgttatctatggttatagaagcagaatttgttcaaaagtctttccctctccctctccctctcccattccctctatctctccctctccctctccctctccctctccctctccctctccctatctctccctctccctctccctctccctatctctccctctccctctccctctccctctccctatctctccctctccctctccctctccctatctctccctctccctctccctctccctctccctctccctctccctctccctctccctctccctctccctctccctctccctctcccattccctctatctctttccctctatctctttccctctatctctctttctcaatagggtctcatatttcccagttagattctaactcactacatagcttatgacttgaatttctggccctgtttcgatgctgggattgcaggcgtgtgcggtgatgttgattttatgcagtgctaagaatcaaacacaggtggtttgtgcatgttagtcaagcattctatcaatggagttccatccccaggcagaattttaatgattttatgtaaagcaaactcctgttaccaattctatttaaaataagtatttattttactgggtctttttgtagtcaaagcaatgtggtacttaaaaaaacgagaagaaagaataaagaattttagttgggcaaattgtctaatttaggcaagttgtatatatatatatatatatatatatatatatatatatatacacacacacacacatatatatacacatatatatgtatatctatacttgtcttatattttaatttgtacaaaatgacattttaattattggctgatatattccatgatgtctcctcctaaattaatagtgttattctgcttggatacagtacaatgagtcaactggatgacgtttacagtttctataacaccagaagtttcaaaggtataaacaagtattgttaaaactgtgtaccagactcagacaactagaagtgtcaaagaaacacggtggaagaagcacaactagcagccatgttcatccaggagcatagaatcatgtgactcataattcatgctaaatcttagcacggtttccaggcttggcagtggctgcacaatatgctgctgaatgcataagcaccttgtaattgctgctcacagcatagcatcatttacaatgcattacaactcagtttacttcatccctggatatgtaaaggttaattgtctagaatgattttatttatatgggtatacatttcaggaccagtatttaggtattcatcatgggtagcagttaacattgtttaacctgaacctagtgtcaccacatttctgtaggtccctgtgagtgttaatctacactgtcagtgtgactgcatttagactcacataaggaacagacctctttatggatgtggatctgcatttacagaaagacttaactgaggaatgaagagtcactctgagtgtgggtgacttcattccatggcctgtagacttcaactgaatgaatgcaaaggaaaagagtggggcttcagcagtgattgtctcaaaacatctctggggaggtaattgtagaaatcagtcaatttttactctggttttcagtgttacctttgtcctcctaacactgagtgccattcctaactcctacacactctaaacttttcacggttaatttatagattgatagcctgatctatctcacatgcttgacagcctacgaaaacccagagatgaaagtcctatgaaccaacatttctgtgttaacaggaaagttcttgaaggccacaaatggcaagatatccctgaatggaggtaagagaagaaagtaacacacaatagcattacatgtttatctcatgcttggtgggatgaaaattatgttcaagttatgagtcctactcttaccagggcctacaatctcaacatgtccagagaagtcagtacaacttcatgctcacatttgacagaaccaaactttaagaatgacaaaggagttattttgagtacccatagagaagggacatgtgtttagtataaaggaaacaacattcagatgtatatgagtttaagaaatatggaagcaataaaaaaagagaacattattaaaatctgaagagtacagaagtcaatctataactacattccacaggcaactgtaaaaggaatgagtgaaatgttcaaggaagtcagtgttggggttggtctggtgttgctatgtattcaaatgctaaattctgcaccccgaaatctggctgtgccaagatgagaaaattttggcatatcccaactttttttttccacccctgacaccactattcttgctcagcagcatgttatcatcaattatatttctacatattttctaattctggacattttcataaaaatacatactcaatatgctgcctttgtgacttgctcatttcatgtattatggtgtactggttagttttatgtctacttgacacaagcaaaagtcatcagagaagagagagccacagttgagaaaacgcccattctagttaggacttccattgctgtgaagagatatcatggccaaggcaactcttatgaaggcaaacatttaagtggaattagattagagttttagaggttcagtccattggcaggaagcatggcagcatccaggcaggcatagtactgaaggagatgaaaattctacatcttcttctgaaggcaaacagtagaagatggtttctcatgtggctaggaggagggtctcaaagcctaccctcttagtgacacacttcctccaacaagactacacctcctaattgggtcactccttggcccaagcatattcaaaccactacaatgcctccaaatgatctgtatgcaggcctttgtgctgaaaaccttaccccaatttaaaactgttggttaaataaaactggcaacagccaactactcagagaatagaggtgaacagggcttgagtgactgggctgggggttttagggaccaggaatataaaggaggtggggaggggggagagaacaaagaaggagaagacagaggaaacaggaggtctccattagatgtagtgggtctgcagcacatgcccaaatgaaatgttcccccaggacagactgatggagcagaagtaacctggcaagacacagacagcaagtattttggggaacacagctgggaaaaaagccagtctagcgttagaatataaggtgtaatcccccagtaattgcacaaaagctaaataaataaatcatagtctcagtttcattcacttggaatctagatgagtataaaaataatttaaataatccataaattaaaactgctgaatacagcttcagtagatattttgaatgcatttacttttatttaataaactaagttcagtcaaaggattgaagtaagacaagaaaataatatttataaataggcaaaccacttcatgcaaatgttgagtgaatatcatgatgaattgtaggattaaaataattctagggtagattttcagcattgtaggggtaataaaggagttatcaaggtcataagcttctaaaatgctcatccagtgtgatttaaaaaaaggataagaacaaagcatacggttttctcaaaaggtataaaaatttttgaaataaaaaataaactcactaagatagtagagaaatgaaaaatacaattagagaaaatatataaaggagtaaatatggaagatccattgaaaatagaaaaggtgaacaaacacaaaattaaagtaaatgaattaacataagtgctaattcaatgatcacgattatgttaaattgattctatatcattgtataaaattaaagaaataagattattaaaggataatacttgaacaaaacctaagtgtacataataaaaatagacaaattaaagctatagagaattaactttaacattagaaatactaggtaatttctaagaagataatccaatatggaagtcaggaactcagctataactaacacccaggcataaataaatcactacgtacttatggagcttaaagttaattaggatgatatataactctaaatgtaaatgtatccaataatatttaggacacatatgtaagcccataatcgtatgtgaaattttaggaaaacactcacaaataatggtgtgtgaaatttaggacaacactgtcataaagtagttctccatcaagagaaaaaaacaaaacagattaagtttataaattatatattatgtaattcaaaaaccaatatctattagaagatatttaatggggatcattaatagaatttatagtataaagatgtcattgtcacagtttagtatattcacatagcatgtaatcccttatctctggaaaaagaacataattaaaagtaagaatttctcatcatttccaaataatgccgaaatattttaaaaaaatctttatgatattccttcaaagaataagataaagctttcagaacaaacaaaattgtccttaactttaacaacaaagactccattttatttagggcagagaagtaactaaaagaataaatcatgaaaaggaaagaaaacaaaggaaaggataaaaatttacacagtaggggaaattgtttgagtgttttgttttgttttgttttgttttgttttgttttgttttcctttttgttttagatacctgttgtcttgcctttccatgttcctggttctgcccattatcatattttcaaaaagatgctttctacctgtcttctatatctttttcttaaactataatgttgatcacttccactttaagtgcatttacttacaaatataccttttgtctatgccacgctttacttctaataatttccccattgatggtaagtgtggtgacttgaatgagaaatatctccccacaggcttacttatttaaacacttgatccctggttggtagtgttacatggggctatgacagaaacttctgattttctatctcatcttgatggagttagtatgccactgtggacgggctttgaaagttcataatctgctgttcttccagcttgcattttctgtctgtgctcatgattgcttatggagctttcggttctcctgtccagctgtttgttgcagggccaaccctgccattatggatgcttcttttggtatcattttccaaaatgagacttgggtatgctgtttcagtggaatttggattattattaattttaaatctaagcataggaagtcataatctttaaaatacactaaagtatttttatgttttatttgccatttctgtttttttctaggcaatttagagacacgtagagtaagcctccttgcattttattctagaagtcatcacgattaagctgcaatagtagctaaagaagcactggttcattcatgtacagggagctcacaagatacaacttcttcaaagctatactgacaattaaaaagaaaaaagaaatagaaaaaagcagaggagatgctcacaaaagagaaggacagaaaatacattccaagtaaatattaagttttgtaaaagtatttcttaattcgcctgatgtaactgtcttaagattctctgatactttctgctgggtatactcagcctttgttagttctttctgaacacaactcagctgttcaggcttaaactcctctccaaatggattcaaccttgcttctctcagtttctcctgaacttttctgcttggtctcaaactaacgtgggcaatttgttctagtcttctggctttctctgtcttcacctttgtctagcttgttctctctctctgcaacctgtctctgtaccactgtctcagtaaaactgcccttccttctcattctctatattgcttccctttaagtgacctctcttctggtctgttctctagagcgttgagcatatactattctgtcaaatcgttttctgattcatcactttgtctgccattcaattagagatcactttttttttattacgtattttcctcaattacattttcaatgctatcccaaaagtcccccacaccctcccccccccccactcccctacccaccctttcccattttttttggccctggcgttcccctgtactggggcatataaagtttgcctgtccaatgggcctctctttccagtgatggccgactaggccatcttttgatacatatgcagctagagacaagagctccggggtactggttagttcataatgttgttgcacctacagggttgcagatctctttagctccttggatactttctctagctcctccattgggggccctgtgatccatccaaaagttgactgtgagcatccacttctgtgtttgctaggccccggcctagtctcacaagagacagctatatcacggcccttgcatcaaacgcttgctagtgtatgcaatatgggtgcttccttctacaaactaactttaccgtcattgtttggaattaaaggtgtgtattaaggatgtgtctgtgttccacacagagggattaaaggtatgtgctcagactgatccatgccacaaatataaacatttattttcagtagacaacttaatttcagggttcacagtatgacctaatatcctgcaacaaagctcttacccgcaaagacatcatcaggcctaactccaatttaagtgtgaacacaaagtcctgagttagtacaataaagttgtaattctacactttaaaataatttatacgtatatataacctaatcagatttgactgcggacatgtctatgggatattttgttgattgctgattgatgtaggatgctccacctcactgtggtatagataatggcatccctaggcaggtgcttctgggtggattaagaaagcaggttgaataaaccatagagaagacaagccaggaggaagaatttagccacgatctctgcttgagttcctgctttcaggctattccttcttctcctgcctttattttctccagtgatagactgtgatgggtatgtgtaagccaaacaaacccaacttgcttttggttatgctggttattattggaacagacaacaaaataaaatacttgggtaaaaaagaaaataaatgaaaactccacgtggttatttgtttacaagtttccacagtaatcctttattttgatggctataataagagccatttgttccaaagaaagtacacctagtgtaataaaaacaataacatatgagtaagggcctataaactagtgtttagttgatatagtgatacaacccacataccataagaagtttaacaagatggaaggcttcagtctcacttagaatggggaacaaaatagtcatggaaggcagaggaaaggagggtcctatgtgggagagggaaggaacagggaatagggggcaggatcaggtatcaggggagacaggagagaagcccatagggacaggagaataaatggaattatgcagctgcctggggtgtgggaacagaagaaatctctcaaaattcacaaagacctgggatgtgagagactcccaggattcagtgctgttgaccttatccaaaatgcctaaaggttggaatatgaaacctgaagagagcacttgtagtagtttagacagaacccccagtggagggattggaatacaaaactagctatatatatatatatatatatatatatatatatatatatatatatatatatatatattaccccaaattgttcctgtctaaaagaagtacagggacaaatatggaacagagatcgaatgtctggccaaacagtgactggcccaactttggatacatcccaagtcaggcaccaattcctgacagtattgttggtgcactgttgtgcttgcagacaggagactagcatagctgtcctctgagatgctctactcagcagctgactgatacagatgcagatacacacagccaagcattagacagaagtcaggaactcctactgaagagttaggggaaggattaaaagaatgaagagaatggcaaccccatagaagaacaataatatcagttaacctggacccctctggagttctcagagaccacactaccaaccaaagagcatgcatgggctggtctgaggctgtggtacatatgtagcagagggctgccttgcctgtcctcagtgggaaaggatgtgcctaatcctgtagagacttgatgtcccaggatgggaggatgcatataaggagtgtatcttctagaagagaaagggatggggcaggaggaacaatctctgagaatgggggctggggaaggggaagtatttggtatgcaaataataaaatagctaattcataaaacaatgcaagaatatatcatggcctactaatattttgatagtacagtatataaaaaattaaaaaataatttaaaactatgttcaaaactatgtacattaatagtcctgtgagcataccttgaaatttacactaaagaggaattgataatttatcaataatcaattttcttgtaatatatgatggcaaagatgaataaatagcagtatatcaaatttcaggacagcacaaaagaaatttacagttgtgcaactaattttgttgttatagtgatcttgagggaaggcactgcatgctgtttgctttctaaattcaagctgctataacaaaaatttctatttgaaaatttcttcatattatttttatttataaatgaaattgagaataattttccttctgtttcatttccactttctatttgagaaaatgttcttttaacgtcctcatttttctattgatgtctatggtttttattattaatttgtatatgtacatttcaagttaggaaaatagtctgccatatattaccatatatttttccaagtttctcattctttaaggtaatatttctagatttttattttgctgcttgaatgaatttaaaatttcagaagccagaatcatgtcctttgtgattttatgacctagttaacccataattttctatttgaagatgataactaaacccaactgtgcttttctttttatttatttttttccttcctaatttacatatttgaatcaaggacatggcttctacatccagaagggatgatgcatctggccttccttcattttgattctctaaattgctggtcaagctgttcctccagtttataaatcatttaacctaccagctgcctttctgtttcaatatctgtgagcggccaattacaaaatgatttttgttctgcttctagactgggtgttctattttggtgctctgttgattttgcttgtggtaaattactttattaataaatcttcatttattgcctaagtatcagattttctgttttaaagctttagtttttttccccagaagtgttgccatttttatgcctttagtcatagagtcagaaaacaagagagagtagctaagtgctctaacatatcagcagcaatgacaggattcaagatgcttaaaccctttgtatgcaacaaaaagtcccccaataccagccctatcatagcattcttagatctttgtgttttctgggttcctgtaggtgctttgtttcttagtcattcaggcaattgcaagtagatgttggctgatattgcagttgtacaactgactctatcattaagatagatcattgtatgattggcagaacatccagtccacacagcctgatgcacctgaagttcatcatgagtttctgggtgggagaatcttgaaagtttttaaaccaggagttacagagcaaatgcccagagttctgtgatttaaacttaatctaatttttattttggtagtattctgattactggcactttcttggtaaattcatggttattatagtcagaatgtctactattaaatttagcgtagaaatagtgtcttattcatttacctttcatagaagtggagttagaaagccaaatttggtttttagtgaagccaacgaattagtctcgcgagtagctgtcatcatagagttcttttgattctgatgtgcttcctttaaggacaggaatcccaccataatataactagattcataatatcttataaactgaattgcctcatgaagacaattatctaccaccaccattgccatggcaactttgggcaagctacatctatcagcccattataaagaatgtttgagaattccatgggtgtggaagtggtgaagcatgtcactgcaaaacagagagtgacactaccaacacatttagacactattatcaaaaggtaggggttttaaaccactgagaatttttttattagtctctaggaaatttctgatcatcatctatttcaaaaatcatactaggcaagcttgtctccattggcttccagaacttgcttttaaatagctctattttatttttaatatcttaatttatttttttaagatttttagatatgagttttatatattttttactttttaattttaattaatttatttttttgcactccatattttattcctgcccgtccacccttcaagtgttccacatcccatacctcctcctcacccacctatctccacatggatgtccccaccccccaccccacctgacctctaaattctctgggacctccagtatcttgagggttaggtgcatcatctctgaatgaacacagaccctgcagccctctactgtatgtggggagctggtgtatgctgcctttttggtgggccagtttttgagagatctcgggggtccagattaattgagactgctgatcctcatacaggctcgcccttctcctcagcttttttcagcctttcctaaatcaagaacccacctccagcaggaagacaggacatcaagtgagggatggggttgccgtcccacagttataactctgacccataattgttcctgtctgaaaagaattacagggatggaaatggagagaagcctgaggaaaagaaggttcagtgacaggcccaaagtgggatccagctcagtggaaggtcccaaggcctgacactattactgtgactatggagcactcacaaaaagggccctatcatgactgccctccgaaagacccaacaatcagctgaaggagtcagatgcagatatgggtactcaaccgatggacagaagcagcagacccctgctattgagtttttatatattttacctttcattttccttcctccaattgttcccatatattctttactccctctcatactcatgacttcctgtaaataatattgttatatacactgatacaaggttaaatacagtatgtgtgtgcatacttgcatatgtgcatgtgtgtgcatgtggatgggtgtatgtgtggatgtctgtgtttacgatacatctaatggcactaattgtcgtttctttatttccttttttcagtggaatgtggatatgaaagctttctaattccaatgtgaagaaaacagcagtgtcagtgaagattatcaataaatgtcaatcaaatgcaactaaattatatttactttcatagaagagggcatgcacatgccctgctctctagcgtttttttatgtttatgttagggagactttgatatcatatttgagagctgacagaaacttcattgacaaattaccagcaatctccaaatagcaggcacatcaacactgaacatgaaaagcaataccatttcactgtcttagactgctaaaatataatttttacatcaggaaatattaaccaaactgctatagaatattaggagttccttcattatgtttcattttcagaatctttttgttttttcttgtgttttatcattcattgattttgagtgagttttgtgataattggtttgagttcctacagctgagttttaatgaattcctcagaattttcaaataaaaatgtgctattttgaaatctacttataggaagtttatttgatttaactataaattactcaaatgtttttaatccaaatagagatgtttggaaataaatcttagtatgcctaggcttataatttatctaatccttctatgtttatatgctataataactagtacataaatcattgtcagtgtagacaaatatttaaattgtgttgtcatttgttaaagtatatctcatctgatcattttgccatgggactttggagtgatatacttcctccccactccacccccaggaagatatcaagttatctgtatttgtagaatccatgatcacattttgagaaaattcaaaagaatcctcttgactacaaagctactagcgttaataaattcaaccactttagcatgatacattatcaaggcggaaatcagtgtgttgctgtagagtaccaaggaatgagatataaagtgggttaataaaatgatgtatagcatcatcgaaataaaatatgaaagaataaatgtttaaaaaatataaataatatgaaaacatgaactgaatactaaaaattataatgcattatttaagaaactgaagaataagccgggcagtggtggtgtatgcttttaattccagcacttgggatgcagaggcaggaggatttctgagtttgaggtcagactggtctacagagtgagttccaggacagccagggctacacagagaaacactgtcttgaaaaaaaagaaaagaaaagaaaagaaaagaaaagaaaaaagaaagaaagaaagaagccaaagaaacccgaaaaacaaacaaacaaacaaaaaacgctctgtgccaagcagaggtggcatatatgcctttaatctcagaacttgggaggcagagacaggcagatttctgagttcaaggccagcctggtctacagagtgagttccaggacaaccagggcaatacagagaaaccctgtctcaaaaacaaacaaacaaaaaaaccaaaaaaagaaagaaaaagaaactgaagaataattaaatcaatgaaaagatagcttcatgcatatgaatcagaatagtattaatataataatgcaaataaaagcagtctattaatgcagtataatgcatatcaaaactgcattgtctgtttttggttgttttcagattctttttgttgttgttgttagtttttgtaaaatttgctttttaaattttttttttttagatattttttgtctttacatttcaaatgttatcctctttcctggtttcccctgtgaaaatgccctatcttctcccaattccccctgctcaccaacccacccactcttgcttccctgtcctggcattcccctacactagggcatcatcaagccttccaaggaccaagggcctctcctttcattgatgacctacaaggccatcctctggtacatattcgactggagctatgggtccctccatgtctactctctggttggtggtttagtccctgggagctctggtgaggttatggttggtttatattattgttcctcctatggggctgcaaaccccttcagcttcttgagttatttttctagctcctctattggagaccctgtgctcagtacaatgtttggctgagatcatccacttctgtatttgtcaggtactggcagagcctctcaggagacagtgatattgggttcctgtcagcaagcacttgttggcatccacagtagtgccttgttttggtgactgtatatgagatggatccccatgtggggaagtctctggatggcctttcctttagactctgctccacactgtcgctgcatctcctgtaatgagtattttgttcccccttctaagaaggactgaagtatccacagtttggtcttccttcttcttcagtttcatgtggtctataaattgtatcttgggtattcttgagcttctgggctaatttccacttatcagtgagtgcgtaccatgggtggttttttgtttgtttgtttgtttgtttgtttttttttgttttttgttttttttttttgtgattgggttccctcactcaggatgatattttcaagttccatcaatttgcctaagaatttcttgaaattaacgtttttaatagccgagtagtactccaatgtataaatgtaccacattgtctgtatccattcctctattgagggacatctgggttctttccagcttctgactattataaacaagcctgctatgaacataagggaccttgggtccgtattacatgttggagcatcttctgggtatatgccctggaatggtatagctggtcctctaggtagagtcgtcttgtagttgtgctatgactcatcagccatcctttcacttgtctatgtgtcatgtagagttggttctctggcaatattcctacttcccttcttgtgtaacaaacaatgacaaagtttaggaagaaattaaatgaagtagtgactgaaaaaatcagttctcagtgtacattctgctcaaatgtggaggacaggagaaatctgtacctgtgtcctgatgtggggactggctatctacataaatacatctatgaaactactataaagtgttttctaaaaaaaaaatagccatcttgagggaagataaataaatatgtggtctaatctctttcccattacatgctaaacaaaatttaacaaatgctttgataaaaggagttgaatgaccttaagaaaatttctaattgaaaatgtgtttcaataaatacaacttgatatgattcccattcctcaaataataatttaagttattttatcactaccccaatctaagctgcatctatatactttaatttttcaaagattggggaagggcgtatactagagccttctaatatttaaatcactttgttgtatctgagagaaatgtcaaattttctgaaaaagaattttataacagtaataaataaactacagtgtgttttgcagacagaatcaagattgtttttcatgctatctggtcatagattatttttgattcaagtgattctattttcaggtatttaatttttttccagataggcattctacacaaatacttatgaacaaaaaataaaatggctactctatttgaagaggaagattacaaagttctttactagtaagcaaaaactttgattattgttaatatgaattaaatataaatgtaaaagtcaaggtgtttagtagactacctactttatttacaggataaacatatcagaaaataatttatctaagattatttcaatactaataattttctagctgtgtcttaagaaataaaagtgcttaaatgtatgggaattaatcagtgaatttttcaatttgagcactcaatagtttcatttatgcatcagtaatttagtatatatatttatttatacaaagaatgaaattaagaactattgtagaataacaaaaaactaaaagtgactatctataacagaatctaggatttgtttatgtacattttctattgattcactcattcagtcattcatgaaataatatatactgactgatctaatctcatgtaatagcttatcaaaggatattacttatagatattagtatgtctaggtcattaaataaaattcttttatggtagatattttcttttctctagctattcagagagtataccagacataactttattttgataaaatacataattataaacatttgaaaataactaaaaatattaatagattaaaagatgttgaaacatatttcttaattataaacaagctgtatgatcagtaggattcagaatattaagatatttaagtaaattatttgactctacaatttcattatttgacattggtttaatagaagtaggaatttattatggtattttggttatatacaaaaatagtttggaggccaaagaacataagaaacatcaaagtactattctttaaattggactcatcttgtaaaacatatagaagaacattagtaaaactttccataattattgcttttataataaaattacaaaatgaagaattcttagaattgacccaagtactgaaaaaaatcataaaaggtaatgattcagtaaaggtaaagggtcagaaagactgtaagtttgtactgttttaacttgttttgattttacccattacttttcagagatttaaaaaccaacaaccttataaatactgtagctgccaagtgcaactatctactaggtgttacaggagccaagtgaatttaggatttactaaagcctaacctacagagagttgtcacttttgagtctgtctggaagtttgattaaaaacttcactcttaggagttatttgacatgatttaaaacataccttgcacaaacagagtgaatctggggtgttcattgaaaagggtaagaggaaattccttaaaattgacagtgctcacagttctattgtaactagtaagactattttttaattaatcaactaaaagcaaatatttgataaatatatttctcaagtgagttttcaaatgttctgaattttattggaaacttaaaaaaatcatacatgtaaccatggctgtgtatctgcttaagaacgacatgaaaaattttgattactcacatgttagcttgaaagcactgaacaccaaggagtagggaattatgctacctgtttaagaaaaaggaaagcttttgcaacacactcatagactccttcaataaagaaactttctgccttcaagaattaacaaataaatttttccaatatctagcccactaccaaagtgagcaagcaaggctcttgggttacacacagaaaaaaaacgtatcagttctttacataactgggaaagttattacggaaaaaaaaaccctatggcagtaaacaaaacaaacaaacaaacaaacccaaaaatgaaaaagaaaaacacagcagcaataaatgtgcaatagccaatactggtttgtgaaggagcacaaagttttagaaacactgcattataatttgaatgtgtattttacacctcaaaattatgaagcatgtaattgaaatgtaaaatttgtgttgatatacttagataaaacacataccacttgacagatggtggacaaggagccccaggtaccaggttctcagtctccggcatcccacgctggatatggcagaggagctgagaacagaatatgggccctggtgcggcactaggccctggagatacaggaagagacgagaggaggaggggggtactgggtggttcccatgcaggcaagagtccttaatctgggccttgatgaacagagacagtctatggttttagagctttattgcagaaaggcagggggaaagagagaaggtggaaagagagagaaatgggccatggctacatagagaaaggggagaagggaaagagagaaaagagagctagagaataagaagataaaagctagagagagagagacaatgagagagagagggggggagagggagagggagaggaagagggagagggagagggagagggagagggagagggagagggagagggagagggagagggagagggagagggagagggagagggagagggagagggagagggagagggagaggtaaaagcttagagagcaaggaggggccaaacagcctctcttatcatgggcttgttatcttgctgttgttatataactgtggggaggtgtctagccagaaggccagaagcttgggacattgtctaagtcccaagccacatgcctctcttgtgggggctgtgggggcagtaacttcgacagtagccagaggttcaggagacgtgatcgacgccttctgccccaggtaggtggaaattaccaaccacctggtcctaccagggttcaagacctcagcttgactggagaccaggctgtctgtgcacagcccattgccctacatgtggtaatctgacaggatgcatgggatgatttcaatagtcttgtatctgttgaggcctgtttgtgtccaattatatagtcagttttggagaaggtaccatgaggtggtgagaagaaggtatattcttttgttttagggtgaaatgtcctatagttatctcttaattccatttggttcataacttctgttagtttcactgcatctgtgtttagtttctgtttccacaatctttccattgctgcgagtgtgatattgaagtctcctactattattgtacgaggctcaatgtgtgatttgagctttattaaagtttcttttatgaatgtgggtgccactgcatttggagcatagatattcagaattgagagctcatcttggtagatttttcttttgatgagtatgacgtgtctttcctcagtttatgttatcttttggttgaaagttgattttttttagccttttttattagatattttctttatttacatttcaaatgctatcctgaaagttccctataccctcctcctgccctgctcctctacccacccactcacacttcttggccctggcattcccctgtactgggacatataaagtttgcaagaccaaggggcctctcttcctaataatggctgactaggctatcttctgctacatatgcagctagagacacaaactctgggggtactggttagctcatattgttgttccacctatctggttgcagaccccttcagctccttgggtactttctctacctcctccagtggggtccctgtgttcctgtagatgatggtgagcatccacttctgtatttgccaggcattggcatagactcacacgagacagctatatcagggtccttttagcaaaatcttgctggcatatgcaatagtgtctgggtttggtggctgattatgggatgggttcccgggtggggtagtctctggatggtccatcctttcgtcttagctccaaactttgtctctgtacctccttccatgagtattttgttccctattctaaggaggaatgaaggattcacactttggtcttccttcttcttgattttcttgtgttttgcaaattgtatcttgggtgttctatgtttctgggttaatatccacttatcagtgagtacatatcaagtgacttcttttgtgattgagttacctcactaaggatgatattgtcagatacatccatttgtccaagaatttcataaattcattgtttttaatagctgagtagttggttttatttgatattagaatgcctactccagcttgtttcttgggaccatttgcttggaacattgttttctagtcttttactctgaggtagtgtatgtctttgtcactgaggtgcctttcctgtatgcagcaaaattcttggtcctgtttatgtatctattctgttagtctgtctttttactggacaattgaattcattgatgttaagagacattaaggaaaagtgatttttgtttactttcttttataatttgttgttggatgaggaattgtgtttgtgtggatatcttcttttaggtttgttgaaagaagatggaggagttagagaaaagactgaaagagctgaaggggtttgcaaccccataggtagaacaacaatatgaaccaaccaggacccctacccccaccccaactgagctcacagtgactaaaccaccaatgagtacacatggagggaccaatggctacagccacatacgtagcagagaatggttttgttgggcatcagtgggaggagaggcccttggtcccgtgaagacttgttgccccagagtagaagaatgccaggatggggagccaggagtatgtgacagggtgggggaatatcctcagagaagcagggggagggagaatgagataggctgtttccaggggttggggagaacctgggaaaggggataacatttgaaatgtaagtaaaaaaaaatccaatttaaaaaaaaaactcatttgaaaatataccaaaataatgcaatctatatattcttcagacatgctttgagcattaattcccacaaattctaaggaaattatgtctgagtaaacaccctagtacctcatggttgagaatcagaagtgctgtacacagataaatatactctttagatgacctacagaattaacagaaatcctattgaaatttccaactccttttctctgaaattgacagatgagtctaaaattcataacaaaataaaatattagaattatcaagtaaatctttacacaatgacaatattgaatttcttgtattcctgattttaaattttcctataaagctatcacattcaaatcattgtatcccgacataagattaagcataaagacctaaggcatagaattgttattcaaagtaaacaatgaattctgactttcacaactgattgatttgcaacaatgacatgaaattaatacatttcagaaattacctatgttatcaaaaattatttcaaggatacagggaggtttttatgagatagacaggtttattatgcaatttatatgtgacaaggatagtctaacaagttcaagatttcttaaatatatttctatttttaaaactctgaactggctcatttatggtgcaagcctatagactcagtacctcaataactgaggcaggagaatcacaaatcctaagcaaatctggcttccatcccgattctttgtctcaaaagaaaaagcaaataaagaaatcaagaatcaaaaacagcttttcattgcaatgacatgaactcttggcatattatcaacaaatagagcttagttaaaagtataatatacattagttactatatatattgtgttgtcttaacattactttgaaaacttaaaggttgaatcatcattcttttgatgaatagcacccattgaaccatctcaaatagatagacacttaaggataataaacaaaataaaaattcttggagtagattaattggctgtgatagcacatgagaaatgtatttagtgaaagtaattgtcaggcctttgatccaaactaggaaattacttctaaatgaaacagtcattatacatgctgaccatggcagcaataggattgttacaatggaaaaagcaattgagacaattaaccaaaagccaccaagcatagtgattaattgtcaaaatggagtaccaattgctgaggaaaggtcaaggtgttactgaaagcacaggagtgtaaacaaaagcagagttggagaaggagtgaagtcattttagagcaatggcagaaatgggaaataccatacattttagagaatgttataggggtgattcattgaggtgtatgatcatggggttccctaaagcagcatgcctcctagtaaaaaattagtgtatgtaaaatgggtcaatgagaaataataaatataacagaccatatccattgaacatactgtgatagaacaaaatagcacttcaaagaagtcatgagaagatttgaacccatcaacagccacttcaattttgcttaacttagacaactcaagtagtagagtattgtagaattccacaattaggaggcccatgattcagtagtatttaaaatcctaagtaattaagaatgccaaggaggtttgaattcttggtgacaaatgaggtcaacaattatgcaaggaaatcaagttgaggaaatactgtcatgtgaacatattgctgtcatctattagttaccccaaggttataacactctataacaagttgtcttcttgaggatttcaatgactgacaatgtacaggtgaacatagctgtttaatttcctctcataagcatcatagacatcattccacaaggaatgaataagttagtagtaatcagtattctcacattcaaaatttttgtactctagttaaaagatgaatagggacacacagttaccaatattaagaagtacttattatacatttcagatttgtgagatttgcatacatatatctcatgcatccatatacttacatagctatgaaattatagagaggaatgttgtgtgaaagagcaagaattggttatgtcactaaaagaatgattgtagacttggtatatgatttttacaattattctttctccactcattttctaattgtactctatttgtggtgggattgcaagcttgtacaacctctctggaaatcagtctggcagttcctcaaaaattggacatagtactaccagaggatcccataatacctctcctgggtatatatccagaagatgtcccaaccagtaagaaggacacacgctccactatgttcatagcagccttatttataatagccagaagctggaaagaacccaaatgcccctcaacagaggaatggatacagaaaatgtggtacatttacacaatggagtactactcagctattaaaaagaatgaatttgtgaaattcctaggcaaatggttggacctggagggcatcatcctgagtgaggtaacacaatcacaaaagaactcaaatgatatgtactcactgataagtggatattagcccagaaacttagtatacccgagatataagagacaatttgtaaaacacatgaaactgaagaagaacgaagaccaaagtgtggacattttgcccccaatggaggagctagagaaagtatccaaggagctaaagagatctgcaaccctgtaggtgcaacaacactatgaactaaccagtaccctggagctcttgactctagttgcataagtatcaaaagatggcctagtaggtaatcactggaaagagatgcccactggacacgcaaactttatatgccccagtacaggggaatgccagggccaaaaaagtgggaatgggtgggtaggggagttggggggagggtatgggggacttttgggatagcattggaaatgtaattgaggaaaatacataataaaaaatatatataagaaaagaaaaaattcaatttgtgttctgaatgcgtctaaattgcaaataccagtttctctgtgtttctataccacatttgttttctagtctgaatttttgcttttacatgcctagtatcagctccaggtctgtcctcatatacctcaatttatttcatcctatgtcttctaattttgaaatggattgtaaatgtttaggaaatatattaagaagctttcaatgaatggatcttaaaataattatattaagtaatatactttaagcatgttcacatctataatatttctcttatataccaaatccttaagttttaaatgacattcaataggcatatatttgcatagaaatttgccttttgactttttatgacccaaataattaatttgcagttccagaatatcactgaaattttgaaactttctttttaactccaccaagggaaatgaggacaatgataagtacctttaaagaaattttctttctcaaaccataaaccctaatttattcaagccttggaaacagactgaatcaaattccctgtacaagaaagtgtcagacaaccaccctatttacactttgatttctgtaattgttgtgaagtcacctaagggaaaaatttgaaggaaagggaggaattctaatattcttgctcataaatttaagtgaatgatttgaacattcatacacccattaaaaatctatgaaaatattgtcacccgaaagagcttgaattcctgcaagatacatcctcagtctagactgctcagagagtgtaaagaaatttcatcaacaagcaaatactgaatattatggaaaagtccaaaagtgtgagtgtgtgtgtgtgtgtgtgtgtgtgtgtgtgtgtgtgtgtgagagagagagagagagagagagagagagagagagagagagagagagagagagagaaagagagagagaaatttattgtacagcaaatgtggcatattatggaggtttataagtcccaccaatgccccatgaaatactacaaagctgatcatatgatatcagtccaagtttgaggcctgtgaagcaggagggctgaaggagtttgtagttcctagtctaaagctagggaaggctgagatctcagctttaaacactcacacttattctcaacacttattccctctgttcaagtggtggaatgatggtgaccatcaacttgaaggaagacaaactgcctgactcattacatggatccaattgcatggcttcttgaaatatccccacaattatttcagaaataaaattaactggtattgtgcattacataccataggtagactgataggtgaaatcaatcatcaaacatcaactttctgaataaagaatctgaagtggaaatttctggtttctttggaaattcaactgtgccatgtgatgtttttctggaagctgccttatgagaggatgctttactgagaacagacacttggtgttttcctggaagctgcctggtgaaagggcatgtgatgtttggctggagggcatgttcaagaggacacgtgatgtttcaaagagtataggtataacccaacagacagtgaatgatgctctggcattgatttgtcttgctggtcttcatggggattcactaatgctggcctcttttgaagatgttcttgcactggcttaccttgctttctttgataactctaatcacaccacttatagacagaagcacacagatttctgagttcaaggccagcctagtctacatagtgagttccagtatagccagggctacacagagaacctctgtctcaacaaacaaaaacaaaaaacaaacaaacaaaaacaaaaaacaaaaaacaaaaaacaaaaaaaccctgaaaccaaaaccaaaaccaaaaccaaacgaaacaaacaaacaaaaagaaatgcactaaagactaaaggacttctggtggtacaacgggtgcttcttgctgctttggtggacttgtgctgattaatgaagctttgcagtttctaatgcattgagccactgctgttgattcatgtttggtgttttgctggtgtactagactgctgacaacaaagattggaatcattcccaaagtaggttttgaaaaatataaacctaaaaaacccatcaacccttgctatgctgttcattatgttaggactctgtaatgtctatcacagacactaaagtgacaagatgacagagtgggaagcatagagtactagctgtccagaataagatcatatgacaataaaatgtataaagagggaatgggtctaggcttccaatgggaacaaaagctaaggaagagcagaaaggagagctctgttctctgcctatcaatcactgtatttatgagcaaatttctattctcttcaaccatgaagcaccattctcttttgaggacctataaagcattagatgtattttaatctccagagtgagaggattttcactctgtgtttcatagtccttcagacactgggtagctaacattaacataatactatataattctcagtgaaggtttacttggctaggttgtcttatgaaagtgtttaaaatcagaaaatgttagtctagataacctatctgaaaaggatgaagaataaatggtttggttggtagatgtataatttcagaagtaggagatcacatcattttaggcttcttagcagtaaattaagcattcaatccttaaggcattcaaagatttaaacaactttcatggctcatggatatcactgtcaaaacagagaaaggtaaatattaatcataaattcttaatactatgattaaatacactttttaatgccaaaacccagtttgcttctatgaagacagaagggatattctttttactaatggaattagttgagaagatttgaatttacttgcaattttctctgttataattttgttagctagtagatttcttttgttcactaactttagtacacactagttcatcacttagtacaggtcagaacatactgtgtactttaacaaatcttctgactaaatactcaataatgtagcctgaggcaggtgaaatttacaaatagctcctctttgtattgtggaagatgaagttgcacagcttgcgtattctgcttcagtagcagcctgtgatctgggcctatgttctcataggatgcaatctaccttctacccattgttactgcatttatcccaggatcttcttagcttttcttgattcttattcttttaaaatatatttttaccaattgtttgagattcaatatacacacatgatctatttttattacatccatccctcacccttgctcttaaaatcctctcagatcaactttcacctttagttgagtagctattggcagttgatagcttctggggaaagacgtgttaggtatctgtaagagtttggtctctattaggtccactatgctccagtggatggctccagatcattgagcatatgggaagcacaaattagaggtggtgaatttaaaaagtaaatatgaatttggaatgtgtttgggtttataggtgatggatcttttcatcctgtccttacaatatccagatttttcaaatatattcattagaactgcagccaagaccagggcagacaacattggactgaagaaatgactacaagtactgagtaagtattaactaagtgtattgcccatgacctaatatgactatttttttccttgtgactgcttaaacagcagtatcagtactcgctaggtatgttaggccttattttatcacttagactacaactgaaatactgtgctcaatgatgaatgcaatactttaaacaaaccattgtggattctatctttagtgagtgcccaagcactatattttgttagtacctagagggtaaagtcgacctacatggaatggttgggtgaactgcaaatgtatgaactttggaagtagaagaaaagggatacagaagacaaacaagtttgataggatagctatttcaaacataagaatatttactactttaagaatgaacttgacaatgcttgatacagaatcaaagatggcaataggaagatgactaacaaaaatccacttgagaccagatgtacaccttcacctgaatgtaggcatgtagaagtggtgcaagggatgtagttgcactgataaaaaatcaggctttattgcagctaaattctttccaaacaaaaggattttgttattggttgtaagcgggataattaaaaactagagatagatagacatgaaaaaactttatactaaatataaatttctgagaatcacaatgtcccaaagctcaggacacttcctaggtatttgttaaatgacatatttgtttagggccttaattgcaggtaccaaggcttcttaaaatcatctttcacttttataagtgggagaacacttcagctgatgatcaagaccaccaaagcctcaaggtgtagagtttgggagcttcactattgagaactacttgggttataaaattattagaggtggatgattgtgaatttatcaaaatcttgcatctttatataagatgcaaataagcaacatgtctttggataccatcaactgttacaaaattggaactacatccacagaccacaaaggaggtaaaatacacttcagaggtcagtaaatatttattatgaacacatttggaagctacctaacaatatgtgaatacatatgaaaatatgaaagaaacagaagaagaaagggtatacatccatggataagaaaggagtgaatgtagctaatggacataggtcattaatgaagatagatgctaactctctttctagttctgcttatgtcatagagtttttaatttggttattggataagtgtataagatggagattgaaagtgtaaatttaatgtgaaactcagagcttctgctcctaattcatatgacaactatagggaaggaatatatctagtgcttggcactggaacttttgttagataatctatataaatttcagggaccattgtctctcacaacttcatttaaacccctcccatcattctcagacatatgcatacacatgcaaacacatacacacatatatgcatactcatacacatatacaagtatgtatatcacatacacataaatcacatacatatacatcatatatatatatatgtatatatatatatatacacaaaataaacatacatgtacatatatacacacatatatatgtatataagtatgtgattttaagtaagcttataaaatatttttctcatggattttgtaaccatgcttagtgttattcatctttgcttcctcctctccttctgtattactttcttcccctttccttaaagccctccctcatttctcctatttcccacttcatagcatcctattatttttttcttctagatttccttctccccagtatcctctatggcccttaatcacttccatgacttctgcactagttcagattatacactcagatctaaagattcagatctagaattcacaagtaacaaggaatacatgatgaacatttgttctgttctggattatttattattttccagttatacctaatttctggcaaattttatgatttcactttattttatgattaaagaattttatgtgtaccacatttttattatttattcatcagttgaaacacatttaggttgtttctgtttcctaacaactatgaacaaacaggaatgaacacggctaagcaattatctctgtagtaggatgctgagtcctttatttgccaaagagtagtatagctgggtcatatggtaggcctacttttagctttatgcatacttaatgaaacataaataagaaataattttattttacactaattatataatttatggtttgttttaaagtagtacatagaatattgtaaaagcaccaaatatgtatctgcatataaattaattgaataatgcagaaataaaaacataatattttggtaaaaatactaatgaacttttttcaggcaaatatgaaaacaatgtaggttttattttattaatacaaggaacttcacagttatcatgtagccacagaataaagtacttaaaataatgagcatttattatgcatttgatttgataacattttgtatgtcaatcaagcatgcactattataacactgttattcaaagtattcaaagactactgacttttttttattttttgagattttaatgtaattccataattttcaccttatatctccttcctccaaattctcccatataacacttggtactctcttttaaatgtactctctttcaaatttatgtactatattttaattattctgtacacacataccataccataccaaacacacacacacacacacacacacacacacacacacacacacctgtatacattatgttacttgcatatatatatatatatatatatatatatatacatacatacacacacacatatatatttaaagttgactgcttgctattgggtaaccaatcaatgttccttccctggaaaagattatttttcttgttctcacattttctcaattgcctatggttctttaaggccctcatgagctttcctatttgattttagtatacctatagctatgatgatgtattgctattgcccttagtactgctctaaaggtggaaggtttaagtcctattaatgtacatcacacacagagcccagaggccctgaggtggttctgacctgaaagcctcctccctgaggctcagctttaatgatcaagctttgaaaagagggaaacaattagccttagctcaggtggaattactatgggccacattggatggccagcatggcacaataaccctaagggtacaggagtggcatgcataccttgttgataaccagtagttttctaatttgacttaaatcccacacaataaaaataacccacgtctggtactagaaacctagccaactacctaggactagagatgttatggatcttagaggaagacttacaagcatcactttattaaagcagcataatttccaactgaattcaaatatttatcttttacagacagataaatatagccccttaatgatactccattatacagaagcgtaggataactgtctctgagaggttctcagcaacagactgaaacaaacaagccaaacaagccaaacattggatgaaggtcagagaccattatgtaagagatgagggaagaattgaaggccctgaatgggataggaacctcacaggaagaccaataatgtcaaataatctggactcctgggagctctgagtctgagccacctatcaaaaagcatgcattggctagactgaaatacctagcaaatatgtagcaaagtgctgccttgtcattcctcagtgagagaggatttgcctaatcctgcaaagactagatgtgacaggatggaggaatacacagtggggccccaccctctcagaggtgaatgggaggataatgaagggaggaactctgtgggggttggactgggggacagtttttgtggtgtaaacaaacaaaaacaaacaaataaataaaataaagtcaaatgtaaccaggactctggaacctcaggtagaaggattttaaatctgatgttattttaaggtagataatgcttatttttatgctaattccttcaaatagaagtgaacctttcaactgtcaagaatagatgttgtgtggccatgaactcttcttgagagagaaactggtcagagccaggaatccattctcttcccaaatagtatacactaaactcttcattacagctagggtatttccagacttaggatagcttgatgtttggttttgctacttttcctagcaaaagtcaagtacgtccagtagaaactgcagttcggactgggattttggaccttttcctgggcttttcttcaggtttcagcatcagacagaaagagtggccactcactgaaaaaggaatcctactatatgctaagagactggatatgcaaacaagatccagcattttgctgcatacaggaaacacacttcaataacaaagacagaaactatctcagaataaaaggatgcaaaagggtcttccaagcaaatggtcccaggaaacaagctggagttgccatcctaatatccaataaaatagacttttaaccaaaagttatcaagcataatgaggaagaaggaataattcatattcatcaaagggaaaatccaccaagagaaagtctcaattataaacatctctgccccaaatgcaagggcacccacatccataaaagaaactttactaaaactcaaaacacatattgaaccccacacaataatagtgggatacttcaacactccactctcaccaatgaacagatcattgaaagagaaaataatcagagacacagtgaaacaaagagaggttatgaaccaaatggatttaatagatatctacagaacatttaaccctaaaacaaaagaatacatcttcttagcacctcatagtaccttctccaaaatctaccatataattggtcacaaaacaaccctcaacctatacaagaatattgacataatcccatgcatcctatcaaatcaccatggcttaaggctggtctttaataacaaaactagcaaaaacaacagaaagcccacatatatatggaaactgaacaagtcttttttgttgttgttgtttttggttttgtttgtttgttttttgaagtagggtttctctgtgcagtcctggatgtcactctgtagaccaggctagccttgaactcagaaatccacctgcctctgcctcccaagtgctaggattacaggcatgtaccaccactgcctggccataagtacattgtagctgtcttcagactcgccagcagagagcatcagatctcattacaggtggttgtaggccaccatgtggttgttgggatttgaactcaggacctttagtaagagtgttcagtgctcttaccggcttagccatcttgctagcccctctgaacaactctttactcaaggataacttggtctgggaagaaataaaaataaataaataaataaataaataaagacttcctggcatttaatgaaaatgttgacacatcattcccaaagttatgggcacaatgaaagcagtgctcagaggaaaattcatagcactaaatgccttggtaaaaaaactgaaaagatcttactctagcaacttaacatcatacctgagagttctagaacaaaaaagaagcaaagtcacccaagaggagtagaaagcaggaaatagaaaaactcagggcccaaatccaccaaatagaaacaaagagaacaatacaagaatcaacaaaacgaaaagctggttctttgagagaatcaacaagatagattaacccctagcctaattaattaaaggacccagaggcagtatccaaattaacaaaatcagaaatgaaaagggagacataacaataaaaatggaggaaattcaaaaaatcatcagatcctactacaaaagcctatactcagccaaactggaaactctagatgaaatggataattttctagacagatactacataccaaagttaaatcaagagcaggtaaagaggcccatatcacataaggaaatagaagtcattaaaaacctcccaaccagccgggcagtggtggcacacacctttaatcccagcacttgggaggcagaggcaggcagatttctgagttcaaggccagcctggtctacagagtgagttccaggacagccagggctatacagagaaaccctgtctcgaaaaaccaaaaaaacaaccaaccaaccaaccaaccaaccaaccaaccaaccagccaaccaaaaaatcttccaaccaaaaagaacaaacaaacaaacaaacaaacaaaaaacaaaaacaaaaaaacaaagcccatggccagatggatttagtacaaaattctaacagaccttaaaagaagacttgatacgaaattcctcaaactattccataaaatagaaacagaaggaacaccacctaattcattttataaagccacaactactctgatatcaaaaccacacaaggacccaaccaaaaaagagagcttcagaccaacgttgcttatgaatatcgacacaaaaatactcaataaaattcttacaaaacgaatccaagaacatatcaaaaccatcattcaccatgattaaggaggcttcatcccagtgatgtaaggttggttcaatatacaaaaatccattaatgtaatccactatataaacaaactcaaagaaaaaactcacttgatcatttctgtagatgcaaaaaaccatttgacgaaataaaacaccccttcatgttaaaattattggagagatcgggaatttaaggcccacacctaaacataataaaagcaatttactgcaaacaaacagccaatattaaattgagtggagagatacttgaagcaatcccacaaaaattggggccaagaccaggatgcccactctcaccatatctattcaatatagtacttgaagtgctagctagaacaataaggcaacaaagagatatcaaggggatagaaattggcaaagaagaaacaaaggtaacactatttgcagatgatatgatcatatacataagtgatcctaaaagttctaccacagaacttctccagatgataaacaacttcagcaaagtggccggatataaaattaactcaataaatcagtagccttcgaggaggctgcctcagcctcagcagcagcggtcgccatctgggttccgggactccacaggacctaggaaattagtctgaacaggttagagggtgcgccagagaactggacagcttctgggacgggcggaagaacagagccgctgaggcagcacccttggcaggccacagacagccggccaccatccggaccagaggacaggtgtccgcctggcttgggaggcggcctcagcctcagcagcagcagtcaccatcttggttccgggactcagcagaacttaggaaattagtctgaacaggttagagggtgcgccagagaaccggacagcttctgggatgggcagaagcacagagcagctaaggcagcacccttggcgggccgcagacagccggccaccatcgggaccagaggacaggtgtacgcctggctcgggaggcggcctcagcctcaggagcagtggtcgccatcttggttccaggactccgtggaacttaggaatttagtctgcacaggtgagagtctgcaccacagaagctgacagcttctgggagctgccaaagcaacacagcttctgtgagaggccctgttttgggccttcttcttcgaccaggaggaggtccaaaaacaagatatctgcgcaccttccctgtaagagagcttgccagcagagagtgctctgagcactgaaactcagaggagagaatctgtctcccaggtctgctgagagactgtaacagaatcaccagaagaacaatctctaaacagagtcaactataactactaactccagagattaccagatggcaaaaggtaaacgtaggaatcctactaacaggaaccaagaccactcaccatcatcagaacccagcactcccacttcgcccagtccagggcaccccaacacacccgaaaacctagacctagatgtaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagaaacaataaagaaaactcaaagtgaggcaacactggagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaaaatatccaggaaaaccaggacacaatgagaagaccaaacctacgcataataggagtggatgagaatgaagattttcaactcaaaggaccagcaaacatcttcaacaaaattattgaagaaaacttcccaaatataaagaaagagatacctatgaacatacaagaagcctacagaactccaaatagactggaccagaaaagaaattcctcccgacacataataatcagaacaacaaatgcactaaataaagatagaatactaaaagcagtaagggaaaaaggtcaagtaacatacaaaggcaagcctatcagaattacaccagatttttcaccagagactatgaaagccagaagagcctggacagatgttatacagacactaagagaacacaaattccagcccaggctactatacccagccaaactctcaattaccatagatggagaaaccaaagtattccccgacaaaaccaaattcacacattatctctccacgaatccagcccttcaaaggttaataacagaaaaaaaccaatacaagaacgggaacaatgccctagaaaaaacaagaaggtaatccctcaacaaacctaaaagaagacagccacaagaacagaatgccaactttaataacaaaaataacaggaagcaacaattacttttccttaatatctcttaacatcaatggtctcaactccccaataaaaagacatagactaacaaactggctacacaaacaagtcccaacattttgctgtttacaggagacacatctcagagaaaaagatagacactacctcagaataaaaggctggaaaacaattttccaagcaaatggtatgaagaacaagctggagtagccatcctaatatctgataagattgacttccaacccaaagtcatcaaaaaagacaaggaggggcacttcgttctcatcaaaggtaaaatcctccaagaggaactctcaattctgaatatctatgctccaaatacaagggcagccacattcatcaaagaaactttaataaagctcaaagcacacattgcacctcacacaataatagtgggagacttcaacacaccactttcaccaatggacagatcatggaaacagaaactgaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaaacaggcctcaacagattcaaaaatattgaaattgtcccatgtatcctatcagatcaccacgcactaaggctgatcttcaataacaaaaaataaaaaataacagaaagccaacactcacgtggaaactgaacaaaactcttctcaatgatacctttgtcaaggaaggaatatagaaagaaattaaagactttttagagtttaatgaaaatgaagccacaacgtacccaaacctttgggacacaatgaaagcatttctaagagggaaactcatagctctgagtgcctccatgaagaaacgggagagagcacatactagcagcttgacaacacatctaaaagctctagaaaaaaaggaagcaaattcacccaagaggagtagacggcaggaaataatcaaactcaggggtgaaatcaaccaagtggaaacagaaagaactattcaaagaattaaccaaacgaggagttggttctttgagaaaatcaacaagatagataaacccttagctacactcactagagggcacagagacaaaatcctaattaacaaaatcagaactgaaaagggagacataacaacagatcctgaagaaatccaaaacaccatcagatccttctacaaaaggctatactcaacaaaactggaaaacctggaagaaatggacaaatttctggacagataccaggtaccaaagttgaatcaggatcaagttgaccttctaaacagtcccatatcacctaaagaaatagaagcagttataaatagtctcccagccaaaaaaaagcccaggaccagatgggtttagtgcagagttatatcagaccttcaaagaagatctaattccagttctgcacaaactttttcacaagatagaagtagaaagtactctacccaactcattttatgaagccactattactctgatacctaaaccacagaaagatccaacaaagatagagaacttcagaccaatttctcttatgaatatccatgcaaaaatcctcaataaaattctcgctaaccgaatccaagaacacattaaaacaatcatccatcctgaccaagtaggttttattccagggatgcagggatggtttaatatacgaaaatccatcaatgtaatccactatataaacaaactcaaagaaaaaaaccacatgatcatctcgttagatgcagaaaaagtatttgacaagatccaacacccattcatgataaaagttctggaaagatcaggaattcaaggcccatacctaaacatgataaaagcaatctacagcaaaccaggagccaacatcaaagtaaatggagagaagctggaagcaatcccactaaaatcagggactagacaaggctgcccactttctccctactttttcaacatagtacttgaagtattagccagagcaattcgacaacaaaaggagatcaaggggatacaaattggaaaagaggaagtcaaaatatcacttttttcagatgatatgatagtatatataagtgaccctaaaaattccaccagagaactcctaaacctgataaacagcttcggtgaagtagctggatataaaataaactcaaacaagtcaatggcctttctctacacaaagaataaacaggctgagaaagaaattagggaaacaacacccttctcaatagtcacaaataatataaaatatctcggcgtgactctaactaaggaagtgaaagaactgtatgataaaaacttcaagtctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattagaaggagcaatttgcaaattcatctggaataacaaaaaacctaggatagcaaaaactcttctcaaggataaaagaacctctggtggaatcaccatgcctgacctaaagctttactacagagcaattgtggtaaaaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcatgtagaagaatgcgaatcgatccatacttatctccttgtactaaggtcaaatctaaatggatcaaagaacttcacataaaaccagagacactgaaacttatagaggagaaagtggggaaaagccttgaagatatgggcacaggggaaaaattcctgaacagaacagcaatggcttgtgctgtaagatcaagaattgacaaatggaacctaatgaaactccaaagtttctgcaaggcaaaagacaccgtcaataagacaaagagaccaccaatagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacctgaaaaaatgttcaacatccttaatcatcagggaaatacaaatcaaaacaaccctgagattccacctcacaccagtcagaatgtctaagatcaaaaattcaggtgacagcagatgctggcgaggatgtggagaaagaggaccactcctccattgttggtgggattgcagacttgtacaaccactctggaaatccgtctggcggttcctcagaaaattggacatagtactaccggaggatccagcaatacctctcctgggcatatatccagaagatgccccaactggtaagaaggacacatgctccactatgttcatagcagccttatttataatagccagaagctggaaagaacccagatgcccctcaacagaggaatggatacagaaaatgtggtacatctacacaatggagtactactcagctattaaaaagaatgaatttatgaaagtcctagccaaatggatggacctggagggcatcatcctgagtgaggtaacacattcacaaaggaactcacacaatatgtactcactgataagtggatattagcccaaaacctaggattcccaagatataagatacaattccctaaacacatgaaactcaagaaaaatgaagactgaagtgtggacactatacccctccttagaagtgggaacaaaacacccttggaaggagttacagagacaaagtttggagctgagatgaaaggatggaccatgtagagactgccttatccagggatccaccccataatcagcatccaaacgctgacaccattgcatacactagcaagattttatcgaaaagacccagatgtagctgtctcttgtgagactatgccggggcctagcaaacacagaagtggatgcccacagtcagctaatggatggatcacagggctcccaatggaggagctagagaaagtacccaaggagctaaagggatctgcaaccctataggtggatcaacattatgaactaaacagtaccccggagctcttgactctagctgcatatgtatcaaaggatggcctagtcggccatcactcgaaagagaggcccattggacacacaaactttatatgccccagaacaggggaatgccagggccaaaaagggggaatggacgggtaggggtgtgggggtgggtgggtatgggagacttttggtatagcattggaaatgtaaatgagctaaatacctaataaaaaatggaaagaaaaaaaatacaaaaaaaaaaatcagtagccttcctgtatacaaatgataaacaggctgagaaataaattagggaaacaactcccttcaaactagccacaaataatataaaatatcttggggttattctaaccaaacagtgaaagacatgttagacaataagttcaagtctctcaagaaagaaatcaaagaagattccgaaaatggagagatctttcatgctcacacatagaaagaaagaccatccagtgactggaccaattgggatccagcccatgcacaggcaccaaacagacactaatactgatgtcatgatgtgtttgtagacaggagcctagcctcactgtcctcgggaggttctaccagcggctaactgagacagatgcagataattacagccaaaacattggagtgacattggaaacccctacagaagtgttagggaaaggactgaaggagttaaagtggactgcaaccccataggatgaacaaaagatctactaaccaggacccctcaaagctccagagtctaagccaccaaccaaagagcgtacatgggctggtatgtagcccccagtacatatgcagtagaggactgccttgtctggcctctgtgggagaagatgtgccctagggaagaggaatgctagtaggggtgaggtggggttaggtgggcaggaggggaagcaccctttcagaagcaaaggggaagagtatggcgtgaagaactcagagaggggagactgggggcaacatttgaattgtaaataaagtaatttaattaaaaaagaaaaagaaaaaggaatcctatactctaaagcgagctgtgtggcaagacttttctggttagtttggtagatgagatgtacttccaacttatgatatattcaacttatgacagtgggtttattgggaatgaatcccctcttattggagaactaggtgggtagaaatgtctggactctaccttcctgaacccctgctgtctcttcaagaccatttctaaggatcaaagcaccctcatcttccagtaaagattcatcaggaattaatccttgatggagctgctttgggtccccaaagttacttttcagagtacagcttttatttcaatgcaatcattctcacacataaaaataattcccccaaattaatattttctttctttttttttctctaggtttggaaaactgagtttcctcccacaattgcatttatcattctcccttccctacctagcattctaattatatttacacatcctagcaaagtcagggagagaatactataaagaacaaggaaagccattcaacctgaaatttaaacaatcccaaggtcaaataagaatgccaaggttgtcagggacagaaggcagttgccaagaatttgatactgacaggtcatagtctgatactggtcttccatgagcagaattctttacaggacccaatgcgttgttactcccaaactatgtcagtctacatcaatagggaggcctgagtaaaggcatctttgtttagaggcagagacctgtaagtgttagactctcggaggactgtgatagggagcataggtaaaatggatgatctgaaagtgtaatttggactttgagtggtaagcacagtaaggtaggctgtgcatcaattcaggatagggatattatgacagaggtcaattcctcattgaaggtagttatttttcaagttcaaaaaaaaaaacataaaagttcaaaagtaaataaataaatgtagtcctcactcctaatttaaaaaaacaaaaaaccttctctttgcagcagatggagaacactacagaagaccatgaaaatccatcaaaatgcagagttatagagccctgttccaactaatgcatccacaataacatccctgcacctatggatcaggtatcactaaggaagagagtctagaaagtttgtaggacccagagaatcagtgagtttgatgtgaagttgtatttcttagcaatgtcagaagctgcattcatgaactctcatcatcacgacagctcctgatatttgtgcactggttctatagggtgagcctactggattcttttattagtactaactaacatttttatttcctatttattttctttctttggtaagctattgtggtggctggtacggtggtacatacctgcattcaggaggcagaggcaggccgatctctctgagtttgaagccagtctggtcttcatagtgagttccaggacagacagggttacacagagaaactctgtgtagaaaaacaaaaggcaacaagacaaaataaaatgataccaaccaaccaaacaacaacaacaacaacaacaacataacaaatacaaaacacaaaaacaagttgaaaatcctttgtgtttttctatcatataggttcctgccttctacaaatgcagatatttaatgtcttttctgatgtgaaaaacaatattcagatgtaggacagactgtactaaactttgagaaacattcttgaattgagacagaaatgatatggaacctcaagacaaaaccaaacagagtaaatgtaccaagtaccagcaaccaaagcagtaatgtaaaggaaagcacacttggagatattctacatcctaagttacaatgctttcatcaagctatcacgataaaaacaatatagtcttcccataaactaggaagagattactataaaagcatatagtcaccaagtctaaacgaaatcatgtaaattttgacaagagggctaaaaagacacagtagagagatggcctcagcaaaggtaatgggaaactggacttccacgtccaaggagcaaatgcacccctagcgtacatgtgtcacatcacaaagctaaacaaaaacttgaaactgtgaaaccgccaaaaagcatacaggggaaaagcttcaacagttcttttgacattaattttttttggatagcccatcaagagcaaaacaagcagttttccacataaaacgaggtacttcacaaaacagcagtgaaagcacctacaaatttacttaaaaactcctttgtataatgcaataactactcattctaatgttgaaataagtgacatattccctctactcatttaggtgcttccattctgatttctcatgagatatttttttacttctaatgattgcagaattacactttttgtcattattttaaacctttgcagtcatcagaatctaactttctcccccagattcctatgatagaattctgtattgatagttttatggtaattcttcactggtatagtcttccattttcctcagccatattgaaacattgctatgaaatggacaaccttccaaacctgacctatattctttgcagacaacatctattcaggagaagtttgccagttacttctctgctgctgtctgatgagaaatactgaaatcgctggtcaaaagcctcgaggggacagttcagcaaccaagagtcttcccattccagagttagtaagggccttaattaaatacatgcttcagatggattttaatttttctactactttaagtaacatgacaagaaatgctgctttcccaattcagttcatcttgcaactgacatttgattccctttaaaaaagactttgtcaagatatcaggaaagtgttgccaccataattatatctttttaaaaatgattcagcaaaagtgggtggaaaaggaaatgaattcaatcagaaatttgataagtaacagaaacagtgtttatcacataggttttaaccctccaggaagcttagatcgttttgtgcatttaccagaaaattagtcattatcatttcttctcatatatcttattgtccaaagaccgaagaagtactgttttctttaaactattttattaagaagaatgacataatttaattttgaaaataactgtagataaaagccccctgaatgatactatgccacaaaactacaatatatgaatttatcattaatcaaaggggggaaacggtgttagtttaagagaaaagcctaagatgtaagcagaggtttgctttaaaaccatatggtattatttaagaaaatattccgtgagatccagaacaggaagaatcgtaagaaaggtgtcttctcttcacagcatctggtaacagtgctctgctgattctgccgctcattcatacatagactcctttcaagttctatcttaaccaaattccatacataaataggtgtttcatacattttattcatcttacaaattttaaattgttcaatttaaattataatttttgactcgctgttttcctaaaagtcgcataatgttcaatttccaaggctcttgtttccttgagtttcatggaaggttcagttaatatcaaacatgacatggttgttcaaagacttataatgcctttctgaaagtatgtctagtcttcagtatgattttcatctcagttaaataaaatctcccataacctcttttggtaatgctatctgatctgtcttcttggatgcttgagtattttgttcaagtacattattaattaatgagttatttcactctatctgtttagatgtctcctactgtgtagaactaggaagtagagtatttaccttctatagggagatcctcagatagtatagtatcatcatgaggataaaactcatcatgttagatacatgcttgattctccagtgatctgtagaatgtagactgatagccattccccattctattctcatatcctttttctgtagtaatagacaatgacttctttcctcatattgtctctgtgctgtgctctcttccttgtggtgaagatactttgtaggttcatgtaatctaatgaacacaattttacttttatgaggtattttaaagataattatgtaatagttcctttcattttccataaaaggtaaatatattgtcatatcataaaagtaaaccaattcaaatatttttctatacaataattgatctcaatatttgactttctacaatgagaaaccaactactctctctcaaggaactatataattcatctgaaagtccatattcatctttatacattgcttagctcagtcttgttcaaataaaataaaataaacactgtatattataaacttgatggattttcagatatactggcattttataatttaataatataaatacaaataaagaatggaaatttgaatgattccttttgctgcataaacctaacatattaataaaaattaagtgatagcaattgtttaaagagtaaaattatgaacatagtggatcataggtctgtattacatgttggaacatcttctgggtatatgcccaggagtggtatcgctggattttctggtagtactatttccaattttctgaggcactgccaaactgatttctagagtggttttactagcttgcaatcccacaaggaatagaggagtgttcctctttctccacatcctcacagcatctgctgtcaactgagtttttgatcttagccattctgactggtgtgaggtggaatctcagggttgttttgatttgtatttacctgatgactaaggatgttgagcaatttttaggtgcttctcagccattcggtattcctcagttgtgaattctttgtttagctttgtacctcatttttttaatagggttatttggttttctggagtctaacttcttgagttctttgtatatattgaatattagccctctattgaatttagggctggcaaagatcttttacaaatcagttggttctttttgtcttattgacagtgtcctttgccttacagaagctttgcaattttatgaggtcccatttgttgattcttgatcttacaacacaaactattggtgttcagttcaggaattttccccctgtgcccatatcttcgcgtctcttctaaactttctcctctataaatttcaatgtttctggttttatgtggatttccttgatccacttagacttgagctttgtacaaggagataagaatggatgaattcacattcttctacatgctaactgccagttgagctagcaccatttgctgaacatgttgtcttttttccactggatggttttagctcctttgtctagtgaccatacatgtgtgtgttcatttatgagtcttcagttctattccatttatctgtctttcattgtaccagtaccatgcagtttttatcacaattgctctgtaatagatgctacaccttgtaataaggacacatgctccactatgttcatagtagccttatttgtaatagccaaaagctagaaagaacccagatgtccctcaacaaaggagtggatacagaaaatgtgatacatttacacaatggagtactactcagcaattaaaaacaatgaatttataaaattcataggcaaatggatggatctgaaggatatcatcctaagtgaggtaacccaatcgcaaaagaaaatacatgatatgcactcactgataagtgaatattagcctagaagctcagaatacccaagatacaatttgcaaaacacacatgaaactcaagaagaaggaataccaaagtgtggatactttgatccttcttagaagggggaacaaaatactcatggaaggagatacagagacaaagtgtgaatcaaagactgaaggaatgaccatccagagagtgccccacatggggatccattccatttgcaatcaccaaacctagacaccaacaagagcttgttgacaggagcctgataaagctgtctcctgagaggctctgacaatgcctgacaaatacagtagtcacagccatctattgggtccccaatgaaggaactagagaatgtacccagggagctgaagggatttgcagtcccatgggaggaacaacaatatgaactaaccagtatctccagagctccctgagaaaacatagttggactcatggctctagctacatatgtagcagagaatggccttgtaggtcatcaatgggaggagaggctcttagtcctatgaaggttatatacctcagtataggggactgccaaggtcaggaagcaggagtgtgtacgttaggaagaaggggtatgggggaaggggataggggattttcataggggaatctaggaaagggaacaacatttgaaatgtaaataaagaaaacatctaataaaaaatgagtaaaaataatgagaagggcactttaacttttgtattttgatattcagaggctatcaaggtgaattaaacttgcttacatccagcagggccagcagcaggcttcaacattttttgattttgcgggactaaactccctaaagctttgtgagctgaactgcattactacttcctctcacaagaaggagcattaatcaataacaggagccatagtcaatatttttgataatccaatagaaaattcattcaccaagcattctattggaaatgcatttgtttgcacagataaatctgatggtagattaaactttcgttttatatgccttggagaaacaggatcaactcaaatcatatgtatgttctaaaacctgaaatcaaatgggcaacataaaacatgtgtaatataaaaaaaattcctttgggatcaaattcagttaatcaataattgatcatatattgtaaataaaagaagcaaagtaaatgagccctgcagccaacctgggcaactcaggagagctggccctgatggtagaggcactgaaaggctggctccaggagagtgaaaggggaagagctggcccagatcctcacctaggcagcatgggagaactagtgacatgtgcacaggaatgcttgagagctgacagattcagctaccaaataggcccagatcaagtgatttgagttggcccacggctacatctaccccacgagctgctggagctcttgaagtgaccttttctgcagatccaaagttacaggatctgcatgacacaggacaacaacagtatgtcagagatgagtcaggatgaggatctagtattaatggtgttgcagaagccatcaaaccagaccaattactcattgcaatgaatgtttgcaagtaaagttgtttaggcaaacgggtatactgtgggacatgccatgacactgcagctttcacagccaaatgtttgataatgttgttgttcttgtggtggtggtggtagtggtggtggtggtggtggtggtggtggttcttgttcttagtgttgtttgtttttgttttgttttgttttgttttgttttttggtttggttttggtttattggggggatgttgcaagggcaaaaagtagatgtgaagggatgtggagataaatgacattgtggtagatgatatgaaattcacaaagaatcaacacgaagtttaaataaagaagcaaagtaaaatgtaaagtcataaacctctgtctcctaagtgctaacctcatgattgacaggtggctccaattgtttccttctgcactgggcttattatcttctatactttatgacatcatcctgtaagaaatcaatatgatatttgctgctgagaattttgataaagatgggatatgccaaatcatgttaatatgactatatcttcagcattatttgtagtaaaattattatttgaaataagatacaagaaatttatgtttctattatacaataataatatttatatacactaagttcaggtaagattactttttacttagatttattttcatttataaacatgttaaacttatttctctctcttctctcctcagtaactcatttccctatttctatccatctcttctctctttctgtttctctcctctgtttctctgaccttttctctgtatctctctgtgtctttgtctctctctatttctgtgtgtgtctttctctctttctccactattttgttgtcaagcaagcaataaaatattcacatctccttcccaccctttgttttgtcatccctcccttcctctcactctctttgtggtagaatctcagctatggaaggctggcactgaactttctatattgccaggggaatggcctttaactcctgatcatctaccactctagtgctgggataaaacccaggttttgagtactctaggcaagtactttaccagctaagcaccttctacagccaagcaaacctgctctactttgcttatggctatgttcataaagttaggtcctctggggttacttatgattgttatatactcattcttttctcaaatgtttcccaatgtcttattactacacagtgcaaatgtacataggttgagggttcaacaacaaaacaagtgtacacatattcaaaactccagggattgagtgaaacatagagtgaagacacagggaatattttaaaccaattgattagagtatttctttttctgttaaaaagcaagcagacataaaaataatggtaataacaaataacaataataatacaataatatcaaaacaaaccagaataagactaaactattacccagaataaaagagccaaagattgctggattcattttattttggcttctttctttagttcccatttctttacatcccatctctagattttctgtctaccatgaagcaacaaattccctttatttttttagaacatgttctgtttctgtcaagtatttgaggcatcaccacagaataactcaggaaaaagagttaaaaactctcccacttcaaagggattccaattcaatggagctggtgtttctgctgggtgctcaatctgcagcacttatttgctgttgagactattcattcaaagatagttgatgaactaatttatttaataaatataattttataaacatactaatactttgaaagcaaacataagtaaacttatgaaataagaattcttatcaaggtcaggatttttagtatataagtagaagatgcataagatagcttaaatattatagcaagtgcacaatgctccaagaagagacatagatacaaatgtatgaaactaaatgcaaagagccacataataataatccaggaaatttcagggcacattgataatatccattctggccatgtgtcttctgccctgtcctagtgttttattgctatgagaagacaccatgaacacagcaaatgttataaaggaaagcattacattgtttcagaggtgagtctattatcattatggtagagaacagggtggcatgcaaatatatgagcctttagggtccaatcttattcaaaccactgcatgccacaaggaaaatccaacagtggccaatgagtctaattgtgaagctgcagctgtgtatggaataattatctttgtctcttcccatcaaaacaagaataagtcaagttcagtctgtgggcccctctccttaaggctttatctgtccttagaactagactcccagttagcttgagtattataatttgctctgtgatgctttctgttctacaaaggaaaattataagtgacatagagaattagaagcaaggtttaaagatttatatattctcatgtaggaaatgttcagagtctctgagttataaaaccaaacaaggcaacaatgctgcaactaacaacagaaaacacccccaggaaatatgcatcataaaagcagtttgacagtagcttgtgtggaagtggagctgggacagggtgagaaaggctgaacaaaaggaagaaagtagctagtttctccactgggtcctcagttctgttgctctcccaattcattttatgggtggcattgacaacattgaaacagaaaagaaaatcaaaagaaaggaaaactggagaacagcctcctattttacttagcatcaagtctaacataacagtctttaacaaatgattaacaaaataatagcaaataaaatgcaggcaatattgtacataaaaccttacaggatacttgaaggacactccatcagacatgcagggctgattaaactgtgtaggctttgctccgtgccttcactgtcattgttcccagcctgcctggtggggtgataggctggcccaggtttcaccagattgctcaagttttaacaatttgcctctctctaaatcctcttcaagaggcagggagctctttactcttttttatttcatttttccagtaatgggacaaaaaaagtaaaagaaatgtgtggaactttaatagagctcccaaccttttaggtgaaagcaaccatgttttagtgttaaatggatccaagacagacctgtcagacttcatttattttaccgtactttcctgtgtctgatgatgctggaaatctatatttgcaattcacaatatacaccatcattattgaatcttgtggacttttatgaatcagggttagatttaatggatagcattagcaattaatctcttgtgagcccgtggattaatgcttatgcagtgtacaaactctgtgtagcttcagcgttcaacctggcaattatctagagaatgttttcttagagctaacagttatgatacaataccaaagtcgtatgggccaggcatcactggaaaaggataagatactgtgtgtatctctgtgtgtaacagagaaggggacactcacaaggacaacacagtggtaaagaaccgaacacactgcacacagagtaccacactaaatttggaattggacacagtggaaaaaggaataggaaagcaaataagatggcacacttgtcaatcaaggagagcctctcctctgcctatgtcacatcagtgcttagctgaaagtgatggaagtgaaatttgtttgggaatataacaggagcaagcctacagtcagatcttctgtgttctgttgaactcaatacatatgcctttcctgattcagaagttctgggacagtagaaaagaagaaactccctccttcccagtggagtgtcgatgctgtcacgttgtcactgggatcatgctttcctgagagtgtcagcgcggtcccaaggaacagcaacaggaaaatatttctctgaaacacttaaatgatatttgatttaaaaacaattggcgcttcaaatcgtgtggatttatattaatgtctaaacacacacaaaactgagatcattagtagtttgtccaaaaatgaaatagactgttttaactatttccaaatttggaaaaagaatgtaaatatatattttgccatcccatccatgttccatcaatggaaatggaaatgtatgtgtagcaaacgtttttcttgttttaaatgcaataatcttaaatgggaggtttttgattctatctgtctatctatctatctatctatctatctatctatctatctatcatctatctatctttctatctatctatctatctatctatctatctatctatctatctgttttctttggttttctgtgaaagtgaagttttattatattttccccaaaatattcagaaacaataagatgttttaaatttttatcacatttatttgtggatatgtatccttgggtgcatacacatgggatggcacacacagagagaacagaggacaaattgaaagactcagttctctctttccatcatggagttaccctaaagtaaacttcagtctttagacttggctaaattgactttagccattggactatctctctggcccttgattagatttgtatatgcaaactcttgaaacagaaggaaaatagacttttcccatgtatctaaataatagcaattatttccagctgaggacagggaatatcagtctgttaatttttttaaaaaatcacattttcaaactatgcagctaggctaaagcctttcaattaggaaactctattaaaaatcagaatcaagaaaacaaggacaataaaacaggggcttatataatcgttcttcaaatgtgaggagcttcaaagagcccatgtgttgcacagagaagtgtaagctgtgtatgcttatgttgctacataaggcatgtaggttgagatgaaaacaataaaaaagacatttttttaaaaataagattgcttgttgtctcaaacacactgccagataaaagcggccaagttaagcacaatgttcacacaactaagtttctgatttcttcaaatctaacttttaccttttcaaattaaactattgttaaaaatcatttctcatggacggaaatgtctagtagccaagtcacttgctactgaggctggtggcttcagctctacccaagggacacacatagtgagaggagtgaatggctgtgtgggctttccctgcagccatgctcttctctccacctctctccatgtctttgtatctgtgtctctggtgtctctgtctctgtcgatctatctatctatctatctatctatctatctatctatctatctatctatctatctatacacatatacatgtatattatacatatatattatatatacatattatatataatttatataatatattaaatattaaataaatcttttatgatatatatatataattacatacacagtgataatagaaacatatcaaattctctaaaagagagctgtcaaatttaaagtggtatccattgtacttcagattatttaaaaaccaatggataacttagataagagcagcctctctgatgagcgtatggactgtgaagttctgctgacatatgactggcctactcagcaccatcaatttgatgaagaggtgatattctggagagctggaaagtaacttaactttgaaagcatgttacaggttagtacaatgaagtgtcccatacttcaaaaacagtattaatggaatattgagttcaatatcctgacagtatttgaacactagaaagtgggataatgtcagatcagcaaaatcaaagccaccagtcacaatagaatttgtgatttactgtgtttgatttttgtcactttatgagggtaaacatttaaaaaaatagctcagaaaattttagaaagagacaagagtaaagtcatcctaacatactctgggggaaacttaaacatgctattaatattttcactaaatatacatattatctgcttgaataatttaaattcctctttaaagaaattcttacattaatcattaattaagagtttttaatttactgaaatgaataaatataatcaccttagttatatgtccataaaatgactattacacaatgatataacctatacaatttgattaaataatttctgcaccaggtaacaaacattacaaaaatagttacactttttcatttatatgctacttattggaatggtcttagattttgtttgtttatttgcagggtctctctatgtagacattgctagaagctagcttccaaatcacaaagatcttcctgcctgtgcctcccaagtgcaggaattaaaggcatgtgtaaccacgcccagcatgaacagttttactgttacttgctataatttattattatttactatgcccagttttgctattaattactgattgccactgttaactggtactatccttgatttgtttaatact

SEQ ID NO: 194 - DNA, 5453 bp, Mus musculus
ggtcatgacaccatcgtgttcacagcggacgataaggtcgatgtcatctccaagcttccacctgcggtaactacaaggacagcaagacgcactcactacaagatccagtgctgtggatggaccaccccagacagcacaggacagggtcacctgtccccaagagccgacttaccggtaagcgacggaggcgatctcattcttatccatgtcgtcctccacaaatgggtttgggttggggaaattgtatctttctcttccctgtagaagagacaaagctttcaggagctggggttgacttcaagtcggcagacccagcattgcttttgactgccctggctggtacttctgtccttaaggatgtaggctcattgtgtattaaggaccaagcccaacacaatcactgagtaagagccaccatgccactccctgcttccttcctcactacaggcagactgtagctaacaggacagcaagcaatgccttttctccctcctccatcacagtaaaaggtgggactattgttcagtgctgtatcctcaaggtaacgaatggttttatccacaggcattccacagcccatctgtgacacaggcgttatcaataactccacagagaggaaatatgcctttagacctttttgtggctcggatccctgctaccaggtgggcgagcctggccaacctcgcaccaccatctagtgcagagcagaggctcagcagcagggacctaacccagcaggccagcgcatccgctcctgtgaactcaccattctcaggcactgctgagagaagttgtggttgatgtaggtggcttccatggccaggttccggggtgagttgaaggagttgccttcatcttgaggcggctcattggctgtctcactcacagtcaggaggtctggaaaaacccaagcatggatgtcacctgctcatgcagccgagccactggcagtgtgcacagcggcacggggagatgtatagacctacatcataggggcccatctgcaaataactgccttctgctgacagaggactcccccagggcatggcatgcacaggaagtgggtggctcacagaaaacattaggtgtgacccaacaacactggccatatagtaataaagccagccattccttctcattctttctggatcctcaagagaatgtgtctctcttgatactttaacaaatcaggcttgcaactcaaacagaattagactgctttgttttcaagctgtaattctgtggtttactgactgtgtgtatgcatatgcattttctttatagttcataaatgggaaaaggaggaggaagaggaaggagaagaggagaagtaggaggaggaagagtcctatgcgtataacacacagccacagcgctggtgtgagactcagagctgaagcacacagaagcactgaagtggtctctttgcttggactctagaggacgggcgggatcatcacactgctcactcttattcttaagaactgacaacactcatgcctaccaaagtcagagttgtccctcttgtcaaagaagagtttagagccgactctctggacaacgatgtcccaggagtacacggagcgggtgcagctcatcagcgtggccaggatggcgtcagtggcaaacacattgccctgcgtttttgccagctgaaagcagggagagagggacaagagagtgaactgaggacgctgaggtcacttgggaagaagacatgcccagtcagtcatggaggctgcagcaaatgggctgggctgtcactgtagcaggccatggtggaagcatggccctcactccactcattagtttccagccgagccacccctctacctttgtaggtaagaaagctaaggctccagggcagcaaagtcaggttggcagagctggaatctgagcatgcctctgcttaacatatttaagtgtatccacttccatcaaactctaagtgtgatgtggaagaacctcatctaagggctgggctatgcagtcagccgttcctgtggggtctcagcaatcaatccacatgttcaggggagaaaacgtgcccgacaagcacgcacaccttctctttgtcaggtgcctcaaacaacagggtaacaactgcttatgtagtagcatccagtgtcttaggtgtggtgggcaatccagaaggatctgaagcatggaggattgctggggccgacaggcgagtcacatcaccggtactggagcacccatggcttttggtatcatggggtggtcctgaatcagaccctgtgaacactgagggacacctgcacgtcttgtgccctgctctttctgaggcctcagcgacattcccaaaggtgggcaaagggtgcacaccttccggatgacagggtcgtctgtggtggtgacggtgtgaaagatgcgcttgatgctccgcaggggcttctcactccttgtggtgatgcggtcaaaggctttgtcgtagtactccagggctccgcagcactcgctgcggggagaggggaaaaaaaaaaatcacagagatcctcttcctcttttatgccatggaatcggaagtcagatctattggcatgcctggcactgcagggtgcgtgcctacaatcccagggttagggaggcagatgcaagaggatggcaaattaaaaaacctcagctacacaggagggtccatctcagaaaataaacttcacccagaagttcagtatatatgaaagagacagcattaatccctctgaaaatgagacaaatctttagtgttagtttagtttcctgtcttcgcagctcccaatgttcctctgtagaacacagggaaagaccttacacagtgaaccttccctgggaaactgagcccattatagaggcacccagatagatcgacttctgggttgaagctctggctctccactgacttagctctatgtccttgccctctagtgtacgatgctacacaaaatggagtctcctgaacaactgtcacgcctctcctgctgcaggagcttagtgactgaactactgggctttttctcggatgccaaaagtggaaagaaactgggacttttttagtaaacaatgcattttttaaagtgggtcttgatctttcaaaaacatacccaccagtccatagcactgtaagtggcttcaaatctgctttggagttgctaggacttaaggagacactgatccctggcaggcagacagactctgaaacagggtgggcaccagggaagaagctactcacatgtcttgaggctctgacacttccaagtagcgcatcttcatcagctgagggaagtccatctcctccttcacctcccagtcactgcgaacttcaactgaggagtctcggggtttctgcagaggaaacacaggaagatcttcatatcctacgcaaatagcaaaagacagagtgacatgggaagggctttcattcaatcattatggtcccggatgttttttttttttaagttcattgtatttatttgatctctgggttctctgctgcatgtacacctgcaggccagatgagggcgtcagatccctttatagatgggcatgagccaccacctgggtgttgggaattgaactcaggacctctggaagagcagccagtgctctaaaaagctgagtcatctcattagtctggtcctggctgtttttaagcagggcccgtgactcctggcagctcagagaaggaagcagggcctcagcatggggcttctcagggtgtcaagcacacgcccgatacagcaagcagctaagtcaacctgcaccttcacgactttatcaccctacaacactcggcagtgaagccgcgattctgtgcccgaaaagcagctgctttgctgttggcaacactcctagcccaaactccacttctggtcatgtctgttatgctcacagctcccacaaagatggcagtgttatacctaacagtgccaaagtggaaagatgaatggctgaaggaaatgtggcaacccatacaaaaaaaccactcttgggcaaaaagactccatgtttgtgagctttataccagcaggtctataaccagtcacatgtaaactgaaaattcttggatgctcagcatactggaaatcccacctactgggtggctgacagaggaggatcacccgagagttaaaatgatactttcaacccaaatatataatccagaggcaagctaaagtccacgaggggacacacatgagatacatgcagagaaggtcagtgcacacaaatcttgatctctgagggtacctggaaccaatccttaacagacatgaaggaaaagtgaaaagactgtgctaacacgggctgcgatatgatcttaaaagtggcacactaactaaagggcacagagtatgatcctattgtacatgaaatgcccgcgggcatcaggggagtcccgagacatctctcaaggtcaaagaaaacaaacccctccaagtccccacagagtccctagagggacactacctgtgacttctggtcccatttttgcctcactccaaattgcttctggaattttttctgcaagcgaattcgttctctgaaaagacagacaaaatgctgtgatttcagtgtcggcttctagctgaatcgcatcatccttcctagctgctaccaggatagaaaataggggcttagatgtagaacacactggggattcgagcagaggcgcactactagtatcaaccagcattcagcccagttactcccatggcagccctggctagggtgcagtggctgctgtgcccagccccaagggcccacaggatatagcataagtggtgctgcctgaaaccaggcatccagaatgtagaggccacagagccacttcaaatgtccgcctcacccacctcctgtctgtctgccattgcccagtcttgggcagcaataggtgaggaggttttgctttctttttcaagagtgaaagatagccagtccctgccctgctctgtgattttgagtacagcccatttgggaacataactctgacttggcaggaagggacgctcacctctctttctgcttggcactcttgggcagggtctgtaggttgaactgcaccatgttcctccgatctttgtctctgcggaggttgcgctggggagcaggaagagacccatgttagcccctcggagacaaggctcatggtatcttgagagtaagtttacggcgtgagttctaagtttcacatctctttacttttactctacagcgactacagaatttgggctaaggggagtagcacttgtgttagcttggactgtcattcccactttaatgtgggtttactagttttattggagttgcaaagtttgcaacattatgtagcaggaggcaccctaccaaaccatgtaattaacaaaggttgtacatgacaagtcagcaaggcactgggttcccagcacagctgtgtgatgtctgaactactgtgaacaaaaatctaaactccttcaatg

SEQ ID NO: 195 - DNA, 2244 bp, Mus musculus
aaagatttatttatttattatatgtaagtacactgtagctgtcttcagacatttccagaagagggagtcagatctcattaaggatggttgtaagccaccatgtggttgctgggatttgaactcacgaccttcggaagagcagtcggtgcttttaaccgctgagccatctctccagccctccaagggatatttaaattttgagtgggagaagccaggcagtggtggcacacatcctaacatttgggaggcagagacagacagatttctgagttcggggtcagcctggtctatagagtgagttccaggacagccaaggctgtaccaagaaaccctgacttgaaaaaccagggggaagaaatctgaagggagggccaggcaaggtagcatacacttttaatctcagcacttgggaagtaaatgcaggcagatctctgaattctcagccttccagggcaacgcagtgaaaccctatgtcagataagtgctgcttagtttgtgtgtgtgccacatgtatgtgggtagctagcgaggtcagaagagagtgtggggtcccttaagctggaggtgaaggctgttgttaccagcctgacatgggtgctgggaactgaactcaggctcctatgaacaacagagtgtactcttagcttctgagccatttctccagcccagacttcacttttaaagcaaggctaggtctcattgcctaagctggagtgcctttgaaaaaggtcataactgtatcaggatgcaggcccaatccagttgtgtcccagatggtggggctcaaagctgggaccacaagaataaggcttgaaatagttgtcactctagccgggcctgtagtgtatgccttcaaaccccagcactcaggaggcaggtgaaactgtttgacccaacctggtccataaagtgagtcccaggtcacctaggcctgtcacgtaaagaaaccctgtctcaaccctcccctcccattccaccccctcaaaaatggttctgtcgttgtcgtggctgaggattgaggtagtcctgatgtttctgtaaccatttattatctgcaaagcatttgttattctccctgccttgtaggttccaattgctggttacctatatatgcgtgcgtgcgtgcgtgtgcgtgcgttcacaaggaagcctccgtgttcaagcaccacttacctcatttttagacacgttctttccctcggcctggaacttgttgataaggctaggctgggtagccagtgggcccttgggtcctgttgtgttccttgtcagtgctgggtcacaggcacaagctactgtgcctcatttctttttcatgggctccagggatccacttcagatcctcaaacttgcaagacaaacatctacccagccccatcaattacaatctttaagagatgtaaaatgagccgggcagtagcgatgcacacctttaatcccagcactctggaggcagaagcaggcagatctgagttgaggccagcctggtctacaggacaagttccaggatatccagggctacacagagtagactctgtctcacaaattccaaaagcacacagggacaccgccgtagaggatggcaaagggaggcacagagtatgtcttgttccggggagaggtcctgtgaaagatctgcctggtgtggctttgtgcaggtagagctcaggttatgtttggatcttacctgcaggtcctggtggggcagccacaccccatccttccctactcacctcatctttgtttccacaccctaaggcggccgaggaggaagacgtccccaaacagaaagagcggacacacttcaccgtccgcctgacagaggcaaagcctgtggacaaagtaaagctgatcaaggagatcaagaactacgtccagggcatcaacctcgtccaggtgcggcccgctcctcagtgccttctcctctcctcggtgggacagctttaatgccccacacttctgactgttgtctctttcaggccaagaagctggtagagtccctgccccaggaaatcaaagccaacgtcgccaaagctgaggccgagaagatcaaagcagccttggaggcagtgggtggcaccgtggttctggagtgaggcatggttatgaggacttacggactagagttctgggatccgggcaaagcctgctcaccccgattcactcccagctgctgtggtgggagcaacagctagtgacgcgagtgtccgaagtctcctgagagggacaggatggacctactgt

SEQ ID NO: 196 - DNA, 10424 bp, Mus musculus
agtgtatgtatttattctgtgtttatgcatgcgtatgtgtacatgcacgtgcaccacagtacaaaggtggaggagctcaggggacaacttagggagctggttatcccttcccaccatgtgcgtcccagggattagactctgatagtcagcttggcagctagtgcctttactcactaagcagtcttgcaggctccccaaagtaccaaagctgtttttaatcagttttcaagtgggtatgtttttaagtaccaaaagcaaactttctttctttcttttttttagggggggagggttttttgttttttttctcgatacagggtttctctgtatagccctggctgtcctcgaactcagaaatccacctgcctctgcctctgcctcccaagtgctgggattaaaggcgtgcaccaccacgtcctgggttttttgttgttgttgttgttgttgttttgagcagtcagtgctcttatctgctgagccatctctccagcccccaaaagcaagttttcagtttgctcctttaactgttggaaggaacctcactcacttttgtctgttggggaataggattttaggcttccccaaagaatattataaagattttggcatattcgatgaaaacatctttcctattttaaaaaagccattgagggggctggcgagatggctcagtggttaagagcgccgactgctcttctgaaggtcccgagttcaaatcccagcaaccacatggtggctcacaaccatccataacgaaatctgatgccctcttctggagtgtctgaagacagctacagtgtatttacatataataaataaataaatctttaaaaaaaaaaaaaataaaaaataaaaaagccattgaaatgtaagaatgtaaacaaaccaaaacaaaacccaaaacgattaaatgtaaatggagctgagcagtggtggctcacgcctttagtcctgtcactgggaggcagaggtaggcagatctctgtgagttccaggccagccagcctcatctacacagatagttccaggacagccagggctacacagaaaaaccctatctccaaaaataaacaaacaaaaataaaacagtaaatgcgaaaacatgctaatttcttaaagttgaattgatactagttgtactggctagttttgtatcaacttgacacaggctggagttatcacagaaaaaggagcttcagttgatgaaatgcctccatgagatccaactgtaaggcattttctcaattagtgatcaagggggaaaggccccttgtgagtgggaccatgcctgagctggtagtcttgggttctataagagagcaggctaagcaagccaggggaagcaagccagtaatgagcatccctccatggcctctgcatcagctcctgctttctgacctgcttgagtttcagtcttggcttccttggtgatgaacagcagtgtggaagtgtaagctgaataaaccctttcctccccaacttgcttcttggtcatgatgtttgtgcaggaagagaaaccctgactaagacactagtgtacaaacattgttgagtaaattctcaaagaatattctccattcacaaaaacagcatcagatacattgttatcgtaacagtgacagactgcctatagctgtatagcctgggctgcagggggtgggcttcactctcctcctctcatggcagcacctgtaagagaacccagggataaggaagcagaaacaacagactgcaacgctttgcaatcctagtatctctaattgtcaccgctcacaaagctgaaaacagttcccacagaaataaaaactaaacatgacaaggactagagagacagcttagagggtaagtacacttgttcttgcaaagaacgtgggtgtgattcccagcatttgtatggtggctcacgatcatctatagctgcaattccaggagatgcaacagatgtatacatggaacacatgcatatagaagttaggcctaagctgggtggtgatggcacacgcctttaatcccagcactcaggaggcagaggcaggcagatttctgagttcgaggccagcctggtctacagagtgagttccaggacagccagggctatacagagaaaccctgtctcgaaaaaaacaaaaaacaaaacaaaacagaacaacaacaacaaaaaaaagttaggcttagtttttcctcccagccccatgctcccagagataagactcagactcaatatacatttacaaatatcttggccagatagctaggctctgctctgactagatcataactaaagataacccacttatttttaacctacattctacaacatgactggctttcgtactcaggcaaccctatgtccatcttctcacatcttcccagggtaatcttcctgcaactggctctatcccagaattccttctctctccaggatgtcccacctctatttcctgcctaagccataggccataggctttttaattgatgggtgatgcatcaacacacaatacacaagatattctctctacaattcccctttttagtccaataaaaggctgcctttctttcaaatatatattgaatacaactataatgattatgaaacaattatgaaatctataaggcataatatacatttataatgtccaatccatagtatttggcaattaaggaaaaatttctattatttatcctatctgggtttacttacagttctgcatctaaatcaatttctatcctaatttgtattattaacttaaaaatactttcttaaacattttgggggggggggtcgagacagggttcctttgtgtagtcctggctgtcctggaactcactctgtagactagcactggcctcgaactcagaaatctgcctgcctctgcctcccaagtgctgggattaaaggcatgtgccaccactgcccggcttactttcttaaacttaaaacatctttttaaatcctaaacaattcaaacttatagtaagactatgactatctagcagccttcaacctcatcagagccctaagaaggaataaatattatctgcgtatgtaggaagtgctagatcacagcttccaaaaataataaaaacgacagagattgctgactgcctggacagtcctcaatattctctataatgttggagcatctatcttcagccttctggcccagaatatccaacagaccttttgtgaagcaggaattataaaggacttgtttaccgtgtcttggcagagttaggcagttaatttccctgtgtctgtctgtcctgtctggacagcattttgtctgtagatgaagttaagatattttctttgcctcatgactagcttgccataactgaagcaactcaacatggaaattattaacgctcatcatcatctctgaaatggaatggggatactggcaggaacagacctgactcctagttaaaagatcttacaataatcagataattttaaatgtcatattctgtggatctctgaggttactgatgcccagttatctatctatattatatctgaattgtcaaacattgtttattcttagctatatactatctgaataaccttgaaaacattttattgtaactagctaaactagtatctaatatgaccatgagtttgactatgactattaatttgtatttcttaaccattcctaatagttcataatttgcattttatcatctctaacagtttgtagaagcagctttcgaaagtactagaactttatattgcatctttaagaattatataagcacaatacctcaaataaatgttaaaaacatatatacattttcctcttttctgtcctaacatagcatatccttggtctggcagtctaaagtcattaagagtatggattgatttaatccagcagcctccttcttatataggtctgctctattttgacctctctcataggggatttgtaataccattacagccatatgacttataactatcttcattttaataattttaaactaattattattattattattattattattattattattattattattagagtcagggtttctctgcgtagcctgggctgatttggatttgtagattaggatgtcatcaaactcacaaggaacctatctgtccctgccttatctcccaaatactgagatcaaaggccaggatttgtttatttattagctatgtaaccttgaaaataattatatcaattcccatttctttctcccttccttggagattaatatatatgtggataaatacacctatattccccttgttctttatataaatttaagttgatacgtatttttttttaattattaaggatatttttacttattattaagcaaaaacatacatagtatccttaagggaaaaaaatgtgacaattctaattttaaactgtcatttgcaagtggctgtatctatcggcagtgttgtgtagaccaggctggtctagaattccagagatctgcctgtctctgtctcttgtgtctgctgtcctgtagagctcagaagctgtgctgtgcctagccactcccctgtccctttgtttacagcagaggggtttgggccttctgtgcagccaacctagggctgcatttttgcacaccatgaatacttgggagaacctgaagtggcttatcccacagctgaggtctcctggaagtctccatggattctgccagcgttatgggctgcttccagcctgagtgtacacaggagcctcccccttggaggctgctgtgctctgcccttgggagaagcccaacttctgtgttctgcctttaaacttagtaggagcttcttttaaaagccaccttccatactatcactctgtaggttcctgctccttggctaggaaacttcctcccatcttggaatgttctggaaggctttggctttgatctgtttccttccttctttccatccttccctccctcctttttttttttttttttggactgtcctaaatttgtttattggatatgaattttacaaatatcatgtgtattagcggtaacggtggaactggagagtattgcgccttctccaggctgcacggtgggaaccaccaatagtgtggtggaacttgtggccctttccaaggccacggctctttcggccagcagatgtcagcccacgcatctctgtgtttgtggactggtttggtgatccactgggtgtcaggatttcttctgatagctttatggaatggatcaatgaagataacctcaaaaaatttatatgtaatcttcaccaacccagtaggaattcaggactctcaaagccccacaatggcgcccagctctctcctcagcaacagactgaaggcttcgggcaaatttcagctggttaacaccatggtggacaggcttgcggtaagttgcacccttaggaactgggcgtttacgaccaccacagcggacacgaatcctgtaaatgacatagccttgcttagccttgtaccccagtcttcgagctttatcaggccggatggggcggtgagccctgtgcagcgcagagagctggcggtattgccagcagcggaccctcagaagaaagcacatcatgtcggactgcttcttcctccatagctcctggatgtatttgtatgcacccatcttggctcacctgatggctgccgccagaggaaaggtcctccctccttctttttaagagaccagacctcttgtcctgctagcctcactttttccagctttttactctggccttttcaggctgtaaacttgggttctaactgctgtaagttgaacaccattttgtagaacttaggcctggttcttcctcccagctccatgctcccagaaataagactcaagctcaaaaaatatatttacaaatgctaggctctcctctgactagatcataactaaagagaacccgtttatcttaacctacgttctgccatgtgactgactacctgcgctcaggtgatcacgtgtccatttcctccatcttcctgtgcctggctctatctcagaattctttcttctcccagatgccccaccttccatttcctgcctaagccacaggccatcggcttttttttttttttttaagatttatctatttatttattatatgtaagtacactgtagctgtattcagacactccagaagagggagtcagatctcgtgatcggatggttgtgagccaccatgtggttgctgggatttgaactcctgaccttcggaagagcagtcaggtgctcttacccactgagccatctcaccagccccaccatcggctttttaattgacatctgatacattcatatgatacacagatattctctctacatgtgcattcatgcaggtaaaacattcatacatacaaagtaaaataaacaaatctttaaaaatatgcatggcaaagatttagttcaacaaaatagttgccaaggggacaatttagatgtttaaattgactttcctttggagttgttggtcattgaagtcctagatccacaaacactataggccaatgctctaggaaccacaaactacaagctaaaccaatgttctcagtcatcctccagaacttgacagtaagaccttatggctgagataccacatagttgagtcatagaccacagaaagaggctaaggagacagctcagtggttaagaacactctattcttctggtggtcccaagttcaattcccagcacctacacggtgactcacaaccatctctaactccagctccaggggttcagacaaccctctctgacatccacaaggactgcacacatgtggtatgtatacatacgtgcaagcaaacactcatgtacataaaagaaacatatatctttaaaaaaaatacttaaaaggacgtggagaaatcatgcgggtactaccttggaagcttcgtccgtactggatagcttttatagagctggaaagtgctatgcaatgcgatgcgatgcgatgcgatgcgatgcgatgcgatgcgatgcgatgcgatgcgatgcgatgctatgctatgctatggtatgcgatgctatgctatgctatgctatggtatgcgatgctatggtatgcgatgcgatgcgatgcgatgcaatgcgatgcctggtaacagaagaggaaagtagtcatcagccttaccgagctgagaacgaacgctctgagatgtggtaataactgagctggcaagacaatgcccactggtgcaacagacacacaaatgttctgggagtgatcgactattttctgattggattgaagtcctactccatcaattcaaaccccatactggagccaagaacctgtagctagacaggtcatgggcttcagagacatagtatctaactgcctcctacagatgactttcctttggaaagccacccacagattagtagattggtcagctatcatgtgagaagctttttatggcaatcaactaacagccagccactactgaccaatgtgcagagaataagaaattcagaaaggcttaaccctgggtgggatgccttcatcacaacccttccacccaaggaagagggggcaggaggattacaggagccataggtggtggacgaccacacagaaacaatgcattctggacacagcagagcagctgcacataagaatctacagccgttgaggctgtgcacaaaactcgggctcagacaaaattacagcattgaggagaggaggtggcatgtagtccctcccgcccctagctaaaggctactggcgctgatctttgcctggagagagagtcagttttaagggtgtgattcctgtgaacacgcttgacccagggagtggcactatttggaggtgtggccttgttggagtaggtgtgtcactgtgggtgtgggctttaaggccctgatcctagatgcctagaagccagttttctcctagccgccttcaaaataagaggtggaactctcagctcctcctgcaccatgcctgcctggatgctgctatgctcccaccttgatgataatggactgaacctcacaacctgtaagccagccccaattaaatgttgtccatttaagagttgtcttggtggacacgcaaactttatatgccccagtacaggggaacgccagggccaaaaagggggagtgggtgggtaggggagtgggggtgggtgggtatgggggacttttggtatagcattggaaatgtaaatgagctaaatacctaataaaaatggaaaaaaaaaaaagagttgtcttggtcatggtgtctcttcacagcagtaaagtctttgtcttgctgtgccaagacaaagggtgcggcccctggagagtaggccagcttctagtgaatgccatagctctatgagtgtatgggcagcataaagtgtacttgacgaattaaaacaaacatacaaaaactaaaaaataaaaacacagaaggttgagtgggtagaaaagggggtggggtaaatatgacccaaatgcattgtataagactctgcaagaactaaccaaaatgagaaaaggagtttaaaggagttggtatatgaagactacattgtggtcaataagagaaagggtgaatcatgcttaccaataatgtaaaacaggttatcatcccacaagaccacagcccacagcctgtatagttgtatttacacaacaaacgagaagggaacctgtcaaaagtatacaaccaaaggagaggagggcagggggaggtggggaggcacacccttctcttggatggtagttattcttctgttccttgcctggtcacatgaaagtggaccacgggagagtatggtccctataagtttgcatgggggtgaggtagggaatctgatgttttaagaattctaagcactttgagttattacaaaccacacacctgtactgtgatatcttaagtaaaattataggaactatgtctcttagctgaattaggggctgaagaaggcactgaacccaagaattcgaaaagttgtagattcaaaagtgtgtgtgtgtgtgtgtgtgtatgtgtttgtgtgtcctgtattaaattcttgcaggttcatttaaaattaatgtcaggagttccattacaaactgataatatgctgttctaatgttcagtgcatggcacatgaaatgtacaaatgaaaatatatttgaatttattttcattgagcaaaatgtattgacaggaatgtaagcgaaggcatgtgtgcaaatatgcacacactcaaggacccagcaaggtatgtgtgcacaggctcactcagggaccctaggagacacccactctttaccacagttcctactggggtcgtttaaagtgatttgttatggctctttaaatatgaataaggtgtttacagtgatcttcttatatgacacacccccatcttcccataaacgatcataagttttaagcgattctaagacatacctagagccctcctgaaacttatcaactggttttcccacacacttcctgaaccatctcagatgcgagggcttcaaaggctgggaattcctaaatctctctctgtgtgtggtctggggaaaatgtccttgagaaggacctgtgaggctaaggttcggggtacccaggcctgggaatttcaggtgcgaagaatagccgctgggtgtcgctgctgtaaggacaagaaggtgcgaggacctgcatccttgaggatgctcgaaatgtgcgcaagaagtagggtgcccctacagcgtctgtaagaggctgggcctgccatggaagaattctagcccggcggtaagcatttggaaatctcttagacaagctcctttaagcaacctgaaagcatggtttacaaattggcagaaactgaggaacgttcgggaagtcaaatgacttcttttaaaaggagaaacctttcaaaagactctggaaggtggacctaacacctccggtctcccacggtggccagcaaagggtgtgttggggggtaaggggaaggcagtcctttaccttggagttggaagcccatctgccccctgcaactgcaggtcctgagaagagatcacagcatccgatggtctttcctcctcacccctaacgacacaaacttgaagggggaaccgatggagactacaaacaggtttatagcctgccagcagggctcagggctccaaattgcccggcgaggcagtccccggtggttttggcggggcgggtgcgcagggccccgccgcgcactcattagcgcccactctgcttaatggcttcctgtggttgcttgtttacttcttccttgcctgaggctttgttcctggccaccgctcgccttgcccaccacctttctttgcttgtttgcagtcgcagcccgaagcttggtcagcatccccgcccaaggcttcaaccaggttcccttccaggtccaacgcctacctggtaagacagaatcccggtaagacgtgtactcctgagagcaggaacacgctgagcatcc

SEQ ID NO: 197 - DNA, 6569 bp, Mus musculus
ggacaacatttaattgggggctggcttacaggttcaaaggttcagtccattatcatcaaagtgggagcatggcagcatccaggcaggcatggtgcaggaggagctgagagttctacatcttcgtctgactcccacatggttaggaggaggtctcattgcccacctccacagtgacacacttcctccaacaagggcacacctcctaatagttccattctctagaccaagcatatacaaactaccacaaataccttggccatatagttaggctcttctctgactagctggtaactaaaataacccatttattttaatctacattctgccatgtagctagttacctatgctcaggtaccatgtgtccatctccttaaatattctcaggtagatctttttgtgcctgcctctatcccagaattctttttgcctgccgaatgttccaccttctaatgttccctaactaagtcataggccatagactttttaattgacaggtgatgtttccatacaatatacaagatataatctctacagttgccctttttgttccaatgaaaggctctttttctttcaatttgaatacaatttgaatgcaattataacagttatgaaaaaattgtgaagactagtccatttaaatttggcagcttagataaagtattatctattctatcttggtaagtttacagttctatatctaaataattttctatcctaacttgtattaccaccttaaaaaagatctttacagatctagaacatcttaaattctaaacaacttaagcttatagtaagactctatctagtcttcaaccctatcagagacccaagataggttaaatatgacctgaatttgcaggaagtgcaagcagcagcttccaagactaagaactgacagcttcctgcacagctacccagaattgactttaaaacgtaggagcatccatcttcagccttatactcagtatatctgacagacttttttgtgaagcaggaattatgaaggacttgcttagcctgtattggcagagcttggtggttgacttcactgtatctgtttgtcctttctgtacagacttgtctgtagttgaagcataggcattttctttgcccagtgattagcttgccacagttgaagctatttcatatggaggttattggtgctcatcatctttgaagtggcatagggaacagacctgtctcatagtcaaaagttcttttaaaaatgaaacagttgggctggtgtgatggctcagtgggtaagagtacccgactgctcttccaaaggtccagtgttcaagtcccagcaaccacatggtggctcacatccatccgtaacgagatctgacgccctcttctggagtgtctgaagacagctacagtgtacttacatataataaataaataaatctttaaaaaaaaaaagaaacagttttaaatgccatattctgtggatctctgaggtttttgaagaccaactatctatagtatatctgaactgtcaaacattgtttactcttagctatttactatttgaataactttgaaaccatcttattgtaaataactaaactagcatctaatatgaccatgagtttgactgactaataatctaataatatctaataatttgtaacttgcatttttgcatttttatcttccctaacagttttcaatagcagcttttaaaaggactagaactttatattgcatctctaaaaattttataagtacaatatctcaaataaacattaataacatatatatatatatatatatattatgtgtatcaaaaataaccttaaatttgtatcaatatacaataacctatgccaatgtatcaaaaataaccttgtttttgtatcaatatacaaaaatctgtaccaatttaacaaaatataacctcaattgtgtatcaaatataaaaatctttaccaatgtaagatcatggttataaaatgtttttctagtttaagaatagattcaataatctaccctcatttgtctaatttttaaataatattttataatatttctatatcccccatttttgtttttaaccctcttccccttatctaagaaagatagaaaataggaaagagatgagagaagaaatccctgaaactaatgtccctattttgtctcctccctgtccatgctttgctttcctggaacttgctctgtagtctgatggctatgcaggcctagacagtacagctgagctgtctgtggtggataggatgcaagtgagcaggctctgtaggagtgggctcagaagaaatggtcctgctacgtgtctgctgtgaggtggagtgggtacagggggattaccctctctgcctcgtccctcaccacttgtagtagttgggagagctgcccccatcccttgccagctgacccacttgggagagtgggctctgaatcttgcctgtgcgatatagtgttgctggccctgatggtgaaggcatgggtgagtcagcaccattgtgtgagaataggagaactggtccaacccctcattaggtgcagctcttgggagagtggcaaggaccagcctcagcttggagaggggtccctgaggaagaggtgtttgggagcagtggaagaaagggctggaagtcagtgatggggtacaagctgccagctctgtgttctgctggagacagctttcttttttcttttgtttttttgagaaatgagtgtggaagagctaaccttgccttctgctgatggtggcacgggtggcctagctgaaacagtgctggagagcttgccctggtggtgtggataagggctctctggtggggtgatcagctctgttgcagttccagatccagggctttgagttggcccacccccaaatctacaccatctgtgaattgttggggcacatgaaaggtccagtcttttggatctaaaactgcaggatttccatgacataggacaacaatagaatagtcaggaagagaaagcagtattgtcagtgtcacagaagccagaaacctcaaactagaccaacgactcactgcagtgaacatttacaagtgaagatgtgtggacagaaggatgtactgtgggacacactgtgacacactacagcttccacgatgagctgttttctatgctttgtgttatttattttgctgtgtgttttctcttttggctggaggttccaagggtggagggtagatttgaggggacggggtccatgatgtgaaatgataaatcagtaaaatgttttaaaaaccccaaatttatttggagacagagtctcactatggagtcctggctagtctggaacgctatatgtagaccaggctgcccccaaacttaagagcgctgtttgtctctgtttcctaagtctaggattgaagatgtgaatctttacacagataatttttttaaaaaaaaaaaaacaaaaagatttgtttaaatatgtctgtatgagtgcctggatttagacatgttagtaccatggcagaagtatggaagccagatgataagttttggagttagttctccacttctgtcagacttgagtggcaagtagttttgccagaggaaccattgttccagaggaactacagctccttgtgcagttcaaagagagaatttgtgcttgtgaagtcaggctgttatattatagccaacttgccactgagaggtgcctactggtcttataaacttgatatcacctagagtcacttgagaagggccctcaaggggagactgtttagattcggttagcctagaggcagggctgtgacggtttttctcagtctggttaactgtggtagaaagacctactctgaatacaggtggcgccatttcatggatggtcctcaactgaataaaaagaacatagtgagctgaacacaaccacgcaggaactgattgaaggaactgactgaaggaagcttagggcagagaaaacaaacaaagtaggcaatctgtaagcagtggtagattctgggaagagggggccggagatcagcaagacagagaaggcccgcggcattacggttaggctgcagacgctggcaagcaacttctcggatcctgggatgttgtgtgacagacatttgctggggagacacaacacatatatttcctaccctccaaagggagcccacgacagagtcatgggtacacttgtttccaacttggtgaaccaatgaggttttagtgaggtcacttacaggagtgtgagtcagcggttagtgacgaggagcaggggtaactcaaaacgcaaggttagaaagcctagtccaatgtgggtgacgattcagaaaatctacaaccccggcgctttctaccgagctcatacgcaactctatcattgactatcttttctcatcctatcttcccgcagtgtgggtagcagccctcaggtgtcttccaatttcctgttttcagataactgttcacctcctgaggctcaaaggtctcacactttgtgtgagtctttcaacttggagggaatgtttcaattctgaagaacctgtcacatgaccggggctttacagagagaatgagattgtctgtaatgtcagggtaagcaagcatgggtacgatttcgattttgaccaatattagaaaaaaaaaaaggcaatcagaaggaaagaaaagttatgcttttttaaaattaagaaacaggcagaaagcagagagaattagtgaaaatctttaagtaactctattacggggggggggggggaggactttgggtatgtaaatacagtatctcattagggggagaataagcagaaattattccttccaactcctcagcaggcctgcctaggcaaactagcagctctcctggtcagatgattgacactctaaagggtgggatcaatagtaaaaaaaaaaaaaaaagctgtaaatttagtcagattgtgcctcccttcacctaaggccagaggtaggatttagatttattcttttgagccttcgtttgattacttttgttgtcactgtaaatcaaaccctggttgaaagctccttcgggaggaaaggatttctttggccttttggtccatcaagaaaggaagcaagggcaggagcctgaaggcaggaactctggagaaactcaggctgacatccctggcttgctcagctagcttccctatacagccttgccagttgattttggtgttcaacctcctggttgcaagtccctagaaaacctctatcttcaaaaattaaaaaatttttacattacaattcataacagtagcaaaattaagttatgaagtggcaacaaaaataattttatggctggggccccatatcatgaggagctgtattaaaagggtctcggcattaggaaggttgagaaccactaacccatcggatcaggaatggcttggctctctgccattgattagtgtcatagtttggggttccattgctgtgaagtcacaccatgaccaggacaacatttaattgtagctgacttacaggttcagatgttcagtccattatcataaaggcatgaaacatggcagtatccaggcaaacatggtgctggagaaagctgagagttctatgtcttgatccaactgcggctaggaggagactgtctctgccagacttgatcatgtgcgagcgtgcgtgcgtgcgcgcacgcgtgcacacacacacacacacacacacacacgcacgcacacacacagagacctcaaagcccaccccacagtgacacacttcctctaacaaggctacacctcctccaataaggccatacttaacagtgccccttcccatgggcaaagcacagtcaaaccaccacaattagcaatcaagaaaatgcccaatagacagggccacaggtcaattaggtcctcaatcgaggtttcctcttctcaggcatgtcaagttgatgactgaagggattataaggaagaaccagcttgctcctagtggcccacaaccaagcttatagctacagcttttcatatggtgttttaaatctcaagaatgggcgaagccgggtgtggtggcgcaagcctttgatcccagcactcgggaggcagaggcaggtggatttctgagttcgaggccagcctggtctacaaagtgagttccaggacagccaggactatacagagaaaccttgtctcgaaaaaccaaaaaaaaaaaaaaaaaaaaaaaaaaaaaaaaggtgaaaaccagcaataaacaaaacaaacaaacaccacatcaaaaccatctgctccagaaatgatagtcttaaggcttctggaactaatttttgatgttttatgggtcgtcggaagcacgtcccctacacttcgccaaaaaaagaaaactcatttataataacctagactctggttttccggactttttgatgcaggtaaagggaggattctcaaatgacccagatccagcagagacatcaaatttgagctatgattaacggaaaagcactttttcacctgtgaaatacccttctgaatgtagcaggtcagtccacaggtggaaagaagcttggattccttctactttgggggtttctccggtttagatggaaaaaaagagacaccagtcattagagtactcac

SEQ ID NO: 198 - DNA, 10657 bp, Mus musculus
gtaacttccttttttttttaaagatttatttatttatatgtaagtacactgtagctgtcttcagacactccagaagagagagtcagatctcgttacagatggttgtgaaccaccatgtggttgctgggatttgaactcaggacctttggaagagcagtcgggtgctcttacccactgagccatctcaccagcccaaaataatttttttaaacctcaaaaaaattgttaacatatttaatgtaattgttaacatatatgtacataaatacatatataatgtatatgtataatttaaatattttatgtatttatttttgatattttacacataccttttttggttggtttgtttgtttgcttgttgtttgagacaggttttctctgtgtagccttagtggttcttgaacttgctctgtagacatatctggcctctgcctcctgggattaaagttgtatgtaccatcactgcctggcctataatattttatatatatattttcactaattactttatttattcactttacatcccaatatctgcccctctctccttccagttcccctccttccctccttcccatctttgagaagagggaggtcccctcacccctaggtatcaccggcatcaccccactctggcacatcttttatatatacatttaatcattcttttttaatgatatgcttatgtgtgcgtctgcctgtgggtatctgaggtgagctcagcgctgcgggaagacagaagtgggtgttgcatctcttgaagctggaggaacgggtggttgtgaatcacccagtatgggtgttgggaacagatctcaggttttctgctggatcctcaagtgtccttaaccactcactgaaccatctctccaatttcccttcccatcaactttgctgcagcggagggatgggtgtgggaggggggttgggggggtgtgggggcgaatctttggaccccacaggaaatgctgcttcctggagaatagcttaccgtaaggtatgtggatcctggcaggtctttgagcccatacacggatcctttcttctgtagggctgtgcagccgccctcagtagcacttcctggtcattacggagctgcagtcattacggatgactgctcctacaggaactcggggatcattaccttcaggccctacggagggcatctgtcacacgagggtctcccgaatgcattggtttgtcactgttcaaattgtctctttctctctctagtgtccctcttcaacgaatccaccttggacacagaatcttaaacccactgaatggatgggaacagctggcagagctttctaggacctccacctctggtggcaacccctcctttgtgcctctctccaagttcatgaacgtgagtctcggtgcccccattttcacccttgcggcagaataaccggctcttcgtttaccctgtgttctcttgtgccaccagacccagtattttggaactattggtttgggaacgcctcctcagaatttcaccgttgtctttgacacgggttcttccaacttgtgggttccgtccacgagatgtcatttcttcagtttggcatgctgtgagtttccctgaggaagaaggccaaagggtcgggatgggagaagacgagggacttgacttcatgctccctaggctgtcctcataggtgctgagtctcccatgccctgactgacacccatctcatctcttgaattagggtttcaccatcgctttaatcccaaggcctccagctccttcaggcccaatgggaccaagtttgccattcagtatgggaccgggcggctgagcggaatcctgagccaggacaatctgactgtgggtgacttcaccagctcaagactctaccgccatctggttcagggaggggcttgaggaggcaggccctgataggagacagggaggagatgcttgagaggaggtggatggggggtggggtgggggtgggagtgaggagtcatggtggtgggagtcccctggcaagggatggagcttcttagaaagaggtagggtttgctgggaaaagaggtaacatttctagcagagagacggggtctccttagcaagaggatggggcttcttgtgaaaggtcggggcctcttgagaaagagggtgggacttctaaaaaaaaaaaaaagataagaggcttcctttgcggctgataagcattgcctcctcagaagtggggcttcctggatgatggggtggaacctcccgagcaaatgtgtgtggttttttaggaagaaacgggatgtagaccatttagactcctttcccaatggtcccaagcaggacctcagccataagaagagtaatgtgtttctagaactaactgttcccacatcaatttacccctagatcggggggatccacgatgcttttgtgacatttggagaggctctgtgggagcccagcctgatctttgctttagcccactttgatgggatcctgggcctcggcttccccactctggctgtgggcggagttcagcctccgctggatgcgatggtggagcaagggctgctggagaaacccgtcttctccttttacctcaacaggtattgtgtgggaattacttccatacctgggagtgcaaatatggctaaaatcccttaaggggcatctaccgtcctcctaaggtgtcccaatacctaggcacccttctaccacagtttactctggggaaccaatcagtttactatgcttccttccagagaataggtgaggctttgctcacaatggtgtgtgtgctcctccacctcaaaagctgtccctgaaaagccttcacccagagagatgagggattccctgtagctccaggaatggagcttccctcagtcttccctggcctgcacactctagcacctctcccaggtcactagcagttgaagcagcgttgcctaggtgggagcagctgtgtactcaggtgaggatcccatgcccgccacccagccctccatgaggggggctaagcagtcatcaaggccagctgggaggaacttttgcaacagagcacagctaaactcccgagatgttggttgttcggcttggcacacaatcacaacaatacccccaagcaatctccctcaggaagtttccatttatcaacacaggaagtccggtggtccttgaaggaagtcagcctcccaacacaagagcttctacctgcattcaggaaagtgtttacccaatatagaaaaatgaaaagagaaaaaaaaaaaaaaaccctcacaacctaagtggcaactcaggacataccaccaatgctcaccgtaggttcacaatgccccagattttgaaatcaaacaggaaattccatgcccatttgacaagtactgcacttaaggaccccttcttcaccccaaagagagcttgcacttcactggagagcccagcctagagctagggtcagccattactcaccagcttttagtaggcacagccttatactcaaaaggcccttctcagatcacacatggctggcagcacagcacttggcaggtggaagcaggatcaggagttcaaggtcatctttgtcttgcttccagtccccatatctaggacctgcttgtactcccctacctgcctttcttagttagggttactattgtcatcataaaacgctgagaccaaaaacaaactggagaagaaagggtttgtttggcttatgcttgtgtcttcatgcacaccagaagagggcatcggatcccattacagatggttgtgagccaccatgtggctgctgggaattgaactcaggacctctggtagagcagtcagtgctcttaacattgagccatctctccagccctggcttatgcttttaaatcactggtcattagtgaaggaagtaaggagaggaactcaaacagcactgtcttagttaaggcagtgtcttagttaagggttctattgctatgaagcaacaccataaccaagacaactcttatttatttttgtttttcaagacagggtttctctgtgtagccctggccgttctggaactcactctgtagaccaggctggccttgaattcagaaatctgcctgcctctgcctcccaagtgtgggattaaaggcattcgccatcactgcccaactccaagacaactcttttttttttaaagatttatttattcttatttatatgagtacactgtagctgtcttcagacacaccagaagagggcatcagatcccattacagatggttgtgagccaccatgtggttgctgggaattgaactcaggacctctggaagagcagttagtaatcttaaccatagagtcatctctccagcctgacaactctttaattaaggaaaatacttgaatagagctggcttacagttccagaggttagtccatcattgtcatggcaggaagcatggctgcctgcagacagacatggtgctggagaaggagctgagcgttctacatcttgatccgaagccagcaggaaatgacagtgagccactggacttggctcgagtgtcagagacacccccctagtgacacacttcctccaacaaggccacacctcatagtagtaccactccctatggggacattttctttcaaaccaccacaggcatgaacccagaggcagaaacagaggtcatggagcggtgctgttgactggctttctctcatgacttgctcagcctactttcttatagaacccagaaccacctgcccaggggaggccccacccccaataggatggccctcccacatcaatcactaattaagaaaatgccctacaggcttactaatagcttgatcttattgagttattttgtcagttgaggtaccctaatcttcagtgactctagctggtattgttccaattttagtatatgtgctgccgaagtgagcactactctagctggtatcaagttgacataaaactagccagcacacccatctagaagccaactggaggaagtcccatcccagaccacctcggaaaccagcagatgaaacaccagcctcctaactacactttgcttctgcagggattctgaagggtctgatgggggagagctggtcctagggggctcagaccccgctcactacgtacctcccctcaccttcataccagtcaccatccctgcctactggcaggtccacatggagaggtgaggagccgggctggcttcatggggtttgagctgagggtctggacacccaggccctgcctctgatgacagctcctgccctatccttccctcacagtgtgaaggtcggcacagggctgagcctctgtgcccagggctgcagtgccatcctagacacaggcacatccctcatcacaggacctagtgaggagatccgggccttgaataaagccattgggggatatcccttcctgaatgggcaggtgaggactactcctggtgctgaatgggtatgctggaggatcttgggaatttggtgatagactggtgggaagctgctgcctaagggacagaagcaggtaactaggaagttaagaaagaggacaggtgggtctggaggtctgagtgatagggcagaaggcagtaggaggaagccaacatgctttccaggtgggtaggggagaaacatggagaactggacttagtagcagaagcctacaggagactttgaatacctgactgcccaatataagctgtactccagggcgctaggaagccacttgaggagagcgagagccacctgcctacctttactgctcctcttcttccacagtacttcattcagtgttccaagacgccaacgcttccccctgtctccttccaccttggtggagtctggtttaacctcacaggccaggactatgtcatcaaggtaaggtggtggccagagtgacttcagagtaacaacaactgagcttgagagggtgaagctggggctctgacgcaccagacccaggtatccaacgcaggaactctgctcttagacagactttcactgtggagctctggcaggcctagaattgttaatatagaccaggttggcctcacactcagagatcctcctgcctctgcttctcaagggctgggatcaaaggtgtgccagcactcagcctggaccttgtttttccttttctattcttcctttcaaaaaaaaattttttttaatttattttgcgtgtgagcctgccttctatacacgtgtatagaagtcagaagacaattaaaggaatcaacttttttcttactacgagcagctctgaggattgaactcagatcggcagacttagcagcaagcacctttaccggctgagccatttcataacttctctttcacttcacttcacttcacttcacttcatttcatttcatttcatttcatttcatttcatttcatttcatttcatttcatttcttccttccttttaaatggagtttacgtgtatagccttggctggtcttgaactccccaccctcctgcctttgtctctggagcactggcatcacaggctgatggcatcctgaccagctagaaatattccttgtcctcttctgggtgtagatgggacaatcaaacccggagccccgtgatacacagtatcctgtgttgtcatcttgcagattcttcagagcgatgttggcctctgcctgttgggcttccaagccttggatatccccaagcctgcgggacccctctggatccttggggacgtctttttggggccctatgtggctgtctttgaccgtggggacaaaaacgtcggcccgcgcgtgggactggcgcgtgctcagtctcgttcaacagaccgggcagaaagaaggactacgcaggcgcagttcttcaaaagacgccctggttagggtacaagctcaccgggccacagcagctatgcttctttccaattaaacaaattaaaaaaaaaaatcaactttccatggaaggatataccatttgggtaactttcggggagggaaaatgaatgtttgacctctggatttaaggaagaaaggagagggaagagggcatcccattttgcagggtgcgagagagggaacaacaatccccatgaagcctctggccccccactgcctgtaatcaaagatccgcacaccgcggagcatcacggattttgtagttctctccctgttagcgtcccgctggaggcggccacagccacaacaagcgtgggaggcgaccggtcgcgatgacagcgacaggtggcagtggggattacatcggtaaagggttttccagtccttgttctaaggaaagaagtcaccatcctacggaccttgtgtgtcctaccctctccctggggattccaaggcccttgggtcggacataaaggcggagcttgaagaccctgggttgtggggagcaagggctgtccctcctccggtggtgatgtcacagcctccatccgcaagtctctcgctgcccagaggtgtcggggcacgttcactctatcccccggccactcttcccccgccgccagatcccttcagtccccttctcgcctaaatttggggtgagtacgggaagggggcagaggctcaagctctgggagcgggaagacaaactgcatctaggcttgtgagacagggaacaggggaccaaagattgcagcagaaggatccccctggattttgagctttggggagggacaaggtacttgtgtgtgttggggggagtctttttgtttgttttggtttttatttttgaagacatagtttctctgtcctggaactcactctatagaccagactggcctcgaactcagagagctacgtctgtctctgcctcctgagagcaggattaaaggcgctcaccatcacagtctggctagggtgtgggggtgggatgtcttatgctgtgagtttccacagtctccaatttactgagacttttccctggatttggcactgatggaatgcgggtagggagcagaacacaaaggaatctttgaagtccaagaggggaagactggtccctagtgacatggtcttgggaataggggagaagacagtccgaggggtgacagaaggtatctggggaaaggatgtggatggatgagttaaaccaagactgagaaaagagtctcaagaaagagccggatatttttcctatgtcccctcactcagccttgattctgttcccctcgggataccctgtaactagcttcgtgcagcctctggtgaagggaggtgattctctaatgaccaaaccctctccctacaccctggcgaggtcttggagtgatgaaacccaagtttcccaagccttcatgagtttcaaactgttgcctgcctctaacctcacaagtcttctctgtttcctctcaccatcctccacctccctcccaacttctgaccaatttatttggtaattggatcctgttcatggcctctgctaaaagcagcaagtcggggtggaggtgaggtgcgaaaggactgtgacctaggtcctcgtgctagtccattcctcagcctctaaagcatcgccatccccgccctatccctgcaagcctatccctaattgacctgggatccacacccactctcgcacagcaggtccctctgtgatacgccagcattaggagtacaaagtgggcagtgagcgcctcttttctattttctgccctggcgcctccatcagagtattgaagtctccagaggagggggctccagggtctggaggagggtgaggatgcactcccgggtctgcaggacaggccccatttctgcaactctcctggagcgacagactcaactactgccaggacgggggttagactgaggtagagaacccagaaacagaggaactaaaaatctggacctggagacagagaccaaggcaagactagggccaagagacccagagacagagaggaaccaagatccagggagagaggaagacagagaccctgagagaaacaaaagcccagggaggggtggggataggaagctggggaagagactcagaaagggagagacagagtctgagagagagagagagagagagagagagagagagagagagatccagatggggaagataagtgaccgagagagagaacctgatacctagaggagggggacaaagacccaaaggagaaaggagagatccacatatagagacatggagaaacagatttagaaaagagaaaccggatacgtagagtggtggggacaggtaggaggacagagacagcggagaaaggtgacaaacacacattagcgggaacgggtctggagacgggaatacgaacccgcgtaaagcctgcagaggaaggcgaggagccagcgaccgccgcagcccgtgacccgccctcttcgttcccgcaggcgcctcctcccgctgcagcccccgccgcagccactgcactcgcgcactgccggccctgcgcctaagaccgcccagagggcggggcctacccgctcggaggtgtgaggtctttcctctggcttctcacttttccctccataaccccgccccttcccaatggtcccgtctgacctcgtggctgagaggctgttgtccgtgctcccggtggcgctctttcctgcatgcctggtccccactcctttacccatctcttggcccttctgtctgcactctttgttgtctacgcttcatcccctttcttccaccagctggcaacttttgccccttccctaagacgtagtggaccatcctccggggtctctaccaatgaatctctctattccagcccacccccagccccgtgcccagcaatgagtgtccttcccctaacaggcatctcatttccagaactccatcccaccagcctggaggcttctggctctctaaatgctcatttttagcgccccactttgccatccacttactagtcgcatcttcctctggactattgaaggtgtttcatataagatatagaccctgtccatctgcctgtgtctcccattcgtccggatcctcttcgcccaggtctaaccccgtctaacgaagtccaaatttgcaacatccagttggacatggtggtgctcatctgtcatctcagctacttgggatgctaatgttgaagcaggaggacagcgaacctaagacctccctcaactccacaacttgcagcctccgcccctccccagctttcatccagaggctcccaggcctcgccttccttcctttaccatagcgtcccagtatcttccgcttcgactgtctcctgtgagtttttttatttaatcaagttccaactccacctctagttcccttgtaccgccctcaccccagttgagaccctcccccctcattgtcgcggcccaataaggattgttaataatctcttgggctcgctgcatccaattactcctactttcccgttcatttgccttttcagtgcaggtcccgcctgcccgggctctaggcaatttgttttctttttgtcagcttctcttgttgtgacttctttccccccacccaccaccccccaacccgttcctcacccctacccccaccagaattgataggcctttttttttcgaggcagagtctcatgcagcccaggctggcctctatctcactttgtagcatgaccttgaacgcctgatcccccttccttcacggtacctggctctttcccatacctggctctgaggtctccattttcgctgtgctgctgagttaggcatttttagggtcccc

SEQ ID NO: 199 - DNA, 9025 bp, Mus musculus
attcaccaccaggtagacagcctccatgatagggctgcgaagttcaggacaaaaggaaggctggctcctcagggaaggcggtgtcaaggttgccactattgtggcgagatcggagtgaatttggaagggatgcgaacgtctaaccaaggaagaagcaagggctacagaagtgggcttcagggaagacttttacagaagggaacggcgtcccggcttggaaggcggaatgttcgggagcgaagaggtgaaacatctctaaagtgacagcgagcctggaccggaggaagcacctcagcgttaggagcctggagcggtaaacacgacagggccacgggtcagaccgggaggagacccgcaaggatgggacggagtcgggaagggccgggtcggggccgggtgggggcggcgcaggctgggcgcgggctcgcggtccagccacgcaagtgcccctgtccccgcccggcccctgtcctcccgctcgcggcgagtggcacccaaagggagagcgggacggaaagtcagcctcggcaaatcccgagcgcggcctcgactccactgggcgccgccatcttgtttgcgaagggacgtggcaagcagggggcgggactatagcctgtggccaatcagtgaggggcaatgggcagaaatgtcgacaaaccattggtggttttgaatggcgcccaaagacagtttccaatgagaggggtggaaatgtgtttataaagcgccccctcctctttgaagtggtgataggtccgttagcatgtcggtataattttccctccctgtcccgctccgccccttaaagagccagagccacactttaatgaggctgcctttaagtgttgtggccccaactccacctgctcccgatcctgcgtgcattcttggagctctgggctaggctctgagatagtacctcctccgcgtacgctgggacccccgcctcatctcattcattcattcattcattatttatttatttatttatttatttatttttgggttttcgagacagggtttctctgtgtagccctagctggcctggaactcactctgtagaccaggctggcctcgaactcagaaatccgcctgcctctgcctcccaaaggcatgcaccaccatgtccggctcatcatttattttttatcatttattaagcacttaacatgccttggaaatacaaccctttttaagattatcgtcttatctcaagctattcacaaagtgaaaaagattgttaaaggagatctgttgtcattgagaaaaggagccacagaatgaaggagctctgctttctaccttgacccctatcaacatgtaggccatctgtaacccatacatcaagagctccagtgttttctacttacccggaggtctctcgggtgactatcatacttgttagccttaattgtcaacttggcacagcctggaatcatgtgagagaaacctcaatttaagggattgcccaggtgggtttggtctgtaaatttgtctgtgaaggattcttttgttaattgacagaggaggacccagccaactctgggtagcaacattacctaggcagaggggtcctggactgtgtaagaagaaagcttgtggagagtgacccaggaactgtaccagctagctagctagcctcagcctccatggttggcaaaggtaatgtgtaactccaggcgcctgccatgactttctgccccagcctccctcagacatgtactgtgacctgaaggtaagatagacaaaccttttcctccccgcagttgctcttggtcaaagtgttttatcacagcaacagaaagtaaacaggacacttatccttcccctggtcacctctgtttgtttttttaatttcccacttgtttggaattcagattctctgttgccaactctgaacagtgagtaagcccttcatttccttcaagcatcgcccatgaaagacgcgagtgcttgcctcgaattgaatgaagtacaccctcagcactacacatcgaggcttcgtaggggcacttgggaggcagaggcaggcggatttctgagttcaaggccagcttggactaaaaagtgagttccaggacagccaggactatacagagaaaccctgtctccggggtgtggggtaagtgtgtgtgggggtgggggtggggaataagtaaataaataaagcccagccagttagcagtataccttagtcagtacctaggaggtagaggcaggcagagctggtcaagttccaggaccagcactacatagagactctgtctcaaaaaaaaaaaaagaaagaaagaaagaaaagaaccagagaaatggctgagcaggttgtcaggtcccaaatagcagagctgttgacactatcttagacagattctggctaggtaagcagaagggttgttaccaggtaaacaagcctaaagattacggtttattagaaaagcagatctcttaaagcagtttctgttcaccaggaagttctcttaaccttcccccaaaggtcaaaccctctgccaagggcacctagttccatttcaatcttgacagcttgtatcagctcagacccccacatccacctcaccgtcacataaaatctgcttttcagccacgtcacccctctccctgcttgtccctccagcccccaaacacaccaagagatggtcttcacagtctgattccaaataaatctttctttctgcccacggagcaatctagttcagtagtttctctgtgccatggcttatacgggtaaaaagtctggtggcctgcacccaattcccagcagacgggagagaaccgcttccacagatacatgcaagtgcgcacgcgtgtgctaacctgagtgcacacacgttagagacccaggagggtggcaggtgtcttctatcacttcccaccttattttgactctgttctctggccagtgggttcctgatgctggagagtcaaactcctgtcttcttactgcacacacaggaagtgcctagaccatctctgaaggcctcacgtgtgggtttggtttggttttgttttttttgtttttttttttttttgtgaacctgtgtcttcagcctgcagctagtcaggtgtggatcctgaagcaatttaaatttccttcaccaagtttgtagagctgggactgccagcattacccacagctggaacccagttccctacacccacaatcacacctgcattggttacaattaaacagctagccaggatctgcaacatggctcgcctgtaaaaggggcctgctgctgcctaacctaatgaccttaatcccagggacccacatagctttctatgggagcatgggagcacacacaccccccatagataaataactgtaacttagaaaccagtgacaaaccaaagcagccagttttccacagtcggaagaggggctgaagagatgactcagcagttaagagcactggctactgttccagagaggtcctgagttcaattcccagcaactacatggtggctcacaacacatctataatgtggtctgatgccctcttctggcatgcaagtgtatatgcagatagagctctcattcacgttagatacctggatggatggatggatggatggatagatagatagatagatagatagatagatagatagatagataaaaaatttaagccgagcgtggtggcacacgcctttaatcccagcacttgggaggcagagacaggcggatttctgagttcgaggccagcctggcctacaaaatgagttccaggacagccaagactatacagagaaaccctgtctcgaaaaaccaaaaaaaaaaaaaaaaaaaaaaaaaatttaaagaagcagggagagaccttgggtgccaaaggcagtccctgtctatctgggacagaccgttttgcctgatacgaggtatactaaaccaaagtcattttaatgagccacagccctcgaccggagtcccaggtgtgggtaaggtgggaaatcctagctcagcaaacttggtggaggaagtttaaattacttgccagctcagaagaaaacctgatacctagcagttccttgcaggactgagaaggtaaagagctctgggagaagggaagccctccaggcctgcaatagaagccagggcatctgcactgcaggcaggcaggcagggcctttcttctgcttggtaagagaaaggccagctggacatgcgcagggctttcttagaggttccagggtgtgtgtgggctaagggactcagaccaggacagagtctccaattcaagaggctgttctgtgaacgccttcatctcccagacaaacattcagtaagataaaagtgttttagtgccgggcgtggtggcgcatgcctttaatcccagcactcgggaggcagaggcaggcagatttctgagtttgaggccagcctggtctacaaagtgagctccaggacagccagggctacacagagaaaccctgtctcgaaaaaccaaaaaaaaagaaaaaaagtgttttagctgaaggttttctttttaatttatttaatttaatttttttaattatgcaaattaaagctagggtctaacccagtggtagagcatttgcctggcatgggcaaagccttaggtttcatccctagcagtgtgtgtgcatgggcatgtgtgtgtgtgtgcacacatgcatgagaaagagagagagagagaattgtgtatgtgaaagtctgtgtgtgaaagtatatatgagtgcatatacaaagaaattatttacagggtcaaaatcaaagtcaaagttattttaggatggggatagggtagctcaatgatggagctcttgcctgccgtgtaaaacgccctgcattcaatctccagcactgggtaggggaaactatatgcaaaggtagattctaagccaagcatgttggctcacacctacagtcccagttcaggaaactgaggcagaaagatcaacgtggatttgaggctagcctggtgtctcaaatacagagaaagataaaggaagagaggtgtcattgctcttcgctcctgccctctccccacaggtgtcccttctggtagcatgcatgctttagaagtcacatacattctaagctctctctataaaagaatccatggaggatcgagtgaggccacctgcttcttcacaggtgctctcagcccagtgaggagctgccatgagcaagggccgccctgctaagctgaagacacagatgcacaagaagttatgggagacgtgtatccatggagaagtgccggcttccagccctttgcggcttttgcagtggatgaccgtgtggagatgctaagcggtggacagcggcagaacactaggaaacagaaggcttgggacaaagttaatagcgcctgttcacaaagttcacaaaggacccgttttcactgtgtcctacaattgggtcatgtagggctggccaggtggctcagcttttaagaacacagttgctcttccagaaggcctgcttctattcttcctagcacccacatgggtgctcacaaccactagggtcactctgcttccaagggtttaatgttctcttctgggctctgaggaccgagcaaagaggtggtgcctggatatacatacaggcaaaacattcataaaataatcagctgaaagttgttttaaaatcagtttatgtgcattttcatatacaatttttttaaagatgtatttacttctatttatgtgattgggtccttagcctgaatgtacgtatgggcatcatgtgtatgcctgcacccagggaagccagaagaggcaggacaggagttacacagatgttagtaagccacagctgccacatgtgtgctgggaacccgggtcttttgtaagagcagcaagtgcttttgaccacagaaccatctctccagaccgctgaaattttttgataaataaacttttgtgatactaaaacaaaaaatagcctggcagtggtggcacacagccttaaacctagctttcaggaggcagatctctgaggtcaaggtcagcttggtcaacagagtaagttccaggatagccaggactacacagaaaaaccatgactcaaaaaaaaaaaaaaaaaaaaagatacctgttaatccctctatcaattgggcaaaaccgtcattaactctagcattcattttggaagttaagtatctggcttaaataagtatccttctaactggaaccttgaggtcctactaccacttttcaaatgtttttcatctttatgcgaatgggttttccctgccacatgcatgcaggtggccagaagagggcgccagatcccacaggattggagttacagatggctgtgagctgctcaacgggtgcagggaattgaacttggatcctctggaaaagcagctcttaactgctgagcagtctcgtcagctcctctgctacctctttatcttctggcaaacagaggaagctgggagtggtggtgcacacttctaatctaagtgcatgggaagtagaggcagaggagaaccaggacaattaaggagaatcaaggacatcctggggtacaaaaaaaaaaatccaaagcaagctgggtagtgatggtgcatgcctgtaatcctagcacttgggaggcagaggcaggtagatctctgagtttgagaccggctccctctccggagtgaattctaggacagtcaggactacacagagaaaccttatctcaaaaacagaacaaaacaaaaacaaagcaaaagcaaaacaaatattttaaaatggggattacctttgaactcaaggcaatcctcctcccgaagcctcccaatttatgcatgtttgtttaagaagatggttttttattccagtctgggtctagcagaaaatataaactctccatctcaaaaccctcattttcaaaagggcaagaaggaatttttacagcatgctgggggaaagccctgatcaacagacttgtccctggggaatggtacatgtcccctctttaaaagataggcctaattttgcaaatggaaaagactccttgatggagtggggtcatctatgggtgaaaagcatggattgtgacagatgcgaggaagggaggctaggaggtgacagctttgtttacagtgtgcatcatgtcccgaggaagccttctggtcaagcacttggctggctttgtaccccctggccggttgagtgtagttgagcactgcataagctcatttttttttcccttcttgacagcacatcagaacccatgtccttgaaacatgaagtcattgaagtacacaaaagccacagtctgtggttgtgcagggaagagaggcacttggatgctcctgccttctagcttgcggttccagaaggaccacacgtcattgcctgccaccacagatgccaatacgcccagattggaaatgactctaagctatgactttccacagagccagcagtctgagaagaaagaattcacatcccatcgagcaggccagatgtatcagcacatgttttttaacccagcacttgggagaccgaggcaggtctctgtgagtttgaggccaggctattctacatagcaagttccagaacagccacggctcaatagtgagacctccaggtcaggtgccagccttgtctctgaggggggaagggttggcacactcttcctcatcctctcccaatgggaggatgcagctgggtttgcatacacccaagggtctggggtacatcccctactgctcctccttcacctggtctaggggttaacaggcaaatcattggtggtattcctgttgagctatttgcaaactgcacctgcaaatgccattctatagtaggaagtataaatgcctcctcaaagaatatgagagtccctatctgtccctcttgtctcctatcagaggcactcacactggagcctgagttgggaattttgatgcctgcctgggttctacgtatgcacaaaaatatgaagtggaaacttgagggttctttggaaagtccgttggatgatgttttcctgggacaaacatgtgaaggagtgctttcctgaagtggacacaggttgaaaggctaaggctgactcgtgaaggaacgtttcactgaagcagacaagtgaaaggatgttctgctaaggcaagcacgtgaaagaacacatgatgaaggattctttgctcacaacacacatgtgttggtctgccttacattgcataatggagttccatttgtcaagactccttagagagaaacacaccaaaaactttctagcgatgggctgcttgggcttgcgttgattgacagagtgatgtcagctgagacagatgcatgtgctgaggcaagacacacatgtggaggcaagactggaggacacatgatgtttggagggaatgcaaaaggactctatggatagtgacagggtggggtggggtggagtggggtggggctgagttaggcttgcttatagagcaagctcggcaatgcttgttagtctcgtgtcttcactgatctttgcttcactgagagaggcacagctgagaacttctcctgacgttcctgctggcccttgaggcctggctgtctgggctaggtagtgactccactgccgattcgtgtttactatcccggctctgttgaactggactgctggtgtatctgtggagtatttgccagtgacacaagttgccgctactaacctgtgaactgaactgccgatttccagacacagatgagagttgctccaaagaacctttctagacaggtccactttcttcctccacacctcatatcctttcttttccactacctctggtgggtggtgggctacaagggaggttaaagtgttttaaaagcatcattaaaaataaagtttggggggctggagagatggctcagcaggtaagagcacccgactgctcttctgaaggtccagagttcaaatcccagcaaccacatggtggttcacaaccatccgtaacaagatctgactccctcttctggagtgtctgaagacagctacagtgtacttacatataataaataataaatccttaaaaaaataaataaagtttgg

SEQ ID NO: 200 - DNA, 3046 bp, Mus musculus
atctaacatccctgagggctggatggggctgaagatggcggagcactagcaggcctgagccattaaaagaagctgaagtgttttaagtgctttggggcatttagaatctgatgtgtcactgagacatccagcggagcactccccataggtaagagtctgtctgaggcagggccagaaaaaatggataggaaggaaaaaaggagcagagtgtttctgcaattcccactcactggtgacctactgtgtgcccaggctcaggcaatgtctgtgtatagctgaatgtgctctgtggcaccgagtccccaggaggcagaaagcatcaacccattcgatggaggaagaaactgagtctccgagattaaactaactcctcaaacttacatagctagaaacagcagaggcaatggcatgcacagggccctggggtggaataataggaccatataaactgggcctgggcctagtccgtgtaatggcagcactcagcaggtggaggcaagagggtcagaagttcaggggcagccttgactccatagtaagtcctgagtcatcttgagatacatgagactacatctaaaacaaacaaacaaacaaacaaacaaaaatctcctctcttatggggttctttagctagatgtgggagtgtgcatctttaaagccaatacttgggggctggtgagatggctcagtgggtaagagcacccgactgctcttccgaaggtccagagttcaaatcccagcaaccacatggtggctcacaaccatccgtaaggagatctgactccctcttctggagtgtctgaagacagctacagcgtacttacatataataaataaataaatctttaaaaaaaaaaagccaatacttggaaggcagaaatatgacgatctagaattcaaggccagtcctggcaatatagcaaattcaaaaccaaccagcctgggctataggagatccaaaggaacatgctcaggacttgaactcagttccatctggaaggtaccacatccctaatcctgtctgcatatggtagtcaaggaaaagactggaatagaaaacgtataccttaaagagggaaagtgggaggtgatgggggagatgagctcagagaagggccagatcagaggtctctgggcccctgagggatctggggtgtggcaggagagccggacattagggaacaaccctctttagcacagcagcagccttcatcagggacctgtgctgtgggaaactaggaagtagaggctgttggctgggaaaggacctgaaggaaggaagtgccctgtgactacgtgggctctggagagcaggacagatggtctggactggtttggaaaagactggcgtggatgtgcgcaggcaggagtaggaggtaatgcgctcgaatattcttgttttgcacaggtggacaggaacagcttcatctttggaaagcgtccatcctatctcctctaccccaacacgcaggcctctaactacgctgtcctcaggcctcagccccggtctccactgtccccagcccacggctcccctgaggttatccaggaccggcccctcccactcctgtctgcagtctcactctccctggcccagaccagtgaggcaggagggaggagtttccaggcaggaaagagctgagtcactcggtggcacatctggtctcagatcttgatacccagctggaaggggcaggaaggaagaggccacctcccccacaaactctcctgactgaatcctagggttttgccaactgtgtggggcaggctgggagatgctgctggcgtggtagcaacaaccttggccaggctgcctcgcccacttgcctgggtcctttgctgctgtgattgccgttaatgttcgttcgggaaaagcctgggaacacttgggtggattgtctccatggtgcaggtgacagagtggcttgctcaagagcacagcattttggagagccagcctgtgagtgtgccctctcccacgtggctataaaagaggaagtagtatttagggtaactcagagacagtgggcatcgtctgaagggctcaagacagatggatggaaatgtagatgaggaccatggattccatctcaacactgcagggaccagaaggcttttctctgtgtgcagggagacatgaaacccaagcccctggccagtgggttacccctctattcctctgactctcctgatttttggctttctctctctctctctctctctctctctctctctctctctctctctctctctctctctttctctctctcacacacacaggttgattatttgacatcatttttgtcctccctctatccccccatgctgagaagagccttggcagaggtttcccaccatcctgtcctctgaaggaggcacggggacatagtgttctcattgtcctgcatggaaagatgtgtccaggtcctggagacaggaaggcatcacaccagggtctctgactcctctctaggctgcacaacagccttctctaggggcctcagctgtgcttggacataacatccagccagacagtggccatgtcactgcccttctcccagtaaagctgtcccacacacatacatcagtctctgcagatctctcttcttccctaggaccaacccatccagaacattaactttggactgatctaattgtatataaagtagtcacaaatgtaccctcgctgtgtgaccttcagacatattctgagacttgcctgagtcatgattttctcttttcctttttcattttttttttgttttgttttgttatttcacagatatttgaaaagtgaaaaagaacattcgaaccctcgactcacatgattctgtagcattttctgagtcaagagagaactgagggctggagagatggctcagtggttaagagcactgactgcttttccagaggtcctgagttcaattcccagcaaccacatggtggctcacaaccatctgtaatgggatctgatgccctcttctggtgtgtctgaagacagcgacagtgtactcatataaataaaataaataaatataaataaaaa

SEQ ID NO: 201 - DNA, 54089 bp, Mus musculus
gtagagtcttctttccccaaagcttcctcccctcccccactgctttcagagtagattaactaattacttccaattaaagccggtagatctctgtacctcctgggcttcaacactgcccctaggagtctccctaggctgcctgggtctgaaagggacctggccacttagggggatcagtgaatcagttaagtaatgcagggggccacaaaggaagcccactgggtcatgtgcttgacggggagggctgcagacaagcctggccctctggctgcagcatggaagtgtggccctgcttcaggccctaatgggcccgggaaggtcaggagctgccgtctttggaggtaagtcagccgggtgaaggtcctgtgcagatgcccagggctagagaagcaaccaccagaggataatccagaagccaccagtccttggggacactcgtagcctccctcacccaggatgtccctcctctgccttccaagtgctccacccttcactggtctcagcactagcccagcccagtccatcccaggccccaccctgaccccacgtgtgggacgtgaggggaaggatacctggcatcagaggtagggcgatgggttgtgacctaagtctcacctctggacaagctggcctgtcttggtcaggcaagctcatgccaagatgtgactcagggccagggcctaattctatcttgagttctgctgtagcagggatctgggcttggatctctgtgtgtatgtttctggcttgaggtgccctctctctctcagctcttaggttctagggttctggctatagctgcaccttctagcacgttgccctggtaggaggtggcaggaaaggctttctggcaggaataagagtttcaggggcagagggcaactgagctattcagggcaggaagtgccacttctggggtgttaaaagtctgtttgccagcttgcttaacccctaggtccatataaagcgggtcacaacttcctcacatctagggttgcttctttatgtatgctcaggtcagtgacagggcagcttaacgtttttacttgtttctctgtcccttgtcccccttctcagaccttcccaaagatctgtaggactctgttctttcctgcatttctttctggccagcagagggcgctgcccaaggactgaggccaccagggaggtgggtagagaatccttccttgtgtagggctagtaagtccggtctccctggcctgtcctccccacccccccagctgccccccaggaagtttgcctttctttttgatgatttagacttaacctgtcagagggttcgaagttagacaacaggatgaacccaggtggctttgggcaggaaaaagagcttgagggacagagatgcctctcccaacatcttaaatggggaaggcgcactggagatggccggctttccttccctgaccttggaagaagggttgggaggggctgcatagactagctggtgtcccaccctgtgggagggactgctgtggacatctgggctacatctgggatcctggcaagacagctcatgggttataggattcagcccctggtggtctctcattaggctcccggggaaccctttataaacaggtacacacctgctacaatgacctgtagttgtaacaccaccaaattcgggccgactcagttatcctgggcagcagcaggctccactagatctttctgtctctggttggggcaggggtgggggtgggagctgatactggccttatgtcctggggtccattctgccctccaggtgggtaggagggaggattgagtgtggcctcagcacctttcagaaactctgcctcatggtaggccgagtggggaaggggttacagttgggtcgattcacacaaaagctcgacaatgtggttgggacagaaagcgagggaggggacagcaggggctattctttcctgcgtctaagggtctggggtctgcgtggggaacaacacagagggggttaaaataaaaccaaacaaaaaacccccaaccaacctctgcatccgctccctgccaggaatcccgggaagggagcaggaggatggccaaaatggccttgcagaaaggagttggagggggagggggagacgggccgagagcggagcccacccggactgtccccctggtcggcccactcggggggcccggcccctcttcccagccccttccccgccggcgcggcgcggcgcggcccctcccccaggccgagcgccgcctccccctcccctcctccccctcccatcccgcgctgcagctgctgccgacggcccattctgcacgtagcgaatggaggagcagcacaagggaggcctcgagtgcgcgcgcgcgggagcccggggccgcgcgggcgggggagcggagaagtgagcgcgtgcgcggcgtcgcgccgcgtcccggagcgcgcgcgcgccaagttccggagcgcgcggtttgtccgcgcgcggctgcggggctggtgatgctcagcggtagccaccagtccctctctcccagggtccctccgcatacgcactccttttccaatcagcgcaacctctacccaggccccttaaacgcccccaccccaatagcactgttcctggcgcatagtaggctcttcttgtagtaggggtgttgcgatgcatcgattgattagcccaatggggtcactgccctgtaataaaccaggaactgggcggggagctgaaagaagaatgaaaccgatggtccttagccatgagagataaccatgtttcctctaggagcctgcacctaaggcaggccccatgaaacgccctgtaagggcctggagaggcaaaaaccacttgagggtttttacctctctttcctctggataggacctcccaggggaacgccttctctagtcacttccctttctttgtcacctgcacagttcctaccccactgggtgtccaggatctggcgtggctctgcccacacttctggcaagggcgtgttagggtgaacatacagtctgttctgggagggttcagaggctataacatacagtactccaggggcaccctccccacttccctaatccttgatctcagaggttgacaggtaaatactgtagagattgttccttccctacgtggcccaggttggcagtgtgcttcccggcgtttgctggggcttccctaagtgtgggcacttagcaaggcatgtgtaggggcttgcaaaaggatgaatacgggctgcctttggcccccttgaaggtggtagcaggggcgacttcgaaaggatgctaatcagctaatcagtagcgtattgggatgaaggtggctgagggctccttatcctatacttgattgtgcataagttgtttggcctctctgagcctgcttcagagatcatcagtaagaggtaaatctcttctctttccactattttgattggctcagggacggggaacttttccctcagcgcttatttccctggacagaagtgaattcaaaacaccagcgctgacaacaccttggaatctagaggtgggttttcaggaaagctagagactagctacttgtctcgtttacgtcatcagccaagaatgaaccattccatactagtttccagacattaatatctgaaaccttaaaaaagagagttactacatacttcccggctctcttaatcagaggcttcggaacatgtgagtccatgattcctggctgtggtcatatttcctggtggtaacaagtgaaagacaaacctttacaccaaacacccatttcatggtttcagccttttttcctttggggtcaggattggttttttttctttggaatcagggtctcaggctggcctgcaactgtgtagtccaggctagcctccagctagtggtcttccttcctctgccttccaggtgttgcttttaattccctctgtcctcctgtctatgtttaaaaactcacctgttgattgccacggctattgccctgttagatgctagttctacagccttcgttttggggcctccagcagacaccccccccccccaacccatcccatccttctcagcttgtttcaatttgtctgtgggctgagaaaccagaaaaatcacatctgttaggagatgtggaaaacaagatctgttgaatttgacaaactctattaaagtttgtctggagaaataaacttgcagaaagtccaaaggagcgttgtgagcaagcaggacacgaggatgttctccaaagcccaaataataaaagagccgggcactaacataagcacaggcaggcagatcaaagggacagagtcagcccagacatacacccacacgcagcttcaaatgtaatatatgagaggccgacgttttgcatcacaggagaaagggatgaatgatcaatcaaatcgattaagtggccagctgtttatgaaacatactaaaccgagttccccaaatatgaaataaactccagatggaggaagggtatcaaacacagaaaggaaaaccatagaattactagaagaaaatattagccaagaaaaggattctttgggaatatgacgaaaaaaaccaggagagtcaccaaggagggggtttaaaacaaaacaaaaaaccctctaaaaacccagctagctttaaatgtaatagtccacacacctctctaccaaccttccctctaccttgagatagggtttctagcctgggctaacctggaactcactatggaatttgaccttgagcatctgattctcttgcttccacctcccgaatactttgagttgatggtgtgcgtcaccacaccagtttctgaggtgctagggactaacccagagctgcacgaatgctaggtggacaccccgtgtcctgagcttcaccttcagcccaagagcgtgaaatctaaaagggaggatctgataaccaaggagctgaaaactatctccaacgtggacgaagagcgagttcttctcagtcaacaaagaggagacaaaaccagcctgagctgtcgacagagaaggagttacaaatgatgacggagcagaaaatgcttgcctcagtcctaattccacccaccccccgcccatcaaacctaggcgatggcaagatgctcttctctctgattggctatgatgaaaaaggccagtggctcaccgcgtggacgcaagcatcctcagaggtacgaaggctatcgtgactcgaaggattgtaacagacatgagaaataattcataagcagctcaaaggaacggagttgtgggtgagacgacaggcacagtggtgtatgaggcaggaggatttcgagtttgaggaggactgtgtcaaactaaaacatacaatgtcgccaaaacccccaaagtgtcagttgcattcctagtaggtatatatatgtgtgtgtgtgtgtgtatatgtatacatgtatatatatacatatatacatgtatacatatatatgtatatgtgtgtgtgtgggtggtttgtcataattccttattctttttaaaggtttatttatttgatatgagtatactgctgccgtcttcagacacaccagaagaaggcatcggatcccattacagatggttgtgagccaccatgtggttgctgggaattgagctcaggacctctggaagaacagtcagttctcttaacctgctgagccacccctctagctctgaggtttgtcataactctacttctaatcttgaaagcctgcgtttgaaaagcagagtcaaatgcatcaggaggggcctgcttaactatgtgatgggcagttcacctccatgagcagctttgtgggccgttctcatgaaagacacgtggcagggattgacagaggacctatttaacacaatgttgggccaccctagactactggatcaggaaccccaggtctgagacctaatatcttgtgttgtatgtaacatgtttcatatgtaatgtaatgcatgttcaagaagtactggtgggaaacatgaactagaaatagatacaaatcttctgccttgacatttctaagattcactagaaatgggctttctatgagcagagcaacggggcaaagagggacagattgtttgagtctcactggctctgattggctcatagaacttggcttgcctctgcctcctgagtgctgggattaaaagcatgtgtcgatgcccctggctcacccagttcttggaaaaaaatgactcagaagttaaggttacctttccaaaggacctgagttcgattcccagcatggatatggtggtttacaacctaccataactccagttccaggggcatctgatgccttcttctggcctccacaggcagcaggcatgcacgtggtgcagacacactagcagataaaatatcctccacatatataaataacaacaacaacaacaacaacaacacaggggatggagagactgctaagtagttaccagcactgttgctcttccaaaggacccaggttcaaatcccagcactcacatagcagctcataactgtctgtaattccagttccaggggatctggcatcctcacacagacaaacagacatgaaggcagaacatgtaaaaatacatttaaaaacatttttattctgtgtgtgtgtgtgtgtgtgtgtgtgtgtgtgtgtgtgtgtgtgtgacatgagccatagcacgcgtttggaggacagcttgctggaacggattcttttgcttctaccatgtgggtcccagggatgactctcagactgtcgtccttggtggcaagtgcctttacctactaagcccttttggttctaggaatatatcacttttgttttctaaaacaatacttaatgagatgaatcctttggagttgggtgtaccgctcaggggcagagagcttctatgtaggccaaggccttggattaaataaacagtgtctcagacggagcaagagaatggtgaatgtgctacactgtgctattcatttacctactggtggacatttgaaagaatgagcatgcttgtaatgtttagccctactaatccacgagtctgtgtatgtgagttatcatttatttagaccagtgagtcagagttacctggaaagtttgctaaaatgcaggcccctcccgggctgattcagcgggtttatttggtgccttaaaatctgctttttttttgtccaagacaaggtctctctctctctctctctctctctctctctctctctctctctctctctttctctctctctttctctctctctcccagcaggctggcctcaaactcacagagatcctcctgcctctgcctcccaagtgctgcattaaaggtgtttgttacttctaatcactagctccaagactgggatcactgcggggctttcttcagtctttgaaaaaaaaattttttttgtttgtttgtttgataatttcatacatttatttagatattgaattttagtgttttctaccttctccatcccactttcatgtctgtctgcctgtatctgtctctctggaacccttctcacctcaagtctcttgcatactttaatgcccttttttcttcttttcaaaaaagatttatttacttgtgtgggtgtatgtgcatgtgtgtgtgtgtgtgtgtgtgtgtgtgtgtgtatgtgcaccacatatgtgctgatgcccctagaggccaaaagaagtggccatcaggtccctgggagctgaagttacaagcagctgagtgctagaacccgaatctaggccctctgcaagggcagtgagtgctcttagcccagagccatctctgtagcctcatctgccttttgtgtgtggcccactgagttagggtttcttgccagagagtgggtggggagacttttttttttttttacaggagtgaggggaacttatgggtggttagcaatggagtagaattcagtcttaaaagaagagacaggctaaattctggctcaggttaaaacctagatgaatctcaaggacattaaaagaagtgaaattatccattcacaaaaagatggcttttataattctgtcggaaagaaggacctagagttgtcaagcacacagacccggaaagtttctggcggctgctggagggagttagatttagtggggagagtttcggttttgcaagacagagtctggagagggatagtggcgagggttgtgcaagaggggtgtgtgtgtgtgtgtgtgtgtgtgctttgtgtcactgagccgtgcactcaaaactggttaaaatgggaaacttcacgttctgtgaacaccattaaaagttaagaagacaagccatcccaacccaaagatatgtgaaatagagctagccactggcgtcaggtcctgggtgcaagcctccctctcgatcccagagtgtaaacttgacacccctgcttgctgataactcttgcactttcctctgtgtgtgcaagccttgacatctgataagagaggctaagcgatgagaagcgggaagcagaccttagcagctggatgcctggagggatggcacagagtgacagtagggaccgagggagcagtttggggatttcctggaagacaaaggcatgctgagttacaggaaagctggcttatcacccagccctttcaggtctcctgagagggccagaggtttatgaggagggtgtagggaatggcccagacaactcccgtgtgtaggcagaggggctgagtgagatttgtcggacaaggcatatactttttggggatgagcttgggctggagtgaggactctattggaaagagagatgattgcagggttggggggagagaggagggaaccggacatgaggggaacctggccacagagaacaggcaagagactaagcttgcaagtttctgcctgccctctgctagcagctgggggtggtggtgctcctgtttgaagctgggggcttccctatgtggcttactctggtctgagccaccttagatcccccccgtctaggcacgtggactctgggactgccagaagtcgtgtgtgtgtgtgtgtgtgtgtgtgtgtgtgtgtgtgtatgtgtgtgtgtgtgtgtgtatgcagagggtgtcaagaaggagcccagaggtacatgcttggagcctgcagaatcccaaccctaggctctcagcttttctggcttccattcaatccactccctagcaagctcttctgggaaaactggagaccatccctgacccctggtcacagggagctcatggtctggccaggagaaaggccactctgactcaggcagtgtgggtgtcaaccacccacctggctgggtgactggggggcaggatctgtccagattctgcagaagccacgggccatagtctgaaaagtggggctatctcagtgtacctcaggatggacagttatcagtggtagctggtgaggcacttggtatcctgtagttggggctgtcaatgagacagagagggcccggaagtcttttcttctagtgctagcagtgaggatcaatggttagatcacttgcctggtatgagtgaaaccctgtgtttcatctcataaaccaaccattaaaaaaataagtcctgggcctggtgagatggctcagcggttaagaagcgccgactgctcttcctaaggtcctgagttcaaatcccagcaaccacatggtggctcacaaccatctgtaatgaaatctgatgccctcttctggtgtgtctgaagacagctacagtgtacttacatataataaataaataaataaataaatatttaaaaaaaagaaaagtcctgctgggcggtggtggcacatgccttttatcccagcacttgggaggcagaggcaagtggatttcttagttcaaggccagcctggtctacaaagtgagttccaggacagtcagggctatacagagaaatcctgtctcaaaaacaaacaaacaaacaaacaaacgtcctttcaggctggagctatggctcagcagtcaagagcactgactgctcttccagaggacctgggttcaattcccagcacccacatggcagcctacaactgtctgtaaccctagtcccaggggacccgatatccttacacagacatacatgtaggcaaaacaccaatgcacataaaataaaaataaattaattaaaataaataaaactgtggccaccccagtttcagcatcgataggtctctgtgtttctactccttgaaagggagataggaggtgagacgccagagagagctcggggagagggattcccaaggcctgcttgttttactctgagggagaccttcctttcccagtgtcacagtgttgggatctccctcctcttgctcctggagctgagaacaaggacgtatgaacagacccacttctgtgcaaagctggactcacggacatcagagctggactcacggacatcagaccctgccttgcctgacatcttcaggccacagacaaggatgttcaggctgtctgcccatcgtcatgctcaaacggccctggcgacccgtccctccagctgaggacacagggcctgagatgattgagatgatgctacaaaatggccgtctcacagctggacctatcccgtggctcttccttgccttggctgccggtgatttagcatgagagtctgtctggggctaggtcgtgagaggggaaccaccaagagatgtaacacaaatgctagaagtggctactcactgagggtgaccatccttcctcaggagggtggctttggaaaggagactcctccaaccataacaagcctaaaaacctgcaatgatgttgcagatgataaaggatgcatgtgtttcagactccagggagattgaattctgacccagatggatggagagatacggaatctatcttaatgaagttcacagtgggagaggggagattcccccaccccaaaccccgagtgttgggagacccaggcctagaaagacacagcccaatcttcagtctgagggaaggcctgttcccatcttaaggaagccccgccttgagggagatgcaagcccatctttagagagcccagtctgaaggagacagagtcatagctccatctttagaggaccccactctgagggagacacacagtcatacccctgtctccatggtgataaaaagtgccaagtgttctccacttcctcctttctaggtattttcctcttcttttctggaagtttccatccctcaaaaggaattagtagggacttgggcagttccagtcccctgccttctgccctctgactccaagctggctcactgaacctgcagagagagactaggaagctgaaatgtgagcttgcagacaggaggactgagacacagtgagtcaggatgagtggaccatggcactatcagaagggacaggagcgcctggtggagaaagatctctgcttctgctaacttaacatcctggtgccctctcccatgtgtcttggagctctgggcatacatgtgggagagcttacggcagcccaaatgagcactcatgttctgcctcttagttgacatgtgatgctgggtgaatcatggaccaggatgagaatgtcaggagatcagatgcagtccagctgtttggggcaatgaacctgaccacccctgggctcctgtggtggccttcttccttctccctatccccccagaaacactcccaggaaagatccccttcccaggatccaaccatgggttggttgttttgtttaccatgtacggacttttcttcccctcccatgacacaggtagagacaagggtgtagggtggccctgaggagcttgaataaggtccacactcacacctctgctgtgtctgagtgctcactggtacaaacactccagacagggggcttcctgatgatagaggccatgtctgagggcaggaactaagagtcatgcattatttctgtggctgcctgaagaagaaacagtttcctctcatctggcaggagctcactgggtgcacactggcctgtctccaccagcagactggaggatctaatagagaccaggatggtagcaatgcccaaatgcataagcgcttcctccgacctagactcctgatgctggggcttccctgagcgcacgagagctgtgatttcttttcttttcaacaaagctaaattagacatagcttcccggcagggtggaagtttcctgaagacagacctctcttctctccttgcttagaaaggaatgcctcctgggccaggctgcattccctgaggaaattctgtgtctgcccagcatcccaggaccctctatgaggaccagctgcgtctcatctcgcaggctatttccgctataatcttggagacggagttggccccaggacccttgcttgtcttctttgccacttctgcagtgcttagggcaactgcagggaaggcggcagtctgggcacggctcatgactctgcccctcagcctctcttgtcctgtgtgcctctcagtcgggacccacggcacggtggggaatccccttggttccttccttctctgacgtccatgtctggctcccatgtcctcctgcccacccacgcacactgtggctctaatacgtaggcagagtttggtctctggggaggtgtgtcacagatgtggtgtcgtctcctcacaaggctggaatgtagaggggaaagtgatctccctcggacaagtgaagtcatatagctcgcaggggcagacgggtctgggctggaggtttgcatcaccttgcttgcatctgactatgcactgtcccgtgggtcagactctccagccccctctcctgtctggcctcacttcaggtgcttcagtttcctggggagaagccagtgagaactcaaagcccctggaaggctacctgttagaagcatgagctgggtgtgcctcaggggctgcctagagaggggtggggtggggtacatcggtgtcttgaagctaaacttgtatgccaggatggagctattttgtgggtttggacttagggatgggggcagacagtgggcttctgtgggccaggcaaagggcagtctaatcaaccaacaggaggatgtggtaagttctactacggaagggaggtgttggcactcaggaagcatgcgtgtgtgctcaagaatatgggcacatgtgcttgtgcacccacacatacatacacagacacacactcacacaaacacacatgcacagacacacacaaacacacacacacagacacgcacatatagacatatacattaacagatacataggcacataggcatagagacacacatacatagatactcagacacacacatggacacacagacacatacacacacatacacagacacacacacagatatacacacagaaacacacagacacacaaagacacacacacacagacacacatagacagatacacagagacacagagacagacacacagagacacagagatacacacacacacacacacacacacacatacacacacacacatttccatctatgtcacagtacccactccataggtgatgagaccctgggtcagagaggccctttattttccagagcaccttgtatctagttttcagcctgttctgtcagatctccaagctaccacacccatgaggtaggagctcttaccagctgtgtggttgagattttcaatatctctgtgcttcggtttctccagataataaagggcaatacctatgaggccttgttatgaggactgatggggatttgtgaactggtggcctagagtgctcacaggaaaatgtgggcctccatgtcttcttgcccatcctaccttctccatctaaagggaaaagaatgatcaagagttgggacctggccaaacgggctaaggtttcctggggaggacaggaatgtatttcccactggtccaactcctcctgggcccctggttacctccccacagcctggatatgggctcctgacacgtactgggtgataagggccactcagcaggcaggacgtgggctacgtgagggaccagtggaggcggctgtctgccgagcccaaggggccaaggccaggaggctgggccatggggtccattgtctgctcaccaccccctctggcgatcacaggctcaggagcaggcagcaccaggcccttggcagaagcccggtcttgttccccccacgcaggcacgtcctggcccgcacgtcactgggcctccagccatgttggtgctggccgttgctctgccactggcctctagggggcgctgcttgggcacctaggaaattccttgcatggtgagttagccactgggactacatcttgaggatactggggggtagctgattgacatagtgcaaaccggaagagggcagagcaaggatgcctttactaggatgccagggcaaggactgaccctgggatggcgctttggatgctggttcgctgaaatgtcagattccaggtgtataggtagacagaggcaagggggtaagagctggccctctcaggtctcagtctccctgggtatgaatacaggaactggagagagtcctctctaggtgaatgttcatcctgtctgggctctgtcccacctgaaagtagtgggcaagattggacatgttacaaagctgtgccttcctctctccttctccatcaatgttaggtcatctttagggtctctgtggtcccatgcccttggaagtccttgagggatgcttggcagctagcttactttcttcagagcccccaaacccaggcctcctagggccagggctgtgcctctgatcaacaggttaaaaataacccccatgggcttttctccctccacaggaatggtgtttgtgttggcatccatgggccctgtagccctgccaactctcacagcatgtgacactgtcaggagactggaggtgtgaggcagaagtcagctggagaggctcctgcggccggccggccgcctgcttccaggtgaggggacagagaagaaagaggtcagagatgctggcagagccacctgtcatcccaaagctgcccacgaggctgggagcacatgctgggcaaaaacaaagttcctttcacaatgaggagggcataaactgggtcgtacctaggtgtgggccaggctcccctgggtcagccaggacactcccagccctcatcccagaactgcactcagagattcacaggactgcagaacagggaattctacacttgaagtcagagcatctttttcaaacctctgcccaggcaggaaaaaaatgtcaagctccattagagaatatttgtagtttgacctggatgccaggctcaaagctggcatacacaattagtcttcctacatctgtccactgagcccggtctctctctctctctctctctctctccctctctctctctctctctctctctctctctctctctctctctctctctctcgtctttctctctgtctctgtctctttctttctctttaacagaagaaaggtaaaaagaagttaggtgatttgtcgtaagtggctcttaaactccacatcaagacacccctgccctcccaccctccaccccccatcccccatgtgtttgacctcacagccagaagccggctggtcgcaggtctatagcaaagtggcctcaggcttggaccattgaggctgctccttcacccctggactttgacccacatcttgttacatctacatctttcttcacagcaagtaccctttcctgggaagtcggaattctcccccaggaaccagagatctcctgattatattgacgttaatgaaagactacttctcttttccaccagagatgtgacgtccccattgccccgccctcatccttactcactgtcatggcggtcacactcagactttaacatgaggaatgtatggaggagtgattctatctgtttcaatgacgtgcccaacgtggcttcaatgttgcccgagccttctcttcctcaggcaacaggagctcagccccttttcttcctgggcttgtgtttgtcctccgtggtgcctgtgctatcctgcctggcctctgcaagctcctttgggcaaatggggacatggttgggggatataagagctgacagcacccctccacaagggttgctaagcaatgggtttgcagtttgttgccatcccagcaggtccccccactcccctaccctacatcccaaggatgctgatatgggtttaagatgtcttttgggtctccaggggctagggctggtgttccagatagggagtcctatttcctcttctacacgcacatcccaggcctctctgctcctcaccctccactggtgtaataatgtggcatgcacagaagaggcgttccttgccagagtctccacatcagccaggtgaggaagggtctgctctttccaggtaagggtcccagacctagaggggagctctacctgggggtccaccggaggaaaggctgtatcatttaatgtttggtttacataagatgcatgttctcactcatgtgcttgaaccctggaggtaagcactcctggggtaatgcaatggttaagcgctgggaggatcccagtcttgtctcttattgatctactagctttccacttccaaggtcatcacagttcccagatggcttctggcactctagccagcatgaaggacaaagacatcctgaaataggagctctcccttctctttataggaacttcctggaagttgtatttacttctttgtaggagaaacagcaggcctcactgacaaggtggtggctgcttctgcataaagtcaggtgctgcgcagcctcccaggtaacttcagcatgagggccaaactgaagtctgcctgagagcctagagagtggtgacacagacaatgacagccaatggggaactgccacttggaggactcacttgcttggtaccaatgggatgatggtggagggtctaaagggcgctccctgggaattaataaaggtgcttgatactgcgatctcacctgctccccactcccagagtctgatccaagctgcctcatccccaacccccaagggcaagtatggttgggcagtccagggtgcaaagcaacatttcttatatcccattgattagaattcagtcatccagccaaacctagctgcaagggaagctgggaggatgtagttttgatcttatgtgcatctggctaaaaaaaaaaaaaaaaaaaaaaaagatgaggttcctcatctttcttcttcctcttcctcttctttcttcttctctttatgtatataagtacattgtacctgtttttggatacaccagaagaggacatcctatcccactacagatagtttagagtcaccatggttgctgggaattgaactcaggacctctggaagaacagacagtgctcttaatcactgaaccatctttccagcccatccatcttcctgtttttaacaacattgatttttctcccttctccaaggtcttggttttcctgatacttagtgtttactgccagaattgtgaatggcagccatgtaaagataggtacgtctacccttatctcatggtagactgataaataataaataattattaattaactgacctttttacagttgggccagttgaactccagagaggttgggtaattttccttagagcacacagctgggctgggagcccagtacctgtcctccccttttactggtgcccactgtaggggtggatgtgctggaccctcattgggttggacaggaagaactggaatggcctgagccctaggagggggtgtgtctggaagccgagggcaggcaggggtgtggccttaggcacaggtgtcttctcagcacttactcagtgcatggtcagcgacacgtctgaacagggcactgacgggtttggggatttctgctggcgccagatgctggccactgtagccacatcctcagacgccacatttccccagatgaatgtccgagacctagtggtgagggaaggcagatatacgggacagcttggctcactttccctgtctccctccaagccaccctggtgatactcactgccccctctgagtgtgtgtgtccatgtgtatgtgtccatgtgtgtgtctgtgtgtccatgtatgtgtctgtgtccgtgtccgtgtccgtgtgtgtgtgtgtgtgtgtgtgtgtgagagagagagagagagagagagagagagagagagagagagagagagagagaacgctctttgtcttcgcttcatgaatgtgcaagcagggcatcaagtccctgctaggctgcttggtggggaagtggagagactgcaaacggttgagagaaaaagtctagacgctaggcctgaggaagcccatctgggctatgcctctacctccgggtaggactgtccttgctgacccccgatataaggtcattgccctggcctggtgtggagaaactctgcgcgtaagtgtggttactgcagcttacattactgtggttagtgatgtgggtctctggccaaagaggaagagctcaggagctgtgtgagtcacagctggcggactacagcggggtgtgttggggacagtcctgagacgcagatgtgacctctgccctcgggaggtctggccagatgtagacaatgaacagaaagcactgtttgaggctggaggccctcccctcctcgagaaaagaccttcctggttaactgtgatgaaatttctctgggattgatctgcagttctggcaagatgggcagatccggccaggtctgggcaaggagcacctgcgaatgctgtaccagggacgggacatggcagaacgctacgctgctgttagagtctttacccactcagcaagtgtgccaggtgctcagggaagactggcatcaagcaatttgcacaaataaaaaccattacaaactgtaatgtgctgggaaggagaaccccaagtgggttctgggaaactcaccaggaacttggattacctgaggttggaccttatattgaagctgacctcctgcctagctgggctctctctctttctctctctctctctctctctctctctctctctctctctctctcacacacacacacaaacacacatgaacacacacatacacacaaatactcacacactcaccctcacagatacacacacccacacacacttactcatacatgtacacacacacattcgcacactcactcactcacacatgtacacactcacacacacatactcactcactctcacacatacttaaatacactcacacccacttactcatacatgtacacacactcacacccactcacatactcatacacacatacactcacacacacacatatactcacacacactcacacatacatataaacactctcacacacactcacgcgtgctcacacacactctcacacacatacacactcacacatgtacacacacacaactgtcaggtaaagtcaaacatttaagtgacaactgtgataccatctgtttggtccgttcagaagcttcctacttgcatgggccatgggctgtatctgtatggccaaggccctgccctaggcctggcataaggaggtacctgggatttgggaggactcagaatgccaccaggactcttctgtccaccccaaaattaatgttaggacgctggagatgaggcacagggggttatggaccgtccaggaaggctccagggatgagtagggatgggcctggaagggcttgaacttagacgagggctcagcatgatggtagtggtccaactatgggataatgaggaggaggctggagatacagagggcagggcagatttggggtagcaagcagccctgtgctgcatatgcttgaggctggccttcaggccagcactgtttgtaccctggatgggcatgcagggtaatggtgggtttctgtcccacccttagtcacatcatatgaccctctggggaggggtctgggctgatccagagctgagagcttcctccccaccagcccttccccggccctggctctgcatcactaggaatagtcacagatcacccgagggtacttagcagagctgatctccctcagccttgggtctctgtctggaaactgacgtccctacctcctgttgctggacccatctccaagctctagtgcctttctctcgtcctgttcatcagcctggttctcgctacactaagaccaggcagggtctcagtagggtgagttgctcagggggcatctccgctcttgccaggagctcatctccctcgtagcccctcccctgctgccgactgttcttcagggagaaggctcactggcagagtggcatgctgcccaccaatgggggccatgccaagcgtgatgtgatgtgtgctgatccctctccacgccttgctgaagaccaggggctgatgcacccgcaggctggggagcctgggcggttctcccatcgtctccctgggggagtatatcacagtgaatagagggctcccttgtgttatgggtggaggggccagtcctaaagactttcctagaccccttatgtctggtcttgtgcacccagtttatgggagctctgagcactactcaggctgtcatgttagctgtaaccccagtgggtacagaggggccttggggtagcagggccccactcccagcatactaaagacagtttcctgctgtcctttgcataactctgtctgttgaggtctcaggttccaggagagagtgtgaggggttttagggacaggagaaacagaggcattgttaagtatggtaccagtacaatttgaagagttcctttctgttttccttctgtctgcgatggattgtgccaggcaagaggaattctggagatcctgggacagcccatctttctcagatatagattcttttgttttgttttgttttgttttattttttggtttttccagacagggtttctctgtagccctggctgtcctggaactcactttgtagaccaggctggcctcgaactcagaaatctgcctgcctctgcctcccgagtgctgggattaaaggcgtgcaccaccatgcctggcttcagatatagtttcttgagattataatgcattgaggagaggagaggtttgggaaagctctttggctctgcatgttgaaaaggtcccccagggatgttaacatcagtcaccaaggatcacactgtattaagaacagatctcagattctggaggtgggcagatccagttctggcttctctgctctcaaggtgactccggacgggccgtgatgcctcaccttgtcatgtgtggcaatgggttatcaatattccccttgaagaccagactgggcagtcacagctgaagactagcgtcagtctgtgtatggtggcacagcctgtaatgcccgggaggtagtatgaaaaggaactcaagcttcaggtcaatatgggatatataatgagaccctttcaaacagacagacagacagacagacagacagacggacagacagatcctcccccgccccaaactaatgaggatttggctcggcacacaaaagatgccaataataatggccgtccttgggatgcagcttctcctttgcttacagtggattgaagctcgtggtcctcccatggctgggagaccctgatgaggtgcggtggtgattttgagataggacataaaggttgtgttgggagatgctccaaggaagctgcaagtgccgggctacaggaaggactgaagatctccccgatccaccaacgcagggactctggctttaaaaataataacctaaaccagatgtatgtgccagctaccaacctgaggccattaatcagttcaactcccaaaggggaatgctggtggatgggggctgtgaactgtcctgtgggtgggaactgaacctggatcctttagaagagcagccagtgctcttaaccatctctccagcccagtccccagtataaatccgccaccgaggttcatgtttgtaatcccagtgcttaggaagtagaaccagtgattcggggttacaaatggcaggtttgagaccaagtctgggccatttgagaccctgtctcagaaaaaagaaaaaggcagatcggttaccttactttacagacggagaacccgaggtacagagaagccgaggcttcttcttggggtcacacagctcgggtctgggcttgaatccaggcagtttggcacatcattgcctcgagcatgaagctccctgggaagaaagatgtgctctcctctgtgggtgttctgggactggctggctgggctgggctgggctttggtattgtggtgggaggaggtaagtcccaaagagaactcgcttcctctagactgcccatccttcctgggctccgttgccttctgtggttgctggttgttctctgtcccctgcactccttatcttccttggggttaagttttgctttctccaactgtgagcatctggaaccccccccaggaatggtgcctgggctctgtgtgcccaggctgccacaggcttcagatcagagagagccatagaacttcaggctcagcttcactccaaggcccaaggccttggtacttggctgttcttccctccatccagggtggtggacactgggcacctgccccctcaagtgctatttatgacctggtaaatcactcagccaatcctcaggcttaatgaggcccagagccccgccactgcaccccaattaaccgcagcatctgtttccctttagcagaaacagcgtggctggtgatggagagcccagagtagggtgtcgtgaggtgggctcagaaatgacttaccacccacactgacctctgcgatgctcagagcacagctcccccaccctcacaagaaaccagcagatctccttaaacacacacttatatatgtcctcctcattaaagcaggctagattgagttttttttgggggggaggggtgtgactcagagggatttgggatgccccactgtacgctggcttcctggagatttgggagcctgatgtgaatgtcagcaaaggtgtccaagtacgggaaggggcaggaggtgaggatgggaaaagggaaactgtcagttggtgaggtcacactccaacaatcccagggctctcacactgatccttgggcttagtggtcactttgcccacaccgccttgcactgattggtgaatgagtcgggtggtcataggagggagggcccgagaggtgagagttcttcctggaaaaggtagaggtgcagaaaatgaaggaaaggagcccccgccccatgaacattgtgggagtcagctcttcctcaggtagctacctgaggtcaggatgctggcgattgtgagagttagtatggattctggggtgctgggttgggggactgtaaattggagtgagccaggggagctgggagattggactcattaggaaggcaatgggtgaaggaatctgcaaggtagcattagcgttggataattgtctcaggagtacacggcgagacgagtcccagtgtgccttaagcagaaagcacttccatccacttagccttaaacagcaaccacgcataccgttaccatccacttctgtacgagtggcagatgtcactagctgatcatagaattctctcttcagtctagaaacgtggttctcaacccgtgggtcacgacccttgtgtgtgtgtgtgtgtgtgggttgtcaaatgactctctcacatgggtcacatatcctgcacatcagagatttacattatgattcataacagttgcaaaatttacagttatgaggtagcaacagaaataatgttatggttggggtcaccgcgacatgaggaaccgtgccaagggcacagcattagggacattgagaaacattggtctaaaaggagagtctcacttctcatttttgggttcaggctatcactgtgagctgattaggaccattagaagaaatgacaatttgctttctctttagacgggactcagacatatttagggtctaaggagactcgtaggagagaactcatttgaaggggggggggtcatctaagtagcgctggcagaggaaccaggcaggcttcagagtcagaaagcagagacaatgctaaaccagcctggtttttatcactgcattttctgtggcctacctttttgaaagatataagggtaaggggcatacattcctccaagcaggagaaagtgccaagggtaaaatgtgtttcacaatatcatgtgccagagagcggaataccacatagctggcttggtgcagggatcaccaagatcttgaacttgaagtggcctgtagaatgatgtggaggtcttcaggcagacaggaggctgagctctcaaaggtgcagagcagagctgggctaccaggtgagctgttgcttcttctgagctcaggaggttgcagagtcacaccaatgagctgtgcgcttgctgcctttttggtggcttactccccacccccacccccccatcccaccccccaccccacccctcagtcccccgaagagacagatgctgggcctctgttctcattctccggccccacgaacgaacactcatgcacttgctcatttctgcattcacacacatattcataacctgccccgccctccatctttccccagaaagcaacaggaaccctgctttccactctccagtgagctgtgagtgcatctgattggtcgagctggagttacttgtgaattaaagctgggaggagcctaaatgcccaagtttgagctgcctgtcactgctgaagtcaatgagctaagacaaagttgaccacttgaccagagggacgggactaaattttaaaccaaccaacagtctgtgtttcaattctctatctatctatctatctatcatctatctttcatttcatacatatatatctcaatatatatattttatatatctgtatctctcatctaactatatttctctctctctctatccatctatctatttttatctatctgtatatacctccatatattccctatatatatgaaatgtaaggtggttttgtttttctgtttgttttgttttgacacaagatttctctaggtagcaatggctgttgtgcaatactctgtataaatcaggccttgaactcacaaagatccccctgcctctgtctcccaagtgctggaactaagcatgtgccatgccactctatccagtcataaagtagagattttttgaatgttagtcagccacctttagatctatcagtggttctcagaataaagtacaactttatttagttcaacattcgctgccacttgtgacaggtgtggcacacacctctctgcccgccacctgggaaggcctgtggttgggggtggggtggggatggattttgagaatggcctgtgctgctggccaccacatactgctccttaagcactcccaagatgccaggcttgggcgagatgctctcagaagagtggaagggcatagaggcagccttcatccctctttacctctcgctactgtgcagcatttgtgtctctgggacaccaccagcctgtcggtgttagcgctgtgcttggctctcagagactttggcaccaggtaacagtgccagatgggaactctcctggccttgtttaggcacggctggtagaactttttagggcatggggccagtacaagttgcttcttagggtctgatggttttatctaaatcctggctgtactcctctttgaaaactgtcacaaacatcccccagtcctgggctgagtgttggtggcattgggagggaagaagcagaggcatctcctagctccctggctaaagaggtgacacaatctcagctcctgggaggcagaggcaggcgaatctctgagttctaggccagcctggtctacagagtgagttccaggacagccagggctacacagagaaacccaaccaaccaaccaaccaaccaaccaaccaaataaatagaggtgattaaaaaaaaattccaggtttgctgagagagatgaatcactagaggtttcctaaccagctagtctggcgtaaacagtgagctccaggttcaatgagagaccctgcctcaaaacattgatcgagcaatggggggaagaccccagtgtcggtctctcacctcctcacacgtgcacgaggcagcgtgccggaacacacatgtgcacacatgcacacacatgtgcacacacatgcacactatatacactgagagaagaaatgaagaaggcacacaaagggccagccatagggccaggggtgaattttgggggcctgcggaggctgagaggagagctaggagccagggcaagggagacagtcatatttgggaaatcaaagtagagatttcattaaatccagagtcaggctcctccaaagggcaggccacggtggtcctatatccaactctgggtctagtcagttctacagcttgctcacttttgcaggcaattggatgaggttggcttttaaatgcttgcataggctactaggaatgacttatggccaaggaggggctcgggggtgccaaagggctgctgtccaggcagacagactacagggaaaccaccatctccaaaatggtagcagcaggagaaactagtcctgccctcctaccctgggtccccaggcaacagggccaagtggctaggggcagctgctgtcccttagattccctactcctgctgtccacccctgtcctgctttttccctaaggcagaacagccagctcctccctgcgtctcgctccagccgatgcccgatgccagtcctcctcagcttgggcggtggggggacccgggtggggtcatgacaggacaccactgcccgagggtgagaatggaggaggcccagctgtcagctggaacccatcagaggacaaaccaagccctggcagcgggtaagaaggggagggcaggctaataagaaaggtgccccttgagctctatgcttcttcagcctgtcttaacccttcctgtgccaacccaaggcatggcctgacacttttccatagagggaaatagcttcgtgtctctgcttatcaatccaagttggtcagggttgcatgaggctgattaatggagagattatggccctgcctcagggaatcctaatctgacaggggaggaaagcttcctcaaactagaaagggggtcacataactctgtcgtaagagggatcctactcttttgggagaaaagattgcttatacatactgagggaggttttatctgccctgagggagatccagcctgagagggctcaccctatatcctccaggggccccagactaagtccagagaggctctggatcagagatacaagaggctctgtctcattattaaactgagaaaccagcattatgctgtgtctgtgtgatgtttcgaagaatcaacaactagaacccaaaggaaggatgtcaatctaaaaaagtgtaggcaggatgtctctacagacccagggtgctgccactagggaccgttttttaccctggatgtcttcctggggtcagctgccttcttcggctgcttgctttcctgaaaccctttgcagtccctggacctctcagcaagtggcttattttcaacagctctttccttctttggtctccatgaaacttatataactcatgcctttcaatggacaatttagcctggtgagcaagcacaccaaggagacatgtctacgtgcagccggcccttcttcagctgcctggtttagatgtccctgatttattttccacaattagtggctggccttctcccaacttctcagtatcctcaactggcctgctgttggctgccacgtggcctgggagaggggagctgtctgctggtcccctttctccagtgcttcatggtcccagagttcagaactccaggtcactggctgtgctgggggttgctgatgtcaagctacctcttggggaacacctgggcccaggtccagaaaagtggcccagagctacgctgccacttctgtaagtctctgctatggtttttggcttcaggcaagcctttccgactcatgagcctcagtttcttcatttgctaaagcctaggtcctggggactgtggggagcgggtgtggcggcagtctcaaaggcgccagggactgcagctaagtcgtatgacttgcacctgacttcctcatataagccacaaacatcttgagagctgcgcaggtgtaccaggataccggtgaatccattttgatggagatatgcccctgctgccctgattagctgaagctgtgtgcctggtgaggtggcgtggcctgctgtgcgtggatgggaactgagagtataaaagagtgagaggcccagggttcgggggagatataaacaagaagaaacaggactgaataaacgtgtgcggaaggatcctgttgcagcgtcgttcttcctggccagttgggcgtgcgcaagaggggacctcttgcccccaaggttcaccatttgtaactatttttctctgtctactctaccttggtttctccagacaccatgacgtggcaataggcagagtaatctcttaaactgctgatctgattagcagggctttttaggtaggtcctgtgctgccggccaaagcacacacagcttatcccatctcctcctcccctagatggcactcccatgactgaggatacctgtaggcatgcaggcaagtggagtcagttggccacattttcctgggatcctctgagctagccctaggcccttgttcatacgggagcactgacacaatagtcaatgctacaagcagccaaccgtgtagactaagttcttactcggagccagggcctcggctggggtcgacagatgaacaagcaggcgtgctacagctgttggtagcactagggaacacgctcatggcctccacggttagttgaccagatcagtccagctctcccttcacagggaagctggcttctctctctgccttggtttttccatccttagagcgagccactaacagtcctgtaaccgtcggtggcaatagggattacatgagtcagtgaatgtaaagtgttcagagctcgggtgtggttgcgacaactttctttgtatgcacacagtgccaggaactgctgtggtgtttgttttcgacagagttctcccagggaaggaaaagattacttttgactgtgctgaggaatgaggcctcacaggagagatgctaccatagtctgatcttgaaaagatggtgataggttctaggagtagtgatgggagaaggaggagggaaccacacaaggaacagcagacctatgcatgaaagaaataaagctgcaaagtgtggtcaagttgaatgaacgtggaaatgcaggaaggatgtcctgcagagaaatgacactgacgtgttagcgtagtttccctccacaatggcaccaatggcagggtagccaggagtctcccattgctgtgggttacaaaagtgtttgcatcggggctggagagctggctcaacagttaagtgcactgattgctcttccaaaggtcctgatttcaaatcccagcaaccacatggtggctcacaaccatccgtaatgagatctgacgccctcttctggtgtgtctgaagccagctacagtgtacttacatataataagaaataaaatctttgggccaaggtgagcagggccggagagagcaatcagggcctgagttcaattcccagcaaccacatgatggctcacaaccatctacagctgcagtgtattcatatacataaaataaaataaaataaaatctgtttttttttttttttttaaagtgcttgcatcgagatcagcgacagctatcctgggcctcctggccaccatcaatatggagagcactgtgaggagataggtcatcagctctggctatcctgagacttgaaacaacttctcaagctccatccttaagtcccttctcctgcctcatggcttcagtcccgttttcaggcagcttgagattgcctgtgtcaggaagtgtaaacaaggtattggagtctgccccgtgcctgctctgctgtactccctgtccactgtgggcgtcacccagccatcctcttatgcactaggcatctgacctctgcttacaggcactgagagcgctggaaacttggttggggtggggggaggtgactgaatcatgacagaggatggtgggttggtgtgtatagggggagaccacatagcccccattttacatttggctcctggcctctcctgggtctttctggtggagcctattctaagcaggcttgttttccctcccggactctgaatcctcaatgctaggaactggcttttttcctcagatgctcataggactccccagtggcccaggtgagggacaagtggaaactcctcaaagcttaccttcagttctcagcagatcgtggtgtccagtccgagggatcgtctgttggttctgtctgccaagggccccactcttcagggcaactcaggagccctaggggagccagcatgaactcacccccccccaaaaaaaacccacttcatcttaatgtaaccaaagtgtgtcccagcaaagcgtggcttagtgaggagggctgggaggcagcatccaggaagggaggactcttttttttatttggtaaagatggtgtgtgtgggtggagccctcaccgagccaacctgcatcgtatgagcactcagcaaacatccggaaggctctggaaactctttcaaaggttttgaaaagcaaggattggacggcatccgatttgtgttttggaaaaaaccttctggctcaggtggagagcaggttgggaaggagtctgagctgccccagggccacccagaacagggaggaaccttgtgagccagcatggtagcactgctagcctgtggggcccagtagggggtgtgtgtgcttcaagttcccgagaggaatggctggtcttctttctaagttcaggggtcatagccatgtggggtggccctgctctgtgcgcgcgagagtgctcgtgcgtgcatgaacagtcacaagaatgcatacactctcatatgtgtgttcatgtgccgttcatttgtctttttttttctgttcatgaaatatggccttatgtagtccaggctagcctccttgaagctggggctatccttggatttctaatttttctgtgtcacctccccagtgctgggattacaagtgtgtaccgccatgaccagtgcatatgtattactgggaattgaacccaaggcttttgtgcatgctaacaaagcatgctatcaggcaactgagctccatcaccagccctcattggtccttcaagagtaaaagaactcgtggttcccattgtcttttttgaaggcctagagagggaaacagcctgccttaaactgagctcagtgcatgagaagggcagatgccaccaggaataggtagagctggtgtcatagctgaaggacaggtaggctgagccctgtactgaccaagcaacctgcagagggtgggggcgactgagggagcctggctttgggggtcagctttgtcctgttagatggagggacggacaccagaggtttggggactttccttcgtctcacttctacctgaggggtgggggaaggtagaaaggctagaatgctggttggcagggcttgagttcaggcagtcctgggaaccttgcctgaagtgcctgagacagaacagccatgaaggctggcctgaccaggctagccaaggggcaggagcagggcatttttcattcatattcctgcctctgcatggcagcccacattgccacccctgttcctgggctcccagcctgatcccaggctctgcctgccccttggcagccaccacccagcctatccacccagatactttcgaattcccatgcttctaaccgctccctggcccctgtggggtaggtgtgctgaaagaggctcaggcacaatgtggatgtgtacatgtaaaacatatgtagtacgtatgtgcctatctatgtacctgagtgtgtcttgatgtgcatagaaagtgcacgtgagcatgtgtttgtgtgtgcatggttgtgtctacgagtctgtgtatatgcatgaatgtaaagtgagtctacatgagtgtgtgtgtgtgtgtgtgtgtaggtataggttgtgtaggtgtgagaatatatgcacaacagctcatgtgagtgaatgagtgtaagggtgtataccaaggtgcatatgagcccatgtgagtgtttgagggggtggggtaatgaggagtcaaatctgccccctcaaccccccccctgcccgttttgaaaggcacatgctccttttttggggaggaggtcacatgccagtacttcttaggacagatcttgtaaactgaagttccccattcccatggctcgaatccatgacctggattaggagtgcaagataacagccatgcattttggggggacctccttctcatcgagctgtgggagtgtccagagtgccccaacttgaccgtggagagtggagcagagctgaggagggctgccgctgattccaggagaatggaccccgtcatcgctgaggctccactgggaagctggagactgggaggtcctttggacagtttttactgttcccagcctcaggcctggcctggatttcccttgaggggacagcgggagggaaccgcaggactggattggtttattcaatgaagtagcaacatcagtgtgtttcctgccagcttttcttcccgcctcactttcttctcagagaatagaaacacccaggaggggttttctttctcactggcaagccagagtgggggtggctggggccctgctattggcccaggcccttgtcattacaggcacaccccttggacttgagccaactccaacttcagcaaaggagagcaactgtattagcagcttcctgcccagcccagggctctcactgggagaggccccatgacctctgcttgaaaggccaaggctttctaaagaggcaggtcagtcctgatctcagactcttgttcccgactctctctggtcccagctaggtcttgaagtcacaatagcaatagggctcagggggagcaatattatgccaggttcaaatcctggttcagccacgtggtattgagccacttggtactgataacttctctggtgcctcccacctgtgactaggatatccataggactgacgtcatagctttcgttttctgttttttttctttctgagagtcaatgaattcttgtttgtttgacccttgaacttgacctcaatctgtatgagtggttgttaaacacttgtcacttccccaggtatgagcggctgaggtggaggttgctggaggaggggctgtccgtccgattacctgctcatcccctgctctaagctccacccccaaacccagaagcctctgccttttgactttcttcttcaacctctaagtcccatcccgccaggcaggtggacggctccgccttcatctcagaccagtgattgaggaggctcctcatttcagtcccccccccccccccccccccccgtggctacagtagccactcccagggcaccccatatggccggcctctctccagtgccttgtagctcccagctgccccaggaaggaagtggatgttctgtccactgggctgtggcctcaggcttttgtttgaggctagaagggttcattcatgtaaactcacacaccttcctgaagctataggtctgatcaggttcgggcctcccacactgggctagggactttgtagagacttctcttgccttccagggaccttcatctccccctcattctggttctctgctcctaagacctgtatcctacctgtgctctaaaatcgagccccatcttgactcccactggcagtgctatgaggccaaactgggaggttcagccacccacatgtcccagagggtgcctcatggccttggctgcctctgtatagcctacctctctgactccagcacctccactggagctgcaggcagatgtatgacagccttgtcatgaatgctcaggtcctgcaagaagcctggcacggctgctgctgctgctgctgctgcttctgcttcttcttcttcttcttcttcttcttcttcttcttcttcttcttcttcttctccttctccttctccttctccttctccttctccttctccttctccttctccttctccttctccttctccttctccttctccttctcctcctcctcctcctcctcctcctcctccttctccttcctccctctacccctccttcttcctcctccctcctccccctccttcctcctcctcttcttcatgttttttttaaagatttatttattttatgtatgtgagtacactgtcactatcttcagacacaccagaagagggcattggatcccattacagatggttgtgagccaccatgtgcttgctgggacttgaactcaggtctgagaagttagcactcttaactgctgagccatctttctagtcccaggaggcctggtttgatgtcaagaagtccatttcaactttcttccctagcatgtcacatctactctgtgtcctcctaagcctggcaatggggcagagatgaagaagacccaataggtccctccctccaatcttgtcttccccttgtctccccctcctttctctctcttttgctcaactccctcttgtttctccctccccctgttcactcccttttcctttcttccttctcttcctcttgtcttcttcctctctcccacctcctcctttcaccctcttccctctttcccctccctccttcttccattccctcttcctctccaccctcctccatctttccccgaagcattggtgagcagctcctgcaaactggtacagacgggcagtgattttttcaacttgattggacctaggttccaagacggatgggaggtggctctgggtgggtgttccaaggcatttcctggaaggattcgctgaaggagaggagctccctagagtaggtggtcctttcaggcagtggctgctccactctaaaggagtctgagagataagcacagttgaggttgctccctgtgggtgcacacatctactctgccacatccaccaccacatctttccctgcgtttggaacccagcttcatcttccaatggattggtggctcccaggaaccctccagtccctcagcatcagactgcagactgctgaggcccctagcccggtgcactgagtagcctcaggagtctcagcctctttagcatgccaacagcctatgtgggactcccagcctggaaagtcaatctaatagatcctaatatatatccattcaatcagcttaaaagccttgaccaatatacatatttattgcatgatggggctcaaggagtactcactgtagttcccatattcacccttgtttttttgggggggctccctgagctggagatgaggcccccaacatgctgtctttggctctcatagatcccctgaattcttcattcattcccatccacacaggaggtgcctgctctgggaaaagcggtcagcttcaggcttccatcacagcagtggagaggaagctgggtctgggaagagagttctaggttgaggaaaggacacaggcaaagccaggaagcgccaggaagcgccaggaagcgccaggaagcacaacactctggggggcaggccctgggccaggcagaaagatggttccagcagtgctgactcacagggaaacttctaggacagttgaaggtttcatttctccagcttcagggatagaggggggaacactcaggggatggttgagtgtcaagaggcagagggagatgcagacatttctgtggaaccctgactcacacctggggcttcatctagcacgctccctgatccccgtgctcctccctccttgtgctcctccctccttgtggtcccggggcccttgctgtcatcagactttctctgttatctaagctgggtctcctgccacatttttgcatgtcttttgtggagacggccacagtggagccccttccttctctttttgttcattttttttttttcttggctcgctttgcccttccttcatggtctccgttgatctttccctcttctttgtttcttctaggactctggctcccctctcattcctgaacaaggtcttccaatgacccgtagcagtactgggacaagaaggcagactgtggggttgtaggtggcctggcaaggggctctgtgcccaaagccttgtcttcttctctctagggtcagaggggacaggatccagctgtcctcagctgcagctccgtttccacggcgagcctagcgagaggctgtgacagaacactaggcactggagcccagagaagtcttgctttgccaaagaaaagacagtatggcagcttttaaaaggaggaggtggggctgtgggcaggagtacttgttgctcaagcacggagtctgaattcagatccagtactctgatctgctgcagaaagcccagaggcagcagggattaatattgggggagactggaggatctctggggcttgctggctgcccagcctacttgaagaggaggggtccagcttcattgagagacagtctcaggagaatagtggggggtgacaaaggccatgcggcctctgtgggtatacccactcatgcacgccacccagagatcagccctgccagccctgagctcatgagcgtagtcctgtttctctctgttcctgactcatgagcttagtcctgtttctctctgttcctgactcgttcagtttctcctcttttaaaagtaatattcattttattattagcctgtgtatgtatgggagagacagagagagagagagagagagagagagagagagagagagagagaggaaggaggaggaagaggaggaggaggagggggggaggaggaggaggaggaggaggaggaggaggaggaggaggaggaggaggaggcatgtgtctgcctcagcacccttgaggatgttaaagggttttgtttttgttttgagacagggtttctctgtgtagccctggctgtcttggaactcactctgtagaccaggctggcctggccttgaactcagaaatctgcctgcctctgtctcctgagttctggaaattaaagacctgtgctaccactgttcagatagtagtaaattttttcaagttggtcttcaaacccaggtcatcagacttggccagcaagtatttttacttggggaaccatctcagaggcccacgtacatctgtgtgtgtgtgtgtgtgtgtgtgtgtgtgtgtgtgtgtgtgtgtatgtgtgtgtcttttcttttttggtcctcacatggtgacctctgagttgtctggttcatggaaggttgcctctcaatcaactataggccccaggatgacccctgtctcaccttctgtgtgtgtgttgggcctaagcaagagagtgtgtacatggagcaggcccatgtgacacgcagcaaaatcaagtgaggtgttcgtgtgaaggtgagggtgtgtgaacgtagtaggtacaggtgagggcatgcatgcggatgtagcaaatataggtgatggtatgtgtgtatcagtagctgccgatgggtgtgtgtagctggaggaagtatcgtctgcaaagaccaaagggagctggggtagagatgcctggcacaccaacttcagcttgggcctgtggtggggtggctgtggaggggtcactgaaggtggagggtatggaacagggactcctgccgggcgcacagggtcaagtcaggtttcctaggcagaacagggctcacgccactcccatgcctccacttattctaggaaaacgaagaaagctactcgtcccactgtgcctactgaacacaaagtgcattgttcccttccccaggtctctgcccttgtctctgccagtactgccagttcctggtggcagatggcagctttgccattgaggtggaggctgctcacctggcgcacgcgcatgcatgtgtgtgtgtgtgtgtgtgtgtgtgtgtttatgtgtgtgtgttcaaactcctgcatgttcctcccttgtctccctcctggaggaggcagggtcaggcacatgccctgccttttggacctctctatacttcttgctggtgccgggagctggcccaggctcaagctggtgtgccaggcgtccccaccccagttccctgcagtgcatctttgtggacatcaggcatcctgtatgggaagctggctttctttcttccttgatcctgcatctcacctactctgggtgttcttttctgactcatctcacctctgccttgaccttaggaggtcacaggtctcagagcagacaggcagcgggtctgaggtctaagtttagaggctgagtgttattcaggaagcagcctggggccctgggaaaggtgtggacactgaccagtggtcaccatctcccggtacttcctgtggaccattctgttactcatgagcagttcttaagtgccagtgaatcaacctcatttgacagatgagaaagcagacatgacaagccaactagccacagggcaaacaaaaacaccaaggctccccctgagcaggagtttcatatatgttggggtggggaacgtgggctggagtcaggatggaggaaaagttctaggggtgtttcctgatacttgcgcacttggcctaccttctttgtgcagactgccagcaccaaccagagagggtctgtcttccccacgagaacagatacttggctctaagccctcctcaacttaactatgtcctctcctcccaactgcccccagcttccccagaaggcctggcttagagaagctaacccatcccttgtccttctgggcccccaccagctcccctgtgcctggccctggacacctacagtgagatcgattggggatttccagtagggccttctcgggcttcagtgtgtgggaagggcttgggatctgccgcttcctccttggagaccattcatagagccagcttcttcctcccaacttctccattgctcctcctttcctttactctgtcctcccagcaggtcgcctactgtgggcaacatgctgtgtccctgtcagacactggaattgggtccaatctgcttctaaccagacaagcatacatgcgtacatatcatatattcatttttaaaaacattgacttcaggtttctgtgcacacagctgtgtagaccctgcattgggagtcagtcttgtgggctgtctcgctgtcctttccccgtgctgtgtgggcttcaatctccttggagtcctgctgaccctactcccactcggtctccttcctggtcccttcctccgcctcgctcgggctctccttgcttggctctgcatggtaccctgtctggaacctggctttcctgactacttagctttcttctctgtaccatctcttctatatttagcagttgattctcccttcagggggcccaggtagttcagcctaacttctaagctgggcctacatggccctgagacatagaagtggggtccctgtcctccaggggaagcgggactaccagaggtgagggagacttgagcactctggggaggagcctggtagagacctctccctcaaggtggagggataggcccttgatggaggctgttgtgtggcatcatctaattcccatttggctggtgtcttctgttttggggaggttggtgaccaccctatggatatattatactttatcataggaaaccagttttctatgaatgagctcctgagagcgcctatactttgtggcggtaggaatggtgataagcaaacagtacggaccgcctccgagcctttccctcaggtccctggaggcctctgtctgtctccttctccacacatgatctcctttcctaaggcctccctcatctctctggtggctcattcatggggtctttagtgaaacataaacagcaggtttggaaaacacacctcctttctcctcaggccacggaacccacgtgctgacaaagacactcttggtttcccaagtgcccagtaatgtcacggccctttggctgcaagtaatagaaactcaaatgagtaagagaacacaggaagttattattgcccaggaagagcgatcccgaggcgtggtggctatgcgctcgctcgggggcgattgatcagatgtcactccatcggcttctcttttctttttttcttaggaagatttttttttttaactaaaggattttatccacttgaatacttacttagcatacccaaagcaccaaaaaggggaaaaagttaatattcaaattaactggatgaaagattcactctggacatcagactatgtgtttacaatagacctgcctttcaatcccatattccagattcctggatatcagcacaccgttaaacctacaaacccgaggctagcctgtctacagagtgagttccacaccagagctacacagtgagaccctgtctcaactgctaccaccaccacctccaccaccaccaccacctccaccaccaccatcacctccaccacaaacatccccacccccacccacacctcttcctcctcctcctacaccaccaccaccacctccaccaccagcacctccctcctccttccaccaccaccaccaccaccatcaccaccaccaccaccacctcctcctcctccaccaccaccacctccaccaccaccaccacctcctccttctccaccaccaccaccttcaccaccatctctaccaccaccacctccaccaccaccaccaccaccaccaccaccaccaccacctcctcctcctcctcctccttcaccacctccaccacctcaattacacaagggctggagcacaggctagagtttatcaccgacatcaggcaactcacatccatctctgactccagctctaggggatccaacaccctgttttgacctctgaaggcactcccacacatatatacatacacacacatatcttcacacatgcacacacacacacacacacacacacacacacacaaatgaagaaaaggtcttaaaaaataaaaagttacagtactatcccagtgtgtcttagtgagtagtgatgctcagagtatggtgggctttgtgctggttttcgagtctacttgtgtttataatggagtagacgacagttgaccaacttccctttgggaaacattagtagaggctctttgagaactaattgctttaattgctttccaatgtcttcaaatctctctctctctttccaagatttatttttattttatgcatatgagtgtttgtggatctgcatgcatatgtgtacgctgtgtgcacagtgcccgtggaggccagaagagggcgtcgggtccctcttaaactggagtcatagatgactttgcgctgccacacggtggtgggagctgaaccaggtcctctgcaagagctctacggcctctcgactgccggagccatctttctagatgccatcctctgtcttattttatctggtcttgaatataaagacaaccccatgtggtcagcaacaagagtctgcatcagcatctttcaaatttcgtgtgctggttatagcattgatggaatcaatttctagatataaatagctagggaaatggggtgttttctttccaacctagctgtctattgactgtcagctgatgtcctctggcgaggcacaatgtctttctggcctttgcattctgaggatacagtccattatggaggaaggttatgacagcagggacccgaggcatctgctcatgttgcacccacagtcaagagcgtaaaggaaagctctgatgagtcgtactttctagaacttagtcctgtctctttctcttcaaggcgctgcttcactccttggatgcacttgccctaaaggttgaccgatagctgctgatgcaagcgccagagatcttgtcctgaggtgatgtgctcggaggctgcagagaacccgtctgtctgtctaggtccgtctttaagattaaggaaactttccccagaagtgttcccagaacttgcttctgggtctcatcggccaaagttcagccacacactcattcctgtaactcctagtcggggtaacgtaggttctttgcctagcaggtgagtcatgggttatgtggactctagaggaggaaagggctggagggagaggttgaagatctgacaaaggggctgacaaaagctctccccaaaggggaagatgcctggttgtgtttatttttcttttctgttctcctcctcctcttcctcctcctcttccttcacttcctctccttcttccctttccgcctcctcgtttgtttgtttgttttggaaacagggtttctctctgtagccctagccacctaacttgtgctgtagaccagcctggggggcgggggggaggcggaggcaggtggatatctgtgagttcaaggccaggagtattaagcattttctatcccatattccaagtctgtgattatgaacaggaactaaatcttgtcatctcatcctcaccttgtaaaacctttccgcacgcgctacgtaaactatttgtttacacaaaggctccctgcatttttggcctaaagttgaaaccccttttcccttagctcttatcctttcaagcctatcaggaaagatgtgaggtaagaccccggccaatgggaaaaggacacagtctagaataaaaagccgagagtgtgctcccccgcttctgagcttgccttcttgatcaacggtaaaattttaccttgaggatacaaaaggggctgagagtacagctcactaggttcgttacctggattcattgccttcctccccccacctcccccataaaacccttctgagcatcctgggatacaggactagagtgcagggaaggacctggagttggcgctggatccagctgccctacagtcctcgtccctggaggaaagggtcagggtcacagtcactgaggttctagggtgcagaaccggctgaaataacccttgaagtgacattccttacaaccgtggttacagattcagggacaggagggacaaggtaatctgacatttctcttgacccataggtgggccttgtcattgcccccgagacagggagggacaggaaagagagttgtgagtcaggagcatacctgggggaaagaaaaacacaggaagtgactcaaagcctgcagaggagacaggtgaccagcagtctgcgggacagaccctgggcaagccagatgagggcaggaagcccctctctgaggctgcgtgcgggtgcgcacacctgcagctatttctgccagccatgtttcccacaaattcttccctcctcaccacagcagccactgctcactcacccacaagcccagctgccagctgtcgtagttcctggctcccacccaccccctgtatctgggaggccctctcacctatgaccccagaggtcgccacagacctttccagaaggacatctttgctcacctcccaaagggcaagtgtggggtggaggaggtggctagagagaaagtcaggggacacgaaggtggcaggcatatatcctgtggtgccaccagcagtaggaagaggggccctcggtctccatgactttcaggacattagccttagcggcaagcattttttaacccctgaggcatcttgctgatctacctttctttctttctttctttctttctttctttctttctttctttctttctttctttctttctttcttccttccttccttccttccttccttccttccttcctttctttctttctttctttctctctttctttctaaaaagtcctttcctctctctctctctctttttttttcatttgattgttttcttggaaacaagggtctcactttatagcctcagttggcctagagtcaacaggtctctctgggactggccacacactgcagaatctctgtatatgtaccagtctggctttaaattttctatgtagctcaggctgattttgaactcctgatcaatcttcatgtcttaactccccaacttcagaattaccatatccaactctgggagccccacagccaactcttctttgtaaggcagtttgtttgtttgcttgtttgtttgttttgctatgtagtccagggatgaccttgagtttgagatcttcctgcctcagcctttggggtactagaattccagctgtgtgtttccttcctttctctctctctctctctgtgttatgcatttttgtatacatgtctgttgggcatttctctagttgccttcacaagaaaaggaaaacacaaacaaaacactaaaagttctcacactaggtggaaggttgccaagttgactaacagtgctggaatgcccttcagaatgtgttagcgttctttctggtggcattatgggagacggcccacgtagccagatcctccacagcgctgggtgttcctgactttcctaatcattgttgggttgataaatgaaaacttacacttggctgaaagttgcatttcaaatcattaatgagatgggacattatgtattaatcttttaaaagctttacttattttattctatctgtgtgagtgttttgcctgtgtgtattcatgtgtactacgagtgtgcctggtagcccaagaggtaagaagaggatggatctcctggaaccggagttaaggacagtttgaaaccactaatgtggtgctgtgaacggaacccaagtcctcagtgagagtaacaagttcccttaaccacagagccatctctccagcccctagatattatatttttatttgctaggtgtgtgtgtgtgtgtgtatgagagagagagagagagagagagagagagagagagagagagagagagagagagagaaaatgaggcttgctatgttctttgttgtgcttctattggatctctggcttttttctttattctttgaaaggcaatcattcatttattttttgctaggtatcatggtgcacatctggaatcccagaattcaggaggcagaggaaagaggattgctagctcaaggccagcctgggctacagcgagacgcctcctaaaacaaaaacaagccaggtggtggagaggtagcttggtgggtaaattgctggccttgcaactggtgaagactcgtgcatgatcctcagaaaccacacaaaaagccattatcatcccagcactggagatggggacatgcaagccctctggttttctggctagtcagtctacctgaatcagcggcaagccccacatcccaataatgtccccaaacacaaggaagacggtgtctgagggacaacacctgaggctgacttgtatcctctacacgcatgcacgtatgcttgcacatatacatgcattcacaggacatgcactcacacatgtacatgcagcatacacgcacacatgcatgcacaagtgtgtgcacacactcaaactaaccaaaaccgatgcttttaacttatgaaaaccggtacattgtcatgcatcttacaggtgtcttcctctgatctctgattttatcttttgatttttatttataatgtttttccttgtaatttctttgtgggtgcatgtattaattacttctgttatgacttctgtttgtcctgtgtctaggaaacttgatacccggggatcacacaatcattttcacaaacatttttagaaacgtgtgtgtgtgtgtgtgtgtgtgtgtgtgtgtgtgtgtctgagtgtgtgtgtgtgtgagtgtgtgtgtgagtgagtgagagtatgtgagtgtgtgtgtgtgtgagtgtgagtgagtgtgtgtgagtgagtgagtgtgtgagtgagtgagagtatgtgagtgtgtgtgtgtgagtgtgtgtgagtgagtgagtgtgtgtgagtgtgtgagtgagtgagagtatgtgagtgtgtgtgtgagtgtgtgtgagtgagtgagtgtgtgtgagtgtgtgtgtgtgagtgtgtgtatgagtgagtgtgtgtgagtatgtgtgtgagtgagtgagagtatgtgagtgtgtgtgtgagtgagtgtgtgtgagtgagtgtgtgagtgagtgagagtatgtgagtgtgtgtgtgagtgtgtgtgagtgagtgagtgtgtgtgagtgagtgtgtgtgtgagtgtgtatgtgtgagtgagtgagagtgtgtgtgtgtgtgtgtgtgcgcgcgcacttgcctgtctgtatgtacactgtgtgcatgctatacctttgcaggcccaaagagggtgctgggttatctggaattggggttgtgagttcttaggagcttccatgtgggtgctgggaactgagcctcagcacagagcagctggtgctctttttttttttttttaagatttatttatttattatatgtaagtacactgtagctgtcttcagacacaccagaagagggcatcagatctcattacggatggttgtgagccaccatgtggttgctgggatttgaactccagacctttggaagagcagtctgcgctcctaactgctgagccatctcaccagcccccagctggtgctcttaactgctgagccagatcccttgacttgtgtataagttgatatttttgtttttttggttttttttttttttgtacttttatggttttatttttccagtgttttcttcagttcttcgatcctgatggaatttatttccatgctaagagtgaggtaaggagtccagatttatttatttgccatctaaatatctggtgaagtgactcaatttattgaattctcctgtttatttgggtccttttattctccacagctgatcctgtgcggactctgggctccagccattttaattactcttgctgtgcagtgttctgcagaatgtctgccagacctacccttccgtgcttagtgtgctttgcttttctctggaatttttctgtctattcttttatatatgtccccccacccccaattaaaattgtcatcatcccatggctcccacggcaactgatccttcgtgcccatacatagtccactaaaccgatagctcatttacagtgatagtgacgtattcaggagactactctttctccatgagcaaggtccccctttatttactcaggtctgtggagtgttccctgtttgggttttatagctctttccacttatgcctgcacattttaaaatgtgttttatgtgatgtcgttttcataagtggcaccccacccccatcccccatcattttgttagtgaccttctgtgcttaggacattttgtttttaggcactttgctaagttctgtggtgaagattaaccattttgtagtacaaactgtaatcattgctactgggcagggcaaggcaggaggatcgtaagttcgaggcttggctggggcagttagtggcaccttgtctcaaaggaaaagccaagaggatgggcccccatagtacacctaacttttggctgttgatagatgttgaaaaaagaaacattgcttttccttgaggacatggctgttggcagtttgctcccagccggcccagtggacggccacacccactgtgcacaggggcagcttagtcaggactcaaagtgcttttaaaaacaacaggagagctgggcggcggtggtgtacgcctttaatcccagcacttgggaggcagaggcaggcggatttctgagttcgaggccagcctggtctacaaagtgagttccaggacagctagggctatacagagaaaccctgtcttaaaacaaacaaacaaacaaaaaaccctgaaagtaatgaatgttaaaagaaaaagatggggctggtgagatggctcagtgggtaagagcacccgactgctcttccgaaggtccagagttcaaatcccagcaaccacatggtggttcacaaccatccgtaacaagatctgactccctcttctagtgtgtctgaagacagctacagtgtacttacatataataataaataaatcttaaaaaaaaaagaaaaagatacataagggaagagagcctgcagatgatgccttttaagaaaaaaattgatttttatcttatgcaagtttgaatgtatgcctgtgcaccacctgcatgtctggtgctggcagaggccagaagaaggcattgggtcctctggacctggagttatagattactgagagccaccgtgcgggttctgggaatccaacccctgtcttctggaagatcagcaagtgttctacctgcacgggtgattcttgtgaaacattcaagtactaataatactgtccagtggtaataattttttcttccaaaaaaaaaaatctatgtatctctagtctacctttttatctagtagctttgtcaaatcattccaggccggtgtcaaatactgatggcgatcatttgcggccatagtgacatttctttaacaggatgctcccgaatgtgaacaggctgagctttccagtttacatagtgacaggtgggtgagccaggtgtggtggctttgatctcaggactctggaggcagagacaggaggttctctgtgaatctgaggccagcctggtctacagagtgagttcctggacagccagcgctacacagaaaccatctccaagaaaaaaaaggtttcttaagtccatggtcactttgggcctacagcagctcagtgcacagtggggaaatctgaggtggaggacgcctgtttacctcgagtgggatgcaaagtaagggtcaccgacctaagtgactctaccagggtggggaaggctgcagtgccaaggagcagagacacgtctcacaggagtaaactgagattctggcacttgcgtcctgacaagccgtctgtccttcactttgggctctcttgagcccctgtgtctaggatgaggcacagtaggaaccattggcttatgccatgctgtggggaaggacccgggtgaggcagatgtcccacactgggtcggggatgggagaacacagagctctagagctctgaggctgaggcaggacaacctgccgacctcacctactcctccatacaggtgcttgcgagtagcggagccctcaccagcctcttcctccaggttcctcggaggcattcttttcccaaagtcaggtgaccccatcctacctttccagtttcctaaagcgtttatggaatcccctgggcaggtacagatgccatcactaccctcagggagccatttctgtgcccaggacttttgggggtggtgaaaaggttgggtgattttccagtgcagagtcttgcagagttggaggagctgtaggcacctgtgtgggtgatgggatggggccaggtggctaaggaaagaaccttcacttgtcaggaccatgaaagaagcaagccctcccaggccctccgttcacatggtcttttaagagaaggggaggtgaccctatggcttcgtttctatcactggtaggagacagacatcttccttttcttctctcgagcaaagattaagaacatacaaatggggaggggagcggggaactagaactttagctcagtgagtaaagtgcttgtctgtgcaagcaaaaggacccgggttcggatctcaggcacacacgtaaaactcaggcaccgtggcacacatctgtaatttcagtgctagaaggcaggtggagacctgaggatcccaggtgggtggggctgggagaagctcactggccagccagtctggtcggaaacattgagctccaggttcagtgagagaacctgtctcaaaaactaaggtgaagatcgactgaagaagacgtcagatgctgaactctggcctacatatgtgtatgtatgggtgaatgtacccacatgtacatgcatgcacaacacacacacacacatacacacacactcgaacatagatataagcacagtgctgggactctaggcagaatgaggaagagcatggttgactgtgtctagccagaaaggccagaggagactagacggctaccatgccgggagcattgaggagttcttatgagcttctggtatgtttcagaagggacacctggactggctctgttttccagacacaggaacctgggaatacagagaggaggtggtcacatgaggaggttctctgttactaaacgaggctcaaggcagaagagccaggatggcctcgcttgaaggagtcgggtgcgatagtcagtgggggaccttggaatgaaaggcaagatagatgctgaaggttggtcttggacagggagcaaaggcaggcaggatgctaggtagcgtgaggcgcctggggcagttgagttgcttccaccagccaaaacccaagagggctttccctggaactctcttgcaaaatcatggcggcatctctactgatgtggcttcctgtggaaagtaggtgctgttggtgggtcctggcatgagcctcactcatttccagtctcctcaatttctgtaccaggcccaagcctccagggggaagcttctagaaaacacatcccagatgtgctgagggagacggagccaagagagcaggatgactactcttttgagaaaggatgccatttcccctttggatcaacaacttggtgttgcttagagaaaacgacacctcccatcctagatctggggatccctgggcttggagaatccttttctaaaccttgctagaagcaggtttgcagaaggcggcgatctggcaaaggggaagccagagggaacagtctctgcttttaaggactcgtgaggttctcctgatttcaagatctatagacttaatcatgtctgtgaagtccccttggcctggtgacacaacagtcataagttccgggcattagggggtgtggctcaccacagtgtttattctatcagccgtatctttggcatgttatctttgtaaagccatacttatgaacgtatgcagtactgtctgctggcagctcaggatatttccctcccttttctgcccaggaggggccagaagccagagaacgagagtcctcagaatcccctgggtgccaaagagcgacaccgccacaggcttcggtgaatggaaaagaagctccagtgttgctcaccgtctgagggcagatgcgtgggctttggcagatacaggatttaggcttttgcgttgctttgatcctggaggctcaggtgtcttgtggtttcagccacttcctgacttcctaagacctaacaggaaagctgagccatcccttcccagcgttgtaaatatagaatcccctgtgtttaagcagagcagagcacctgaagtggtctccatgttcttgactaacgcagtgccttgttgatgatcacgatttatgacctgctggcttgtacttaataagatgcaccaacaaatctgtccgagggtcatggagtattcaaattttggtgattacctgattgcagaagtgtttcctggttttggtattatgtccacatagtcaagaaccgctctccctgcacacccacacaaccccctccctgcttggcagtgaaactgaatgcactgtcagacatatttactcagaacacattcttgaaatgcaatgttttagttgaaagacattcactttttgaaagcattcgtgcctgtttccagagaagtcttctgtgttgtcttattttggcctataggacatgattctccacgctttcttccccagctcagttccttccttccttccttccttccttccttccttccttccttccttccttccctcctcctcctcctcctcctcctcctcctccttctcctcctcctccgacccaggcactgaactcagtcttgtccatgtctgtcaagtgctttgcacctgagccacattcctagtctaacctgggcttccttctctttttctacagcacagtgcagatggtgagtgaatctgactgcttctgccttcagaatgcatccacagccctcgagggtcaccatcgccatgtgatcaggcctgcatcccatctcagctggatctgacagtggctcggaaccatccccgccttgctcagcttcccctcatcctcagtagccagagattttgctcaactgtactccagaccatgccatgcttagctcagatagagaccctcatctcctccaggaaaaaaaaagccagcacatggctgttcatgaaaccctacctaaccaacccctattgctcctctgacctccccatcctactccttggttcgttgtccagcttgccccttgaaccttcttgtttcttgggtgttccaggtgagagaccgtgatgaacacctgtaccagttgtcccctttgcctggacaattcacccagacatctacaagtggggctcctttgtcctgtcatttgtccttgagcagggacttctctgaacctcctgcctagcaacctttcacgttccatttctggttcactccatagtacctaccgctgtctatcttcagacagtgtctcctgtcctctggttctcggctatgtgcattgtgtaaatactggagagctatcgccactggctataagtgtgagttgaatgtagacgtgaacttgggacatttgctgagcctgctgcaccctgtttgtgctgttgtttgtccaacgtaaaactaatttctttctttcttcctccccccctgtccccccatattttagacaagatcttaccccataggtctggttggcctagaactccctatgtagataacctggccttgaactcacagagatcctcatgccttcgcttcccgagtgctaggactagaggtgtgtgctaccatgcctggcttccagtgtgaactactgtgtttcccttgtgaagcatacgacacaaagtcactcaacctcaggagacactaggcagtgcatacggtggaaggcaaaaagcatcactttattattagctctcttgtgcttatttatttctgagacaggatttctctgtgtagctctggctgtcctggaactcactctgtagatcaggctagcctcaaactcctgagtgctaggattaaagacatgtgccaccgggctctgtttgtttgtttgtttttttttcctttgttttgttttttaatatatgaaataagggaaataatagtaactgttccatgagtttttgttagaattaagtgaactaattcatacaaataattgtgaagcatctggcatgtattaatcgttaaataattggaagctggtttaatctccctttgtagtagagggatctaaagctcggagaatttaggattctaaccacaggttacatagcgagaggcagggtgaaggttgaactcaggactcatgatttacacagctggttctgctaagtcaaactcatacagtgacctaaacaaggccgtgggactcttccctcaggcgagagagcagtgcagcctcttgctgtctgttttgtctgaatcctccccacattccagtcgactcatctgatgatctcggaacatcaccaggcccgagagactcactgcctcctgtttccgtgtctggagtggagtgtacgaataatcataccatttgtcacgacgtaggacaaggtgacagagctgaggtgtagtgtggaacagttcctgtaattccgtggctcacaaggctgaggcaggaggattgagagtttaagaccagcttatgctacacagagagaccttctctctcaaaaaataacataatctgggcatagtggcacacacctttaatcccagcattttcaggaggcagaggcaggtggatctctgtgaatgagtggccagtctggtttagataaagaattccaggccgggcaggggtacaaaactgacatttaagaacacaatctcagatgcccactaagtgtctaccctcttcacttcctttactaacatagttcatcacccctcccagtgtccccagtggccgggcaccctgtggcttctgatcctgctgacctctctggtcccctgataggctctggagctatccccatgatgcctatccttgctgctaggcagccttgacttgaatgtggcccttgtcctactctgtaatgggaccctagaggaaggttggctttggtatgggggtggggggtgaggggctacatgtctgctggtcttcacaggaactgtgagcatactacggaacagggctcaaaaacaaggaacatggctcagttaccactctgaacttggttactgcccagttgccaggttaccatccctgtcctgaatcaccaccagtgtggttccagaaggcaagcctcatctgcagggtactggagggctaatagaaggcggagcaggctaggactctatggtttgaagcttgcacttgctctctgtaatcctcaactagtgagaataaagattaccaccat

SEQ ID NO: 202 - DNA, 50648 bp, Mus musculus
ggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattattcttttggtgattctgttaccgtctatcagcagacctgggagacagattctctcctctgagtttcagtgctcagaggactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggccgcctccccagctgggcgggcacctgtcctccggtccggacggtggccggctgtccccggcccacaaagggtgctgcctcagcgcctctgtgcttctgcctgttccagaagctgtcaggttctctggcgcaccctctcacctgttcagactaatttcctaagttcggcgggtcccggaccaagcgaggaagtcacttagtaagggggcagcctcttgcctgttcttatctgtgtctacgagatcaacaaactttatctgatggcttataaaattctcttgcctttagttcagcaatctggaaagtctcactgaaaaacaaaggagtggaggttgagcggaggtggcgctaagcggcagtcgggatttgttgtgtttaacacacacacacacacacacacacacacacacacacacacacacacacatggttgtgttagttataaggcttgggattgttcctcataacatgtaggtgctgaggtgggttctgccacccgcagggaaagggcgattcactcatctcagactcagccttgcagtaggaagaaacccatgaatgagtagtaggttcattatagaattcttttctttctaaagatttatttcttttatgtatgtgagtacagtgtcactgtcctcagacacaccagaagaaggcatcagatcccattatagatggttgtgagccatcatgtggttgctgggaattgaattcaggacctctggtctgggagagcagaccttaaccactgaaccatctctccagccatcattatagaattctaagaggctacggttgcactttctagggcccaacccccaatgtgaaaacacatagccttggtacgtctctgtacactcccaggctcacactttgtgtgtttattacagactccttgctgactcctgccttacagaatgcaaacagacttgactagacttcgtcttgcagcgaatggaaactcaagggcttaagaaaacacctgctaatgctggggggaaaaatggctgatttagaatacaaatggcatttatttcatgtgctgtactataccaccacgatccacgaggaaacctttaaattatgtttattgtctttttttttttcttagagagaaacaaaccgcgcagcatatttggatagtttttcattacaatagttggttgtgcagatccattttaatactgaagagaagatcgattaccagtaataacttgcatgtctcaaagtggccgatcaagctgggtggccatgctacttcggcagattctgcccctcctaatgtggcccgtgttttcccctcacatctgccaacactccatcgattctggggaaccttttttttggtaagtagtgggtgttttagggtgttctgaggatcatgtgggctttgacaggaaagggctcatagatagcgactgcttctccctatgtggttcgtaccaaaggaaggcctttgctaggaaaacagaagggagtgtggtgtattgaacataccaaacaggtgtggtactgagcaggccaccagcatcctgagaaacaccctgtggttgatcccaagtgccctgagtaacaagatgcaggctgaggagcccaactttttgagaaaggcagaaaacttttctaccttgctgcatagcaaggaactccagggaaccctgggaggttgagtgccctggagaaaccagccatgcaggaagtagtaacttatccctcttgctttctacccctactgtgcacagtaactggcttctggcattccttttatttttataaaattacatctatttgagaagaacacataggttttagtttggtattgtgagattatagaagaggtgggttccagtcggccagatataaacccgggttgcctatttgttctcaaatgttgaccacctatttccacagataatttaagccatagatcttacaaacagaccccgattctgttgctgtagctgggtgactccagcggttttatttggtttttttttgtttgtttgttttttttaaattccagttcacctatttatagagtgaggtttgtgatagtcctcataaatagagctcctatgtgagattagtcaagacaggttttggtatgttcagacacttggcctcatgcatgccacagacacacacccagtgcatgatgggaatcagttctactgtattcttccttccctggggcactggcagggactatctgttcacacaacatccccctacagtctctcaaaggctccctgctgtgggccactctctctactcagactctgtgaagggttcggagtgtaaataccctagaaagatactttacaatgtgagggtgcaattgtgtaaaaaactgacagatccatccatttgcctaagaatttcataaattcattctttttaatagctgagtagtactccattgtgtaaatgtaccacattttctgtatccatcatctgtttagggacatctgggttcttttcagcttctggctattataaataaggctgctatgaacatagtggatggaacttcttctgggtatatgcccaggagaggtattgctggatcttccggtactactctgtccaattttctgaggaactgaaaaaactgatttccagagtggttgtaccagcttgcaatcccaccagcaatggaggaatgttcctctttctccacatcctctctagcatctgctgtcacctgaatttttgatctgagtgaggtaacccaatcacaaaagaacacacatgatatgcactcactggtaagtggctattagcccagaaccttagaatacacaagatacaatttgcaaaacacatgaaactcaagaagaaggaagaccaaagtgtggatacttcattccttcttagaatgcggaataaaatacccatggaaggagtttcaaagacaaaatttggagctgagacagacggaccatccagagactgccccacctggggatccattccataaacaaccacccaacccagacactattacatatgctagaaagcttttgctgacaggaccctaatacagctctctcttgtgaggctatgccagtgcctggcaaatacagaaatggatgctcacagtcagctattggatagaacacagggcccccaatgaaggagctagagaaagtactcaaggagctgaaggagtctgaaaccctagaggaggaacaacaacatgaactaatcagtacccccagagctcgtgtctctagctgcatatatagcagaggatggcctaatcagccatcaatgggaggagaggccctttgtcttgcgaagattatatgccccagtacgggggaatgccagggccaggaagtgggagtgggtgggttgggaagcagggttgggggagggtataggggattttaggagaggaaactaggaaaggggatagcatttaaaatgtaaatgaaaatatctaattaaaaaaaaacctgacagatctgtcaaacaaataaagaacatgtctgcggccccttgccccttgcagtcaatgacgactgtgccatgtcacctcaggcacattttcattttccagagaattatataaacagaaaatgcattgcagtctcctctgccatcctgcatcattcgcctcgagctgacaaaagttctgcatatcagcatcccccccccatcccagtcctgctctgctctgagtctgttgtgtacatatggacatgttagttttctccccaccgagtgatgggtgtcggaagttctggattgttctctgtttggggataatatggcgagaactgtggcttctttagaaacccagctacagtgtgtggatgtttgttgttttaaccccactctgcttcccagcggggttacctcatgctctagcagggcccagacttttgccagctgcaggtagtttaattctggggactctgaaatgggagagctcagagagggcttgtggtggcagctcttcctcctgttgctcctggttgctgttgaggtttgtaaagaagttggggagctcctgtcaaggaagattggacttgccccaaggaactcaagacacctctaatcagcaggaagtagtctgttttgttggctgaaagaggtccatgtcccctttcccctctaacctttctttcctacctagcttggggggggggtttgaagggagatagagatataagaactcaataaaatatttgacttagtcagggtttccattcctgtacaaatgaccaagaagcaagttgggaaggaaagggtttattcagcttacactttccacacttctgctcatcacaaaaggaagtcagggctggaactcaagcaggtcaggaactcggaggcaggagctgatacagaggccatggagggatgttgcttactggcttgctacacttgttcaaaatgctcttcatgagactttaccagagaacaaagtctctgctgggattcttttgagacttcctttgtcaatgcaattaatataaatctctttaccttagcctcaggtagactattcagataagggcaaaaagcaactatgttctttacaaaatcagtctctatgccacatactgaaatggcccccacagactcatgtgtttgaacaagcctatgtgggccaaagagtataatggtttgtacattcttggcccagggaatggcactattaggaggcatcaccttattggagaaggtgtgtcactgtgggtgtgggctataagacccttaccctagctgcctggaagtcagtattcttttagcagccttcagatgaagatgtagaactttcagctcctcctgcaccatgcctgcctggactctgccatgctcccaccttaatgatactggactgaacctctgaacctgtaagcctacccccaattaagtgttgttcttataagagttacattggttatggtgtttgttcacagcagtaaaaccctaactaagacagtaccatgaaaaatagcactaacaggataatataaaacaaacctctatgagcaattgtgtgtacaagcatttttatgcataaagctttttttcttggttaaatgcctagacataggggccagatcttatggttgatacagatttagtgttttaggcaatgaccaaaccgttctacaatgtctacattttatgatctcccatccctgacagcggtgaagaactccagttgctgcctgtctctgccaacactctctcggtctttttggttttagtttcctcgtaataaatgcaacaaagtgtggtcagctgtttctcatgtgtttatttgccatctggacatctctgataaggcaaccgagtaattctccacttttagaagtgtgcttttaaaaacatttttgttttttgtgcatgcgtgcttgcctgcagaggtcagaagagggtattgtattccctgggatggaattagagatagttgtgagctgacatgtgggtgctgggatttgaactcaggttcttttgtaagagcaggcaacgcttttatctgccgagccattttctccagctcctagtggtatgctttcagatcctatttgtttgtttgttatttatcatttattttaatttgagctttaagataatgaggcttttttttaaacccctttgctgatcacctttgctctttaaggatgattttactacaggtttaggtccacagaccacttgaccagaaagcagaaggtttttgtaagcactccatcctgcctgctgtcttctttcctaggatctactctcagtgaggtgcacagtctgtcgtccacatttcagctccagctggttcatttcatgggtttggacaaatgtgtaatattgtcatactgaatactttcatcaccctaaaaatctgatgctctccacccgcccctcccccaagcccctttttatatttttatatttttaccagttcaagaatgtcgtatggttggaatcctgcagtgggagatttttctgactggcttcctctgcttggctatacacactcatggtggttcctgcatgacttctagggacggacaggtcatgtccttcatcgagaaatttcccttgagcgaattgtggaggcttgtatgcctgtccatcgtctgaaggatatcttggctccttccaagtgttttgccaataacactgcagatatcagcgtgtgaacttttgtgtggtcagaaaatgccagctcccagataaatacgaagatactgctgggctctgtgtgagttgtataagaacccataaatcaaaaaactaaaaacaaaccaaacaaaaaaactgtttcatgtcgattcccatgaggtcctattccaccctaactgcctcttcccaagcagatagctgtgacctggtgacatctgatgtcagtctctctctttatgatttagctgtctatataggaagtatttcccatatttcaagtcatagatatttatttttatattttctctcggaagtttcacattacaggttttataagcaggcctaagatccatgttaggtttttattgctgtcgctgttgtttcgtttgtagtaaaatggatggttcacagtctctttattttctatgtggtcgggaaattaatggttcagcaccctttgatgaaaagatttccctttaatcattggagtgcctccagacctgtgtaaacacatgaataatgtacttaaccttgttgtaattctgaagccaccattataattctctgcatcattcatcctgataccgttaccacagcccttctgctatgatagccctatagttaacaggatcgcagcccttagttttaacaattctatcctgagaacaagccaccttagccatacccttcaattgtgaaccaagtgtttataaaacacacagccagccaaagagaaagaccaaaaatcagacagcagatagctagcaaaaacacagaactcattcttgtaacctttacagaatcttgcaggatgaccagagcagccctgcagaaacatccagccaggacagggtccaggcagaccctgaaaggatgctttcagcttcccattttcctctctaatccagatgtctctagtttttcccaccttgttacacagacagccacttacacaagcatggggggtgattcctgttttgtgtctgatcctaggcataaagcctaggctatggccattgaaaaacaagccaatggcggatttttgtagatatttttatcaaggtaagacaattttcttctgttctttgctgaaagttgttttctggggtggatgctggagtctgccaatacatttgtctatggagatggtcaccttttatttttctttcttttttttttttagctttttaataaaattatatgacctattcaacatttttggataaattatatgtggtcataatgtattatggtttccatataattttaaatttgaagtcatatattatttttaagctttattctttttgggggggttgctgtttaagaatttgtcaatttgattttttaaaaagacttattcattttatgtatatgagtacactgtatctgtcttcagacacaccagaagagggctccagacctcattacagatggttgtgagctaccatgtggttgctgagaattgaactcaggacccctggaagagtagctggtgctcttaaccactgagccatctctccagccccaagctttactttttaaatgtgatgcagagaaatttcagtgggcaaagtacttgctgacaaggccagtgacagaagtttggtccctgggacccacatggtgggaacaaaagaactgattaccacaagttctcctctgacagatgtgcagtggcatacgtgtaagccccgtgcacacaaattaagaaaatggtaagattttaaaagtggaagaaagcttttgctgtggtagacactggttaacagttttatgtgacatgcttgtctggttttaatgtcagggtgacatcacctggcttagggtccccctccctcttctaacttccttgagggtcttgcacagaactggtctgcattcagtgaagtctggcagcattcactggtgaagtagccttggcttgatgctctatttgaagagaggcttaagttacaaattcaattcccttaaccaatacaggactactcaggtggatccctacctgtgaagctgttttctgatatttccccctacttttcacctgagcccatgggatcgtaaaagaggccagctctcagagcaggaggtttgctctctctccccagaaggagcattttcacctaattctcacatttctttctgacccaaatccctaactattttattcataggacatttctaggatgttccagggaaaactttcatttgtttatgttcttaatacacatcttggctatgcctggtcttcctcacctttcctggggtccccatgggagacttggagttctcttagttgggaccaagggtctttatgcataaagaaaacagaaaggccaagctggccagcattgtccagtccacccatcaggcagatgtcctctggccgtgctcttttgggtgtgtgatgccctccccgtcctccctcactgttagtgctcccttttctagtgctccctttttctagaatttcccctgtggaaccatgaagcagcctcagtcagttatcaagtgacaggaacagctgatcctcttataaatcagcatgtctcactccataacacctatcagaatggtctggaagtttgtcattcctgggacccatgtggagtttactcatgtgtggtccaggatgtggccttgcctgggaaggggggagaggtgcaggaataccacactgctgtgattgctgactgccctaagccagagctcttaggagcctcctctcaagtagatgaatctgagcaggctttggcctggtaaccttggttaccctgggtgtctctccccaacccccaataacactgcagtaagagaatccttaccccattgaagagccagtgggaaatgcgtggggagtgtgtgtgtgtgtgtgtgtgtgtgtgtgtgtgtgtgtgtgtgtgtgtgattcctcccagccttgagctgaggctgggcaaagggattgttctacaggctgagcttgtaagagttgtgttccatagctcccgaaggccccgatacttccgttccattagtaattgacataaaggaagatgtctgtcctcacattgcttcctctcacctccttgtttactgtgctacaaggaagggggaaacctctgggctgagagaacgttagaacttctcttttactgtgaggacctctgggaagtggtttgttagcagcctacagcctccgttattacttttggctcttgcttgatttcaccatagggataaggtgggcagacgtggatactatgagacttgcagaacatgcagccagtgactggctgtgaggcactgggattcactacaaccctgaacctcagtgtacttacctatgaaatgggcataaaatttagcatctgcttttgtgaccttttatggataaagagtatttgcatctcaattttaccctctcttggaaaattcataataaatggttgttttgggggggggatttgtaacaaattttccccaatcagtaaataaaatgtctgttgatttctgggtatgacacttaccgttgagagaaaacatttgtgtgaccaaaatcacaactgtcttgtcaggaaaatgaatggatggtagattagtcgaacgcctcgccttcaccttcctgacaaggtcagatgcacggacctggtgcctgttctgaaaggaagtaggacagtgaaggtgtagatctggactgtcaatcagcattttctctaagtgacaggctgcatgcattgtgactacagccacaccaatttgtgcctgtgcacaggccaatcagatttggccaccagcctagggagattcagaataggaataacaggattgccccagcaggagtttcacatggaaccatggaagacctctgacagaggcatggtctaccttcctgagctctagctgtggcgatggaagtggagtgtcagtcacttggaaagtggtaaatgatgctgaatgttccatcgacattcctttgagaagcatcagagatcatgccctcctggactggagagattgcttgcagaggctgctgggaaaccttctcagcagctagagccacaggaaatgtctccctaggaagaaagcttggaggtgggggcggggcatttccatcatttaagagggagctcctacctctggactccactctttttgatctgacacctagttctaagtgagatttgaaggctgttagaatacttccaaggtgattaatggatgttctgtaagacttcaagtccttgggtcatctcaggtagtggcagatagaggaaaagaagaatgataaacctatgctttccagtttgattttgatgtgcaattaacaatcaatttctttgatgccatcttacctaagatacttatggttcactaaaaatcccaactcgtttgtgtgtgggtgtgggttgttttgggggtatgaggtaaggctttccgtgtgcagtcacttgtcccagcaccatttggtaacaggaatgtcccttcagcctttgtcagagcatggtgctcccttcgtgtgggtctagctcttctctttggattctatacagaattctgtctgtaggtctaactgaaccccaacatcatactgtgttggttacaaaagtggaaatttctggtttcgttggacactcaattttgtcatatgttttttttttctggagactgtcttatgagagaatgttttactgagaacagacacatggtgtttttctggcagctgcccggaggaagggcatgtgatgtttggccagagtagaagcttgagagaacacatgatgtttggaaagggtctaagtataacccagcagacagtagatgataatgccgtgtggtattggttcgccttgccactctttatttattatttatcatgacttctgtcttaatcagggcttatatttctgcacaaaacatcatgaccaagaagcaagttggggaggaaagggtttattcagcttacccttccacattgctgttcatcaccaatggaagtcaggacagaaagtcacatagggtagcaacttggaggcaggaatggatgtagaagccatggaggattgctgcttactggcttgcttcccctggcttgctcagcttgctttcttatagaacccaagactaccagcccagggatggcaccacccacaataggccctcccacccttgatcactaattgagaaaatgccttacagctggatctcatggaggcatttcctcaagagaggctcctttctctgtaataactccagcttgtgtcaagttgacatacaagaccagccagaacaacttcatagtgagaaatgcaccaaagaatgtctgatggtgttctagaggcttcttgtcacttccccagactcgggccagttgaccgaaccacaaggtttctactggatcaaattgctgttgctgattcataaatggtgcttgctaggagatcaagcgaacactgctgattcatgtgaactgatctacggatatcctgacaatgcagattggattttctccaaagaactatttttaaacaggtccacatcctccttcaccctattaacctttcctttccactacctctggtgggtggtgggctagaagggaggttaaagcatttaagtacacttattatagtagattttgaaaaatagaatcctacaggtgactgctatttaactatcattaatgaagtcaaggagtggcattcaccagctaaagaaaagaggtgagggtaagatgaagcagcttcgggtccagtacctagtggtgctcagaatgggatgctgaggtccagtttacatttaatgaaacgaaagtccaaaagacttgagggattggcccacagatgtagtgcataatgaataaagatctagaatccagcttcctttccattggaacctgatcaatagtcaaataatgatgttaatataatgagttgacttttccttttagttcctgtaccagccatgttctttgaggtatttcgtgtaaccctatatgtatttctacaacgcagtatagtgtattgtttatgttacaagtgaggaagctgaggcacagagagattaaacgattatgcaatgttgtgtagttactaggttgctgggataaaatgtaaaccgagctggggttgggggtgaccaagttatgtgtattgtaaagcaaccgttttctgtgtggttcttaggcccagtgtgttggcagcatttggggcttgttgggaattctaagttcacacccaaggtgatttccacggggtaaagcatctgagaacagtgatggaagccatcctccagcagtctctgcttgcagggagccactctgatggaggtgtgtgtgtgtgtgtgtgcgcacgtgcattttactggttcttcttgtgaacattctcagtctgcagaggaaggccctgtgggtgcagaggattgcatcccactgaggttaaggggaagggcttgggatggggatttgtcagacaatggcacaagggatcctatctggtatgtctcttcttccctcttttgtaaagtcacaatgacaggaatgcttacctccttctgggctgtcaggacaaaggaaacaaaagggaatgaatgaccttggcatgaggtatggcccataaaatatagacatcaaattatatatgtgtgtgtgtatgtatatgtatatatgtataaaatatgtagatatatgtttgtgtctctggagtatccatgtgagcatgtgtgtgtatgtgaatgtctgtttgtgtgaatcaggtgtagtatccatgtgagcatgtgtgtatgtgtgtatgtgtgtatgtgtaatattcatgtgagcatgtgtgtgtgcaaatgtgtctgtggtgtctgatgtctgtgtgaaagtgtgtgtacatgtgtatttgcatgtgagtgtgaatgtgtgtagtatctatgtgaatgagtgtgcatgcccgggcttgtggtctgtgtacatgccatggatcaacctctagtatctcctattttgcttcatatgatgttttgagacagggtctctcactgaacctggagctcaccaattcagccagcctggacagctggcaaactacagggagttgctcttctctgtcttcctggtgctgtgattataaatgtgagccaccatgcctggcttttacatgtgtgacgggagatctaaactcaagtcattgtgcttgcctggcaaaagtaacattgaaacatctctccagtttccaagttatatttttttatcactctgatttaatttcacatagacactactagatcataggccttccaaggaatgctggtttgaatttctgcctgtcagtttccagatatgatacagagatgcccggttacatttaaatggcagataaataagcttttttttttgtatactcatgtagtatttgggatatatttaagatatttgttgccattagtatataggatttaaatctgagttccctgcagttgaatatctatcctgctaagaaactttccagtaacaggatcctggtagtgagtaggaattcctgtcttttatgtcctactagctagatgctttgtgtcattttggaagagggaacttcaactgagaatatgccccactggattgacttgtgggcaaaccagtgggacattttcttgactgatgattgatgtgggagggggctcactgtgggtggtaccatccttgagcttcttacaacaccttagtgttgtaagaaagcagactgagcaagccagaaggagctgttcagtaagcagcccccctccatggcttccacaccagctcctgcctccacgtttatgccttgtttgagtttctgccctgatttcctttaatgataaacagcagtatggaagcataagccaaaccctttccttcccaagttgctcttggtcatggtgttttatcacagcaggtgaaagcttaaccaagacagtgaggtacagaatatatttatgctgcctataaagtcttggcatggcagacactcacacctgcctctgtattcagtcctagataatggaagcacagaggcagagaggaacagggtgattcagggacctgtaaaaagggactccagtttggctgactccagctggaaaacaaaagcccagagttgggctgctttgttctgagaggacgggaggcaaaaggaaatcaacaaaaacaagcctcagacacatctgaatgcctgagcgtttatttagccctcggaaatgccttaatgtgggactagatgcttggctttataaatctgtaattacaagtagcttgcatcgcagtgattataaaattgctctctgtttatttaggagctaaatggtattaattggagagtggaaaagtgatgttacttaattaacctgagatggtagcctctgttgaaaacctacaactaccagtgcaggtgagtgagtgaccctgggcagccatgttctgctactgaatgggcttttaaaggcatcagtggttgatggctcagtggatgctcctggtgagaagaaggctggtgactgactgggctgtgaagctggaaagagcaatatttgcataggtgacaatttggaaaggcatatcccagaaagaaaagaaaggcactctctttctctctcctgtaagctttttattcattttattcataaatactccaaaagaaaggtacagtataacatacacaaaccagtaacatggtcacaccatgtgcaaataccacttattatacatgattgcataaactatatcttatacttttaattagttagttgactgattacaataattttgtatctatatgatgtgtgtgtgtgtgtgtgtgtgtgctcatactcacatgtgtacaaatgcatacttttgtgtgttacggtgaaggtcagaggctgagtattcccctcagccactctccaccgtgttcatcctcggagccagcgtctcttattgactctggggatcaccaattcatctagactggctggccagaaatctccagaggtcagcctgtgcctttccgcctgtgtccccacgtagcactgggcttacagagaagagctgccatgtctagcctttccataggtctttggatccagactcagattctcacgcctgccaaacaaacaaagtacttgacccattgtgccacccctccaccccagcttttcatacatgagatgggctgcagagtaagtaggtttgaggaagcagaaccatcataaaccagtaagggacgtattgcactgtggcataatcatggctgtgataccattaagtgttcagagttcctcagtctcccattgatagaattgtatgcagtctcccattgatagaattgtatgcagtctcccattgatagacttgtatgcagtctaccattgatagacttgtatgcagtctcccattgatagacttgtatgcagtctcccattgaaagacttgtatgcagtctcccattgatagacttgtatgcagtccaccattgatagacttgtatgcagtctcccattgacagacttgtatgcagtctacctttgacagacttgtatgaagtctaccattgatagacttgtatgcagtctacctctgatagacttgtatgcagtccaccattgatagaatccagtttctgtgacacatgactgtgttgttgacttagctctacaactaacaactttaagaaaattaaaaatttcttataggaatgtattgtatagtgtacataatccctctgtcctatttctatgccttcactccagaagggatttcttgccagccttcccttcgccccaggtccccattctaccaaccctgcaactctccatcccactgtcacagaacagggaggactaggaaggaacaccctaggctgcagctgcccaggggtcagagcaagaacagaagccaggaggagtgcggaggagagctaggcctttgtggtcccactgctctcttccctcctattcaaccagggatttcattcttcctgatgatttctttcttccttcctggaattgtcttacataattcaggccagtgaaggagccaagcttaatttgatggcatgaaaagaaatgcacctttgttttcttaaaaagaactaatgtttgctttgtctctaatttatgaacacaataaacagagctctagtggaaggagacagcaaacgcgccaggaaaaggacgatgtatttataacattatgattgtaacattagaaatgggcaaattaaaaccatccctcagcacaagggatgtgcgcatgtgtggagacccccatgcatgtgtctcagtgtcttctatggggttgttctcacaccgagcgtctcagtgatgggggattagatctgaagctgctgctgtatttaaagaatcatgtgttctcatgaatgagcaaaagcaaagcggaaagcctccaagcgtctggcttccggaggctttgtgatttgaaaatgtggtcctacgcctgcctcacagggcctcacgataaccagagacgttccaatgacagacagccttcaaatgttgagtggaacctctagaagttccactcatagctatggcaatagagagaaaatgagcacgttatttcaagagtcatgaagcaggatgtttttcatgaaagagagaaagagagagacagagacagagacagaaacagattgagaaagaaagtgagcgagacagagagcaagagagagctcaacacactcacacatacatgcagagacagagacagagagggtcaagtctaaggagaaaactgaattgtcagtggcattcagaaggcaactgggtggactgtatgaatattttgccccaaagctcacttgctttcctggaggggttgtgggtggatgcaggctgagggtattttaatttttggttaataagatgtttccacttgattaatagagaccttcagcttctctgctaagtgtggatagagcagagaggatggagggacttgaccaagccttgcaagcacgaggcatgtctgagtagtggggagtcctgcagagcagggcaggaagctgagctccaacagcacccagtctcctcagaccatattgctgctcttgcctgcatatataaaagtctaacacaggagaaaggccgtagtgtggaaagcagaggcagggtggggtaggactgtgtgcaggtggacccttgattgggctgtcttccaccagctaggcacaactttggtggcttggaaatagtagatgctcattgctcatagtgttggagaatggaaagaccaaagttgtagtactgtcacatttagcgtctggtaaggtttctctgtggttcagagagaacatcttcttgatgagttcccatgtagctgacaggctgtgggagttctctgtgttctcttttgtaagcggactaatctcattcatcaaagctccatctttgtggcctagtgacttcccagaggtctcacccctgacatcacacatagggtctcagcatttgaatcttggtcggcgggggtggggtggggaggggggagaggcatggtaaatttacagataccatgtaaaccagagctcagtagaaccaatttttgaaaagaaatgccaggtggttagacgatcgtagccgtgagctcagcacgggggcagacagatgaaagctttgtatcacagatccatcacgtggatgagctgagaggcagatgtcgggcagctgcttatcctggctaagtggtgttttccccattagtgccaacctctaaagattgctgagagctttaacaaggtgcaccaagcaaggacagagtagtgccagctagtattgctttcaactgtttctacacatttcccttttcaggtgtctcttgggtagtgtaatacagcggagagagaatgagattttgaggtgggatatttgggcctgaggtttcttagctccaggtctgcagggagagagcagagattgggtattgatgctcaagggtattgtgttaacaacttggctgtgaaaattaagtgtgacaatggaggtagaaatttccacagtctcaccaataggaaccaactaactggatcatgtgtgagtctccatttcttctttatgctcctggaatttctggtcacagagatgaatcacccttattataaggaaaagagtaaaagacgctgtgggtctgggataagtggtggggtattgttttgaattgtgaggcctaggaatagggatgatggtgcagtttgtgttctgaggcaagtgagagacagaactatatcactaattacaccatgataactgctattagtggggatgatctggataaatggaaaacaattaattgttcatctatacataagggatgtttaagtaatgttcactgtgtgccactgaaaaataaaagactctactctggggacttggttcagtgggtaaggcgcttgctgggcaaacaagaggacccaagtgtgggtgtttagaacctacagaaaagctgggtatggtggccccagcatgggagatgagagaagcagaagcaggtcctgggactcactggccagccagtcgagctgaaataagtggtcagctccaggttcagtgagaaatgctgtcaaaaaaaatatatatatataggtgaagacacccaaagtgcacaggttacccacctctggtatacatgtacatacaaatcacacacacacacacacacacacacacacgccccacataccacatataccacacaatacacatacagacaccacacattcacacacactcacacatgcactcacacacacactcacacacataaccccccccccccacacacacacaccaaccaaccaaataatcaattagccactgattgaaggtagcttttagatatctaataatcagatctcagatttaatagaatgtggtcacctcttgcccttggatcctggaattcagaggttctatattaagcaagatctgcccagctgtaataaaggttttccagtggctaggaatataaactcattctgggtttgggaagtcactgtttcttttcaaagtttctctacctgagaactaagccctccaggagtctttctccccatgaccacatgaggtctggctttgatgttgcagaaatatttctttagaagaaaagaagctcagaagagttagtgtcttccttaggtgttaaaaatagcaagcattcgaccttaggctgctgattaaaggatgttatttaaacaccctgaagcttgggccttttgatgatcaccatgaagactcttttgggcaaatatcatcaatgagtaatacatttatggaaggccattgtttgaaacatctcatttttgatcatttgttaattgtaacgggtgaattattactgtatagaggagagtccacataattccttgccaaagtgacaagtgaacacctttaaaagccaagaatggacataatgtgcctattgcacatgcccaagaaggaagaatcaagccacaatctggctgctgatgtatcacaatgggacacaaaggagccacatttgaacaaatatcagagaacaaatgaccaatattctaatgtcactgtcacaatgataaagaaatcctagagtcaataacccagggaaatgataaataaaatctatgtgtgatagtcaactgggccatgcatcagagagaatattctacagaggatgcatttttgacaaatgatgaattagaatacaatctttatttagacagacatattttatcaatgtcaaattttctgaactgatagcttcttttttaaaaaaataacatttttaggaaatacacgctgaagaagaaaacggcaaggtgtgatgtgcacacatctactcacagttggttcagaaaactcagaattcaagtgagcatgagtacagaggccacagaccaagtgaggtaaatgtcaagccagcattgtggcgtttagcaagcaacattgttactacttgctcattttggccaggtgtatagtgaggagcattgtagcgtttaggaagcaacattgttactatttgctcattttggccaggtttatagagaagagccagattagacagtggtgcagagtggacaacacacagtgtgcagctcaatgaagagaggatagtgagatcattcgcagctgcagacaaggtggatgagagcaaggctccagtggtttctaaagagatcagcacattaaacagaaatgttctattttgtgctgggacaatacaaacggtgacttgaggacaaagccctatctgtgaaacaccccagcgggtgccaatgtccattcacttagaggctttcactcaaaagttaagctcctaaataaaagactgtatgaacggcaagcagcatccaagtacctagctcaaacaacccaggaaagcattttcctgctggtccggccacatgggcacttgaagactgttttaggcatggtctaagggaggctgactataccttgagctgatagcagaactgtccatccgaagctgttttgcacaagagtccctacatggatctctggagtatgttgtgtgttaagatatgggaataaagcccaagctgcaatggagatcttaggatactagtgttgtaattttctctaagattaaaatctgttttggagacaagcttgctaatacacaggctgtgaagagggaggtgaaacaactgaatattttaagatgggattcttataggaagtaagccaacaggctattctaagcaaaacactccaaactacagtaactcaagtccaggaatcaaacactcaaaatagcctcaggaagtccatgaaacagatcatattcattaggttctctccctaagcatatataagcagtaagcaccacagagagacactctcagaccacctgggctttctagaagaggctccaaaggagctgaacactctggaataaacagcagctgatcagtgtggtctgaacaaagatcagccgagctgcctggtagtggctcagaccaactgagtcacctgtaatggacccacccaccttctgagcagcctgcaggttatgcagtacagccttgtttccgtttccatgagccatcacccatgctgggctttgctgttgctgtctttgagtcatttcttctcctttgagtaacctctctgtcatagtcctgtacgtaatcccaatgaaactcactggttcaccaagttagactttggtgctgtactggctggttttgtgtgtcaacttgacacaagctagagttatcacagaggaaggagtctctcctgaggaaatgcctccatgagattcagctgtaaggcattttctcaattagtgatgaagggtgggagggccccttgtgggtggtgccattcctgggcaggtagtcttgggttatataagagaacaagctgagcaagccaggggaagcaagcctgtaagtaacatccctccatggcctctgcatcagctcctgctttctgacctgcttgagttccagtcctgacttcctttggtgatgaacagcagtgtggaagtgtaagctgaataaaccctttccttcccaacttgcttcttggtcatgatgtttacgaaggaatagaaactctgactaagacaggtggtatcggtactttagtctatcagtttcctatctagggggaggagacatttgtttatgtctccaggaacagtggagtttcacaccacagctagacatgccagaaatatgagaggtacactaaggaatacttccggttctgcatggagctagcctatgcgagaaaccacaggtactgacaatgtcagggacagggtggatgggctgctcgaggctgctggagcttagataataacatgtgccctggatgccagatatggatgtaggcattttcactatgagaatttgatcttgttttgatctaatcccatgctagcctctcacacctccttctgtaatggggatgttgactctgtgccactgtggaatgggagaacgtgccttgtttttctgatgctacaaggaagtgtgtgtgtgtgtgtgtgtgtgtgtgtgtgtgtgtgtgtagcttgtaggcagataagtgtcaaggagtctgaccctttggggacctgagttcctctaggaggttgagactgctgaagatggaaccttagtgtttcacaaattacgactctagatgacaataccaagtggctatcacccaggaagggtcacccttacagcacaccatgctgaagctcctgtctccccaaagccacatgcaagttccatggtagaccaagtgttgaaacaggagaaggccttatcctaaagtacttgggctgacaggtatcatggtggacagccaacacagtgagctcagctgaaaacagcagccatgccttagtccttcccagtgatatacaaataggagacagaagaggaggtgacacctcactagacgtccatttcccccagaacaacaccaggtgaaggtccagggcacactgtgtaggagccagtgaactgtgaaggagtctctggtgaaggcctcctttccatggctatgggactagagcaggaggaggcctgaggactgggagttggtacatcactagaagggagcaaaggtcttcatccaagttgctatcagaaggtcctggtggaggtatagctgggtatctaggcatgcagatgtgggtatgaggtggctggcccggtagaatcagagcccatggttgtagttcacactgaggcagttctctgagatactaaaatgtcaagagggacacgtcccccaagaaacacatcaggacatgccctgacattatgtcaagcatgaccacgcagggacttttttcttttttaacttggagatgtcttaatataatttctgaagaggaaatctgagctaagtctgagaggatgccctccaggagaggtgagtcggtcgttctgctcatgggagcgaagccctcttaggatgctgggattttgctctgagaatgcacatactcaagttcttctcagactctgagagccctccctgcaggcactgggtgatggatgagttgggcactttgtagcagtgcacccagccccagtggttgtgtgaatgcctcctgtcaccatgctttgaatctcccaacttccatgtaggatctgaggttggggaaggcttctaattgtgtcatgcaccagggtttaccacagagccaggacctccacctgcccttaagcctcttggtctgcacgcatggtgaggcataccacactgtggcgagctacaggagaatttcctatactttcccaagataccatttaaatttactccataacaagtgagccagatgtcaaggtgggaatttgattatagaactcataaggtagtgggcgacaaccacagagatgcctcattttccagggaaggaggtgtgtccttggtaactgtggaaagacatttcagaacaaagatatggggacacagagagccagtgttaaaattgggctatcaatcttgttcaatagctttgccacctcaggcaaagaactacagcaaggtgaaggcttccttgcttgtaattttgtggttttaacaggacttccttgccaggactgtggagaggattaagagaaatggtgctttaaaaatggggccatttggattgtcttagaaccttcagtgtgcagtagttgtaactataaattcttgtgcatgtgtgtttgcttatgcgcacacattatacatttgtacatataattcttctatataaatgtattttataatttcattcatgtatgctgttttatacatatatacacatataaaatatacatacatattttatgcatatatatatatatatatatgtctatacctatgcatatactggaagggtgtataagtctatctgtaaccaaattagaaagtaggttttggcagttaggtagaggagaaaacttgggcaggatttgaaagatattattcattgaaaatatggcataaagttagacaatcaagagggtaaaattgggctaattttttcttagaagacacatgtgtcacagaaatgtatttgttaggttcacgtgctgtggagtcaaagtaggcgcttctctaattttaacattttcagtgtctggatgtaaggaatggaaggttctcatggattatgttgctggccttgtgtgtgtgtgtgtgtgtgtatgtgtgtacgtatctctatgtgtgcatatgtatgtatatggatatctgtgtgtgtctgtttgtgtctatgtgtgtaaatgtctgtgtttgcatatgtgtatgtgtctgtgtgtgcaaatgtgtatgttctctgtgtgtgtgtgtatatgtgtgtgtgcatatgtgtgtatgtgtctgtgtgagttgatatgagtgaatatgtgtgtctgtgtgcgcaaatgtgtgtgtctgtgtgtgtatgtgtgagtgtgtctgtgtgtgtgcagatatgtataagtatccgtgtgtggataagtgtgtgcatgtgtatgtatatgtgtgtgtgtgtctgtgtgtgtttgtctgtctgtgtatgtatgtgtatgtgtggatatgtgtgtgtatgtatatgtgtgtgcaaatgtgtgtgtctgtgtgcatttgtctgtctgtgcgaatgtgtgcatgcatgtgcatgtgtgcatgtatgtgcatgtatgcgtgtgtgtatgtatatgtctgtgtgcatttgtctgtgtgtctatgtgtgcaaatgtgtttatgcatgtgaagtgtacatgtttgtgtgcatacatgtgtgtgcatgtgtgcatacatgtatgtgtgtgtgtgtgtgtgtgtgcgcacgtgttgggctgggacaaaggccacttccctctcagtttcctcttgtcagctctcccttctccctcactgtctcctctgtgctggtcctaagcctcactgctcatcactgtgttttcttgggtgagccttttgcctccttgatacttacctttattcatgagtttaaaagaaaataagaagaaaggtgctatgcagcctaaaagttcttccctgctgaaagcatctgtctgtgttcaaaaatgtgggtcatataaggatggacatggaaggaaaggggttctgactcacctctcaccgggcttgaggcctccatgcccgctacctacaggatacaaaggtcagcagtggtaaacaaaacaaaacaaaaaccaagcaaacaagaaaaccaccaacaagaaaacaacctggggctaccacactccatctgacaggtttctggcatgttccatggctggagtctccatctaatctctcaggcctgggtacaacgtccccacaccccttcctgggtagaaatgttctcttcccaccctgatccagcatctaccttttctggaacctgccctggagtgcttgagagtttcaagcaggcagaaagacttccacatgcagaacatttcataggaaactttctacaccaataatataaagggagaccacccatgagccatgtaaagatgggccatgtcatttggtagaaagtatctgcctcagaatgtttcccgggggctgtgacctgtgaatgatggacacccccgtttttcatatgctgtgggcttatctgggggacaacatggcatatgttaatctttaaaaccatcagtgtgaagatagactccaggacaagaggagctgtgaaggaggcagtgcgggctgtgcgatcccagacgctcggttcattccccagagtaaacagtctttacttccttggacgcttgctttcttgcctttccgcagtactgataactgacagcagagagtgagtttggtggactttgctacagacgagaagatgaaaaaaaaatcatttcaacatcgtttttttctgtttactctcttcctgtcatgtgtatgcttggctcgagcactaattttagagttcactgaatgtgacatttagttcaaagggggcactttggcaccacagatcctgatacaacctcccaagcccaggcctggtgcccgttactcatggctctgagcaaggaaaccaattactctgtggaatgtgagtgctggcatgtccactctgctcatggggacatcatttcacatctgctgacatgctgacctcaacgcttatgtttgggaatgtatttgagagtcttgactctctggttttgcctttttctgcctttctgaaagtgttctgagtcctgtctaagatgtttgtccagctgagaatccatcttgaaactggcctcggtcttctacacaaagctactatgtgcagagtggccagtcagtcatttgacctagagctccgataatgtgcaaagttgctcatcagacctgggaggatgtcctgtattcaccagcacttcacaccaagccccattgtttttcctgggacactgggatcccacaacaggaccattttggacttaacttctgggtggctgggctcaaattaaccatacctattctgtaatgagctgtctgcattttaatgtcacttaatattctaacaccacacagtgtactttttgttatattgtagtgccagggaaaggttgaacccccaaaacggacaggagccaatctgatgcaatcacagtagggcctttttatttgagctagcttgggtctctcatcgcactgccatgcaggatggttttgctgatgaggagccccaaatatctatgggtcaaggctttatagaagacagggggtagtggtatgaatgtacaagcgtctaattgggaagttactgtggactttaacataactggttggtgctgggtgtcatatcataaacttaacttctgttccactctactttggtggtcattaggcgaggggcgacttataacctgtgggtgcaggtttgttggggaataatctggagatgctggtcttgttggggtgtaacctggagactggagctaggcttgggttttgttgggaagtaacttggaaactaacgttaggaactggcagttagttcatctgagttcaaacttaggtcaggtcctctaaaacagagtctgaacttaaaagatttggcctctcaacatcaaggatttttatgcaagatagagattaaaaacaaaaaaaatattgcacaggactggaaagctcaggtgtttatgatgagggccttgtggtaagctctcattctaaagctggttgcccattaggtgtgggtcctaaaatagcgcaggtactgtttctgatgagcagttatatggtttatgtgcaggaaggagcagtggtggccagctttttcatgtaggggctagtaggactcctatgcgatacatgctctggctagcaggtacagtcatccctggtcatccacagctatatatattgtgtgtgtgagacaggaagtatggatgctcaggttgaggttggaggtctcttctgattctgccacttctcatcagggaaccaaacccaggtggttacaattgtgtagcaagtgcttgtacccactgtcccatctccccagcccccccccccattgctttcttagagtcatcacaagctatgactaggtagaggcatttcatcaatccaaaccctatgtccttcccagtgcagcactctgggcagcttcttcctatcgactgtaaccacatcctggtctgcacagtgtaatgataacaagacctgagcacccagacatcagcttgtctaaaatgtcaattgataatcgcactttgattttagtttttggtggcacatttcctgtagatgtcatgatgttattgaagtttattgtgtatggctgactgtacttgactgcttggatcatattttattccatagcagctctgactaggatttcttatggagctgactgtgagaacagggaaggccagagagtggctactttacctctgctggtgtagatgggagcgagggttctttgctttcacagcatcctctcataactatgacagccatagcctcttggaccataaaaaactttgccattcctcaagcagagaatattcaaaataaaggcttatctttcatgttaaatgttttatacctgtttaataacggaacttgaacttatctcatattggatcctcttttttacatttaattaaaaaatcttttttacttattcactttaatcctgctcactgccctactcccagtcattccctcccacaatcctttcctcctctcctctccccttctcctctgagtgggtaggggaccctgagtatctccctccctgtcacttcaagtctctctgaggctaggtgcatcctctaccactgaggtcagacaaggcagctcagctagaaaacatatcccacgtacagacagcagcttttgggatagcctctactccagttgtacaggacccacatgaaggccaagctgcacatctgctacatatgtttggttggcctaggtccagcccatgtatgttctttgtttggtggttcagactctttgagccccaagggtgcaggttagttgactctgttggtcttcctgtggagttccaataccctttgggcccacaatccttcctcctagccttccataagagtccccaagctccatccactgtttggctgtggtgtctatatctgcctgagtcagctgctgggtggagcttctcggaggacaacatgctcctgactgtaagcatgacagagtatcattaataatgtcacagacagatgctttctcatgggatgggtctcaagttgggctgcttttggttggccattccttcagtctctgcccccttccctgtgcctgcattacttgtagacaggataaattttgggttgaaaattttgtgggtgggttgatgtctctattgctccactggggttcctgtctggctacaggaggcctcttcaggttccatatcctcagcctagtgagtcacagctcaggtcatccccattgattcttgggctcctcccttatcccaggtctctgtcttgtcctggacgtgggtccactagatgatgctgggattcatatgttcctgaaatgaaaactcattctgcttggttcttcctatgaccctaagaagcaatatggcccagcgattgtcttgggcattgttatctattgggtggatttgaacctgtgtgagttgtctctgccagaacaagagggaaccagctatggggttctgtaaggaagatctgggctacagcagacgctcagctttggacacagctggctgctcttctctgaaagatactttatcattctgtgttgttgttgttgttgttttaatggcaaaggaacttgtctttgtttaaggaggagagatcttgggggcattgaggatcgctataaaggaaaatggagatgccaaaggccatgctgaggctgtgcttggcagtttgacaggtctgtaagatctggatttagaagaagtgtggtggtggtggtggtggtggtggtggtggtggtggtggtggtgtgtgtgtgtgtgtgtgtgtgtataaatgggtagatttatatatgtgtctctctctttctgtgtatatgtgagtgtatgtatggatatatgtgtctctgcacatttgtgtgtgtgtatataaatgtatggctatatgtgtctgtgtatgtatgtatgtatgtgtctctgtgtgattgtgaatatgaatgttaaaatgcaagtagagttaccagtgttaatattcataataaaagttaatgtatacagggtgctaatggtccaggctcccattttattattgacatcaatttaacactattggggaacttattaaatgtgaagtttctctgtacttgctatggaaataggagaaccactttcctctgttgttaattcagcttttaaaacagaaagtgttggcaagaccctggcagtaaacaattccaaacattccctgatcactgtggcagccaggaaaatgaatattaatgagaccatgtcctgccactggtacaaacgccccaggcttccttcctgactggggagggtacgactcactcatcagcttgccttggatgagaataattctactcagaggtgtcatcataggcattcttggggacatctttcattctttggatgccctgatgaagaacactggacgtgtaccaccagccctatcagtgactccctccttgcttttcagtgttcggtggtagagaggctgacgtatctgtaggacgggcagagctctcatagggaaacgattcatttttattgtttttattttgtttgtattggcacatgttcatggtatgcggcagtgagtttcataaggatatgtttatacggtatatcatacactttgctaccccaaccctgcttttctttcctgactcctctaacttccattagtcctctttgtctttctggacacttccaggtcaggtctgcatgatgactttatgtctctgtataaatagtaggatccacagatgagagagaatatgatgtttgttgaatctgagttcattttcttgatacaatgtttctcattttcctgaaaataacaatagttccatttgttttttatggatggaaaaaagtcctgtacatatatttataaatactgttttctgtatatttatatacactgttttctctctctgttcttctcttactagatagcaagtttggttctgttcctttgctggtgtgatcagggctacattaccatcaatataagcatctctgtgatatgctgcttggagttctctgggtgaacacctgggattctgttgtatcctggatctgtttttagtttattagggaactccaaaccgatttccacagggttgatctaatttacagtatctctagcagctggaagaggctcctttcaggagggaaatgagttttaaatgatcttaatttggctcctgatccagagctttggaaaaaccctttgacataagctggtgacctgctccatctcccctatgcagcccactcctccccaggatgtctgcttgtgagtgttggggatcctggattgtcatgatgggtgctactatgcttcattgggggtaagcttgggaattccaagcctgaacattcaaaccatcaccataaactttccagtacacgaactgtgttgttgatcccgagggtgttttaagggtgactgttggtccttttactccaaacagggtccctcaggctgaagacacaaattctctcttaccatctagtaagatattgtgtttgtgggtgtgattgggtctgaggggtgcttgctgaagttttgagccagtggttatagatggcagtgcctctagtaggcattagcttccattaggaaacacccttcgtgtgtgattgatgtccctggggcacaggtggtcccactactgagttgttccctaggattcatggtggcataaaggaaaaatcacttgaggattcatggtggcataaaggaaaatcaatcacttggggcttttttctaagtttcacagaagttccgtgttttctgtgtaacagaacatgcaagcaatcttctagagaaaggcttcgcatatctcaatatgaatagtgataatttactggttagagaagtttcccggtgtgtgtgtgtgtgtgtgtgtgtgtgtgtgtgagagagagagagagagagagagagagagagagagagagagagacagacagacagacagacagacagacagagacagagacagagacagagacagagacagagtcagagtcagagagacagagaagtcaatacctgtataacacagatcagaaagcttggtgaccacagggaaatctgacagagggtcttctaacacatagcaccatcatattcactagtctgggtccttggcaagtgtttggaacttggattcaacagagatgagtttgaatgcaggacttctgtctatctatctatctatctatctatctatctatctatctatctatctatctatcatctatctatctatctattgtctgtctgtctgtatatctatctattatctatctatctatctatctatctatctatctatctatctatctatctgtctgtctatcatctatcatctatctatctatctatctatctatctatctatctatctattatctatctattacctatctatctatctatctatctatctatctatctatctatctatctatctatcatctatctatctatctattatctatctatctatctatcatctatctatctatctatctatctatctatctatctattatctatctatctatctatctatctatctatctatctatctagtcagagtcatctgagaggagagagaggaagggaaagaaggacactgcttgactaccacactgaagcatctaaaatgctctacagggctggcaagaatccccatgtctgtcttaccccccgtgtctgtcttaccactgctgagaggatcttagggacacagagatgatgggtcaaagtatggtgtgtcagttatgctggagtgtgaggcactttcctgtgggtgccaccatacatttctggtagtttctatctctcaacataaagcagaaaattttccctcattgtcttgtgccatgtgctagctgtatcccgagcatcaaaggctgtggaagggaatgaggagagaaagtcagggtcccagcattgcatgttcagcctgcagcctgctcagctgatttgctcacaatggcaaagtgagatttagagctcagggctgttcccattttgtgttcccctatgcacactggtcaagatcacagactgtgggcagattgaggctacagctggctatttgagggtcttgtcactccagaatgctcatatcttcatcccttcctcttcagggggtcctcctttgactaggcactacacaggtctttctctgctgtgtttgccaagctggcagcaggcattgattttcatgttcctgtttagtgaaaatgaaaacttccatctccttttgactttatacagcagagttttgagtgctctcatctttgctcagtgagggggtctacctgcatctcaggagataatgcattgcacatgggggcacttaagcaaaactggtgctacacaaaggtaggcaaatttccctagctttctgcaacctggtttctatttcacacaagggtgacacaccttctattaaccactgtgattggagaatgtgctgtgaacaaggaagttctcagtatagaattttatatacatcagctacatctacattccacccgaatgaatggcatttttacaagttgaaaacccattaggttttggaagattcatgttatacaaccaaaaattaagacataggtgaaggtgtttgatcggaaaactcccttatcctctgtggggttaggaagatgtgaattaagtcttccccaaaagggtggaggtccggttggtcagggtacctgtgagcaaggcatatctaatttactagacatttgcaattactcataatgagcacagattgtttaagcctggggcttcactggttttggttttggtttctgagtttactactttgtgcctgtgttatgtcacagtccataaagctggtgaccaaactttttaaagtggaccttagagagacacctagactgtagttagtacagggcgagtgccagagcctaatgaggtgagactcaaagctgagtgcttctgtggaaaagacgggctcaataacagaatagacaattcagtcaagggcttgtctccagggcccatgcaacacgtaatatgattcagaagagaaaatcccattcctgaagtgcaaagaacagaacaaaaaggaaaaaaaatgattcatacatattgatctgaaaaattgtttgtggttgactgctgagaggggggaagagtgagtcgtgatgcagtcagagcgcttgctcactctttctcctttgtcaataataaatgtggagattaatgaggcagcctcagagccacagctacacatgtttcctaagggggcattgaggggaacctcgggctcattttccttttttattgcattgggcaggatgaaagccattttggggtgtcatgcccagatttcatttccatgcctgccaactgtgtaccatgaccaattctgaaatttctaagcttctatttttcctatgcacataaaagtaagtagtatttacctctgtaaactgtgaaggcagcataacaaactgcacatgagatataacaacagggctggaacgaaggctcagttgttaagagcatttgctgtcttgaagaggttggagttcagatccagtacccacatggggaggctcacaactgctggtaattccagctctgggaggtcttacaccatcttctgggctcagctcattcacttcacccctgtgcccacacacatgagtacacacacaggtgcatacacatgcacatatatttaaaaaataactttaaggaaaagaaatattgtaataagacacagatggttttaaaaaatagttataaccatcacaagtgtgttgctgtgttttgtgtaacaaattgctttatattcaggaaaaatatccacttaaaggcacttgcctggagagacagttactcaaattctacatgaaaacaactgaattaataaaagactgcatagaataacctaggtatgtggaagtcagaagagttcccatggatgttaactgactcaaacttaaaatgcacaaaagaattcacttctctttccagggagtcataaagctgtttgtgttcatgttttatcccgccctttgtaagctccttttgactggtgcaataaagaaggcaggtacctagcacatctctgcctattattcttgaccatggaacactgaggtaagtggtaggctcttggccttgggagaggacacaggtgacttaggtgacagccagaactctgaaaagtcttgtcctcagagatgacctagccttcaaatgggcaagatgatggcatttctgaggcaaaaatggagatcatttgagacagaaaatggcattggcttggtataccaagtcaattgtagaggaattttaatccccaatatagctgctctggcaagggatcacatccaaagatatgatactgcaggaaagcagacacaccctggattacagtatgatctggatggaatacagacacaccctaaatacacatcattaatccctaacaatgaagataaagttagtttatagaaggaatcagccatgtttgaaagtagcatctaattgaggggcagacaaagtgatgaatcagagaaagatttgacagaatgagtcagagataggatactctcaactcacatgagaacagcagagggagagagactacataaataacagggagagtgagaaaaatgtgtgtggtgtggtttggtttggtgtggtgtgtggtgtgtggtgtggcgggtgtatggcagtttcatagagacagttctacagagatgggttacagagagagcaatgtagaagacagaatgagccagaaaacaagaaggagccagaagattagaacagattgttaaagttagtatgaggccaagcagaacaattcagtcagaagccaaaggagccagattgaagcagtcagcttggaagattagattgtatggaggctagaagcttctaggcctaggccttgggatagttagaacagagaaggaaatgcccaagccaactattagcttgggtatggctgccatcttatcccatcatctgaggaaaaataaacaacatttacagtcaacattggtacaccaacatgtagacccagttagctgacaatatgttttcatgttcaacctcaccttctaagactgtatgaatgtggaactagatccttaccaagcctctagatgagaacacagcccaaccaccatctatctctgtgtcatcccagagccaggcctcatgggaaagcacaactcacagaaaatgaaagctaattatgcatgttattggagccatcaatttggtggcaacttactaggcactagtagacaactaacagatctttattaaaataatggtttgtggaggctgctgagatactcagtggctaagaatatctgctgctcttgcagaagatctgggttctgttcccatctgatttcacatggcatttgatgactccctgtccctccaggaccagggaacccatcaccctcttccagtctttgccggtggtacatacacatggtgtaaacacacatgcagacagacacttggagaaattaatctttaaatagtttagtttatcttttcaaggttgtccctaaaaacacaaggataaggattgtagcagtgttcagaacgtctaagtgtatttaaagaggagtgttatttaaaaaatgaatctggccattgccttgtgcctgatgcaaatggttttctgaaagatgatgtcttcaggtttgcctgagctggccacattgccaccactctgcctgtgagggaggcacttggagagtctgaccacttccctgggcccacagatgtcatgaactttttctctgcacaatgagaagctcttcttgaagaatcgatgtgtgttcattgtgcatggaactgggtttcatgaggatatttggcacgagtttataaggtactttgagcatatgccccacctatgtttcctttgcttctacttttctctctgtctctctgtctctctgtgtaatatgtgtgtgtgtgtatgtgtgtgtgtatatatatatatatatatatatatatatatatatatatatatatatatatgatcctataaatgatttttttcatagctctataaggttcaggaactaaaaacaagaggaatatacccaatatttgtctgagacaggcttaattagtctgatatgataatctccgtgtcacgcactttcctgcagataatagttttgttcatctttacaaccagataaaatcctgagtggatagacacaagattttcttcgattctaagtcactgcatctaggttagttctgtaacagagccgctatgaattgaactcttttaaatcacatagaggctgctggatctgttgcagtcgtacaacttgcaaattcttttgtatcagaacagcctccaaaatggatccaaagatccatttccaaatataagacacactataaaatataaaccaaatttgcttagcttatgacttcctgccccatagcaggatgtttgctggataatatttctatgtcattgccctccagtttgtgtgtgtagatagctcatctctccctgtaatgagcactttgtttagaggcaacatcttttctgcctcctggcaaagcccctgaggcaagaacctgggcagtctctagccttgtgcttgtttatagggtgagtcacttgctccaggctgccttccaggctgcctaaggcaggaacatggattctgggagaagtcatacagaattcttctttgttgtaagactctttcttcctgggcagactataagcccttgctttcaccactggtctctggtttccagtttcccatcactaatcctagtgcaaaaatataatgtagagagtcttcactaacttagaattatacatacagcatatacgtatacttatagggtgtgtgctattattcttgttcaaaaatcatttctaggaaaataattaggcagttaacatgtttaataaagtcatgaatgcaccaaagcctatgctatccaaaactcactttactattgttctgggcatccattgggaagcccattgacatccatgttctaagcatcttttgggaaacctgttgacacacatattataagcttctaaaatgaaactttacagatggtagcttttgcagctaaaattaattttcttgaggttctggagggttaaagtctgagactggatgccattagagttgactttcctaggccttcttgactgtggagatggtcaccttgtttctgtgtttttgcatggtctcctcctctttatgtctttgtccctctctccttctaaaaggacataaattagagtagatgaggatccacccttactaccatctataaagactatcaagacacactcaaattcagaggctctggaggctttaagatgtatagacataaaccagctcataattacctcccactcagaaccagtgtaattgagatcaacccagagggaagaagaacccctgggaatgtcaggaaagatggggacacaattgtttttagagacatggttgggtccctggggagtgggccatgcatggtatatggccattccccagagctgagatgaacagagagggagccacttttcctgagttcctcaaagacccaaggaggcagaggaaacagtttgccttttccttcagacatttctaacagggtaatgccctagaggaagcaaggaaaagcctcatgccattgtgatggatagactcttgcatgggatggacaacagagccagaacccagacaggactgctacatgccctagcacttgcacagggttacacagagaattaaattaaaggttctgtggaaaatggccagaaactaaacagtgaggaaggaatactttgtagtgaggcacaattatttttatctccttcaaaatcttgtgagtccttactcacaagtgttgctgaattcagaaatgggatgatatcatttaatgttcttctcaaaagtttgttttatacacttaatccctaggttcatgtgttgatggtatttggaggtggggccttggggagctatggctaaactatcattagtgttagctgaagtaatgagggaggcgctcacaagctggcattagtggcattataagaaaaggaagagagacttggactacccttctttctctgtcttaatggtgtatcctagcttcttttactgtggctgtgactgaaagctctgacaaaagcaacctaaggaatgtaaaaatcgatttggctcacaatccaaagttatagccattactgtgtgtgtgtgtgtgggggggtcacagatgtaggagctggagacagctggtgacactctaaacagaaaagagacagagagaaacagagatccatctgtgcaggcacctcagctcagctccctttcttctacaactaagatgggtaaaaataaaagaacatcatcaagatattgcccccgggcccccagtcagactctgaggcccatctcccatgtgagtctcgatcctgtcaaactggtaattaacagcaacaatcacagctccactccttgtcaagctgacaaccaaacacatcactttaaatccatagtcttctctaccccctatagccttatgaccatgttataaggtaaaatgcattcaaccccaacgttttttcttatctaggactttgtcataaagggacaatagcttgaaagctcttccacattccaggaacaaaacagttcaaagacctataaaccacatggtcagctttatcactacaatggccctacctcccagtaccaatttctgtcttgttatttttttcctgttactgtgataaattttttctgaaaaagcaacttgaggcagaaaagtctgattttagctcacagtttaaagttatcatccatcattgcaagggaaccacagtggcagaagcttgtgggagctggccacagctcatctgtagcaaagaggccaagatctacaggtgagtgggtgcatctcagctcccctttccacttatgcaatacagaatacccttcccagagaatggtatcttcccacaattaagatggttgttccatcaataggcataactgagacaattccccacaagcatacccagtggctcatatctcaggtgattccacattctttgaagctgaaagttaacactggctgtcatacaacacagaccctcttccatcctacaatacatttcaaagcctctggatgctatttttttgtgctgttggagttgtcacccttagtaactgtggtttaaacaagtttctaatctataaagtatctggactgtggtatttaggtatagtaacaagaactaccaacagaccaaagcctggaaattttaaagaaggaaagataaatgagatcaagtgaacagttactttactcctagatctctcagcatgcagaactgtgaaaagataaatgtctattgatcaagatcccaagtctatgacattctgtagacatagagcaagaaagaattagacacatggtacaaggatccctcagcagctgcctggttagccctactcaagtgtctaaggcagcaaacttggactgtaggtcccaaccaagtgtgttcctctctctgtatttggtaatagactttatctttgcttgatcaacagcttcaatgattgtttctctggagagttcattgctgcaagacctcagcatcagcttctgatggaaaggtcaggctttgggcaatggcttagagcagacttgtaagaagtatcatcaatgataagcaactcatttgccttccttggattcaccattacaggtggtaccatcttttcagaaaatgaaggagatgaatgctgcattcatctttgtgctcttcctcatccccacaatgcactggagcaaggtgtgaatgcccattgtgaaacatggtaccatggacagcgacataagggcagccagagggaacctgtcttagggttttaccattgggagcagacactatgactaaggcaactcttataagaacaacatttaactgggtttgacttacaggttcagagattaagtccattatcattaaggcaggaacatggcagcatccaggcaggcatggtgcaggaggatctgagagttctacatcttcatctgaagtctgctagaaaactgactgccttccatgtggttaggagaagggtattaaagcccaatcccacagtgatacacctactccaacaaggccacacctcctctaacaaggccaagtcttctaatagtgctactccctggaccaagcatatacaaaccatcacaggacatgagagggtggacagaggggatgtctgaatggtgaaattgtctgctgggatttgagaactgatgtcaaatttgttgctggccacatggatcttttgatttctttccacctgtcttgtgttataaaagggacatgaatcttccaaatatccaattattgactccttcacttctgagctttggatgtcaagacttggggttctttttaaaaggaagccactgtcattctgggagacccacttttagtgatgaatcttatgtaaaacaaatgttttatgaatgagagaaagtaagagaaaagaaaggaagacatgaagggggcagaatggaggaaagaaagagggaagtaaagggagtaagaactatgcaagaccctcttgtgtgattttataggaaccaggatacctttcactgtggccggcatacatctaacctaatgggatttcaataagtcagggtattctcagcagggttttaaaaaggcagttctatggttcagtgatgctcagggaactggtgtttcatgtctttctcccctgtcacccttggggttataggaatctttctccctatgtgggccagataattgctccaccacaaacatcatgtcctaaaaagactgtgtcttattatcagaaggtaaatgtggacaatgaggctccctgggatttctcagtggtactagaaaaaccctgctcctaagacccttcatgaaatccacactgtagctttcagtctatatagttcaagaggaaatgaatttctctcatctcttccaaagggctgaacgattacagcagaatgggatccctggttcagctcctgagatgtaggacacctgagaaagctagcttaggtagagtatatgttgcttagcaacaggaatattctgtgaagcccatcaccaggccatttgtcatgtaaacatcatgaaacatacttagacaaatagtgttattgagtgatataatttcgtgggaccgctgacctacacatcattgttatgttcatatgatatatgtatagcagaagtatgtgtcacatgactatgttctacaatgggaaatacagtgaggaatttccctacctccacccatccccagtttcatggagttacatgggttacctgggttttcaggtgtggagatagatagatataggtatagagatagagatagagatagagatagagatagagatagagatagagatagagatagagatagagagagagagagagagagatagagatagagatagagatagagatagagatagagatagagatagagacagagacatagatatagacatagatatagacatagattagatatagattagacatagattagatatagattagatatagatgacatagataagactatatagatacaaatacagatacagatctagatatataatttcaggagtaagggaggatgcctttagatgggtagatgtcttaccccttttagaaacagtataaaatcattaactattttgtctcttgcctagggagtgtcaaggcacctgtgtaggagaagttttcattggctactactgtgctgtctgtgtaagctccagggcaatagggagagcagttagacacatgcttcccataagccactatttaatgggaatcagtctgacccacacacaccctgggccacagtttgagtgttctctctgaggtgcacatgaggcacacccacatgttggtggactttagaggagtgcctttgagagatagtgagcaggatatgaggtcatagagtggggcctcatgatggaacagtgctgtctatgaaaaggaagagagatatgagctagtgcctttgttctggcctcactgtgtgacatcctctgttgtgatgcaggaagatgctggggctcacgccatggacctgcaacctcaaggaccacgagttacatgaacttcttgtattctttgtaaatagagcttcagatagtttgctatagctaccctagatgaatttaatcacactgttttcacagttaggataaaatgcgtaaatatgagtattaaaaatctaaaagtagggaaaggtttctcttcctctagatcttgaatatggagggaatgtattttctagaaatgatgcttaaacttttgttatagttcattggccagaacttgtgtgttataaacccacttctaacaaagaaaatgcaggaattgtagttttagcctccatcttggtccaagattggccagaaaagaacaaggaccaaaatgaaatgtagctatatacagtgtggtggtttgaatatgcttagcccagggtgtggcactattaggtgtggccttattgagtgtgaccttgataaatctggtgtgaccttgttggaggaaggcttggagaccctcttcctagctgccatgccagttttcttctagcgacctttagatgcagatgtagcactctcagggccttctctaacaccatgtctgtctggacactgtcatgcttcctgccttgatgataatggaccaaacctctgaacctgtaagctatcctcaattaaacgttttcccttataagagttgccttggtcatggtgtctgttcacagcaatggaaaccctgactaaaacatgcaggcagtcagcacttggttactgatttatttttcctgttaaattgcgatagatgtggtctttcagtggaggctataatttcagaaagttttagaaatgtattatgtttttccatagtaaaataatgcaaaattttactacctgttccagtttaattttgattatagtaaaattatatgaggaaaaaaattgaatattgatggtaagtgtagcaactcagtcttctgaaaatatccaggctggtgagagttcttcagggcactaggttttcaagaccaggagaacactgcatgtcctctcatgacaactgggttctgctgtctcagttcactaacccaaaattgagcaggcaattaaagtgtcattgctgtgtctataatacatgtctctttgtcaggctgaaattgctcacccattagagtattcacaccacaggtgctgggagtctgggtgctcttgtatgtcagtggccctcatccctcaatggcccccatccctcaatggcccccaggcccccatccctcaatggtccccatccctcagtgatgatcagacgtgtactcccactaccaggtatcatttattcatggaaagtcaggtatttaaggtatttcatgggaaggaataggaatagttttatactctctttgaagcactacaccatgagtatgtatgtatatacatatatgaaaactcaccagcttatttttctgtcattgttcagtttaaaaacaatgtcccaaacataacttgggtggttgagaagcaaatgagctgccacctgcttttgctgagaaactactatgtggttaactcatggtgccttacatttatctgtcttgtttcctgagttgtctccctgtaggtcgctgggcttggggacttcagtgcagctgtctctcattcccctctctttcctttaagctgacctctttttgacctccccatgtctagacacatattcagttgctatggccacaactgcttctcatctcaaactggcacccacagtattacatggtagaatatctgctcacagctgtccatggtacatgtatctagatgtcctgagctgtgtgctgatagaggagtcataggagtgagggtcaagcctaggcatgtaagagctgagtgaggtctagtccccgggtccccttatggtgatggtggctgcatcatctcccagtggggctctgtatatttatgccagggctccaggtgtgagcggtgacattgcttcatcgtttgaataatgacttttcctcagcaaaacacattggcaatgctttctgttatgtctatctggtcattgtcacatagctctgtttctaatatttataaagtgtggtttggtcttagctgagcatttaaaatgttgatatctaattagtatcactggatattatttgtgctcctcaaaactaagagttgagtagagatgatttctttgatatgtgtttcaatcccttccattattttcacattccacacttttggctgtctctaagatctgtgtattaaaggaattcaacatttagctattttgattcacccataaaaattacttctagcttcctggttcggttgctaccacacagacagctgtatcataccgacgctcctccactctggtgtactttagtttgtgtaacaaatggatggttttaagtaattgcttctgtgttgtctgcagaaaagttataaaggagaacataaattctgtagatatttagatccaacattgtgtagctatttcctccaacttaaacaacttcctcctggaggggatctcttaagacccaaggagtcaacaaaacttttaagagtcaggaagttcctgaaattacaaagttaaatacccctccctaaggttgtacaagtaggaagtgtttcgggagaacagactttgaagcacccattgtaaggcagggaggtccagatatgtcttagtgagtggtccctcacactagggtaatcttgtgtgtgatgctgccatccatgcttctgtaagacacctgtcacccttgctctgtcagtaaatccataaacccattgtttcaccaagtccactgtggtgggattgttcttttggtctgttgtgggtgctctgtctggggtaagtggactcgatcttgtctctccaggtaaagccatgggtatcttcactatcacctgatgctgttcacattgtgtgttcttgagaatccctctggtacttagcatgtctgaagttttgtcctcattattaaatataggcaatatgtacaagctgcatttctcacacaacctatcaaggacaaattctttcttatcctgtgaaagtcaattaattaaagtattccgctaagaagagcagatgtttcttgagtgttccccacttactctctggtgggaagtcttattctctattaagctatctggctttggctctagttcagccccacatgagtgtgtcttgctcccccctgctctggatgctaaatctttgtttagtgggccttctctggctcccttcctgctgcagaaaagagttgagttactgttatagcaaatgcatggtccaaaagtcctaaaagagttactgtctcatcctttacatgaaatgcttgccaactccagtttagataaaattcatgatggagtctgggatggaaatagatatttattaaactcattctattctccagttttcttgggatgagcaaagccctccatatgttttttgtcatgactgtaagtatcctttccaaacaactgatgcttcttgaagcagagcatagcgcttcctatccattcaacatgctttccaattgagcaaagagagaaatgtctaataacaccatgggcagggtagaagctcttaaagcacaacagagatgacatcagatggcgacaaaggcttcaggctttaaccctgcacccatcagaagagggacgcagaggtctgagtcccatgtgtggaagagcagcatgaacctcaccgggtcggagtgctgccttcactgtagaccagaggtggagctggtccacaacactcttcttccctctcccatgtgctggatggtcttcctctacttcatacaagctaaagtcatctgagaggaggaatcctcaattgagaaaaggtctagagtagatagggttataggcattttcctaattagtgatcattgggggagcgcccagccacttgtgggtgatgccatccctgggctggtggtcttgggttctataagaaagcaggctgagcaagccaagatgagcaagccatggggagcaagccagtaagcagcaccctccatggcctctgaatcatcacctgactccagattcctgtcctgtttaagttcctgtcctgacttcctttgatgatcaacagtgatattgaagtgtaagctaaataaacaatttcctcgctaagttgttttcggtcatggggcttcatcacggttacagaaacccagcccatgcaaccttggtctggctcctgcagcctggccacactgaggctctcagtttttttctgtcctgaaagaagagcagtgatttcttttgctactgcttttaagatggttccaatgaaaagccctaaaaccaaaatgagtttcctttccttaaaatcatttctaaattacccagcttgatgatcacacattatatattatgttagtataggcaaagcatatgcatctcaaggggggtctggcaagccaagacgtcccggcgacttccaccaccttgacagaagggacagatggttgggccaggaggctggaacctgttcaggttggagacgtaactcctacaagccactgcctgcagaaagaaagcctgtggagtgggcatggagccatggacttatagaggaactagcctgaaggatggtgtctgtctggaaagaactgggaaagataatcaggaggaagaacgggagagatggagagacactgcagggactatcttccagcctttaaccttgaaagtttatctaaagcagatctcagccctcgttcatagaaagttcaggtgtaggcttcctcccagtgaaggttctcattgtagtgagtgtgggttcatttggtgggtggagtgggggtggtctcactgtggtggatggagtaggggtgagcttagtgctgagtctttgacgattcagttactgaaataaactgaccttttaatgggtatacaaatgctgctgaagtcactaccagtggtccctgggatggaaggtgatgagctggggtatcctgtgtggcatcttttacttttatgtgtgctgtgagcgcatctagacctaggagccaagttcatatacagctgtgtagtaagagtatagctcagaggttgtagcatatttacatgtgtactggaatcttcacaagtgttgaggcctgaagaagggaacatcacaagtttcttacacatttttaacaaaataaatgcaggaaatctgtgaatgacattcagaatttagacatattgggggcatcattagacacactgggggcataacgtgcagtagatgataatagctacccaagtgaatttcttttatacaggttactacaactctagtgatgagatctgatgataaaaatctattttcttgcttggtaaccgagggatgtcccttctagaagaatcttcagagtgtatcacatgtagaagatggaccaaatggcccttacatcagttatacttcctcaggtagtttcagcttaaatggtcaactcagcaatcaacgatgggtcacctttaactcttctggagaactcggtgcttccttcccaaggatgctcctttatggccaaggagtcacgctctcagctgcttgcttagagaacttgtgtgagttcaaagcttcttcatgaagaagaatctcttcgtagcactgaaagagtggaagttatcagtggaagaaaatttaatttgacggataagaggtaatatcttgatttgagcaaggctgactatttcaggctaattgggcatgattcttgcctgtttttattggattgtaaatattttatatattcatactctgaacattttatctgtgatgtttctgatgcattttctgtctcgttttgtcctttaactttttttcatatttttgatgtatggatgtctcaatctttatgactttttccttcattatgtctcggaatcagaagtttgctttctcatctctagatcaaaaaaattttatgaaggtttttcattattgacagtttttggaatccactaggaatttgttttagagagcagtatgaagttggagtttcaattttttcctctctaaatatttaactagttattctactctccttcaaaaattactatttttctttttgtgatgaatttttcagccttcttttataatatatggattctcatttttatgctcagggctgctctacatgatcttttctgctccatttttctctctgctgagtgccgagttttcatcctgaataactgcttgctaagttactattacttaacggatattctcaatatctgatagactttgacactcatttttcaaatcaattatttttcaagatttcttttattattgatccagttccatttcaaaagtgcaaatcactgtaattaaactgcacatagttagcaaatcaggaggaggctccttaggaagagaagagggtagtgggcatggacatgacagaataccttatagatgcttacagaattgttaaagaatacttttcagaaaaggtgtcctagcacagggcatttaaaaactataacataaatatttttatcaccaaaaaaagactttgttgggttgaatgtgtaatttggagaatggacatctctgttatatcgagtcttcttacctaggaagatgaaagtccatattatggtagtccatgaagtttaaagtgtttcctcatatgggctctgaacagtctttcttatgttacaatggttagtatttatcaacttgcagggcatagaatcaccagggtgagaagccccttggaagatctacccaattatgtcaggacaactcatgggctgggagcccaggctggataaagagtaggaagcagattgaccgccaacattccttctctgtctcctgatggtggactgaatgctgagctgtctcacagccccgctaccatgctgtcccgctatggtggactgcaggccttcaaactgtcaatggaaataaagccctttctcac

SEQ ID NO: 203 - DNA, 3020 bp, Mus musculus
aataattatctcttttaattttaatttacatactgtaaaaccattaggccttgtaagtttccaggcagaccttacacaaaacataaaacagcctttataagttatgtagcaggtagagtttttttttttttttttaaagatttatttatttattatatgtaagtacactgtagctgtcttcagacactccagaagagggcgccagatctcgttacggatggttgtgagccaccatgtggttgctgggatttgaactccagaccttcggaagagcagtcgggtgctcttacccactgagccatctcaccagcccgagtttttttttttttataatcattactaaatttatatgaacatcatctaaaattttggagagggttccgttaaaactgtgttgttgtgcattaagagattttatacaaagggtctcttttatccttttcctatctgagcatcctatcagctggctttaatacgtacatcttatgaagtaaacaagagaagcttctattgggaatagctcacctcttaccggttctcaagagaccatgatgtcttttttcctggggtgttttgttgttttctttctctgtcacagagtcagggagccaccttgatctaggaaggtggccttggggaaactttgaaataacatgcttgggtctgaagtaggcaggccaaatcccatttccagagcatgctttgcggcgaagttaaatagctagtgacaactttccagtattatcaacacccaaagacacggactgaactcagtgatctacatctccataagcagtttgtgtgttctgtagatggatgaagacaacctgaaaagcctaataagtagctgataaatagaaataaaagcaagaaaatgcaggcttggtggggcggaaacaaaagccagactaaaggcttaaggtaaaaatgccccccaaacaaaaataccaccctggggggggggggggcaccgtctaggagacccaggagaaacagtgggcattaggacccggttgtaagtggaagctgagtggctggcggggaggaaacgagttaaaatgagcttgggcggggcaaagtttacgtgtgggcggggcctccagccatttgctcgttcatttatgaaagttgtctaggtctgcgagaaagtcaaacattcccaattggggcaaacagtggccaacatcgagggagtaatgcggacagattggagtggataattggatgcgtttggtgggtcggagcttgctaagacagagctttagagcccgtttaaacaatttggtttaaatttgaaacaacaggcaggtctagtggaatgtcttaccctgcagcctgaggcattccccaggatttagggaaagaaggaaatgaacccaagtgttgagggtgggaggggggaccggggctatcccatgctcataagattcagcagagtccgcacaattaaacgtaggaggttccccaaacctctaaggctttgtgatccagaggacaagctcctgacgcatccaggagtcctgtcagggcacctctgagtcagaccctgatggatggttgaataccttgtcctgcagaattctgacgcgtgggtggcagcgatcaaactgtgaacggactctcagcttggagatcagagagtctgggaggaagaggtcagaagaagggattgaggaagatggatggagaggacagggaagagaggactggccaagctgggtttacacagcaccgataaagccccagggcctgaagatctgtccgtaggcttacagtacccatggaggcagaggccacaaaggacctgaggtgtcaggtcagattggtggcttttatattgagcttaggtgtccatgccagaaaccagggtctggggttgtgggactgggccgggaagaggggtgggggcgggacagaacgggactgggaaaggaacgctctctgtcgaaggacataagaaaatctgttccaggacagccagggctatacagagaaaccctgtctcgaaaaaccaaaaaaaaaaaaaatctgttaacaccagaagtaagaaaacccggcagagaggccgacagactccgttcagagcctcagaacactttactggaacagcaaggggcctcaacctttccctgggactaaagctgagtgtatttacagaggttgggggggacctgttcgcataccaggaagttacagctctctttttgtgtgtgatttgactgggaacagcttgggctgtttgccagataacacatcttgtttctgcaggtggagctgaacagtcagactggggccaagcatctcttcatggctggggctactgcccaggacagctcactccagtcctaaggacaggaggctactaaacaatgctagcaagtgctctaacgctgaactgagctacacaccccagcccttttgttccttctgcctccacaaattaagacactggtcaagctgccttgcctcaattcatagggaaataacaaccgcccgggccagaggtatttgcgaataagtgaaatctatttaaaggactggagagagcagggagcagggatgtgtcccgcttgctggttctctctctctctctccctcccatcctccttctccctccctccctcctcggagttatctcatccagacaaagaacctttccagccttgggctcagcatggtgactatgttactttattatctcccaaaacctgcttggctgctctcacctgttagggtacctggctcattcacctcccatcagcctctggggggttgggggggttgtgtctgtttccttgggaagcaggtggccatctttctgtttcctctgagaggggcaatttcactttgtgggagcgtgggtcttctttccaaatccatatgggtcttctttccaaatctcatgggtcttggagccacagaacttcaccatcttagcctgtgctccagagaggctgggctccggttatgaacaacctcgtctgacaactctcttttccgcctcaccccacagtccctct

SEQ ID NO: 204 - DNA, 4393 bp, Mus musculus
agggtatgaacaacaatttatttataacgttagggtatgatgttaatattgaagttgactattacacatattcattacgtttgatcgttcactgtctatatctggggagatatcccacgagcttaacatgatggagcattctcagcaactgacagtgccaacctccatctccaaagactcaagtcctgtggtagctgacgtctcactcactgtgttgcagcatgcatgggctaagtcagtgcaacaaggaggtagagcgtacgtgaacaccctagaggtgtggatttgccatcccaattccttcacactcgatgacgtaagtgtccttagtggcatcttcttcctcttctgatttcttcacggtaaatttggcctgaaaatggaacagtagtaagtgaatacacatgagaggacagagggcgatcctaggatggaagttaaggagacagagttaatatcaaacccatctgaaaaaggtatacacataaaaatcaagagatacgtgaagaaatgcaacccttctttcatgctgggatcactgttgtggagtttgtcaggacagagaatcaggctccactccacgcccactgactggggacaggggacatgtgggagcaggggacatgtgggacaggggacatgtgcagccaagtcagatgtagattctgaagcattgcctgttgctggcgaaaaggcatcatttctcttcccttttgtttttctaaaacatgtatctgaaccatttacctgtcaggtatgacattatttgctctcattaaatttttcctgccaatttaattctctaaatacataattcaggaagcatgctcagaaagggtaggtagggcggaggagtggcggtgactaatgcccttcagcaccgagcctaacactgtagttctcacttattagctaaagtagctctgaaatatgtgatctttgtcgatgctctggaagtgccattttaaaggcaaaggctgatcctttcaacaaaataatttaagtcaaaacaactacataggtttaagattctgagaaagggatttcaagtgtgccttagcttctaggagtctctaaagtacaatctgacaccattattctgtggccttcctgaccagcagtggtcacaagctttcaatttccatacatggaacagtgcgccgtgtaagtggacatctcaaaatcactgtgccatgacaaaccagaacacagagcaaaagaaccaaactcctgtatagttatttgtctgcagtttcaaattacaaacatgaaaatataaaacacaagcaggagactgggagccatttcacgtttatgcttaggcctactgagggagcctaaaagatggtccagctgaagtctctgatttttacagatgagctatttgtaatgaagcacagaaaataaagatactatggcataagtcacccagcaaagtacaacaaagagccaggtgtaggtggtacagacctgtaagcccagcatgcacagggctgaggtagaaaaatcttgagtttgaagccagcctagactacacttagtaagaccccttttcagctactcccctgcctctgacctacatacacagttaaataagaaacaagggtcataaccccagttcaggaaactttctgttgtgtactctcttcaagtaatatgtaagtggctacaaatatacaaagtcctgtaaaactgtaggctacaatgaataaagctttgtaccaattagcaaggacgctaatctatgagagagaaaacaactgtaaacacagcataagtagaaatgaaagtaactgaagggggctgaaaggacggctaagcacttaagagcactggctgttcttacagagaacccagatccaatcccagcacctacacggaggctcacaatcacttacaactccagttccaggggagtagacattctcttctggcttttcagagaaccaggcacaaatatggtacacagacataaatgtaggcaaaccattcatacatataaaataaaatagaaataaatgtaaaaataatagggggctggagagatggcttagtggttaagagcaccgactgctcttccagaggacctgagttcaattcctacaaccacactgtagctcatgagcatctgtaatgggatctgatgccctcttctggtgtgtcagaagagactgacagtgtactcacatacataaaataagtaaatcttaaaaataataataggacggagctcattgaaagcatggttgcccgacacacaaaaatcattggtttgatttcccagggcaataaacaacaacaacaacagcaacaacggtaaaacagtcaattcacgcctgtcttggatgtaatctacctttgattctcatcaggtttcctgatttaagcaagaccttcccatttcttatcccaacagcaactaagaagagcagaggctgtgaacgttcagtgcagagggagaagcaggcagagggagaagcaggcagagggagaagcaggcagaggctctgtgtgagccaaggctgtggtgcttaagctctcctcagccagtgaatcacttttgtcgagagaaggagtgaggagggcatttgagacagggtcttgccatagagcactggctggcgttgatcccctgaacccaggagcccccatcctcctgcttctacctcccaagcaacagaagataagattgcacctccatgcctagctcattaagaatacagtcattctcattctctcccccctactccgaattagtccgcctgcctctgcctctcaagtgctgggtttaaaggttgcgccactatatgccttagggtgggtgtgtgtgtgtgtgtgtgtgtgtgtgtgtgtgtgtgtgtgtgtgtgtgtgtgtgtgtgtgtgtatgtcttttttacttgctttcttgttcattagaaaggtgtgagttggaagtgtgaggagcagagaaggatctagaagaagaggtagggaaaccatgatcagaatattttgtatgaaaaaattacttcaattgaaaaaatgaactgaaagaagacaactctgtagggactgtggtgtagttcttctgcactctttttcttgttcttcttgttctcaaagtctatcttacagcctaggttggcctgaaatgtgctacatagacagagctggcctctgactctcaagtgacaggtggcaggtaatcactgccatgcctcatgtgaattacttttataatctcaaagaaaaggcggcaaccccataaaacttgagtcacaatcttacaaaattatattagagaatacagtcattgtgtgtggtagctcctgctgcatctaagaactccctgtaggctgaggccagaggatcacaagttctcctggtctacccaggaagttcaaggccaggccaaaatatatactgaggccttgactagtaaaactaaactaaaaccatgcaaaagaataaaaatgaaattccaaaataaaaaatctgctacattttcagaaaagaagctgtatgtattagcagtaataagcagtgagaagcaatttgagaagaaaaagaacagtggctttactagctaaagggaacaatgtttacattttctatgaaaagattagcattaatctcacttgaaatttatattattattattgttgttgttgttattattttagaccagagtactaaagaaaaggtataaatgtattattattattttagaccagagtactgaagaaaaggtataaacgtgagctcacacactagtcaggcagaaccttcactgatgcacaggacttcaggcttccaaactgtcctgggatgctcaaaacccaggctgctagcccgaagcacaggcgtcaaagcatctactctctgctcgctctaatcgcccagtgtgtcaggagacagaagccgatgccgaggctgctgagagctcgccactcagggagcccaggagcagcgtcaacggtggttactgctgggttcctgtttattaacccagtcagtctctctaacaggacactcacctttgctagctgttcagcaaaatgtatagcagtctgcgtgtggagtgtgactgatcctgtttttattctggaaattccattggctagcgccatgaaaataatcagctatcaaaaaagaacaaagaagaaagaaaatctcaaaaatatgctaatattcagatttacaaattctacaaccactcacaggaaaatgctactagaaatcaaaatagcttttaaaagaaattaaaagaataattcctattttctttatgtttctagaagctttacacagtaacagagagtatgtatgtgttaaccacagtctgtggcttggtaaatgcttagccagactgacttcttttctttagttttttggtttttttgtttgtttggt

SEQ ID NO: 205 - DNA, 6916 bp, Mus musculus
agtttaatgtattttaatagcaaacttacaggaacagcacagaagactgacaacattaaaaacatgtacttgtatgtaggacaactcagttagaaaagtatagtgaatggatggaatctactgtgtgataaaaatgctacaaacaccatttagttgccgtcaataagaaatttacttattttaaaaaaatccaaatgctggcattgtccagaaaattttaacaggtttatttataattgttataaagttgaactgttgaaatgtgttcactgaaacattttgcttgcattaatgctttccatcttgcatttatattaaaaattcacacacaaatgaacgtggagaaacgccaatacctgattctgtcccctatgtttccactcgcaatcatatacttaggtacctttgaccccatggaaaaaatatctaacattcagaactactgataacaggaagaagaggaaaaaaaatttttttgagaatgaaatgtttcccctcatagtggactcttaagcacgttctccgcgtatgcggcgtgctagctggatatcttttggcataattgttacacgtttggcatggatagcacacagattggtatcttcaaaaaggccaaccagataggcctcacttgcctcctgcaacaataaaagagaaatgacttagtggtattgtttccaacagttaaaatacacttacacagtaaaaccctttaaagaatttatcaaacgctcacatagaaacctgtcaagatgcctaagttcacaaagttttctacagcctcacaaaacatcaagacacttcaatactccaaatgttaacacgctccctagtaaacaaatggcctcaaagaaaccaacaaatcctaacgtcctcatccttaccagaggaagtgtattggaactcatcactaaggcagcccaggatcccgcaatgggcctcacgtttaccttctgcttccactctggaatgctgaggattgaactcaggaccttgtcccaattggcttattaccagctccaaagtgctttcttccagatccttagcgtgtaatttgccgcactctatcaaatgttgaacccactgttacactgtgagatccttcagggtattttcttattcttcccaccacttaaacttgctagctatacgaaccacccattgacacccatcaagtcatgtgaaaaggaaaaaggacctccacaccttatggttgcccagggttcttttttttttggtggtattgttttttgttgttgttgttgttttgtttgttttttctttcaagacagggtttctctgtatagcccaggctgtcctggaactcactttgtagaccaggctggcctcaaaaatctgcctgcctctgcttcccgagtgctgggattaaaggtgtgcgccaccaccgcccagcggtggtagtgttttttgagacagttgagactcacatgaagcaggctagtccttcctgttcttaagcaactcttcctgcctgcagctcacaaatgctggccatcacttgttccctgggacccatgtgatgaagcagagagccatctcctgagcagcacacatgtgccaccaagtgacgtccgtttaaagccatttctagggtcctagagtaggagctgggagtacaatgtactgacatcccctttcaccagtgtttgttcccagtcaaactccaattctgcttttaaaaccaccaacaaaggaggtgtgagcaacacgacccaacacataaaaaatatacacacagggaaggtttcaaaaagggtgctcacttttttttttttggagacatggcctcttactgaaaccagagcctatcaattcagctaggccagacagagagcaagctccaaggatctgcctatctctgattccctggtgctgggactatagatcccgtgtccctctttttgtgtgcactgaggatctgaagtcaggtcctcatggttgtatggcagccactttaatgaatgaaccatcttcctaatctcaacctagtttgaggatctggaccaaccaggctaggcaggctaaccatcaacctctctattataggcaccaatggccatggacagctgtttgcatgagtgctagggactcaacccaggcctttatggttgaattagaagcacttacttacttacttcaagctatttctccaggctctatcttcatccttcaaggaatccttattaccttactataaaaagtctgcttcatgggggctaaagagatggctcagtggttaggagcaccaaatgcaatcccagaggtctgagttcaaatcccagcaatcacatggtggctcacaaccatctgtaacaggatctgattccttcttctggtgtgactgaagaaagctactgtgtactcataatacataaagaaaaatatctgcctcatgcaaaatttactatttctgtatgtttttaacacttgcgactcttacctatctttaagttctagctcaaagctattccataaagggctaagtaacactactcctatgatcttcctagtgaagtttctgatttccagtttcttggcatttcctctggccctactaaccagtcagcttttaatacctgtcagttagtttggcaagagagatctcattccatgtaatgctctgttcccatatagatgttctatactgcaaagccccaaatccccacaactcccttctaactaagcctttcacccatatcttacctatttcaaggatttaatattcaggggctcatttctgattttacaagtgggctaagaagtctagatagaaagcaagctggtgagatggcttggcaggcaggtgtagatccatcctgacagcctgaatctgatcttggaaaaccacatggtggaggattaagtccttatgtgcacaatctacacacacaattgtaaaaataacaaaactgtgctaggcacagcgtacagtagcctgctctcagtagtagcagcctcctgaagtccctcaggaatcaatcattctgtctcacccagcactggaataatgcaaacctagaatcaattcttctgtggagtgcagcagaaggttctaggccatcagcgaggccatgtgtctgagaccatttgcttttaagagttgtgttctctggaagcctatgggctggatcacagcacacgcatcctcagttctatttgcaaatattccttaacattaaaattgtaaagagcccagcatggtggagtacacagaagacagaagcagagaatctgagttcaagacaagcttgaatctacacggtaaaatcccgtctctaaagaaacggtctaattggtaactcaaaaatgtaattttgaaatggtagaagaaaaaagcatgttataacttgactttaatgtcccactgtctcaaactgtccatccttatcctaaaaacattttagctcaagctccctgatatttagggtaaaggttacattggtcaattccctgttattcctcatctccctgcctctttgaactatgtttattttttttctttagttgtaaagtcatcgccacaattctcgagacagggtttctctgtgtagtcctggctgtcctcgaactcagaaacccgctcgcctctgcctccccagtgctgggattaaaggcgtgcgccaccacacccggccatcaccacaattcttaacctacggtttccttttactgccaaccatgatctgaacatattaaatacaaaatgctaaacagattttttttttttttgaggctggttttacagtagtccagagtggtctttaagctcagtgatcctcctactataacctccctggtcctaggtgtgagcctttacttccaacacacattccatacattttaaactaacaggtcactatgccaggactggtggcacaggctagcaatccaaactatctatttaataaagctagagcagtagaactgctcgttcaagacgagatctgcctgaactaggtgaagccctgcctcacaaagttggccagcatggtgatgtatgtcttatccctgtgctcaagaggcaaaggcaaatctcttgagtttaggtcagtctggtctacaagttcaagaacaggcagactacatagaaagaccctgttgggggtggtggaaagccccaggaggtgggcacgcacgcctttaatcccagcacttggaaggcaaagacgaggatttcttagttctaggccagcctggtctacagagtgagttccaggacagccagggctacagagagaaaccctgtcttgaaaaaccaaaaagattaacttatagatagctcacaacttctatgtgttcattctagtctatgtctgccacatagttggctacctagctctccttagcttcgttcccctgactttcttggatttgggtgaatcttcctgacttacttttcccagaatttctgtctctccctctgccagatgtcccaccttctaaccctgcctcagctaattggccatcagttttattgacaagtgatgcttctacacagtgtagagattctctacagcccgtgcacactcgtgtgtgtgtgtgtgtgtgtgtgtacatgtgtgtacacatgcttgtttataagtgtgcaacatccatgattcatcctagtgcctccccaggggataccaatccccctggaactagttacaggtccttgtgagctgtctgatgtagacaggaattaaagtagggagcaggcttttaaccagaggcatctctccagttctgtgacaaggtttccctgtgcacaccccgccccccaccctcggtttgctgcccccctcccgcctggctatcctgaagttacactggcctgaaacttgagagtagcctgctcatgctgctcaaatgctggggtcatgaagcactaccacaccagtgtgtctaggaaagaaaggaccaccttatgcactccaggctaatcttgaactagctgtgtagtgcaaactggtgttgagtactaactctccttgccactcactattcatgtgagtgttggcactatagactagcatgccctatcatgtccaccttaaattgtgtaattctaaagccaaaaatagaataccttgtttttaagagaggtttactgcgtagcccaggctggctttgaatttacatcaacacccctgcctcaggctcacatgtgctggaattataaaagttttgagtcatcaggacagattaaaaagcactgtttagatagaaccctacctcatctgtttctatatcctttttccacaagcaaatgactatcttctttttttgtctctggtcctagggactaaacctaggatcttatatatgcaggagagaataggactaataggcagcaactctaacacttatagaactttaaccttccaactaacctatatcgctctcacaaatacaagaaaaaacttacaaggaagatcactgtgttctttcatttttacaaaaggatctcactatgtatatgttggcctggctagcctggaaacaagagacccatctgcttctacccccactcccgtgtgcaggattaaagacacctgccatgccagcaagattgctcttttcagagctatggtgtagctggttaagagagcttgcctagccaggcagcggtgaacacctttaaccctagcacctagaaggcagaaacaggagttaaggccagcctggtctacagagggagttccaggccagctagggctactgagaccctaccttggagggtaaggaggaaagctcgcctactatgcacatgcaatggatataatccaagcaccacataaagcagatatggagctcgcctgtaatcctagtcttcaggggcagagagaatagagttcaaagtcacccttaacgacatacctggctttcagagcataaacctaaataaactcaagtcattaaaaaaaaaatgcaggggacattaaaaaaatatatataaaagtgcatattttactcaaaatcatgcttacaggtgattatgtaactaaataatagcaacaatggatgtttactcattaataattttagaaatgttccagcccaaatgtttagtaatttcagtagacaaacaattattgaaagtaaggttaaaaaaaaaaagctggacttacaagtacagtgatgtgttaagtagagcctactaacagtaattagaaaacaaaagtagctcatcttgggaatcttagtaaatgcaaaaggaattgataagcagctattggaatggaaaaataaaattctaaaggaacagtatgggaagattttgatagttgaaatttcagtaatttcaacccatgcaaatttaatagatgccgattcaccaatcaaatgcagtttagcctaaccatagaaacagctcaaccaatcacacaccagagtagaatccacctatcaaatctttctcaaatataaaagcaaaagctaggcacagcaacagtaatctttgaaatcctccaatgatgacgtgcagtactgcccagcaagctgcattcctacttactctgcttctgacccgctgtgtctgcctgcgtgtgtgtgtctgtgtgacgggaacagatcctcagaattggagctgcagggagctgtcatgtgcttgctgggaattgaaccctgcacctcttatccagagtggtcactgcagccccaccttttcatagttgagataccaacactcgtcaagtctttttgtgttaatctcaactttaatactgttgtaagttattagtgcttccacatacaatcactccagatcactgttcccagcaccagaactgagactaaattcagcctgtgtaatgtgatctctatggttgccgccagcaagctccatgtgctcagcccccttcttcttcccagcagtcagtcccaggaccaccaccacttctgcgcatccttgaac

SEQ ID NO: 206 - DNA, 6343 bp, Mus musculus
ggtttgtaaggggaaagtgacaatactttatctgtactgactaagataattaaggattctggagctgtccgtccactcagcactggtagttgataaagtcagtcctttaaattggaagcaagttaagaaacttcccttctgttaatttaattcttctgatgcctgatgggcatgtttaattaccttttcaaaattctgtcattaccaccttgagcttctcatacttgagctgtctctactaaattacaggagtccacacctgggttgtggttctgaggcccaactgaaaggccttctgaacagctggtgggcttctatcaactgaggtctaaccccagccctgcagtttcatttgttaacagactattctcattgccaacaggacaaagcaggacctcataaggaaatctatccctatgtcatccaggaacttagaccaactttaaatgaattgggaatctccactccagaggagctgggccttgacaaagtgtaaactcccttcggtaagtagcagttcaaagagtggtgggctgatggcagcactgtcctgtgggtttttgtgtgtgtttgtgccacagcaacggtgtgaaattcagaagacatttttttctagtcagttttttcctatcatgtcagtccgagggcttcatctcaggttgtctggctctgcagcaagtgtctttacctgctcagccatcttgatcagctctgaaattactatcctgtctatgttgttctgactgctaggattacctggctttaaacttttctgattaggaaaaaaaggctaagtaccagtggtgtaaatgatgaagaggctacaaagtcaggcccttgtaaattgacggaggctgtattaaagcaggaagtgctccagggtggaggctgtttcctggggctgtagttccaaaggtcattttaaataaaatgtcttcattttagcactttactggctaattctgtgctttttttttttctctccctctctgcagatgggcttcctaaggacttaactgctattgctacttgattgaaacagttgcctggaaatgttttatttgaacaaattttcctttgagtatcaaaccatgtaatagtaacttggactttaataaagggaaatgagtttgaactgaaattaggtcttgtgatgttgtctgcattgagaagcagaggctgagctgggtatgggggcacagtcttagtcccagctcatgggtggcagagagagacaggtggatctcttgagtttgaggtcagccaagggtacataaagtcttaaagacagtcagcaaggtgatgtggagaaaagtgctgtgcagcagccagctcttctctgcctgctctcggcagcaccttgttagcttagacatcagagtatttgtctttgctgtgattggtttgcaggcattgtggttaaagactagagaaaggggcttactccttccttgaaagtactaagggaacagccctatttaacttcaggagctccataatcccagcaagcttctcactgcttcctgcttataggtctgtgggacagcagtacggctgtgttactccaacaggaaaacagtattaagttaaatgtagatgctgcggggagttttagtaagtttgatttttgttgttttaaagatgtacatcaaacttgttcaacgtgaacatcagcatgttcaacatttgttcaaccatgaaacctactatggtctagttttactctcacctttaataaaatttgattcccctaccagaagacctctcataccctggttaagaactagaattggggaactggtgagatggcttagcagttcagagcactggttgcttttccagaggtcctgagttcaattctcagcaaccatatggtggctctcaaccatctgtaatgggatcttctggtgtgtctgaagacaacgacagtgtactcatatacataaaataaataagtaagttaaaaaagaattggccagggggtgatggcacacacttttagtcccagtacttggaaagaagaggcaggtagacctctgagtttgaggccagcctggtctacagagcaatttccagacagtcagggctacacagagaaaccctgtctcaaaaaaaaaaaaaaaaaaaaaaaaggaagaaaagaaggaggaggaggaagaggagtaagaagaaaaaatattttaaaataaacccatgctgttgctttttagtttcctccagacactcttcatgttcctccagatattattttgatgactcatcccagggactcatgctgatgtcctgttcttagagaattctgtgtttgtaggaagaaacattaagaaatattaaacaactcctccctaatatagcaaatttagaagttctgtgaacatacattcaggtactatgaacataaaaggcattaaaggaagtgccattttagttaaagccttaagaattaggatagggtgctaatgctagaccctaaaggttacctaactgtcatctgtttggtctttttaccactggagcaggaagaaaggatttttgtttcctcgaagctctcctaaccctcatgcctctacttcccagcgctagaattataggtgtgtgccccgcacccatccaggctcttaatacagaatgcagacttattaaaatagtctgtttcctcacggccatggatggagccaaagagaaaacagttcatatctacctaccaggtgtataatagactgtgtataaggtgatgctgtaatggtcttcatgctacagacattgaatgcctcctgtaccagacatgccaacgctgacaacagagcaacaaacaggaaggaaagcagggagggagaccgagccgttggaccataacaagagtgaaactaatgggaaggatttccagtttgaagctgcaagggagaggtttcccagggaaggtccttagagtataaaataggctgaaggttgacttgtttagaagagggcatctttagactatagagcagtattctcgacttcctgatgcaggaatccccccacccccaaccatgaagttactttcattgctacttaataactgcaatgttgctgctgttatgaattgtaatgtaaatacctggttttggatggtcttaggcaacccacatgaaagggtcttttgacatacacccctccctaaggggttgtgagccacaggttgagcactgctgctgcagaccattcattagctgaggtagggtagggtagttttatacattcccacctaccaccagctcctgactttttccctcccaactccacatattttgaatcaactttgaagaatatatgctttcaggccagcaagatggctcagtgggcgagggtgctcgctctgaagcatgatggatgacctgagttcagtctccacagctacacaacaggagagcccaaatcgtgaaagttactctgactttcacacctgtgcacacaagttatctagcaaaaaaaaaaaaaaaaaggtataaaatacagttcatatttttgcatagtccagtccatcctataatctgcgtgtcttgcagttcactcatggtggcacttgtgtttagctccacactcaagaaacagagccatgtggaccactaagtccaaagccagcctggtctacatagttccgggccagacagcaacaaaaaaaccctctgtgctatgtggaattttaactatatccctctcaggagacatgatcctggctttttgttttgtatttcaagtcagggtttctctgtgtggccctggctgttctagaccaggctggcctcaaactcagatctgcgtgctctgcttcctgagcgctggaattgaaggtatttgccaccatatcagccatattgtaggccccccctcaagtttttttatttcgtttaaatgagtgtgtggagttcaggggaacaacttaaaagattcagttctctccactaagtaaatcaaactcaggtttggtttgtctggcatagtggcaaatgcctctggctgagacatcttgtagcttttcatatcttcctaccaggttaaggcaaacagtagaatgtagcagtaaggtaggaaatggggtttagattcagacctgtgttaaactcttatctaccaaatagcacttttcttgagacaaaattacaacttaacagtgagggtgaagattgtcaccaaggcgaaaatgttttactgccaagtacatcctgggtcctccactcccacccctaaaattaggcaacttcgtttttcattgtttccaaagagcagagttggaaggtttgtttataggccacacaggggcagaaacaaacgaatggattgggtgattactttgctctgcttagaagcctagggcagggagacaggaaacaaaactgaccaatacaggtaacttctggttatttttttctacaaaagaattacggcagccaggcagtggtggcccaggcctttaatctcagcacttgggaggcagaggcaggtggattcctgagtttgaggccagcctggtctacagtgtgttccagaacaacacaggctacaaagagaaaccctgtcttggggggggggggaagaattattattattattattattattattattattattattattgaggcatagagagctatgctgtcacaccgatgaaaccggtttggcatatctgattatttctttcacctgatttctcaggccagcttcagtccggtgacttggagttttgtggattagccagatcttgtggatactgatcttactccaacaaaattgtctcacttattttggaaatgaactcggcttcatgtgtgttaggcaacattcaacaactgagctgtattccccagctgaacaataaactgagttgtgtgtttctggaagtaagcaattccaacagctgggaatggtagtgtaaacctgcaattccagtacctgggaaaccaaagctcggggattgtgagtttaaggccagtctgagctacatagcgagattctgcctaaaaataaaaggagtccggcagatagtttggggtggaattcacaagatagcataggttttatcaaatctgattttttttttttcccaaagctctgatcccaaatgcttctttttctcctatgcagcattttttgttcttttgtccctgggtttcggctgtacaatattgacctaccctttgacaatgtgttagccatggaacagtctcgcgatatttggcagtttctacaaggatctggagcttatttccagccagacacaagcacatcccttgggggccagagtcaagagtcttgacacagccttgtaccctgccacatagactcaagagtgcactttcaccctgcttgctggtgtccaatttatttttgctactgcaggactttcgttcttttttttttttttttttttaagacaaggacttatagcccaggcttgtcatgaactcggcctccacctcccttgacctgagcttacaggtgtgcaccatcattcctaacttcccattttaccaccaaaagagggagggagagaagaggaaagagagagagggaaaaggagagggagggagggaggccttttgcatgccaggcaagaagtctatctctgggctatataattccagccccaaggttgtatttaagtgtggaaatatgcctaaagagagccagctgtggtgtatgcctttaatcccagcacttgggaggcagaggcaggcagatttctgagttcgaggccagcctggtctacagagtgagttctaggacagccagggggctacacagagaaaacctgcctcggaaaaaaacaaaaaacaaacaaaaaagagccagctgttgccaaggtctcggacaggcaagaaaccaaaaaccggtggcatttgtgtaggatgccgtgggtaaatcctgaccctcccaggcctgttttctagagaagagccctgtagccccttcatatgagcccgacccctcctgtattggtcttaaaggagccccggctgcggtgaaagaggcctgcaacgcgacttgggtcggcacaacccgctagcctaccatgtgtcattttacttgactacagactgaactgactttcctgcacatccacaggctcagacagacttcgggtctcagagtacctgaaaggcaagacctgggctggccagttcctgacgggtagggcggaaccttgatgctctctccgcagcaggcggccggaaagcgccaagggaaacccgcgcctgcgcgccgccatctttctaaaggcgtgttacgtcttgtcattcgttcttccccgcgccggtctggccactggcggagcggggcgggaccggtcatggcgacc

SEQ ID NO: 207 - DNA, 5482 bp, Mus musculus
ggttttacgagatagggtttctctgtgtagccctggtggctgtcctggaactcactttgtagaccaggctggcctcagaaatccgcctgcctctgcctcccaagtgctgggattaaaggcgtgcacaaccacgcctggctctgcttgtgggttttctagtcttattttatgtgcatccatttcttttccatgtatgtatatgtaccacacgcatgctggtgcccacagaggtcagaagagagcattggagccactggaattggagttatagacaattgtgatgcactgtgtgggtgctgagacttgaacctggatcttctgcaaaagcagccaacgttgttaactaaggaggcctggtgccaggcacaggaaaaaatatttagttgctcagcttctcactcagtctcgcacacacaaattatgagagaaaaacacatttctaatataagttcacacagcctttcttcctgtatatgaggttttaggacacacgccactgttgttttgtatttagaaacagtgccaccacagtcccccaggctggcctcctgagtgctgggtgacaggatgtgctaccacacctgaccaataactaacagtacagtagcaggacaatacagccacagttactgacaatcctgataaaggaggggaggttttcttttggttgttatttctcctttactgtgtgatattttgatacatggatttaaataacgatcaggtcagagtaactgggatatccattgtttcaaacagttaccatttctctttataagagctagcctgtcacatgccaggctccctggccctgacctctgactcccccacctcagcttccccactgctaagaccagcagcagcaacacttgcctgactgtactctttacttctgagaggaccagtctcaggaagtagaattcctcactgggatcgccactggttagcagtgttttgcttgccttttcattgggtgttttgatttgagacagggtctccccacatagcccaggctggcccaggactggcaaatcttcctacttcaggctccctgtgctaggattacaggcacgatccaccacacccaagctgtgcattttgaactaaaaatacctggtcagtctagagccagccaatccaagagccagctttaacggggtgtcatcctgcaatagcaatggagggggactagcaccgcactgtccacccaacatgtctgagcttacatagcatgatcagagcacctggctcccactctgctacatacagcagacagacagacagacagacagacagagatgcctttcacactcaaaacatcagggacattctgaaacctgaagtcacaccaggactttctagcttccctcatcccaggaagtcctatatacaggtgtcgcaggcctttaagataaatgtcactttcagatctagaaatggctcctggccaaggcaagccgactttgaccagccacatgcgggagcagccgctctcaggcgcaagtccagaatgcttacagctgagcagatgatcactctctgagcatgcccaacccatacagacacacacacagcacacatgcacacacccacagcgcccacacatcaccgctgcactccagacctgataacgactgccagccaacccttgcaggattaccctggggaatacacactgaggccacaaaggtttatgtaggttaagttagctagtctctaggcaacccatactgccccccacccccacctccatatacagagatagagaaggtcggctaggcaaggtataatgtctttaatctcagaattaggagggcagaggcaagcagatctctatgagtctgaggtcagtatggtctacacaggccagttccaggacagccagggttacatagttagaccctgctaggagagacggagagaagagaagggaaacaagggggtatgtgtatggtgtggttctgtgctctaatacggacccgggatgtgctttacatttttatactgcacataaactgtgtgcggggagggaagtaggctgtagctcggttggcagcgcgctctcccagcacctaaagcctcgagtttgacaacccccacccaacgcccccagcaccacctaacaggttgtggtggtgcacacgtacgaccccagaccttgggggatgaaaagagcatgctcgttctgagaagagctgagggaaattcaggtctcagcagagagagcagggtcagcaaccacacaggtcatccccacctgaggctgcaacacaaagtcctgcctctagggagagcaacagggccagattcctaaacacacatacacatggacaaaaggcacgtcaaggctagcgtctgcttacctggcagaaagacttcatcttgtccagaaccctgttcacctccggcatcacatctttgccgtccaccttgatgggtgtgttggaccggttccgaagggccacatgcagcaccgcccgattctagaaatgaaagagacaatgaggagcacggtagaccctagagctagactggtcctagttggggaaggtccagtgtaaggcagtcctctgcacaggacaaacaggtccaggcatccattaacatcaccgtcttgtatagagggcctgggagggaaagccattctgggactctgaggataggcaatcctgtgcgcccccttcccccttgtatgctgtgaacactcagaagcagatacagaaggacctgaacaaacccctaagggcctgaaggacccagggcatgaaaggcctgactgaagatgagcaatgaatgtatagtggtgacgatacagatcagagatgagcagcaagctccttcagtcataaactcagccctcctgaggagagcgcttcttgtttctggcaccttctaaaaatgtcacaaggcctcaggatgtgaagcaagacagggaacagaaggctcccctcaccaaacagtctcaccactgccacaaactaaaccagaacagaggtcttcaacaggtgccaagcagctcacctggccacaagggcaagagagcccaggcagctaaagacaatagcaatgggaaggaagcaggtgcaaaggtcccaaatggtcaggaaagcgacttcaatctagacagaggttcctgtgtgtgggagggtctgagggtagcccatctagtctcacccttcccatgttcctcaaacaaatgcacatccccccactcaaaggaagcccccctcgactgtggcctccctcatatcacacaagcccagccgtgcaagatcagctgcttcccattgcacctctgacctccaagccttagattcctcacatgtaaaaagactcagggctgaagagatggctcagcagttaagagcacatacttgccaggtggtggcacacgcctttagtcccagcactcgggaggcagaggcaagaggctctcttatgagttcgaggccagcctggtcagggctacacagagaaaccctgtctcaaaagccaaccaaccaaccaaaatactcttctaaaaagccggggttggattcccagtacacacactgggtggctcccaaccatctctaactgaagttccgggagaatctgacagctctgtaggcacctgtacttatgtacacacacccacacactcataattaaaaggaaaaaaatatcaacactgagaattctcagtgcagagtgtctcctatgcctgcaggcttccccaccaagtcagggccagggtttcccaaccgctgtcatactctcacctcttattcattccactgtcaaagaaactaagggctttggtgacatgatttttcttgtcactagaacaacctgtagcaaggatccatcagagtatcaaggttgaagttgtccaagaaaatgtctcagccatgtctcagccagccttaagcaaatccctcccttcaggcttgggttgtgcccctccctggacaccaggaactgtgccaatttgattgccaagtccaggctgccagtctcagagaaatcacaccccaaagctctgcaacctctcttgcccccaaagaaaagcctttagcaccttcgtgaggcaaaagcattgcttaagagcaagggtgaagacacagggcgatgctgataacggtcggcaaagaggaggaagagggggggggggcggcgggtgtaactgcttacctcggtgtagttgatcttggaaccactgaacatgttgtcccgtgcagcctccacgcctctggacttggcctagggagagaagccactgctgaggtcttgtatcccatcccccatcctcatcacctatcacaagtccagcccccctccccccccactcccccccccccttgaggctgacagatgttcttcatagacagattccttttccagcatcttcaaagagtctgctcaatcagcagggggcctggagatccctgggataccaactccacaccgggacctagaacccaaaacaaagcgcagcccccacccacaacccaacccagagatcacaactccccagtcagaacattaccagctccaccagcatctgcatcacctccttgttcacaaggttcttggagtagtccaccagaatatgcccatggttggtgttgaggttcaagctgcagaaagatggagacgctgctggtcacaccccagcggcagtgcctggccacaaaggctgacctgtagcagtgttaagtagtgtaggaagccacgccacagaaagaagatgtagacagatcctgggcagaacttcccccttcaagctccacatctcaaacttacaaggaaacacccagggagaggtatcagggacgtccagtgaggaaccacaggtggtcatcccaggtccctcgcctcctggcatcagtgacaaggcacgaagatgcatcacatgtacgatttcttccaccctcccttctatttcgcagtcgctcacaagtctctctggcctctgcatcctgcctccgccgctctatttttacaccgtggctcccaggaaatctcagccttacccaccctgtctgaccaaagcccactaggagcaggtgggaggggacagctctctcgtgcctgtcgagccagcagcggctgctcctcctcatgggtggttagaaatccctactcaaatggctgagactgagaggcgggggcgaagggatccccaaggaggagccgattcctcctaatgactaagcagcctcggccctctggctagcacgcgggtcccaaaacccactccaaggaggcatcaaggacaaagtgcggccccggcctgggccctgcagggctgctgggggggggggggtcacgggagccccgaccccgtgcgtgcacctgaagttgttgaagcgctccggatccgcctcaaaaagttcgcgcagcttgaggttggcagagttcgcgcggtgccactccaggagcttctggaactgcgggttccgggtgagcgcagccatggcgagggacccgagaggtacac

SEQ ID NO: 208 - DNA, 1484 bp, Mus musculus
attcgctccaccacccaggcctcctgctgaggcacaaacaggatcacggtgtttcggggcagtccagaggaggcgcggcgcggaacgcggccagaagcctgcaccgagccctgaaggaagacgagagtaggctggggaccaggcgcggatccctaaatccctctccctagatctcgacaccccccccaagggtccccggagagtgattcacgtggggaccatgacctgtgaccacagtccttcccccaaagttagaagcccactccttcccagctcaagacccaggtgatgtcggtcccgagcctctggtgaaggttgcctcgctctcaccctcagcaaaagggctccagtgccccgcgccgcgcgcgccagcatttcccacagcctcggcgacctccggaaccaacgagaggtggggcagagcggcctcttgtgaagcctgaacccgagcccttccttcagctggtccactccgcccgacgtacttccggcgtattagtccaccctcccatccccactagtcggcgtccgtcaaatcgttccctgggaaacgtaggctttgaagagagagcccgagagtgcaagtttgttctggttctcaaaaactacgaagctcctgggcattgtggtagaaattgaggcaatattccgtccgcaagtggtacaggaacaccgcccaccaaattctgtacccacagccgtgactcagtttaccctccagctcgtgtataactgtcctaatctgtcaccataacgacaatggattggattggcgctcagtagttgcccgtggttgccatagtgacattcttgggtagtcatgctgttgtgcccagctctcccactggggactgaccccattcccgttgtcatggtaactaggaggcctaactttaccttaggactgggcggagatttctcccttccctcttttcccaaggcatcaacagctctttttcatatttttttctgagccagaaacggtcaggcatgatccccttacatacagagggaaacaaagagcctcagcctttcatttttgtctgaaacacatcaaccttgctcaggtctctgacactctctcaaatacaagctttaagaggcctgtatcccccctcatctccttcttctcattctcctcctcctccttcattttacatatacagacactgaggttctgatggggctaaactacagaatcagtgtaagaatccagattctcagagtttagcctctgtagcttcactttacccacccagcccccagcaccttatacaaaaaggactaagactatggtccaagactcagctcatcccagcctaagatctcatgggtttgagcttgttgccagaattccagctccctttaggccccacatctccatcctcttgaacacaaaaaaaagtagaggttagttcaagtttccaaacaagaatttattcttttttttttccttaaaaaatgtaccaggtacaatttttccc

SEQ ID NO: 209 - DNA, 127432 bp, Mus musculus
agaaagagaaagagaacctacccatatttatccaagggtagagataacaaggatttaattagtgagagcatcatatcactgaatttactatagtaattgatactgtgacatctctaaaattaagtgaaaagaactcattttttattaaaatagagcaggggcacacagagagctgactcattgtctcatccactgacaccacttggtatcaagtgcttaacttttgttactttacatgtgaggatgtatattaatgtatacttgaggccattcatggagtctggaactattctctgagtctatgttctcccacttaatcctaaataacaactgagccacctgattgagtttcagatcacttttatgatgtacatatttcccccagtattttgctagttaactttaattaaagagtcatttcaatgttgacatcagtgattttgaagtcttaactcacagataagtgcataaaagaatgttcaaagttaatcattccagtctcaaaaaatattgaaaggtttgaatctatacataccccactattcatggtttcctcaataacagctcttaggatgggaaattatgtattttgtggaggaattttggtcacatttgtaatgtctgttagtatatttatgtctttaatataacatccaaaattcaagagaatatttaggaataattaaatataaaaaatctttattttctaaatatgttgatcctttaaaaaacgattgcataaaacatgtgtgagccattttctttctttcttttctttacttattttttaactgcaggcctgctccagtgacttagtgttcatctagaatcatagagctcggtaaagggatatatttcctatacttagctgctctctcattttctctgtttatttgtttcaatgttagtgcttttatgaacctcaaatgtaacatttaatattaattaatgtcaggtttgtttactgactcctattctgagacttaactgatgtcattattatgatgttagaatatcaaatataggtattctgtactctttggatattacccacttattagtgagtacatacaatgcatatccttttgggtctgcgttaccttactcaggatgatattttctagttctatccatttgcatacaaaattcatgatgtcctcagttttaatagctgaatagtactccattgtgtgaatgaacctcactttctgtctctgttcctctgttgagggacatctgagttgatcccagcttctggctgttattaataaggctgctataaacctagtagagcctgtgtccttgtggtatggtgatggatcttttggctatgtacccaagagtgctatagctgggtcttcaggtagaaccatttccaattttctgagagattgctatattgatttcaagagtggctgtactggtttgcaatctcaccagcaatggatgagtatgcctctttctttacaccctcacctgcacgtgctgtcccctcaagttttgatcttagccattctaattgttgtaaggaagaatctcagggtctttttgatttgcatttccctgattactaaggactctgaacatttctttaagtgcttctaggccatttgagattcttctgttaagaattctttgacaagggagctaaaaccatccagtggaaaaaagacagaattttcaacaaatggtgctggcaccactggctgttatcatgtagaagattgcgaattgatccatttctatctccttgtactaaggtcaaatataagtggattaaggaactccacataaaaccagagacattgaaacttatagaggagaaagtagggaaaagcctcgaagatatgggtacaggggaaaaattcctgaatagaacagcaatgtcttgtgctataagatcaagaattgatgaatgggacctcataaaattgcaaagcttctgcaagtcaaaagacaccttcaataagacaaaaagaccaccaacagattgggaaaggatctttacctatcccaaattagataggggactaatatccaatatatataaagaactcaagaaggtggactccataaaatcaaataaccccattaaaaaatggggctcagaactgaacaaagaattctcacctgaggaataccgaacggcagagaagcacctgaaaaaatgttcaacatccttaatcatcagggaaatgcaaatcaaaacaaccctgagattccacctcacaccagtcagaatggctaagatgaaaaattcaggtgatagcagatgctggtgaggatgtggagaaagagaaacactcctccattgttggtgggattgcaagcttgtacaaccactctggaaatcagtctggcggttcctcagaaaattggacatagtactactggaagatccagcaatacctcttctgggcatatatccagaagatgccccaaccggtaagaaggacacatgctccactatgttcatagcagccttatttataatagccagaagctggaaagaatcaagatgcccctcaacagaggaatggatacagtaaatgtggtatatttacacaatggagtactactcagttattaaaaagaaagaatttgtgaaattcctaggcaaatggatgggcctggggggcatcatcctgagtgaggtatcccaatcacaaaggaactcacacaatatgtactcactgataagtggatattagcccagaaacttaggatacccaagatataagatacaatttgctaaacgcatgaaactcaagaagaacgaagaccaaagtgtggacactatgccccttcttagaattgggaacaaaacactcatggaaggagttatagagacaaaatttggagctgtgatgaaagcatggaccatctagtgattgccatatccagggatccatcccataatcagcttccaaacgctgacaccattgcatacactagcaagattttgctgaaaggacccagatatagctgtctcttgtgagactatgctggggcctagcaaacacagaagtggatgctcacagtcagctattggatggatcatagggtccccaatggaggagctagagaaagcacccaaggaactaaagggaactgcaaccctataggtggaagaacaatatgaactaaccagtaccccggagctcttgtctctagctccatatgtatcaaaagatggcctagtcggccatcaccgggaagagaggtccattggacttccaaactttatgtgtcccagaacagggtaacgccagggcaaaaaagggggagtgggtgggtaggggagtgggggggggttatgggggacttttgggatagcattggaaatgtacatgaggaaaagacctaattaaaaaaattctttgtttatctcactatcccattttcaaattgggttatttaggtttttttggaggttaagttcttgggttctttgtatatttagaatattagccttctatttgatttagggttagtgaagattttctcccaacctgtaggttgccgattttttctattgatgatgttttttgctttacagaagcttttcagtttcatgaggtcccatttatcaattgttgaacttagaacctgagccactggtgttctgttcatgaaatttccccctgtgccaatgagttagagactctttcccactttctcttctattagattcagcgtatctggttttatgttgaggtccttgatccaattggacttgagctttgtgggggtcatgagtatgactcctttttcattcttcaacacacagccagccagctagactaatagcatttattgaagatgctttcttttttcactatatgttgttgatttcttcatcaaagatcaagtgttcataggtgtatgggtttacttctgggtctttgcttctattccattgatcaacttgctggtctctgtagcaataccatgtggcatttatcactattgctttgtagtacaacttgaggtcagggatggtgattccctcagaaggtcttttattgttgagagttgttttggttatcctggaattattttttttccatatgaaattgagaattgctctttctatgtctgtgaagaattgtattggaattttgatggggattgcatagccaaaaagtacagaatacctagggtataactcacagactataagaagtataataagtagaaaggcccaaaagatgatgcttcaatcccacttagaacatagaagaaaataatcacaggaaacagaggaatgaaggttcctgggtgggtgagggtaaactggaatagaatcgagagtgtgagggcaggagagaagctccagacagccaggagaatgaatagaaatatgaaatctcttgggtgataggtgggaagatgtgggaggtgagagactctcaagactcaatgggggtgaccttagccaaaatgcacaatagggagagggaactcaaagagacaacctccggtagatagacagagcctcaagcaggggaacagggctaacaatccatagtaaaaatttctgacccagagagggattctgtgtaaaagaactgcaggaacaaaaatggaaaagagactgaggacagaagcctggcatgcctgtcctctgggaggcactacaaagcagaccactgagacagaagcagatatttacacccaaccattggtttgaagttggggactccttagggaaaggattgaagaacctgaagaagagggtgaccccataggaagaccagcagtctcaactaacctgaatcccagggagcttccaaaaactgagccactaaccaggcagcatacttgggctggtttgaggccccagagacatagatagcagaggtttgcctgttctaacctcagtcggagaagatggacttaacccttgagagacctgatgccccagagaagggtgtggtctagttggagggcactttcttggaggcaggggggaggagtgggatgagtaactgtaggaagggagacagggaggagggacaacatctggaatgtaaataacataatttaataaacaaaacaaaataaagctggaatgggtaggtaaggccagcttaaaatcacgtaactctcaggtaagatgtacgaacataggtatgttgggattgcaaggcatgttctttgcagttttttttttttttttcttttgagtcactcaactactttagtataaaaaaaccggaatgctatttccttcaaatttgtagcttaaaaacttcttaatgtttaggcctttggatggaacctataagactggatcatgaagatgaagaactcataagcagaattaacattattacaaaagaacccagagagttttttaggtctagtgaggagacaagtagagggctgtttgcaacccagataggggcttcatcagaatccaacttgtccagcagtccagcttctactctgtattcctatggatatacatggaatttctgttgttttaaaacactcatccttgctgggcgtggtggcacattcctttaatcccagcactcaggaggcagaggcaggcagatttctgagtttgaggctagcctggtctacaaagtgagttccagtacagccagggctatacagagaaaccctgtctcgaaaaataaaatatcaacaacaaaaaagccaaccaaccaaccaaccaaccaaccaaacaaacaaacaaacaaacaaaaccctcactctacagcactttgttataacaacttgagctgagatattttcctggagtcatgcattatgtgggcatgctttagaatatgctataattgaatttaaactacacttgcccaaatggacaataggttttcctttttctttcttctttgatcttcataatgacctgctaactatctcactaacttaacttatatcaattaaagcatttaaaatattacagacagtagaacttgactaatttttactatttctacttaaaccatttataggcacatcaatatatgcacagaaataaattaattcaatcctcccatatttagcatattctaaagcatgtccacatagtgcataactccagggaaatatctctatcacacttcagaatataaacaacccatggtgtgtagaaggtgttatatgcaattgtttatggagaacaacttcttagacataaaagattagttttggttcaagaacaatttaaaatatgactttaaaaaggagagtattataattgaatattttctaatttgggaggtggtatatgaggtttttaagaagctatgtggaagaggactatgggtcagacaaggaaacaaaatgtagacttttctggaatttgtatagagtaaattccttttagaaatatcaatgtataactatggtttactattttatacctgaaaagctatagattttagtcaaagcaaaaggcttatagtgttttcttctttttgaaagttttactatgaaagttacacagaagttataacaatgtgtcatagaagggtttggatagacccagagacagataaagaaatggctattgactgaaggtggtttatcttgtttcttatattaaacacttaaaaattgtctcctatcgggaaagtcagatactctatgcataatgttttgtgttttgataagtcagatacccgctttacttggaatgatacctcttcatcttttctaaaggtgtctattccaaacacagtgacataaatcagagaatgagtaaacaagcaatgtgtctctcttaagtttgaaggtggcagtttatgtctactaagagcttcatacttttattatgattatggtctgttacttaatattgatagttaattatggcatcatcagagtggtcaaagaagtgactttttctttccatatgtgctacacctggcaattgatgagatgaatattctcttacacggctgtgcactttgttatctggaaagctcaaagaacatagccagctaaagaaaatattggctaaggatttataaatgtgcataccctctgataagagaaaattactcttttaataatagaagacaggttgagtaaatgatgaagttgaaaatttttaaaataatgtaaaatgacagtattaggaggattgaattaatttagttctgtgtatatattgatgtgcctataaatgatttaagcagaaatagtaaaacttagtaaagttttattgcttattatatttaaaatgctttaaatgatctaagttgagttagtgagataactagcgggtcattatgaagatcaaagtgggtagaaaaagggaaacattttcaattactctactctttagaatataaacaacccgtgggatgtgggaggtagtatatgaagttgtcatttattccaataacatcacttatcatacaacccagaggcaactgtttaatgagaattattttaattagaattcaattagactcaagatactcatatttcaaatcccacgataaaacaattggctacagaaatgaaaagtgattctggaggagtttgtcattcattaatttcctggaaatatatttataggaaaccagctatcgctttggtttggatatgatctcagtagtttataggctagaggcttggcccttggtgtcatgatgtgtaaggatgtgaaaacttgggaatgtggagcactgtgaggattccttaggtcaactggaaatgccagccggagagaggtggtgggaactcacccagtctcagtctctgtggtgttttctttcaagggtcattgcttccccacagatttgatgctgacattgtgttgctagctaaccttaagctagtgtgttgctttgggatttccagattggtgagctacatatattccttttctttagttagcaatttaacttcaggtatttggtatatgaatgggaaaagggaataatacatctacttttatacattttgtatgtattaaaaagatacagctaaatgattatagctaattgggaaggctcaagacttttggagacagaaaattggtgtgatatgattgtcagggttcatatattgataaagagaggtggtggaatggggaaggatgagggggtagatgggtgagggagagagaagagttttactgctagaatgacatagattgtattatcatatgatagagctttaatagaaattaaatgagaattactcattacattagaaattaaatgagaatttctgagaggttgtgggaaaacagctgcctgtaaaaacatttactgttggaggccctgcttcaatctccaaggaaagtttttataatgttgaatctttgggaagaatggatccaaaataagagggatagaaaaagtcctattgagtgttaaggtgtattccacgtatgtcctgagtaaagtattttatcaaattgaatataaagtcaagtgggtgtcctatgtgaagtggattatttcttattctagaagtttactttttagcatgtaaatattatgtttaaattgtagaataatttcaaccaataaatgacttattttaccacttgtaaaaaaaggaagtattctgtatatatatataacaaactaaaaagagattcaggaatggcacatgtacagagatgacctcctgaaacctaaagactgactgcaagagcctttcacagtgagcccaaagggcaaagactagcttattttagagatagtaagtaacatttgcatggaaatgaaccaactaatgccagagagagagatgcagaacagaaggaaacagttgtgtgtgtttgctcatgattgcaatcacaggactctagagattgagacaggtggattgccatgaattccaggcagcctgggaaacataccaagttccagatctgtttaccctacagagtgagatcctgtctcagacggactgatacatggagaagccaaacaaactgagaataataataataataataataataataataataatgataataataataataataataataataataataataactgaattttgagctttttctcttgcttataagatttctatcatacccaatgccttcagaatgaaattcagaatgaaattcagttctttgacattgtttttgatatcctggatgatgtattccaaatatatttttcaggctaaagatcaatctgtgtactcactagactcactaggttcatcaatatgtttactaattcacggacacacaaatgaaaatcaaatacggttgcttcaacttctttaaactgcttggttttcccacagacacctcttctgtttggagttcacccctcccaaacccctaacccccttccttaggtatcaagtattccataaaatgcaaactcaaacaaccctctgtccttgaagcaatccttctttagtctaaactgtgttttcctttcactacagctgtgtttgcttgcaccttgtgtaaaatgctcacatgagaaaacttagactctaattatctgtacttgccttatatattgtttcctacccagataggaattctcttgacaaatgcagacaaatcctcttcgtttatgatgcccagactcatgcttaaaatgacgacttacacatggatgatcattgagaggatggttcggaacattatctcagactatgctttaatctgtcacatgcagattagagcgttttcatggattatttctcctaaagtggctctcaagttttagttctgggaattataaagaagtttgttgagattcaacaaactctatgtttctcccaactgcccggcataagtagagcaggcatgactggcaggagtgtgcaaaacagcagtttccttgaaggaattccatgcagattgagacctcatgcgtagaatgaagggctcatggccagttgtgcatcacagaggcctaactggcctccacagaagctgcttgccttgtacaatgctacgttctagaagttggtaacccaggcaccctctacacttccctgcctgcttgacagactcagtgcatggtgactgttggtattctctctaaactccaccctcacagttactggcaacagccaggtaggcttggcccagcataaaagggactgcttggcccctcctcttcctcttaccctcttatgctcttgcctcttgcccccttgtgccccctgtctccgcattccctttcatttagggcatgagttaaaagagtagtagaggcagagaaaggcagagagaaggagagatcagagaagtagatgccagccatggcgacttggagagagggggaaggaaatgggaagagaggaggatcaagagggcaagaggcaagagaggcaagagattaagaaggcaagaggtagaggaggggccaagcagcccctttttttcctgggccaagcctacctggctgttgccaggtaactgtggggaggaacatacctgccctatgggggtggagtttaaacagagtaccatcagtgaccacttctcttcaaaggaataacagtgaagcagcttgtgtaatttgcaggccagagaaagccagatgtggcatgtgatggagatgatggctttaggagacaaaagaaccctcatcgataataaacaagacaccttccatgacaacatcagcctcctccctgccaggaacgcctacttggtactttacacacaataaatagacttctattgggtgaagtagcacatttagggtttttttttttttggaaaaataatatatagcgtaaacataaataacacgttcagtgttcaagaactaaaggagaattatttaaacctagagagttagatttttgtaatcttactctatttagtagataaaacagcaccttaaatcaaaatctgcgaattaataatgcttatgttttcacaagaacatctaacaatggaaacattcttcaccatcttatttctaacttttaatgaaggtgcagcagactgtaccaaaaaaccccacatcatcaacttttcatttacggattacaattttaacctattatagcaacagtttataacattttctccatctatatgattttttatgaaactatgaaatgaagaggaaataagtatctgaaaataaagtaaactttcattcctcaaaatgtaatatcaaacatagaaataacaaaatgagacaaaattcttcttaaaaggtgttacagaagaggcctccctctgaactgttaccacatgagtgacaagagagttattttgaaaccatgttcagtttcttaactccattagctatttctataagccaaagcatcctaaaatctaaatagctgacaatttgcaagtacctccctaatttgaatctcctccctttcctctaattcatgaggcatttcacgatgcagtcataacaaacaagagactttcgatttcccaatgcacatatcatgcacgattggatcaaacatcatttataacattattggattctagaggagctattattactcccttttgtcagaaaagtgttgaattttcccaagcagaaatacgtcttgtagttcttcatttgcattttagaagcctcgtttctaggcatttactctttgtaagtaaacagatggattttaaatattaaaaacccatttggtatgactgaaaacttaaccgcctacattcccccattacagaatctttgggtgtgaaattgaaaagtaaattatactacgttaagtctgaacagagttcatctagagctttgtctttgttaaattgatggggtgggaggaggtttatttgtggacaaggactacaaagggaatggctggccagctggagcttgaccctgaagaataaagagggaactgtaattggtttcaaaaggtatgatttagatatatcctagacaggatatatattttccacccttaatgaatatgtcataggcaagtaaagatagcaacatggcaaacatgatattgcaaattgctctcatgagagtccccagattttcccatttatccacaattccttctgctaaagtggcaaccttcggctattgcacccaaagtttgcctaaaagcttttgatgggcagccagccaattctgagcctttattacctcattagaaagcaggtgatagacaagtagatcgtaatttttcctcatgaaccaactgttttgtcaccaaacagaggcaaggagtttgaagcagaggaggataagcaggcaggatggaggcatgttttgaacaacatacctgctttgtgtacaatgcattagcaagcgtcaggaaaggcaggtgctgtgcgcttccacgacccaggtctccactgctatttggcttaccagggagatgtgattgctctattagcccatagacacttcatctggagtcaaacaatataaaaccagagaagtgattcccctccccccccacctacccaaacagtatagcagggaggggatacactagcacatagattcattcagaattcatagaaccagaaacagtaacgtttgtgatattcatttaaaatgacttaaattgcttagaaaaaggaggaaggagtgtagggaaatatttggttttgtaaacatctagagtcagttgttatttttaagaccacagactttagcttttccattgatatttaacattaatctttctagtgggagaaaggagagatgtggtgtttgatctgcccatggcttgctcgggggttttaacttttctgagtctcaatgtcttggttttgctgcctcttttcttaaggtaggcagctgagaggacctgaggattttacctgtgtctcatacattttaaagaagtcaccatacatcaataaaatattgtaatatcaaaaatatactcgaaactagcaacactaatttctttttttttttttttttttttttttttttggtttttcgagacagggtttctctgtgtagccctggctgtcctggaactcactctgtaaactaggctggcctcgaactcagaaatccacctgcctctgcctcccgagtgctgggattaaaggtgtgcgccaccacgcctgacaatttctttaattttaagtgatattaaaaatttcttaagtgcacttatatgaagatatctattttttaggtacatatactttctgagattaaacattagaagagtgttggctcagttagccttaataatcagaaggaaatgattcattttcttgtcacgtttcattattatacattaatatgaatagaagttacacacaagataggttcctacttttgcaaacaggaatttcttaattatatttcttaaaattaatgatttgttttacatgcttgccaattttatactatagcaaaatatataggtatatttttaacttgtctactaaacacctttttgcttcatgggtgccttttgtactgttgtttcattatgaggtagctctttctgaagtcatcctgaagttttcaagatgactagaaatgcgcatgaatcctttgagctataccacaagtaggattcacatgtaatgcttccgctagaatttcttctgaaatgtttcttttttattgttattgtgtaaatatgtgctctagtttgcgaatggaagagaaagaacaattctgaggatgcttttctttcattccacctttatagggctccaggaattgaacaaaggctttcagactttggagacaaacttttcttcatgtgctgagtcacatatgttgtcacataacagggaatctactcctgtgtatgtgaacatgcatgtggctgttttctacacttattctgcagcagttatttgttaattctacaatagagtacctcctttcctgtttgtttaaaaggattgttcacaaaagtatccacaacaaaaatattagtataatgattactcaagcagccactcttagacttccataagtggccatgattatgtggtagctgaaatacaatacagtttgtatgttgatgtatgtccatacatgtaaatgagtccaaacatatacacatatccaaacatatatattcccatcacctagacacacaatcttcataaaagtgttttaaatggaaacttggagatatcattagagtctggaaaaattaaatctgaaatcttgagctggagaaaagctgtcatcgaaatagaggagaggaaatagtctgtttaggaaatgtgagcctttctgggtggcaatgagtgatcaaagattaaattggatggttggtagaagtcatcctataggaagccaggctcagagttctaagacattttgatgatattccaaaagaaagttgaggtatgatttcatatgatatgacagagtgacatgatcagatttgtgttggagaatggctcctccagcagttttgtcaagaatggataggaagagaataaaactggagacagacagatcaactaatggatacagaatagaatctgactttcagtagtagtgaactggtccatttgctaatctctgtaaatacatgagtatcggtgcctttcaggcttctctacccatcttcccctgtacagccctgaggaaggtccagtgctctccatcagttagtgttcttgtgagaaaggaaaccataaaattttcttcacacttttctttagaatgacaatatttccaaatatacaactgaatatgtattatttacaaccttgtctctaaactcaaagcctatggactttctgataattgaaagctacaatttcacagttcttcaaaatcagcccaagcttctctgtactttgttaattgtcttgttaatgattttgttaacttcattacaaaattgttgtgaagtccattctccacaacaaagaataatgtttggaacacggtttcaggagtcacttttaggccaagcattgctcctctccctaaagtggaagtctatttatataccaggagggcaaatttgctttcatgctcaaggactgtttgttattaaaatcataaatcataaggcattctgcagaaaagcaaatactataaatactctttcaaaacaatcattaaagcttaatagcacattcttcttgtctgtaccaataatttaggatgaatttgaaagtcagaagatacatttatgccagtctcactggttaatttactattccctgcaccaaatggatttctccacatcttatatttttcatttcttagcccccagccaccactttaaacatattcctaacaattttgtaggacatgctctaaaggtttaatccagaaaggaactacattttattttcaacagagcaactgtggtggataaagattcctttgtctataaatcataaactgtctatagtacctttcccatattggttttggattgctatatctagtaatgataagagtgattgtcactccttcagattttatactctgcaaatgttttgtggtagctttgatgccaaagggatactgggatcttgtaagggagattattacctttttttaagagtaaagttactccaatttattaatgaattcatccattaagaaacatttatgctatcagttatatagatatctttcattttcaaaaaaattaaagtctatttggatgatgatttttaaatcactttaaaacataaaataagttatagttaagaaaacaaagattaacccactcacttattagcagtcagagattggtaattaattttatgtgtatattaccttctaacttatgaattatgttgatattggtaagttcagtgaatacctttaagtgcctgccctgctgacttacaagcagagtttttgtcatttcattctctacataggtgcctctttctctgagtacagctcagcagattttgttgaatcttttaaacattaaattttaaggttctataaactaaggctatggtaaggggagacattagcagtattagaagattgcttagaaggtttaacatcatccgtcaatcataaaaataataaggaagcaatcacttcatttaatgctacatcagaattaaagtgatagtttactcaattaaagggccaggaactagaatacctaaagaacttttatttcactttaagtgcttaggctccagtttcattggtgatagacagtttaagtaaaatgtttaacacattctattttccaaaatctaggattaagctgatactatgacaagaagacccatcacaaagaaataaaaaataatgaagctcaatccttcaagctctgtaactatccagatcaggcccaaggacaaccaggtagtacaaagtgattcaaaggtaagcttggatcctaggatggaggtgagatggaattctggaatttatgactattagatggaaaacgctttcctaggctgtcactcgaggaaatggcagagcagacaggaaagatgaggctcaagggatgagacatatgactgaagaaaagcctggcaccatgctgagggggaacaaagtgctagggacatgtaagaagactcagaattatctgggtaatgggtacttggatccagagatgagatgggataggaatctgaaaagtgaagcataaaccctcaggagaaagagaacaagaaaataggaaataggaagagaagggaagtcgatagaattggaaagagtatctgtggttgtcaccatgaagacagtgactgtgctgaaaaatacgagtcaatgaacctttgtaaaggcttacaaggaccagaggttatcagcgatgggattcagctctcaggaaggttccatggctgacaaggaaggacaggcaggctacacagatgtgttctggatgggaggatgtggagaaaggaaagatggtcttggatcttgtgatgcacttgctataggacacagatatttactttattttatagctttgttgtttatattttaatgtcaattggcgttattttgttataattcatagtttttgttcgttttactaaggtcttggtttgaagtaatgttatacttaacatatgtttcacacaaataaaagaaacccaatcaggaaataatttaatcatagagttcttttcaagtgacaaaaatgcatcccttggtgtttaatagtcagattgcttaacctgctttaggtgctccatgccagggagacatgctcactgtctcagggaagatagagagaaagagagagtgagagagtgagagcaagagagcaagaggagagagagagagagagagagagagagagagagagagagagagagcagaaggaggacctgaagattgtttctggcttctgcacacatgcctatatacccacatctgtgtacccttcatacatatgtgaatgtgcatacatacttatatacatacatgcacataaagcatagtgaaggacacaaggaagggaagtacgtggccaccttttcttttaccaagatttctaaaaacagagtagacaagccacttaaagtaccaagatccagtgaaacaggtgacattatcaacagaaaagaaatgtgagtatttcccatgtatttgactttcattctgcacatattttagttctactgaacttcagttaattggctatttacttgttaattgggtttttaattttagttctttgggctttaaaagaaaagttattttgctgctttcaaatgatatctcattacatgtctagattctcaacatctaattatatttctttaaacatgtgatctatctcttgtcatgaacttcatctgataattctatctttcaggcctaatttgtgggctttgtgtgtgtgtgcacggatttctgctttctgagctcattgagttattttatattgttagaaaagttccttggacacatctgtcaggttcatttgaggcatttgattaaactgtatttgtttaagacacaatttgtttatgcctgccagcctccttgatgttatattttcctgtgatgctatattataaccctaatgttttgacctgggagttttgaatattccacacacatttttatggatttgtgttaggaacccatagaggtaattggtcattttccttactacttccttacttcctggtgatattgagaaactaaaatttgctttgttgtggattcagctctcttccctcctttcttccttgtcctctttgtccttgcttaatcatagaggctctcattcaagagtgttaaaaatgtctaatattttcttcaactatgtatctgagagagcctttttctatgtctattaaagaccaagttttaagccagtgactcctaattaaggttgctttttttcctgttaaggagattttgaaattgcaaggtcattcacatttgggaattcagtaactgagaagtactgttagcttagaaatgggtctctttggaaaagattactgtgtgatctgaagtttggactagaacagtaaaaatgacatatatccataagacaaactctgcttctagatacaattttactctgtagctgattaacttttttattagccatgacacacctacacacccacacacccacagataacaggattttgttaggatattttaaatgttctatactagcagaaattttctaaatcattagcataccctgtcaccagaggtgaacacggaacagaattttttaaagcaggaaatattagactacacatcaaggccactcctaaagcagaggtaaacacttaaaatgcatggatttctactaaatgaaaacaagacaaaacaaaatcagccagaagagttgaaaccagaagttaatgtgaactgaagttccatgaagaagcaaagagattcagcagcttgcttgctctaattcttttttaaaaatattttttattattacgtattttcctcaattacatttagaatgctatcccaaaagtcccccataccttcccccctccccacttctctacccacccattcccattttttggccctggcattcccctgtactggggtatataaagtttgcatgtccaatgggcctctctttccagtgatggccgactaggccatcttttggtacatatgcagctagagtcaagagctccggggtactggttagttcataatgttgttccacctatagggttgcagatctctttagctccttggatactttctctagatcctccattgggggccctgtgctccatccaatagttgactgtgagcatccacttctgtgtttgctaggccctggcttagtctcacaagagacagctatatcagggtcctttcagccaacgcttgctagtgtatgcaatggtgtcagcgtttggatgctgattatggggtggatccctggatatggcagtctctacatggtccatcctttcatctcagctccaaactccgtctctgtaactccttccatgggtgttttgttcccaaatctaaggaggggcatagtgtcttgctagtatatgcaatggtgtcatcgtttggaggctaataatgggatggatccctgagacaaaaggatggaccatctagagactgctctaattcttgaaatttcatgattatggagacaatggagtgcagaaagctgaaagcccagacatcttgggttaatttagtccctttataaaatattgtcttaactttctacttaaatgttctcattactgctacgtaaacttatgggaacataccaactctaagattagagtctaaaatctaaaacctatgaaatcatttttttgtgatgctctctgtgatgccatcaccaatgtaattgaaagttatagacatgacactttcttattttgtgagcatacaattttctataagttttgcacactgttggtgaatttgtcatccatggtgactatagtccaggcaaagatctcttaaattgtcctatgaatagactatttcaattcccttttaaaggggattttattttacatggacaagaaacagaattctggctctattacatagtgcataatttgatgatttttataatattctgaacttggtaagagttctaccctcttatcaggtctttgatatgatattgtcagcttttatataaccactcaacacaactagttacatatcgttggatgtactttgattcatcagtggtcttcctgtagcatgttaatgtgggtaggagcaaaaaacctattaatcatgagataactgtattcgtgatgtttgaaaagctcacttactacttttcttaactaaaaaaatgggctgttttaattattgttattaaaataatgcttacaacaggaagaaagtgcctaagccaccaatatacagacccttaactttcatttttttgtacagataccatgctataagctgatgttgaatacaagaatacaagctctatgtgtttattttcccagtattttttagaaagaatacatgagcttttcaaccatggattcttggctaaggtaacaggtccaaatgtgtttcctcctgtgaagaggatcctaagaacaatcagaaagtgattggttgtctgggtaagtgtatcatgccacaccaacattatcgtagatcacaggatttacagcttagtaagaatgtaaaagacttgttagctaagaacctatatagcaacttctgctactatgacaactaagtcctagtcagtaccaacttgctttctccatattttaggaacaaagtatgtggtgtcttcagaaatacaatcttaccaaaaagatctagtggaaagcacagagaaatttggataacctgtattatttgagagattaagagttaacacacttttgaccaacagctcagaaggagtcatctcacatctgacactgggcttctggaagggtcacctatctatctgtgtaggtatgtatgtatctagcatctatctatgtatgtatctatgtatctatttatctatgtatctatctatgtatctatgtatctatctatctatctatctatcatctatctatataatgtgtcatttttctatcatgtatctctatgaggctttaaaacgtagaatctaaaaaatcacatttcatagattagtgaaactctcatacatcataagagattgtgtaagtgtgtgtgcacagtagattgtgattaaagcagaaacccataacttatcaaaacatagaatctatagagttttcagtcacaaatgttacctctgtattgttccctgtgtcccccagtgctccaggaccactgctgaagatgggacaaaactattgagagagctagatgcagggttggtatcacactgaattagtgccatctagatataatagaaccactgctcctgtgaactcacaggagctgcgattgcttgcacaaaccctgcacaaaatcaggtcagtcaacattacagcttgaattatggagatgctcaaatgcctccattcctaactgtagcattattgacaattgacttctggggggagggctcaatattctttaaaggtgacctttggtaggttgaccacactctagcagaagtccccacattcatgaatataaaggcagtacacatttgacttgatgatatatttatagatatttttaaaagagcagagtaacttaagagggttggggagttagggcacatggaaggagtcagagagtaaggctgactatactaaatacatattgtatgttttcagaaattcccaagaattaataagaatatttaaaaagactgcaaaactagcctcagaagttagaaatttgttgagaatggtcagttatttaaagacctaatgatttagtagcagtactgaaatttttcacttttataaataaataaatttttgactctagtgagaaatcattttttctttataaaataaaaaagtaagccacttgtgataacaggtagtttccaatatataagttatttaataaaggcagggaaattattttactagcattgcctgtattgttttcaatcttagttttttctggaaatttcaaaggcaggatacatgtgaagatgctttggaatatcaaaactctactgtatattctcattatcttgtcatcttttggtattacgagtctgttaccttttcccttgactcaatgcaagcagtttgttgtctgtgatgagctagtcttatgagtctgtgcttgtaactatcaagtgttactttgggaagttggggagctatgtcttaataaagactaagaaattttgttggtgatctgagaacttgaaagctgctgatgagaaagtatttgcttagtatttaagttttgtcagggtattattgtgaacagagaggcaggcctgactagcctacagaggtagcctgtctttgttttagacacatggttagcgatagctaccacatagtgcagcatctacaggagagtgtgcagtcactttgagaaactgattcagaagggtaaagtttacaaacgaaggggcaatctcttagatagtacatagttggaaataaaacagaagtacagattattacaaaaatgagctgtgaaaaacaatgagatctttcatcattgagaacctgatcaaaatatttacataatattataatatagaccaactgcatgaacatataaataaactggtataagcaaattgttagcttagaacagagacattttttgagaacaacccagtaaagaagtttatacactgtggattgtaagtccttgttaataagctttattagtccctgtgttttttcccacatacttatttttaattctttttcctgtctggctggttcatattataatttaagtcattaatacattttattgtggtggtagttctccatttacttaggcagacaaactatatatttatgatatgctctttaaggtgacccaggagaacaagtttattaaagtcatattgctttgtgagcagtttcttacaaagaccagcaaagcaagctttccccagagtggtggccttctcatgttctacccaggaagggacaacgcctggaaactgattggcagtgccaattcaagtgactggcagatggtgacatataagcttctctggtcaggtcaaggtttgctctgaaacctgacccttaacctgtgtgtccccatggaatgcaacttctgacttctaaaacccatactgacaaccaaacaattttggtttctatgtgaaaatattgtatgctcattttgatggtggtgatttgtcccctttcctcaaattctatttttttccactaagttttcctgagtaacaacttgtagtagaaaatattttctgagcctggaatgtacctgacacattcactgtttcatgtagcataatctattttctcccctagatagactggagagtaggtgtgttaacatgccttagactagatgactcagagaatataagtatttcattcaccatcattgacattaataaatgtcaaataaaggaattttaaaatctatccatttatttatttatttatttatttatttatttatttatttatttatttatttttacactccagattttatccccaccccatctaccctccaactgtttcacataccatacctcctccccaccccctgtctctacaaggatgtcccaccacccactccacatcccaccagatctctaaactctctggggcctacagtctctaggtgcatcttctctgacttacccagcagtcctctgttgtatatgtgttgggggtttcaatcagctggtatattgctgccagtgtttgagagaccttaggggtccaggttaactgagattattagtccttccttttacacggtaaccctcctcctaagcttcttccagcttttttctaattcaaccacaggggtaagcagcttctgtctattggttgggtgcaatatctgcatctaactttttcaaccgcttattgaggttttcagagggcagtcaagataggtcccttttgtgagcactccataatcttagtaatagtgtcagtccttggggcctccccttgagctggatcccactttggtcttgtggctgagtcttcttttccttagactcttatccatttccatccccgtacttctttcagacaggaacaattatgagccagagttttgactgtgggatgctgccatccccatcccatatccccatccctcacttgatgccttgtcttcctgctggaggtataagttcctttaccacattgtagagaatttcatctaaggtccctccctttgagtcctgagagtatctcatcttccaggtctctggtacattctggaggcttgctttcttatagaaccaaagactaccagcccagagatggtaccatccacaaggagcctgatgaaccttgatcgctaattgagaaaatggcttacatctggatttcatggggccatttcctcaactaaaactcctttctatgtggtaactccagcttgtgttgagttgactcacaaaaccagccagttcacaatcccacctgcaatacaagagtgttgctctttcaccacatcctctccaacatgtgttgtcacctgtggttttgatcttagccattctgattggtgtaaagtagagtctcagggtcattttgacttgtgttgctctgatcactaaggactttgaacatttctatagccactggagttctgtttaggaaatttcaccctgtgccaatgagttcaaggctcttttccaatttctcttttattagattcagattagatttattgagaattggtatttccatatctttgaagaattgtgttgggattttgatggggattgcattgaatctgtagattgcttttggaaagatggccatttttactatattaattttgtcagtccatgagcatggaatatatctccgttttctaatatcttcctcgatttctttcttgagagacttgaacttattgtcatataggcctttccttgcttggttattgttacaccaagatattttatattatgggtggccattatgaaggggagttgtttccctaatttctttctcagcctgtttatcatttatacaaaggaaggctactgatttatttaagttaattttatttccagtcactttgctgaagttatttatcagctggagaagttttctggtagaatttttggggtagcttatgtacactatcatatcatctgcaaatagtgttatctttatttcttctttgtcatttgtatccccttgctctctttttgttgtcttattgttctagctagcacttcaagtactatattttctagaaagattcgagatagcttcagatagactagagagcacattcatggaaaccgaactagaaaatcctctttgataaaaagtgtgttactgtgagggctgataaagttgtaaaatcacattgattttattcttccatgtatatagattttcctcttagaaaatgaaaacaatcagataaactgaacaaaaagaattgttttatattaaatatttaaaagaaactaagaaaaagaacatttatttattgctttgaccagtggttctcagcatttctagtgcagtgaatctttaataagacagtaactcttgttgtggtaacaccatcataaaattatttacaactgtaattttgctactgctatgaatcataatgtaaatatctgatatttaggatatctgatattcgacctctgtgaaagagtcatttgaccaaaaacagtgtaatgactcacaggttgagaaccactggcttagaaggttaaggttttactgcacagaagagattatatgtgataaagattgattaccaatatcaattctgcccactgagcaaattccatgagtcctaactgaactattgtactaaatcttttctagtagtaatccatccatcagaaaacactatatcttaagaatcttttccaatctttgccctagcagcacgttggtaagaaactaacaaattcagaataatataaaatgtcatagaggtcaacctaaatagtatagaacaaaaccttataaaggataaccccaagtccaaagaataaatggttgagaaaaaatttcagcaggaaatccaagagtttttgtaaacactattctttagccccagtaatacaaaggggagagtttgttcatgttttcaatgtgataaaaatagcaataataggatggtaaagaaaatttcttgctggaaattttctctaaccacagctgggtgagtaaataaagtgagtgcattttgtcctcatatcttaggagcaacacttaaaagtgtgtagctaagccaggttttcaacttctaaagaagagctcaagaagaacctttggcagttgaggattttctaagacaatttatttttttttggatttccacttcagtgtgtctttctggtttctgacatattgatgaaaaattggctcaagagttattaaacctagaaatcaagagttactctgaaaaaagtcataggtacaattggaattatctggtagtatattgcagttttaaaaacttggcatatgtccactgagaaggcttcagtggaaaccttcaaatatgtgttatcatccagatgcaacatactaagatcagagaactattattaaagcataagcaacagaagctaatataatttggcatcatcagaatccagttctcccaccacagcaacccttaggtcccctataacacttgaaaagcaagtggataccatataacactttaaaagcaccccgtttcaagaagatgatagatgcatttgaggagaaattaaataactcccttaaagaaatacaggagaacacaggcaaacagatagaaggcattaaagaggaaacaaataaatccttaaaagaaatacaagaaaacacaatcaagtaggtgaagaaattgaacaaaattgtctaagacctagaaatggaaatagaaacaataaagaaatcataaataaaaacaatcttggagatggaaaatctaagaaagaaatcaccagcagagtacaaaaagtagaagatagaatctcatgtacagacgataattgacatatcagtcaaagaaagtacaaagtataaaaagctcctaacccaaaacaaccaggacattcaggacacaatgaaaggactaaatctaagaataatgggttcaagggctagaaaatatcttcaacaaatcatagaagaaaacttccctaatctaaaggaagagatggccataaacataaaagaagtctacagaacaagaaatagattgaaccagaacagaaaatccactcattacataataaacaaagcactaaatgcacagaataaagaatgaatactaaaagctgtaagggaaaaaggccaaataacatatagaggcagacctatcagaattacatctgacttcttaccagcaagttgaagagcccgaagatcctggacaggtatcatgcagatcctaagagaacaaaaatgtcatcccaggctactatacccaacaaatctctcaatcaccatagatggagaaaccaagatattccataagaaaacctaatttaaaaactattttttctaataaatctgccttacagaggataccaggaaaaaacctccaacacaaggagagtaactacacacaagaaattaatcagcttacaacaaatccaaaagaagacacacacacacacccaccccccgcccccacacacactaccacttcaaataacaaaataacaggaactagcaatcattgatctttggtatttctcaacatcaatggactcagttcataataaaaaaacaacataggctaacagactgtatacataaacatgatccaggtcttgctgcatataagaaatacacctctgtgtctaagacagtcactacctctgagtaaaatgctgcaaacctttttccaagccaatgttccaaagaaacaagctggagtagtcattctagtatccaataaaatagactttcaaccaaaagttatcaaaatagatggggaaagatacttcatacttatcaaagaaaaaaatccaccaagatgaactctctattgtgatcatctctgccccaaatgcaagggcaaccacattcataaaagaaactttactgaagctgaaaatacacattgaagctcacacaataatagtgggaggctacaacaccctaatctcaccaatggacaagtcatggaaacaaactaaacagagatactttaaaactaacagaagttatgaaccaaatggatttaacagatatctatagaatatttcacccgaaaacaagtgaatatatcttcttctcgacatgtcatgtaacgttctctaaaactgaccatataatggcacacaaaacaaactctaatagatacaagaacattgaaataatcacatgcatcctatcacatcaccaaggaataaggttgggcttcaatgacaacaaaaacaacagaaagcacacatattcatggaaactgaacaactctctactcaatgataacttggtcagggaagaaataaagaaagaaatcaaagactttatagattcaatgaaaatgaggaaacatatgggacacaatgttaagaagaaaacttatagcaccaagtgccttcataaagaaattggaaagatcttatacaagcaacttaagagtacacctctgaaagctgtagaacagaaagaatcacatacagccaagagtagtagacaacatgaaacagtcaaactcaaggtggaagtcaaccaattagaaacaaagagaactatacaaaaaatgaacaaaatcaagagctagttctttgagaaaatcaacaagatagataaactcttagccaaacgaactaaagagaacagagacactattcaaattaacaaattaacaaaatcagaattgaaaagagagacataaaaacagaaagtgaggctattaaaaaaatcaccagaacctattataaaagcctatactctacaaaagtggaaaatctagatgaaatggtaaactatctaaacacagacccatagcccttaaggaaatagaaatagtcatttaaaacctccctacttaaaaaggcccagggccagatgattttagtgcagaattctaccagtccttcaaagaagagctaataccaacactcctgaaactattccatatgatagaaacaaaaggaacactatttaattcattctatgaagccacattactctgatacctaaatcacacaaagacctaataaggagaacttcagaccattttgcttatgaatattgatgcaaaaatactcaataaaattctcgaaaactgattccaaagccaacattcaatatgactaagtaggcttcatcccagggatgattaaacatactaaaaaaatctatcaaagtaatctactatattaaaaaactcaaataaaattacacaagatcatctcattagatgctgtaaagcattttgacaaaacacaacatcacctcatgttaaaagtcttggaaagatcaggaattcatagcaaatacctaaacataataaaaccaacatatagaaaaccaacaccaacatcctgatgttctacatgcagaagaatggaaattgatccatatttaacaccttgtacaaagcttactctatgtggatcaaggacttcaacagaaaacaagatatattgaatctaatagaagagggtgagaggtagcctgaaacatattggaacaaggtaaaatttcctgagtagacagtagtggttcaggctctatgatcaacaattgaaaaatgggatctcatgaaacttaaaatcttctataaggcaaaggaaattgttgataagaaaaactgaaacctacagattggaaaaatgtctttagtaactctatatcagatagaggactagtattcaaaatatataaagaactcaagaagttagactccaaaacactaaatatcccaatttaaaaattgggttacagaactcaacagagaattctcaacagaggaatctcaaatagccaagaagaacttaaagaaatgttatttctcttagtcatcagggaaatgcaaatcaaaacgacccctagattcttccttacaccattcagaatggctaagattaaaatctcaagtgacagcacatgatggtgaggatttggagaaagaggaacactcctctcttggtaatgggattgcaaactctggaaatcaatctggtagttcttcggaaaatttgaagtagttctaactgaggacttagctataccaggagtgggcatatacccaaaaaatgctctaccactatgttcataacagccttatttgtaatagccagaagctagaaacaatccacatgtccctcaactgaagtatggatacagaaaatatggctcatttaaacaatgttatactattcagctacaatgagctgactcatgaatttgctggcaaatggatggaattagaaaatatcatcctcatcaaggtatctcagaccctgaaagaaatacattgttatgtactcactgataagtggacaatagccaaaaagtagagagtacccatgatacaactcatgaagtgtttgaacctcaacaagaaagaaggcttaggtgtggatacttcagttccacttagaagggaggcagaaggagagagggacctgggtgggagaggggaggggaaaggcagggcaggatcaggtatgaggtgagactggagagaagcccagagggccaggagaaaaaaatcaatatgcagcatcaggggcgggggtgcgagtggggaaactctagaaagtcccagagaactgggatttgagaggcttccaggcttcagtggcaggttgaccttagccaaagtgcgcaacagtgtggaaatggaagctgatgaaaccaccttaagtagatagacatggctcccagttgaggcatgaggccacctacccatcttcaaaaattttgacccagaattgttcctgcctaaaggaaatgcagggacaaaaacggagcagagactgaaggaaagggcatccagtggctgacataacttggggttcatcccatgagtaggcaccaattcctgacactattaatgatggcatattgtgcttggagataggtgcctaacatggctgtcctctgagaggctttaccagcagttgactgaaacagatgcagatacttagagccaatcagggacctccatggtaaagttagggggaggattgaaagaactgaaggggatggcaacctcataggaagaacaacagtatcaactaagacagatccctcagcgttcccagagactaagccaccaatcaaagagcatacatgggctgctctgtggcccctggtacataagtagcagaagattgccttgtctgaccttagggggaaagaattctccttttcctgtagaaatttgatgccccagggaagggggatgttggtgtggttgaggtgagtggggttgggtgggggaccgccctctcagaagcagggagtggggatgggcttaagaacttgggtagtggggaccaggaaggtgagcaacatttgcaatgtaaagaaataaaataatataataaaaaaagaaaaaagaaaactcttaaatccatatgtgaaaaaaaatggctatgctgctggtaatatattaaagatcaaaataagaagcttggcccagtttatatgactttaaaacagacccagatttcagaacctagtggtctcctatcatagcagcaggaattcatggaaatctcatgcatttcaatcagagaaatctgcctccctgcagtgtctagacctcaccctagtacagttattgaagactgtttccttagccctctgaactgctcgctgcatggatgcagaaacactcctctataaactgagagctttgttaatgtataagagttacttatatagaacgtaggtattggtcaagttttataagtacgaacagcgcttttgttatgagtatacaatgacggacacagaatagaacaataaaagtgaagcatttaacaaggattgcagtaaggaaaactcattaaaatggatgtgcataaaaattgtgctcaactacagctttaaaggtgggtctgtagatttgtagggatggatatgacaaacaaagcatgatgaagtattgcatggataagtcatagacattaatgattaataccactttaatttgctttagggtatatttaggggttaatgagccctgatcctgtgcaattgtgtgtgtgtgtgatgcatatacctgtgtgtatgtatacattcacacatcttcagtaccagaccttgtttttttgataatgtgaatggtaaatcgtagaaatattagtatgatataaatagttgatttcatcagttccactgatgaaattgaaacaggtaaatatatttgggcaccaatatccctgatattcaactctatttgatgatctaatcccagtaattaaatctgaacctgtgaactaatttttgttctgcacattgaaagctcctaagggtgggttttagggttttcaattttttcttttctttctttcttcttcttcttcttcttcttcttcttcttcttcttcttcttcttcttcttcttcttcttcttcttcttcttcttcttcttcttcttctttttgttttgtttttagtgctatttgttaactatctttgctttgttcactaagataggatgattgtgacctaatcaatgaaccttattccattatttataagaattagtgacagagtgaaggtgggaaaggagattgagatttatattctgaacgctatcgaattgtatcaattgtttgtgccatttttataatcacagattccacatacaccatttgtctaagcttggagttatgactacatttacagaatacatttcaggtttatttaaatatcacatggtagctatgcttttctttctttctttttttctttctagcatttgtggttttatacccatttatttatttgttatttatattttataatttttattagatattttctttatataaatttcaaatgctatcccaaaagttcccgataccctcccccgaccctgctcccctacccaccaattcctgcttcttggccttggcattcccctgtactggatcatatgaagtttgcaagaccaagggacctctcttcccagtgatggccgactaggccatcactacatatgtaactagagacacgagctctgggggtactggttagttcatattgttgttccacctataggattgcagaccccttcagctccttgggtgctttctctagcttctccattgggggccctgtgttctatcttatagatgactgggagcatccacttctgtatttgccaggcactggcatagcctcatatgagacagctataccaggatcccttctgaaaaatttgctgtcatatgcaatagtgtctgggtttggtggctgattatgggatggatccccaggtggggtagtttctggatagtccatcctttcgtcttagctccaaactttatctatgtaactcctttcatgggtattttgttccctattctaaggaggaatgaagtatccacccattggtcttccctcttcttgattgtcttgtgttttgcaaattgtgtcttgggtgttctctgtttctaggatacacttatcagtgagtgcatacctaatgacttcttttgtgattgggttacctcactaaggatgatatcctccagatgtatccatttgtccaagaattttataaattcattgtttttaatagctgagtagtactccattgtgtaaatgtaccaaattttctgtatccattcttctgttgagggacatctgggttcattccagcttcttgctattaataataaggctgctatgaacatgtgttctgattaccagttggaacttcttctgcgtatatgcccaggagaggtattgcgggatctttcagtagtattatatccaattttctgaggaaccttcagactgacttccagagtggttgtacaagcttgcaatcctaccagcaatggaggagtgtttctctttctccacatcctcgccagcatctgctgtcacctgaatttttgatcttagccattctgactggtgtgagtggaatctcaaggttgttttgatttgcgtttccctgttgattaaggatgttgaacatttttttcaggtgcttctcagccattcggtattcctcagttgataattctttgtttggtagctatgcttttcattgtacctttaaaaagaggttttcacatgtcccagatatttaggaacttgtttccaaatcaatttttattgattaaccacaagatcaccatgtagtaaaatttgactcaaatcacaatgacttaaacaagtaaacaaacaaacaaagtccctctcagagttgataatggatgtcgaatgtatataataacctacataactaagtatgacaaaggtatttgtggtaggaatgtgtgagaagtcctcatttctctgactgagtgtctgggtgttgcttaactgcagaaatgattagtggggcactaatgtcttcatagccagtgtattgattactcactgaaagtgttgcaggtagagatgctgaagtagaggttattaaccaatgttcagtagtagtgagtcctaggaggggtatgtagatatgttggtagaaaaataggaaagggataaataatataaatatgttataatcacaaaaataaaataaaagtttttgtatacatatttatatcatttaatcacctgtagaatgtaggagagatatttaagagtttctgcccaggactctgctcctatatctaagaaacccctactaatgtgctatctctggagagaaataaatcaaaaccaaacttgatggcaagagaggcttacactttttgcacctcatcatgtcatttaataattaatcacgagagattgccagcattttccagttaccttaaaacctttttgagtgagaaacttaatggtagttgtctatagtggtagagacattagctggtgtctttgacatctgcttatgaaaattagttggtctgcatttttctatgagtacgaagtggaaacgttcattagtctctaatgacctttataacatttcttgggaaaatgaatcttgaccttggcagctgtcaaagcaattagaacatgggcattttgcggttatttcacaactatattgtcaacgtaaggcagaatagtgtgatggatgtgcgttcatgcagcatagggaaaaggccacatttgcatggaaattcaatttataattgtttttatttttttattgatgcttagtgaattggatctaaaatgagccatttttagaaagggggatcaaaactgacacataatgaagctggataaataccaccagtaattgcaccaggaattattccttctttcctatactgatacagtgaagacaaagcatgggctggcttctctaactctaggatatttaccaaataaagtcaaagagacttatgtatcctaactgcttttgctcaaaaccagagtaactatgacagtaagttagaaaggctcagtttgaggaacacaagacttaataattagggtgaagccacaagggtgatatacttgggcctttgcaaaatttgtaataaagtaattaagttatacctatagcaaagaatgcttacagcaaaaataatagatgtgtatttctcaattaaaaaaaaacaggaaaggccttgagtacaagacagtagaagaacagaaacctagattttattattttgagtataacattgtatttgaaatggtagtaacatactacataaaagcgagagaatttcatgatgctacgaagaagtatttggatgtctgatacaaaggtggattttagaactctgattagaaaaaccagagaattattacaaactgggtgagacactgatagcaaatagttagtatgtagagcctagaatcagatttgaggtaagcacacattaatatatttgctgtatagctttacatacaaactcacagtatttataacagcatgcaagacctctataagccccagaactactgagtcccagtccggagagaacattgagcctcgaattccatctctaatggaggagatattggagatagtttactgctgggagagagtgagtttttcttaagagtgtaacccttgagcaaggatgtggagaaagaggaacactgctccattgatggtgagattgcaagctagtacaaccactctggaaatcagtctggttgcacctcagaaaattggaaatagttctacctgagaaaccagctataccactcctgagcatatacccaaaagatgctccaacatgtaacaaggactaatactccactatgttcatagcaaccttatttataatagccaagagctggaaagaacccagatgtccctcaacagagaaatggatacagaaaacgtggtacagttacacaatgggatactactcagatattaaaaccagtgatttttttgaaattcgcaggcaaatggatggaacttgaaaatatcaccctgagtgaggcaagccagtcacaaaagaacacacatggtgtgtacccactgataagtgaatattagccaaaaagaagtttggaatacccacgatatatctcacagaccatttgaaacccgagaagaaagaagatcacactgaagtgtggatgctacagtcctactcagtagggggaagagaataatctctgggaagtagaaggagagagggatctgggagggagagatgagtgtgagggaacaaggggacagtttagatatgggaggagatgggagagaattacagagggtcaagaatttaaaggtaggtgtatagtagtgggggagggggagggggaatagccactagaaactcccagatgccagggacctaggaggttcccaggacccaacagggaggactttagctgaaatatgcaacaaagggaagacagaacctgtagagaccatatccaatggataggcacgatcctcagttgagggatgggaccacccacccacttcaaaaatattaatccagaattcctcctttcaaaaggaaatgcagcgacaaagagtggggcagacactgaaggagaggctatccagagactgccctacctagggatccatcccatctgcagacaccaaacccagactctattgctgatgccaagaagtgcttactgagaggagctcggtatagctgtcccctgagaggttctgccagagctggaccaatactgatgtggatgtacacagccaaacattggactgagcatggtgactccagtggggaagttaggacaaggactgtaggagctgaaggggtttgcaacctcattggaagaacaatatcaaccaaacagaaccattcctctgccccagctcctagggactaaaccaccaactaatgaatgtacagggggtacccatgactccagctggatatgtagtagaggactgtcatatctggcatcactgagaggagagtcccttggtcctgtggaggtttgaccaaggatagggccattgtggcaggagtggataagtggatgggggagtgctctcatagaggcaggtgggagggaagagtgaatagggggcttgtggaggggagactgggaagaggataacattagaaatgtaaatacataaaataagcaataaaaataaagtattattaaaaatcatatacctgaacattgtcatagtagagagagatattatgcctaatagtaacttgggagtgtatattatgtatatgtatatatgtaagtatatatatatatatatgtgtgtgtgtatatatatatacatgtatacatacatatatatatatatatatatatatatatatatatatatatattactttgtacactttgtatgtagctgtcctgaatcttaatatcttaattttctttttctcttttcttttcttttcttttcttttcttttcttttcttttcctttttttttctttttttttcttttctttttctgagacagggtatctctgtgtagccctggtgtcctggaattttctctgtgttaaaagggaataagaacaattttacagggctgtcaaaatggctcaggggtagaataattagtgtgcaagcaaatgacctgagtaaatctttaacatgcatatgaaaagccaggtttgacatatgtgtgtaatctgaactctggggattcagagaaaataggatgctgtagtttgctggccaatcagtcttgataagtcaatggactccaggtttagtgagagatactctctcaaagtatcaagggagagaaccgtgaaagaagacaatggacagaccttgactgctggcctacatactcatttgcatatacatatacatacagtttcacacacacacacacatctctctcttcctctctctctcttacacacacacacacacacacacacacacacacacacacacacaccacataacactcggggaagggaacatcttcctttttgaattttagagttgagtaacacattaatctttgtaaatatcttagtctacattatggcttctaactatgtactggttgtttataacactattattcttaactttcagagccataaaggagtatggaggctacaatgtagacaaatctggaacttcagaagcatcagcagaaagcacagactatagcaatgaaaggaacctgaagagaacatctgtatgcaaaggacttgacagcatcaggtgatctaacaaacttggtgaattatggtcaagaattgtcacactcaacttttcagtttagaaaaataatgttttctagttgaaggatatggtccaagttttatagagcaggattagattacatgaaaaagctaacaatgggaaataggacatagtctatgggatcaggaaggatgcctgaaggtgagttatgtcaggcagtgacatgataagaaagcttgtaaattcataagaaaaaagataatgcatgctgttcgaatacaatactgctcactacttcaaagacataatgacaacatgttttcctgaagaacagagaaaactgtcatatgttttctgtatttcaagttatttccggtaaggcctcataatttattaagactaaaggaaagatgtgtttctctgacctttaacaataaggtgactgtacctttctcaaaactgtagtggatttcttgaaatcagtggaaaccttttaagcacaagtgatttaaatactaaaaaattcgttctcctggtttatttctcagacctgctggatgacacacttactttacattagaagggcactgaaaaaaatttcattaggaacacctgggcaatcttgggtcgcagcatattcttggaaaatttgtagttggtgctttttatcatacatatgcagatttgtattctctgttttatcttagtctctttcggtctgtctgtctgtctgtctgtctgtctccccccccccccctctcactctttgtgtgtgtgtgtgtttggtatatactgttctttctctatgggcttgtctggccccagatctctgcacagcacacttgtagtaagtctgctcatcgaaacataaaaataatagtatactaataatattctaatcaataatacttttgactgaatggacaatttatctcattatttccaatttttatctcttctcattatattatgttctgccttagttgctaaaattgttatatcaaaatacgtaagcctggaatatgtacataacagtaatttcattttttcagaactccagttaacaggcagtaaggtaactgtactgaaacactgaaaaagttacattcttctgaatatctttctgcttggtttatgcattactagcttttcgtgcactcaagtagtcgcccatctgccatctgtgtctttatctcaactttccatgcaaacactagacacactgcattactgctgttctaagaactccccttttaacttatataattatttaaagacttattttccaaatgtggtcatggattttaatagtaggctttgggatctgaacagaaacatttcagggaacacaatccaacctgtatccacttgtatttttaaataaggccacttcttactttctatggaactagctcatgggtgaccttttgttctgtgcacctcaggttcttttccttctattaatttagaatctcctgtctctcaagaggtaaatatgcttaggattctcagactgcagcaacagtgaagaaagacctttccacttatgtgcttgatgttctcaatgtgggtctttttctctgcatactttctattttctttttaaatctctatgctttgattcttgtatacataagtactgatttaacataatttttgtcactccttttggccacccttctaactttttctgtggtcctatcttgaattcttaagttcatgacctcttcttttataatttctctctctctctctctctctctctctctctctctctctctctctctctttctctctctctctctccacccccacacacattgttttccagttttgtcatcataaatttatttcttgtttagctcccatttattcttcaacctcttagatctttaaaataattgcccaaattatttacaagcagcaccagtaaatactgaaaaatcttatctgcattggattttcctgagaaatggtgaatgaagaagtaagttaattgtaaattaataatatgattctgttttcttcagaattagactgtgacagttatgtgactctcttatcttttattatttttgtttggtctttgaaatggtctgtgatccagcccaagctggccttggatttatcatgtagctgatgatgcctttgtattagttacttttctaaattgccgtagaaaactctgactaaaccgacttaaagaagaaatcatttgtttggatcatgatcccatcccagaagaattgattccactatgacagggaaggtaatagcaacaaccaaaagcagcagtaggatgctgactgatcacatttcatccacaaacaggaagcagagaatgggaacaggaaatagggtaaggctataaacttagttccctagtgatgaacttcctctagcatggctccattttctaatgtttccataatcttcccaaagagtactacaaactggagaccaggtgttcaaatacataagaactatgggggacagttttcattcaaaccaacatagcccttaaattcctgattttcctccttccacttcccaaatcttggtaatattggtgctcgccccctttccagctgctaagtattgctttgtctttgatttctcattacttttgaaatctgttaatagattatccctcatttacatagcttgaaatttctcctgtcccctaggctggtacatttcaacctctgtactgagaggcagcacagtgaaataccctaatttttgagagaggattttttttctcaaccaataattatggatgtcataaaacagtccaaatctaatacatttataaaattcccaatcaactgatatttcaacattgactactaggacttagctgtttctgaatagagagaacttagggctagttatattattttatggggtcatcaactcagagagaaactgaaactcaggtcaaaattagaacttagatgattatagacctctcatacagggaattttccttcccaagaaaacacagataggcttgaatgatatttatgctgttgtgaaaaaagggaagatgaatattctattcattcatttattttattttttcagagaggagctgtacccgaccttcacacaacagacacgtggtcagtaacatggacaccaaaaggtcatggaagatatatgaaacagttctgtaccacacagaaaaaattaacaagcagcatcagggaatcaaaaaattttatgtgggtgcctttccaaaggttgtgttatgaaaaatgaacattgtttggaggccagtaataaaaaaaaattgagaaaaatgggtgtgtacttctcactgtagtctcttacggtctgttttattccagtggcatcagttttcatttctccttaaaaaaattatttttatggtacattttgtttttctgtattctagctaaatatttcttgttttggatgatgttgcagaacaaaacaaaacaaaacaaaacaaaacaaaacacaacaaaacagtaaaagctagtttcaggggctaggaaaatggcttaacagataaaaacccttgtacaaacatgaaggactgagttcaaaatttcaaaacccatataaaagcctgggcgtggtctgaagtatgcctgtaagccaggcatctagggagtggagatgggagggttgctggagcttgctgtcagccagctcacttcacagtcactgagagaccctgtctgaagtaaataacacggagcatgatagagcaggacatgaaacattctcttctgatttccacaggtgtacacagacatatatccacaaatacacgtgttcatactacacatgtgaacaaacattcacaaaccttcaaagtttcttttatgtttcccagtgttccgtttcctttatttctcctctaagtattatttttttctgatgattttgatcttgttttattcctttttttttttttttttttttttggtttcttaatgcataacgtaagattgaggtcattttaatttttccataggtgtgcgttgctgtgaacttaacacattttagtacgttgtgtttttattttcgtttgtctcaagagatattctattttcaaattttgattacttctttgaaccattttattttttatgttgtccgcagatgtgtggtgttttcatttctacttgttagtgaattttccagattccctcctatttttgatttccttattttctgttatggttatataagatgtgttgatttcagtgttaagcttgatatatttgatataacaaaagctgctctagcctttagaatacttgtgtgtgcttgaaaaggatgcagatttccttattgtaaaaggaatatggaatagaagtgggtgagctcatttagatttatggcattgtttaagtcttgtgtttccttatggatttttctgtcagaatgtatcatccattactgcaagtggaacacttaagtctcctactgttggtgtatggttgtttatttcccctttcggttgtaccaacatttactttatagatttagatgttatggtgctatgtgtgtctgtgtttatactcgtcgtttcttcttaataaattaatatgattgttatatattgtctgttattgctttgtgacaaatattgcctgggaaaatttctctcatagaactatatttatttttactctctataagaattagataccttgctgggaacatataatttactctagatgaagtatagagaaataagtaaaccaaaatatttgaacaataaatgagattatttagttattaaaacatctcactatgaataagacacaggaataaatagcttacatgtaattgatactaaatatggacaataaaaatcaaaacaaagaaatcaagcaatgacaatattatacaaatccccttaaatttgaagaaaacacttctgcacttaaatgtgtatttgagtaccattgtgtgaaaccagtattatcatgatataaaagccaatcaaacacaatagatagtcaaataaaattactgaaaaacatagatgcaaaaattttcaagaaaattctaacaaataaaatacagatgtacattaaataaattcaaacctatgggcataagaatttttttctgagatgcaaacataattctacacatataaataagttagtacaactcattgttttagtagaaaaatgataaagatcaaattatcagcaaaataattatgaagaaatattcactaattaatactctttcataatgaaacccatcttaagccatgtatagaaaggtttttattagatattttcttcatgtacatttcaaagctccctataccctcccccacccaagaaaatacagaaccacagaacacttactcaattcaacaagaagatataaagtattcttatttttgcagatagcatgcataaacccataaatttttcttaagaaaattagaagcagtaaaatgtgctgtaaagtgagaagatacaaaacagcataaaacataaactatgttgttataatcttatctgaaatggaaacaaagacaaaatcaatttataagagaattgaaagtgacaaaatatttgagggaaaaaaacctaactaaatagatggcacacacacacacacacacacacacacacacacacacacacacacacacacacaaagattacatactacaaaattttgagaaaagacatctcccagacagtacaaatgtccttattttgagagactgaagggagcttttttgaccttttacatatgaagatacagcaacaattgccaacgactgaggacagtgtcaacctagttgaacctttcatcttagtaatctcagccttcaagttatgagaaacttgttgttttcgtttatatcttacctaatctgaagtatttccagagctgcctgaacagcctgtaatatccttctcacagtacactatgtgattgttttcatgttcttatttaccctgaatgtactgggatgaaggacaagagaaccctttgaaactttcatctatttggacaaaagtgatgaggactttctcagttccatgatgctatgctcacaaaaaggagctccagtggaggaaatgcctctatgagatcctcctactgtaaggcattttctcaattagtgatcaagggggaaagggcccttgtgggtaggaccatctctgggatggtaatcttggttctataagagagcaggctgagcaagccaggggaagcaagccagtaaggaacatccctccatggcctctgcatcagctcctgcttcctgacctgtttgagtttcagtcctgacttcctttggtgatgaacagcaatgtggaaagagtaagctgaataaaccctttcttccccaactgcttcttggtcatgatgtttgtgcaggaatagaaaccctgactaagacagagtcttattctgaaaattaaaattacatgcttagagcataccacaatgcttgcctttaactaagtgaaagtctgcagctgatcagtttggcttgctcctatcatactgacagaaggtaaagactggattgatacctttcctagagtgattaattttagctgccaaagacacaaaattgctgatcaagaaacaagaaaggatatgtctagaaataaaaagggccctggcgtggaggaacgggtgtcattaacattatcagatgaggtggggaattgtaggggcaaactcctattttaacacaacttttattttcagccttcttttatcttcagttacaactttaagatacatgatgaacatgcccagggtttcttccatctgaagtgcaacctttgaatatacgatccatgtccatgagttatgcatgccctgaaacatgtttgtcatcatgcttcttaagttgtggctttaacttgtgcgcactcagtaacatgctcactagagtactttcctaaacgaatttatatatcactcaaagaaaatgattacacttctttttctggagaggacattattttggaaataacttccttgcttttcttgcctactgattatcataattttttctctactctttagctttgcagtcatcaaggaatgaacccataggattggctattctagtactgccatgtctagtaataaggtgttggaacattgactgttgaatttatgtaggaccatggatggctaaaatttcttttagatttgtataacacagatatccgaacttcagtaggtagaaatgattgctgtggttaatgggaatgaaaattggacagagagtttgatgacgtcataactgatgtagtttcatgaatagaaaaaaacaaagacaggatcctccatatgtacttagccccatctttttctttttctttctttctttttttttctttcgtatttctattctaagaagacaatagtgccggtagtacactctgatttactctaaattttgaagtgtaataagtatgtttgtggctgaatttgaagagaaatgatcatagcgtaatgggccttatatggtcactgattaccaatcactaagcattgtttgtagtgggcaagacaaaccttaaatcagagcagagtctggaggaaggcgtcagtctcagcctcacgctgctcctcaaaggctattgaggatccttgacaaatgttttctgctctttgggaagacagcgccaaattactacgttgaacaatcaaccctgctgatgtacagtaaactggcccttgtgcatggaggctaatggagagctagataaagaggtgacctggaaaggaacccagtggccagggtgggtcctgaagccctgagcttaataacatctaatagcgagccagtctgtcattttggagccttcaataaattcttgcggggagttaaagcctcttctctgcagcaccattaagcatggagaggggaagcttgtctcccttttgagctggaggctaaattgagtgtgatagctgtgatcgccaccagaagaaaacactttcaaatgagtgatggcctcactaattggaaggaagcccgctgctgtgaggcacggggcatggcagaaaaggatgtgcataagggaacacacgagaagatatccggaaaaaccgagataggcacaaaaagggatagtccatcagagaagcatgaacaaatgggtacttgagcagagtaattaatagaaacagcttgctctgtagtcacaggtatccgactcacgcacgtttccctctttaattctcgccaagatcccgagaagtgataattaccatccctactcccaaggacaaggaaactgtgattcataaaggccaatttggcaaatattctgtatctaagaagtcacaaaatgaagatataaattgcagtgtgcttgacctcagtgctaaaggatttaccaactcagacaatttaacacctcttcttctccttgctactcatgctggtgactgggcgatggagacattttttagacactttgttaattaaaaagatcacagaaataccagtgtgctggcttttcaaactttctacacattgagccgctcaggagattatgttaaaaaaatactgatgccttaccctgagggactcaatcttactgatttgatgtgcaatttctacaataaaaatttaagaactcacctagataattctaatttttgacaagtaaaagccaacacactaataaattagtggatagatgaataatagcatttctactttggaaacatttttgattgagtgctatgtatggtctatattcctgataaccttcctgataaaagatatgcgtctcttttaccttactgctgacctaaagtaacttcaaaaattgtagagaaaagtatttagtcctatgtgaatactgtaaatgttttctcacattcagtgtgagatgttcatttgtaaattggtacctactaatgagcccgctctttgaaatcctgatgaaatacaactagcatttttttttctttcagttagtattttcttgtcatgtctaagatatatttgccaccatctaggtttttttatttcctcataagatactttgtttttaggtcatgaggaaactactgcaattactttcatttgacagacaaggatccataggaaagtcctcgttaacttattttctgtcaggaaaaaactgaactcataaaatcattattcagcagcacagagttggccccccagtgagcatgtcagaaatggggaatggtacccactgtgccattcaccttgattttcaaatatgtgacacaaacttctataaatactgcttaaaccatagtaaatacctattgactagatttttttttaaatttttattaggtgttttcttcatttacatttccagtgctatcccaaaagtccctcacacgctcccctccccactctcctacccacccactcccacttcttggccctggcgttcccctatactgaggcatataaagtttgcatgaccaatgggcctctctttccaatgatggctgaccaggccatcttctgatacatatgaagctagagacatgagctctggggtactggttagttcatattgttgttccacctatagggttgcagacacctttagctccttgggtactttctctagctcctccattgtgggcccagtgatccatccaatagctgactgtgagcatccacttctgtgtttgctaggccccagcatagtctcacaagagacagctatatcagggtcctttcagcaaaatcttgctagtgtatgcaatggtttcagcgtttggaggctgattatgggatggatccccctgatatggcagtctctagatggtcctttcgtctcagctccaaactttgtctctgtaactccttccatgggtgttttgttcccaattctaagaaggggcaaagtgtccacactttggtcttcgttcttcttgagtttcatgagtttcacaaattgtattttatgttttgggtattctaagtatctggcctagtatccacttatcagtgactagattttatctttataaaagaataccttttgtagtattctacttcctcattgtttcatgcaatgactttggatggatgctaaagtggtccaagcctaaggatttattttatatttacttatcaatgtatattcttcaaataccttattttaccgggtatggagttgataggcttgtatagttctaaggagaaacgtttgtaggtgtgcctagaattcaggaaacattttaggcctttgccacagtggctgactttctgtctcagctttctcttcagctcccatttggagagtgtagttaccagataaacacggaatctttagccacattgtcgactaagcaaaacagaagcaataatgtgatttccatgtagtatgctgaatgggttatacttggaatttattatctggaatttaaatttaactgggaaattgtatgcttatatgcaaaatcaggcaactttccttaggggtctaagtgtatgtctacgtgggaagatgtcattcacatattcatttcaaacctcatatctttattgtgactatttcatggtatctaggtttctctctcactagggagtgattatcatggatgtatagtgtaacacacacacacacacacacacacacacacacacaaacatatacaaatatatcttctacctaagaaaataaaagcacattttgtaacagtatttaaaagtgtttcaaggatatttcacatcgagtctactaggagaactaaaatgccttattatagtacattagtataataactagtaggaacaaagactagaatggaagataaaaataacaaaaatttccacattaaagtacatttaagcttaaaatcatggatggaaccctaattagatgccagaaggtatactaacataatgttgagtttgcaaatttaactacatacaagaacggcaatttagacactaaaatttctccagcaacattaactcaaccacatcgtacattgtgcataataaagttaacatttagtaaccagggttggtgttataagcacaaaatatgtgcataattaacattttccacattttaaaaaaagtcatttcaaaggttcaatattctcttttcgggaaacgattagtcttagagttaaaatgtttgctaaagcatgattatcttatagtctttccttaagtctaacttgagtttcattttttctcaacaatatcaaaaacaatttgtaataaagaaaattagagtatcaagttttaaagaaagtatgaagcacaatcatcatgtaaaattattttaagtattatctacttatattattaaaaattaacaatatgttaattagtacttattattatattttctaacagttaattattattggtatgcatatgtgtatgcacacatgtttatgcttatgagtatagatagtgtgaacatactattgtatgtgtaggtttgaggaaaacctagggtgtcttctggtgccccatgatataatgacttaggcaatgacatttatttattatgtgatcccaagcaggttatattgccttttttgaactcagattctgtatttatgatgtagaattcatagaggtagttaactcctagaggtgccataagaattagataagctaatatctaaaatgctatttcattcaataaagaggtaactaaaacccatagtattcacaaataaatatactccacatgtattaaaaatgacacttcatattatccttcatctacatctacacataggatattagactataggaatcattttagaaattctagaataccacattgtttcagtgtattaaatatagattaaaattacgttaagtatttctactattgccagtaaagctatgaaagaagttgctaaacttattggtaatcatgatataaaattgacatgaaaattgcatagtgttatacaactgcattgataaacgaataaaaaaaaaaaaagcctggcagtggcaatatccactgtgaggggtcacatggaattgtccatcatttccggaatgaataacaatctcttcaaccattttggacaagattttggcaactattacctactaaattgatgtgtgtatcctataatttagcaattctagaaattcatgtgcatgggcaccaaaggaaattatatggtgatcttactggcttcattcctctaacaagaacttggaaaccatccaaattgctatcagcagaatggaaaaattgtggagtgttttgcaaagtatatttgtagaatggtaatgggacttgaagtgtgacatttgctcctacaaacatgggtgtagggaaggaatatgcacgttgtgatttcaatcatataaatctaaaaactcttactatcttggtttagaagttaaagtaactattttttttggaaggaggaagtagggcttcattagagctaccaaagtcttatctttcgctggcttttagttaatacactctcctggtcagttaatacagttaatacactccccttgttagtttttgacaactttatacaaactaaagtcacctgaaaagaggaaactcaactgagcaatttcttccaacagattggtttttggtgaatttccttttttttttttttttttttttttttttgactaacatgggagagcccagtgcactgtgagtggtaccatctctgggcagatggatcttggttttataagacagggaggtgaacaaaccagggcacaagccagtaaacactgatcctcagagatctttgcttcatgcctccagtttcctgtcttgagagcctatttcatcttccctctataaaccttaagcttaaataaatcctttcctggttggtctgcctcctcctattaacaagggctcatgtcagtgcgcatcccatgtcctggcgaagcttgtgctgtgaatgatgtcccccgtacagttcaggagtaccacatgactcaccctcagagtgattttaggcacatgccaatgtagaaatgaaaatggattccacggaaatttaaatgtcaattttattttttgttcaattttattttttgtgcatttcatttttaaatgttttccctgatgactttttaatagtttaacaaatcaaacaaaagtggactgaaaactaaactctttcccctcccacattcttttggtttgtgttttatcacatcaacagggaagcaaactaggccatatacattcctttaaatgagtttttgatttttattttaactaaaaattttaagcctaagaacaacctcaaaacattttaagattcttgttttccacacccttaaaaagattatctgatttgtgtctattattctttctagcactctgtacagacttaaaaaatcaatgtcctcatagggaaaaaaaaaaacctcctgttcataatatatcaattctttaaaacagttcattataattttaagtttacataatactttgattcaagaggtgaagaaaaccagaaattaaatagtgtattgaataacataattcaggaacattttactatagagtattgagaattagaattgagaagtgataaacataagaatgtgattttggagacagtagcgattggaaagaagttagactgagacctgatgcttggcccaagctggttgtttgggaaacaagatgaaaacaaattactcacaaatggttaagcagtctacagagacgaaaatgaagtttatgtaaagacttttatgctaagtagtttgcttttaataacattgtgtaagtaggaagatattaacattttcatttacgttgagttaatgatgaaccaaaattacttcatgttctggtttagaataaaattgacaaatgttttaaaatcatatgaataacataaaggtattatttgggcaaaaatttaacccctaactttaaggtgggagattatcatcttaggaaaacagagtaaatctagtaaattaataacccatgtatattaagatcaaaggggaaattttatggttattttggagttgaataaaaaaatgagtcagaatcagaactgtcatgtgagccactggaaacagatcgtatttgagcgaagccaatactggctttgtctaggtagctctctagagcacggctgtattctggaggtgaatttactcaaggcaacccaaagaagctgaatgtgtacttatggccgaggcgcaaatgtccagatgagaattattaatgcatacccaaatgaaaaatactaggttagaaagcctggaacttttattttatagttcaaaaaactcatcactgataatttcatattactgaacttgtatacatttgtacaggcgtgcaatgatcgacggtgatgacagaaatccatatacacatgatggatagagtggaaggcagtccaatctcctaagactactttagagccaaagattatgtaaggatgtaaaacatactcttcatacatgtgctgaaaatgtttatttgagttgagatttttaaaccccaccgatgcttaatgattaaaagtttccaaaatttacaattctgttttcttttcttagggaaggttctgagtttaagaaaatggtacagacttttttttttttcttagaaaatagcaggatcaatatagtaaaaatggctatcttgccaaaagcaatctacagattcaatgcaatccctatcaaaattccaactcaattcttcaacgaattagaaagggcaatctgcaaattcatctggaataacaaaaaacctaggatagcaaaaactcttctcaaggataaaagaacttctggtggaatcaccatgcctgacctaaagctctactacagagcaattgtgataaaaactgcatggtactggtataagttcagaaaagtagaccaatgtaatagaattgaagacccagaaatgaacccacacacctatggtcacttgatcttcgacaagggagcaaaaaccatccagtggaaaaaagacagcatcttcaacaaatggtgctggcacaactggcggttatcatgtagaagaatgtgaattgatccattcatatctccttgtactaaggtcaaatctaagtggatcaaggaactccacataaaaccagagacactgaaacttatagagtaaaaagtggggaaaagcctcgaagatatgggcacaggggaaaaattcctgaatagaacagcaatggctagtgctgtaagatcgagaatcgacaaatgggacctcataaaattgcaaagcttctgtaaggcaaaagacaacataaataagacaaaaaggccaccaacagattcggaaacgatctttacctagcctatatcagataggggactaatatccaatatatataaagaactcaagaaggtggactccagaaaatcaaataaccccatttaaaaatggggctcagagctaaacaaagaattctcacctggggaataccgaatggctgagaagtacccgaaaaaaatgttcaacatccttagtcatcagggaaatgcaaatcaaaacaaccctgagattccacctcacaccagtcagaatggctaagatcaaaaattcaggtgacaacagatgctggcgaggatgtggagaaagaggaacactcctccaatgttggtgggattgcaagcttgtacaaccactctggaaatcagtctggtggttcctcagaaaactggacatagtactaccagaggatccagcaacacctctcctgggcatatatccagaagatgttccaaccggtaagaaggacacatgctccactatgttcataacagccttatttataatagccagagctggaaagaacccagatgtccctcaacagagggatggatacagacaatgtggtacatttacacaatggagtactactcagctattaaaaagaatgaatttatgaaattcctaggcaaatggatggacctggagggcatcatcctgagtgaggtaacccaatcacaaaagaactcacacgatatgtactcactgataagtggatattagcccagaaacgtagactatccaagatacaagatataatttgcaaaacacatgaaattcaagaagaatgaagaccaaagtgtggacactttgccccttcttagaattgggaacaaaacacccatggaagaagttacagagacaaagtttggagctgagatgaaagaaaggaccatctagagactgccatatcagggggatccatcccataatcagcctccaaacgctgacaccattgcatacactagcaagattttgctgaaagcacccagatatagctgtctcttgtgagactatgctggggcctagcaaacacagaagtggatgctcacagtcagctattggatggatcacagggcccccaatggaggagctagagaaagtacccaaggagctaaaggggtctgcaaccctataggtggaacaacaatatgaactaaccagtacccctggagctcgtgtctctagctgcatatgtatcagaagatggccttgtctgccatcagtggaaagagaggcccgttggttgtggaaactttatatgcctcagtacaggggaatgccagggccaggaattgggagtgggtgggtaggggagtagggcgggtgggtatggcagacttttgggatagcattggaaatgtaaatgaaaaaatacctaattaaaaaaattaacattaaaaaaagaaagaaaatagacctttatgactgaaactgataccttttttaaaggatagtgcattttatgcttttatccaacacacaaatagtatattcttattttctcaatcttttatgtttttaaatattgttattaaacaaagcacttgtgaaatttcacgcaacagatatatcattatattatgacataaagatttttttaaataacatacatttatacatagcacaaaggaagtatagacactttgccaacacgaaagccattgtcatttccactacaaaattcttggagtaagaacattattatttagcaaaaagcttataaggaacacaatttaaaaggaagtaaagtatccatggctcaagaaagtttttgttacaatacataaaagacaaaaatggagctagtgactaattttattaaattagctgaggcattcgggtaaaggttcatgtgtgtctataactaggatgtgttactgaaagctacattattcaacagaaatatatgtctatatatcataaaatatcataaatatcataatattatatttataataacataaaagaagatagaatatgatatttataatattttatgatatttataatatcataaaagatgatcagacactgtaaagttcactgagctgcatgatgcacttatttaatatgcatttattattttaaagaaagtatttacatagtcagataatttaatgtaggttgtaggatttcactttcagttttcacttagtttataatcatggcttaacatctcaggttaaaaaaattcttgttcaaatgaatttctgaaattttccatatagggggcaatcccctatatcctgtatatatcatcatcttcttcatcatcttcatcatcatcatcaccaccatcataatgtaactattaaaatcattacagaaatatcaaaaaacatatttgaattctagaagatgccagtatgtagtacttctatgaggcagcagttgtaaaatttgcttttgttttgaactcctttgacttaagtggagttggagtactgaatatattttatctcactgacccattttgataatatgatggcttaaaaaatttgtcctggatagacagtctttgtaacctgaaatgttttgctttttcttctgtgtgatactatataaaatatttctattgtggtgacataatatgcaaattgtattgttatgcagaaaatgaaatagtatttaaaataatttaaaaatcctcaacaatgtggctttttcacccatgacagaatgcatagggataaatgtaaaaacttgtaagaagctgatgtagtttgctatatttgataaatgacatttttctaataaagtgctgctatagagagaaattatggctctttcctacagtcatcaccaatgttgatcaaaaacggaaatatagtcatgatgagtactttctccctgctagtttctctgttatgatgttagaccttaagaacaaatgctttcataatttaatgaacaaagattaaaaaaaggaatttcttttttcccccaaagattcatttatttattatatataagtacactgttgctatcttcagacacaccagaagagggcgtcagacctcattatggatggttgtgagccaccatgtggttgctgggaatttgaactcaggaccttcagaagagcagtcagtgctcttaactactgagccatctctccaggccacgaatttcttcatattaaaagtgtattcttttcttctggggctgcagctctgcctgcctccctggaggcctgttgtcaccctggacaaccagatgaaatgcccatgccccaatctctgccctgctagattcccagctagtccagcagccttgaggtctgccctatctcctctgtgctccatctttcagtccacacttctacctgcaatcccagacatgcactccatccctggtccacatccctgtttggctcactgtaggcctattgtctcccagcaaaatgagagccctgttaccatcagagcctaccaactctacttgcagttccagaggcctgctaccaccagggactactatgtcagtcaaaaccacagggacaaccagatggctaaaggccagtgcaggagcacaatgaacaaaagccagggcaatatgccatcctcagaacccaggtttctaactatagaaaactctagatatctgaaaataaccgaagtgcaagatgaccttaaatatcatgttataaatatgatagagtcctttaaagaggagataaacaaatcccttaaagaaatacagaaaaatacagaaaaatataatcaaataggtagatacctttaaaaagaaaatgattaaatataaagaaatataggaaaatgtgattaaaaaaaggtgaaggaaatgaatataactgtacaggacctgaaaatggaaatagaagcataaagaaaatgcaaaggagctaaccttggagatggaaaatccaggaaagagaacggaaactacagatacaagcatcatcaacagaatataaaaggtggaattacctcaggcatagaagacacattagaaaaaaattaatatattggtcaaagaaaatgccaaatctaaaatgtttctgacgaaaacatccagaaaatttggaatactatgaaaagacaaagtctaagaataataggctgagaagaagattcccagatcaaaggtccagaaaaatatcttcaaccaaatcatagaagaaaatttctctaacccaaagaaagagatgcctatatacacacaagaaacctacagaatactgcgggaagcggtgcagccgcaggccctgtgaaacccacgtgccttgcctgagcatgtgcagtgaggctgcatgcatgagcttgatacagctgtctcctgagagactcttccagagtctgacaaatacaaagacagatgctctcagtcagccattacactaagcacagggtccccaatggaggagttagagaaaggactgaaggagctgaaggggtttgcaaccccacagaaagaacaacaatatcaaccaaccagatccctcagagctctcagggattaaaccaacaaccagagagtacacatggagggactcatggctccagctgcacttgtagcagaggatggccttgttgggcatcagtgagaggacaggcctttggtcctgtgaagactccatgccccagtgtaggggaaagccagggcagggaggtaggagtgggtgtgtgggtgggggaaactccctcctagaagcagagggagggaagatgggttagggagtttcagggaaagggaaaaatatttgaaatgtaaataaagaaaatatccaataataataataataataataataataataataataataataataatgaacatgaagcctacaaactcatggaaactaacctactctctaactgggccaaagaaaaaacaaggaaagaaatcagactttctaaatttcaatgaaaatgaaggcatagcataaccaaacttataggacacaattaaagctgttctaagaggaaagtttgtaaaactgagtgttttcataaagaaatttgagacatctcatactagcaacttaagaacacacttgaaagctctagaacaaaaaaaagcaaacacacccaagaggagtcgacagcaggaaataatcaaactcagggctgaaatcaatcaattagaaacaaagagaacaatgaaaagaattaaaaaaaccccaaagatatggatatttgaggaaatcaacaaaacatacaaactcttagcaaaactaactaaaaggcagaaaaacagtatctaaattagcaaaatcagaaatgataagggagacataacaaaagacacagaggaacttaaaaaataattaggtcttacttcaaatgtctgtactacaaaaattagaaaacctaaacttagtggatgattttctagacagataccacttagcaagttgaaatcaagatcaggtaaagtatttaaatagtcctataaccactaaagaaatataagcagtcattaaaattctcccaaacaaaaaagcccaaggccaggtggttttagcacagacttttaacagactttcaaagaagagctaataccaatactacttaaggtattcctcaaaatagaaacagaaaggacattctcaaactcagtctatgaggtcacagtcaccctgatacctaaatcacccaaagactcaacaaagagaatttcagaccaatctttcttttttttaaattttattttattattttattagatattttctttatatacatttcaaattttaaatgctatcccgaaatttcccttaccttctcccctgccctgctcccctacccacccattcccacttcttgtccctggcatttccctgtactggggcatataaagtttgcaataccaaggagcctctcttcccagtgatggccgactaggccatcttctgctacatatgcaatctttcttatgaacattgataaaaaatattcaataaaatactcagaaactgaatttaagaacacatgaaaacatcatccaccatgatcaagtaggctttattccagggatgcaggggtagttccatatactaaaatccatcaatgtaatccaatatataataaaattgaaagaaaaaaaaaaaccacatgatcatctcattcattgctgaagaaagcttttgacaaaatccaatgccctttcatgttaaaagtcttggagagatcaggggtacttaacacaataaaggcaatatacagctaggcaacagacaacatcaaattaaatggagagaaacttaaagcaatgttaatacaatcagagacaagataaggctgcatggtctatctattcaatttagtatttgaagttatacttagagctataagacaactaaagttcaccaagggaatactaattggaaaggaagaagtaaacgtatcactattggcagaaaatatgataatatacaaaagcaaccacaaaaaattctaccaaagatctgttacagctgataaacaacttcagcaaagtgcacagacacaaaattaagtccaaaaaatcagtaggtatcttttataccaatgacaaacagattgagacagaaatcagggaaacaacactcttcacattagccacaaacaatagaaaataccttggtgtaactccaaccaagcaagtgaaagatctgtatgacaagaacttcaagactctgaataaacaaattgaagaagatatcagaaaatggaaagatctcccatgctcatggattggtagtgttaacatagtaaaaatggccatcttaataaaagaaatctagagatttaatgaaatttccatcaaaattacaaaacaattctttacagacttaggaagatcaattcttaacttcatatagaatttcaaagaatccaagatagctaaaacaatcctgtatattaaaagaacttctggagatatcaccatccttgatttcaagctgcactacagagcaatagtaatacaaactgaacaaatccatacatttacagacacttaatttttgataaagaagcaaaaaaaaaaaatacaatggaaaaagaaaggatcttaaataaattatattggtttaactggatgtttgcatgtagaagaatgcaaataaattcattttcataaccctgcacaaaacccaagtccaaagtggatcaaagacctgaacataaaactggatacagtgattctaatagaagagaaagtgtgaaataaccttgaacgcatttgtagatgatactacttcctgagcagaacaccaatggctcaggttgtaagatcaacaatttataaatgggacctcaagaaactgaaaagtttcagtagggcaaaggaatctatcaataagacaaaatgacagcctacagattggaaaataatcttcactaaacctacatttggcagatggttaatacccaaaatacataaagaactcaacttagtcaccaacaaaccaagaagccaaattaagaaaatgggtacagaactaaacagagaattctcaacagacaaatctctaatggcccagaagggattaaagaaatgtaaaatgtccttaatcacccgggaaatgcaaatcaaaatgaccctgagtatccatcttaaacataccagaatgactaagatcaaatcctcaaatggcagcacacactggcgtggatgtggatcaagatgaatacttttctactgctgctgagagtgcaaatttgtaccaccactccggtgtcaatctggtggtttctcgggaaatttggaatagttctacctgaagacccagctataatcattcctggtatacccaaaagatgctccaccataccacaaggacacaaggaacaagtacactatcttcacagcagccttatttataatagccagaagttggaaacaacccagatagtcctcaacagaagaatgggtacattaccacaatggatactactcaactattaaaaatgaggacatcataaagtttgcaggcaaatggacagacccagcaaatatcatcctgagtgagataattcagaccccaaaagacatacatggtctgtatttacatataagaagatactaggtgtagaatacaggatactcattcctgtattttacatacatacccatctacagacccaaagaagctaaacaagagaaaaggtccaagtgtggatgcttgaatctcacctagaatggggggggggataaaattatcatgggaggcagatgtagggagagaactggataggagaggggatgggggcaagaatagggcgattcaggtgtggaaaagacaaaagagagggccagacagccaggagaatgaatggaaattggcaactggtgagggcgtgggtgtgtgtgggggcatctctctattccaaagactgggataggtaaggctcccaggagtcgatgggggtgaccttagctggtgagactcctagtagggggggtatggaacctgaagtgtccacttcctggacctcaagccatccacaaaaactttgccccaaaatttgtcctgtctgcaagaagtgcaggaacaaaaatggagcagagactgaggaaatgcccaaacaataactgacccaactttagacccatgtcatgggcaagcaccaatccctgatactattaataatactctgttaggctcgcagacaggagcctagcataactgttctctcagaggctccactccacaggtaactcaaacagatgcagagactcacaaccaaacattggagggaagcttgtggcgtcataaaaaaagacttgggggaggattgagggagccaaaggggataggaactccacaggaataacaatagagacaactaatctggacccttgggggctctcaaagactgaaccaccaacaaaagagcatacacgaacaggacctagtcccccaccccacatatggaacagatgtgcagctcagtcttcaactgtctcctgcttgtgtatctggttcccctaacttggttgccttgtctggctttagcaggagaggatgggcctagccctgcaaagacttgatgtgccacagtggggcgatagaggggttatcttctccttagggaagagaagggaatagggttaggactttttttgtagggtttgggaggcagtggtcaggttgtaaaaagtgaataaataaatgaatggaaaaatgtatttgtctccagacataactttcttttctaaaagaaaataaaatttaaaatttagattctatttatttaaatagtcaaacatttgttcgcatatatcttttttcttttggttgttaaggacacatatattactctgaaatttgcaaaggattttcatctattaatagatggcaaggaatcacttgggcatatgaggtattagaaatataattacaactagatttctacattatgttattgtaaattatagcacaaatatatttaagcttttaatagaaattataaaatgtattagaagaaaacattggaaagttatcattgtgagcaggcaacgagctaaataacaatcacgaggcagctattctaaatcagccttcttcaagtgttaacttagaccaactacatgcatttctcctggcagcttttcagaaatattgactctcagtcttcaatccaggatttttacttaaaacaaatctccagggatttgtgtcatagtacgtagttttcaactgcctgtcatttagcatcttcagagaactatgtataaatgtcactctaaccaactgaatttggatttgcatgtgtgatggctcagacaacagttttttttatataaaagctcctaagtgaacctgagttgtactctgaggaaggaaccactgttcttcagaaaaggatgtataattaactttccaataaatgcaaatatagagtcagagaaattatttgcaacaaggatatcatggagaagtgatgtacccgaaacactaagatgtctttcaagatgattaaaagactgcccaagcactataaccttacatagcttgagataatgaagagatacaacattctcctgggaagaaagttggacacaactttaaacactgcaaatacacagcttgtctcacaaattcattcttagaatattaaaagaattgccaaaaaaggtttatgaatccttactggaggaacatatatgtttgtcaacttgttcaccagacaacattagtaaaagattttagacatgttaattgtggctaaatgtgtgttgaaaagtatccagcagtaagagaatgtaggaggcccacagaaatactttttccagtatattattgagctaaaagagaaatctgtatatttcttgattttattttatttgctgtggttttgctttcagatgtgatttatctgtagagagccagaaagattgcccgttgtactaaaataatggctctcagctagggatggaagagagaaaggcaaggtggagtcttttaatctttgatatcacatggcttttttttccttgctcactttaaatacttttgtatttgaattgtagttatagcttggtgttagaatacttgcccagcaggtttaattacctaggatccatccatgcatctatcgaggtatgcatccatccattcatccttctatccatccatacatccatgcatgcatgcatgcactcacacatccatccagctttcagtctttaagtttgggtgcctgacaccataatcttaacattgggaagctgaggtaaaaaaaaaatgagttcaagtccaggatgtgtaacagaacaataacctgtgtattgttttaatgtggttaaaatggatactttagaattagtttttgtattactgtgaaggaaatgcttatgtggactagagacagaaagtattctttgtttagcctgtagtcgttaaaaagataatatacatatacatctaaatatacatatcatctaaaactttagaggttcttagaagaatcatacatctatacaattttagatattggtatcgtgctaatgttgatctcctgttatataagtaatacaagtaaaattttgcattgagaaggttgttttgcagtaagaaatcatttgtcaggactaaaattagggagctcaaattgcagtccagcaagaaagagagatagcaaagcataggacacagtagtcagccgcacagtagtgctgcatcctccttccgagggttccaatgtctttcctcatacttagaaaccacacaaaagggagaatattggctcttgggaagaattaaaaattaggataggatatgaactatgtgaatgagaacagactttatgatttgttcttctatttagtagtgtgaactgaggaaagagtatagtaattataaaggcattcattggcttttgactttagttactattcatagaggctaaaataccctttcctggataatgaatgactaaatcatactttcaactttagattattatagggttttagatatctgaaattacaccacatggaatggaccagggacttcagcctataaccatttttgttatggttcatactttacattcttatgaaaatactaataaattatgttctttcattttattaaataaacaaagggcttgtctctccgcagccacatttaattttgcagataagccttgactttctccagtgcccgcacagcaccttgtgtgatgaagttgagcagctcggttgctatgtttatctttgtaaaattaattgcagaagtcaaagtattttctaaagagaaaatacttctcaggagttttatttcagcatatgcataattattttgccccttcactggaattgacacaggaaaaaaaatatagcctcatgataaaagaaagataaaaaagaacaacaaaggaggaggaaaggaaagaatggagagagggagggaaggagggagggagggagggagggagggagggagggagggagggagggagggagaaagagcaggtgagaaggagaggcaaatggacagctataaatcttcctccttattgttacattaattttatttaggatctttatatcctttctaaggttaatacatcagtctgccttccttctgacctctggaaggaaaatgcagtatacacacacataggtagtcatctttagcaaggcaccagggcaagccccatcccagtgactgttaagtctctctaacctgctctgcacaggagtacttaccctgtaagagcatcaaaccaatttcagaagcaaggccacttgagaatgacagattagcttcagggaaggttgacttagctcagtggggagccagcttaaacactaagaggcagagcagaagtatagattccctaaatgaaaagctatatttctatctgagttatgaaaagagaaaaaaaatctacagggtcacagctactaggaattgcaaattttatagctaactttaataaaaattgtcaaaaagcaaccaggtcacgttgttagtgctacataaaaagacagacagctaagcaagtaaatttttcttcggtataaaacaagttgatcataaactattaagaaagtattgcagcaaaattaacacaaatgcacatatatacagatatgtgtatatattatttttcttgagtaaataattaaaatattttcctagtcttctcaattatttacatttgaaggtatctgtagagcatggtccaagagggctggcattggtagagcttcatggtagagccttttggagagagaaaatgtgtgtgtgtgtgtgtgtgtgtgtgtgtgtgtgtgtgtgtgtgtgtgtgtgtgttgtgtatgtgtgtgtgcaagagggttgggtggagaggaagagggagtaggagtttacaaatatataaaactggtgctagtcaacataggactggatttggtttgaatttgtatcaaacaagaactggtttttaatactattgtatgggttttatggacaggatttctcctgacaccttacattctaaactacatctcatagctcctaccagtttgaagccacttaatcctggctagaattattttgtaggtgtgtgtgggtgtgtgtgcacgtgcatgtgagcacacacacttaaggagtctttaagaggctgtgggatactctggagctagaattatagttttgtgagtaggcagcctgccatgggtgctgggaactaaatttgtttcactgctagagcagccaaaccacttctccaaacctccaaaacaagtttattagagggtattaaagggaccaagaaatgtgtttaagacattggagtgaatggagctttctgcttctagcaatcttaattctttgggactcagttttaagataaaatattgtttaccatattaaaaatcaaagtggtatgtatgaaggaaatggaaaggaatagagaaatgctgatggtatttgttcctagaccttatctgaatgcacttggaggaaagtatagttgtgttgtgctaaatctcaatgatgctctgcagacagaaatttaaatttacgtttggtcaatatcatatttagtttcacagtatagttgcttaaacatggaaggacctctgaacaggctctacatagaaataaataattaaacatacaagtaagtttagcctcaagtgaaatacactttggttagtagttttcaaatgtaaatcttatcatatcaaacatttctcaggcttgggagatggttgaatgggcgagagtgcttgctgtggaagaatgaggaccagagtctagatggtcaggacccacatgaaagctgggtgtagccacatattctcctaggtaacagtgctgtggtggggcttgagtaggaggcctgtgggccaacggttaggttagctaaattgttgatctccaggtttagtgagacttctgtctcgaggaaatatggcagacattgacagagtgggatatgtgaggtttcttctagcttcttcaatgagagagttggatgatatagtactcacagagaaacacatcacatcacacacacacacacacacacacacacacacacacacacacacacacacacattgtacctcctttgaatggagataattatttatcctatttttatagtccagataatacagactgtactcctacttagtattgaggtattatacatctacatatgtgtgtagatatgaatctacatatacataatatttacaatacattaaaatagtactttagcttgtcgtgtgcacttaataattagtaaaagtactattttatcagtcttcttatagtaagcttgtttaaaataagctataaattcatcattaccttcttagatcaatataaaaattattattttttgcttagtatgtatatcacagacatattcttaacatataaacaatctgtgggtactgttttaagtctgaaattatcagagccaaaaaaaatcatttaatgctccaatttctccatttaacattatctccatccctttgtctgccataataggaactgggaaggccctttcttccaagcatttgaaagcaatgctttagttaccagagaaaaaggaaaaataagcttttctattccatgcctgtctaaggcatcacatgcagggtggaaagatcagagagatttgggatagagatgtagtagagtgatagtgtttaacaagcaagttaaaaaaattttttttgagaagaaatgaactggaagaattttacttatgagcattctgctcatggtttgctcaatctgttttcttttttttttaaattgggtgtttatttcatttacatttccaatgctatcccaaaagtcccccacacgctcccccacccactcccccacccacccactcccacttcttggccctatagttcccctgtactgaggcacataaagtttgcacataaagttttctgattcatatgcagctagagacacgagctccaggggggtactggatagttcatattgttgttccacctataggattacagatccctttagctccttgggtactttctctagctcctccattgggggccctgtggtccatccaatagctgactgtgagcatccacttctgtgtttgctaggccccggtgtagtctcacaagagacagctctatctgggtcctttcagcaaaatcttgctaatgtatgcagtggtgtcagcgtttggaagctgattatgggatggatacccagatatggcagtctctagatggtccatccttttgtgacagctccactatgttaatagcagccttatttataaaagccagaagctggaaagaacctagatgcccctcaacagaggaatggatacagaaaatggatacagaaaaatacatttacagaacggagtactactcagctattaaaaagaatgaacttatgaaatttctaggcaaatggatggacctggagggcatcatcctgagtgaggtaacccaatcacaaaggaactcacacaatatgtactcactgataagtggatattagcccagaaatttgggatacccatgatataagatacaatttgctaaacacatgaaactcaagaagaacgaagaccaaagtgtggacactttgccccttcttagaattgggaacaaaacacccatggaaggagctacagagacaaagtttggagctgtcaacctgttttcttatagcagcatgcaccaccagccctggggtgacactcttcacaatgggcttagccctcctccatcaattactcataaagacaataccctacaagccagcctacagggcaaacttaggaggcatttttttttccattaagattttttctttccagaagtgtctctgtatccaattggcaaaatcagtcaatataattgatccattgtattttgtcacacataaaccacattggatgttaaatggtaaccttgcctttcttgttgtcctcaagtataattagcattttttctttttttattagatattttcttcatttacatttcaaaggctatccccaaagtcccctatacccttgctgtaccctgttccttaacccacccactcctgcttcctggccctggcattcccctgtactggggcatatagtcttctcaaaactaaaagcctttcctcccattgatggcctactaggccatcctctgctatatatgcaactagagacacaatctctgggggggggtactggttagttcatattgttgttcctcctataggatagcaaactgctttagctccttgggtgctttctctagctccttcattgggctatgccagtacctggcaaatacagaagtggatgctcccagtcatctattgcatggaacacagggcccccagtgaaggagctagagaaagtacacaagttaaattttatagctgagtagaagataagttcattataaggaagaggttgggaaatttaaatttcagttgttggcattacagttatcaacattgttcttaacttatttaccccaacctgtgtattttcatttctttctagtttacaattctttttgattagtcacctaaattctatggtggtgatatagggctatttgccatgtttgagtattgtgaaatatttcacatttatgtcttatctctttgcctgtttagaattcaggaatagctagtttgcctattaaacacttatgtattaagatagaattattataaacaatgttagcaatacttactaacttgaaattttttgcactggtgaagtgaggcattgaagattaagaccttatgcatatatcaatagtataacataaaagaatatataaatgtctagccttctttgactatacatttaatgatgtcgacattaaatgtatactcatttatgcatgtcagtactttcacatgagtctaattcatgatctaataaatcaaaacactgagaatacaatattttcagaatatcttgtgtactgtgtagcagatggctagttaaatatccaagatcactttgaatgtgaatgttccaataacttgcttcatcttccatcgctatttccacccaaagttctcagcaataataaatatgtacatgtgtaccatttgttatctactacagtcctcaaagctgttactctacattagtgttcatgatgtttaggtaaagaagtattgagtagataaacagaattactgttatatatgcaaagagatatcaaatgcaatgtgagattgaaaatacagaatttttatcttcacatacagcaatagagacaaagcatttatacatgagttctctagtcttccacagaagttgtcagcaccttgtttatcacacgcaggtattttgatgcttagctaatttgctttatccaaatgctaaatgagctttttcatatctgtataataggagatacatttggattgggatgctaataaattgttcgtgtgtttgtgcagaaactgggagagaggtgttttatcctctgtgctgactttttagtgtaggatatgtgtgtgtgtgtgtgtgtgtgtgtgtgtgtgtgtgtgtgtgtgatgtgtttctctgtgagtactatatcatccatcctttggctattacagcaagttaatctgttgcttggctttctttgataggatcctacattggtctcttcttccaaaggacctatatcagaagtgtcttgacaccatagtctaggacatcttgttactttcttttctaagctctctttctccttgtcactcaggtctaacacaatgggcagatgtcatgtcggtaccacatgattttaagtacctttggtttctagttttcatctctctgcttatgactggagttctccaattcactgggattaacaaagacaccttgagttgaacttctctacacaccctgtatgtaccttatatatttggggctatttttggacatgatttaaaaaataataataaagataattaagttttatgtgtttcacggggccattttgaatcataatgcacagtgccattttggattctgaggaatacaaatgattcaaaatgaagccttctatctaggcaagacctaatcacaatgctcaacatctacattagaatggctctgatacaaagtacacagctatgaagaccggcgtttccaactctgaccaaacaatgagtatggggcaaacaaaagtgaaaatatacttattttccctgtttaaaaaaaaaaaaaacatagggtgtctttctcaccgaattctcttatcaagaacttctcatttacttaggggattcacttctgctacttgtaattatacggtcttttttttcactatttcattaaaaagtatgggattaattttaaagaactttgtagacctaggaaaccttaaaatcttggaatatctttatcctggacctgtaacttatactttgaaatgccattatcaaaggcatggggaaatagcttggtgacagagtgcttgttcagcatgtgtagaggactagattataactagaatagattaacacacccaaaaggtaaacaaaacacacacacacacacacacacacacacacacacacacacacacacacactcacatcctacactaaaaagtcagcatagaggataaaacacctctcatccagtttctgcacaaacacatgaacaatttattagcatcccaatccaaatgtatctcatattatacagatatgaaaaagcgcatttagcatttggataaagcaaattagctaagcatcaaaatatctgtgtgtgataaacaaggtgctgacaactcctgtggaagactagagaactcatgtataaatgctttgcctctattgctgtatgtgaagataaaatttctttatttacaatctcacattgcatttgatatctctttgcatattgcaacctgacttaaaatgtatgaggttttctatgttgaaaaaatgttttttaaataatttcccccaagaataaataacattgtttaatatcctgaaataattgcggaatcgttttaaataaattttctggcattattgcctgtgattctgactactcgtgtagctgaatttatattctgaactggtcttattttacattaaataaaggggcagggagcccaaagtccagagttctctttcaggggattagaaaaaaatatcttagatctgagatggctgtcagagtgacttgtgacaagctgtaagttcattctatttccatgattatgacagataacacctccagcctttgaagtgtcatatctattgaaaatgtcatgactgcaacctccagaaaaaatcatgaaaggaactgaaagagatgctgcttgagtcccttcaaaatatccatctattcccaggaaaaggcatggacattctgtaacagaatcttaggtatgagtgtttctagtgaccagagggtctcaacctgtgggtcatgaccctgttggtatcacgtattaaatatttaaattgtgattcataacaatcgcagtgtcactgtagcaaaattacagttatgaagtaacaatgaaataattttgtggctggagatcaccacaacatgaggaactgaattaaagggttgcaacatcttaagaaccattgtgatatacagcagcatcttagatataaatttgagcaacttccatttcctgagacagaagattcatgcttcagttgaaaaagcatcgcacagttctggtatatgggtcacacttaaatatgtagacattttctgggtgtggtttcctcttttcaccatattgttatactgccgttgtgggaggagacatagattgagactctcctcccctttttggtcacagaggaagtattcagtttctattcttcataaaaaaatgttatttttcttttaaatgaataccaaatggctatggtgggctctttctgtcattgtaatttcacctccatatcatccctattcatttacattttaggtttatctctttttctgtctgtgtctcatatcatccatctatttatcaatcaagcatctatttgtgtgtgtgtgtgtgtgtgtgtgtgtgtgtttggtgtgtgtatgtgtgggttcagatgtgtgatatctatctatctatctatctatctatctatctatccatccatccatccatccaaccatctatcatctatctatctatctatctatctatctatctatctatctatctatctatctatctgccacaatgtacatgtagaagaagaacagtttggcagaatcagctctgtcttttcagcatgtgaacctgggcatgaatgcaggttgttaggtttggtggcctaacttggaggtgcctttatttgctgagctatctcattagtccatcatttattatttttcttttatcggtgaccttctcaacctccacgagctaagaatgtgtctcgtgagcctcttgattgtcctgttcttccagtaagattgaactttcattgaagtactaaccagaccacccctgacactataaatgatattctgctatccttgcagacaggaacctagcagaactgtcattacaaagactgcacccaataactaagggaaattggtgcagggagccacagccaagcattaagtggagcttggggaatcctgtggaagaggcagtagaaggtttgagggagctagaagggtccaggacaccacaagaaaacttggatcttaggagctcacagatactgagctgccaatcagagagaaagcatgggatgaacctagggactctgcacatatgtaacagttgtgtacttgggtcttcacatgggattcctaaaacaggaacaggagctgtatctgactttactgcctgcttttggatccccttcccctaaatgggctgccttgcctagcctcaataaaagtagatgcagctagtctacctgagatgctaatgctgcttgatatccaaggggtggggctcccattttttgagtagaaggggagaagaggtgagagggagagggtaggagaagaggagggggtagaagaaagctgccatcaggatgtaaataaataatttaattaaacaaaatccatattaattacttatgtggttttgggtcccatttttagttcttttaccctagggtaagaaaaggtcagtttgaataaaagatgaagtggaataaagtaaaattaatatacattgatttttttccaagatattctaaaatgttaactggtacctttttacttatgtctggtaattttggagtacttgtcaaaaatctttattttgtttacattattacattacattattaatttattttgtttacattagatttatatgatttaattttcaaaatttacttttctttataaagcagaatttgggtttaataaaggtatatttatctagaatttaagcaaggggaagaaagacagacagaaaggaaggaaggaagagagagagagagacagacagacagacagacatactgcagagcatgatcatcaggttctcaaaaagactctgattttttctattttttccagtggctactcccgcaatgtagtcagaatgacttatataaattagtattttaaaaattgtgctataaatcatatgtaatgattaaaatcagacaacaattatcagtagtaaatatattttcatattattggtatgtaaaacctaacactttgccatgatttgacttgaatgtaaacttctttcagtgttcaacaactataaagtattcaagcgcctcttgagctgctttttctaatcctcagctggattcggtttgtggtatactattgctttaccattgtatttaaaaataaaacaaatgtagggaatcttaagaatcttaatatatgtaacatcatgtctatggtagttgcaaaagatatttaatccaatgatgtatctattgtccaaagggttactcttcttaataccatctattatcaaaaaagcatcttttgataataagttggatttcttgccactatgaagtgccatcccttgttagcttagctcaatatagaagatcaacccaggtaatgcaatttcacagtgaaaataaggcatagcactgaagtaatgggtttatatatgtgtcctttctactttttagaaactgtcagccagtttcaaagatgacagtgacaaaattactggagtgcaatcgccatgttttcctatgaatattgtaaatgtgactttttaaaaccacaatcatatattattattcccattaatatctaagtctatgaacagaagacctcatacttccagacagaccatttcatgtataatatgattattataagtttggttagcttttactacaaaaacatgtaatatgaggaataagaattaattgattaatttattggaaggtgtacctcaagttagatgagaacatcttacaggatataaattgaccatggaaataatgctcagttcttttactctgaaacctggatttttaaaaccacaaatcccacagactgtacagatgttcttttaaaaaatacttccctggagctggggaagtaacttcgggaaagcccctgctgtgcaagactaggggcctgagttcagatccccagaacctatgcaataaactgggctcagtggcaaatgtttgcaacctcagcattggaaatgtgtagacaggtggcttctggggactgtagcctaaatcattgtgcaccatattcaaaagaatcctttccttctatgtgtactcttttgttggtggtttagtccctgtgaactctgggggtactggttggttcatattgttgttcttgttatgggactgcaaaccccttcagcttctggggtcctttctatctcatccattagggaccctgtgctcagtccaatggatgtctgtgagcatccacctctgtatttgtcaggcattggcagagcatctcagtagacagctatatcaggctcctatcagcaagggtttggtgactatatatgagatggatcccaaggtggggcagtttggctgttcctcagaaaattggatatagtactacctgaggacccagaaataccactcctgggaatatacccagaagatgctccaacatgtaataaggacacatgctctactatgttcatagcagccttatttataatagccagaagctggaaagaacccagatgcccctcaacagaagaatggatacagaaaatgtagtacatttacacaatggagtactactcagctattaaaaacaatgaacttcatgaaattcttaggcaactggatggaactagaaaatatcatcctgagtgacctaactcaataacaaaagaacatacatggtatgtactcactgataagtgcatattagcccagaatctaggagtattcaagatacaattcacaaaccacatgaaattcaagaagaaagaaagtgtggatactttgttacttcttagaatggggaacaaaaaaacctatggaagaagttgtagagagaaagtgtggagaagagactgaaggaatgaccattgagaaactgcctcacccggggatccatcccatatacaatcaccaaacccagacactattgtggatgccaacaagtgcttgctgacaggagcttgatatagctgtctcctgagagtctctgccaatgcctgacaaatacaaaagtggatggtcacagccatccgtccattggactgacaacaaggtccccagtgagggagctagataaaggacttaaggagcttgcagccccataagaggttcaacaatatcaactaatcagtacccctagaactcccagggacaaaaccaccaaccaaagaatatacatggtgagactcatggctccagctgcacatgttgcagagactggcctagtcagtcatcaatgggaagaatggcccttggtcctgtgaaggttctatgccccagtgtaggggaataccagggccagaagtgggagtgggtaggttggtgagcagggaagaggggagagggtagaggaaaggggttttcggagaggaaactggaaaaggggataacatttgaaatggaaatatagcaaatatctaataaaataaaagtcctttccccaaagtacagttgaagttgagaggattgaagaagatatttgatgctgacctcttccttgtatactttcatacagacacagatgaagtcacaccacactgcacacacacacactgcacacacacacacacacacacacacacacacacagagagagagagagagagagagagagagagagagagactcgtgcctcatgcatgagagattggagagtggaggtttttctttcttcttctctttctcttctctttctcttctctttctcttctctttctcttctctttctcttctctttctcttctcttctcttctcttctcttctcttctcttctcttctcttctcttctcttctcttctcttctcttctcttctctcctctcctctcctctcctctcctctcctctcctctcctctcctctcctctcctctcctctcctctcctctcctctcctctcctctcctctcctctcctctcctctcctctcctcccctcccctttcctcccctcccctcccctcccctcccctttcctcccctcccctcccctcccctctcctccactccactccactcccctttcctccactcccctcccctctccttttctcttctcttctcttctttttttgccagcaagtgtttcttgtagtagataaaagttctagattggacatttacattattttttagatttgtttatcttcaaaactgtttaagtcttgtattttatctcagggctaacatagagatacagatccatcattaaaagaagaaaagcattgcaatagagccctatgtttctagttgactgccagatttgttgcttttagacagaaaattaaattgcaagatgaggcagattctgtcagttcacacgtttcctgaaatctaaacactgattcattctgtgtacttgcagttgtgagagtctctaggactgtctagggacttttctagaaacatgatggctattttcccctaagctgacagatgtttcctgtactctctacctatgtaagataatgatatttatttctcatgttaggatctgtttctggggaaagtgaaattcaggctgataacagttcacaatagctgtaatttgaacccaccctgcaaaaggctatatggacttcagaaaattttaataacatgaaatgtaatttatgttgtttttaaattataaacagctaatattaaatgtattttagtcagattaaaatttcaccacagcattattttcaacattagaattggaggagtttgggccaggcaatcttaaccttaacttgaaggctaatgtgtggcttgtatttgatgctacagttcttcaagtctcaatttatttgcttttaattaattttgagacagaatacatcaattcaatgttgtcttgagctgctgtctcttaccaagagctgagattccatgtatgtaccagtatgactggtattagttctatgtatttaatgtgaggtggggtcttgatctagtttccaggtggactttaaatttgtggactcaagtggtctttcaacctaagcctcctaagcagcttagacatttgatgtgctattgtgtttggactcttcatcttccatattcagctgaaatttttctgttctgatatggtatgtaactgagagggggagatgcatccaagacaattactgcatgacgaaaatcctctgagtgactgaatctttttcagtgatacgtgatttacttatattagaaaaaaagttgcttgcttatgtttttcccctcaaatagcttaatataacaacatgcaaatggtttacttttctttttgtgaatttcatgatttaaattcacttttaaaaaattctcaagcagtttattacatagactcatggtcctacttgttttaaaaagacagaaatctttgtagacactcatctcattacctctggctcttacaatctctttgccccctttctgcagtgatccctatactatataatatgattaaagaatttaagaaatagaaagaaaataaagatgacaaaacaacaggaaaaaaatccacaagaactcctcccctcccctcccctcccctcccctcccctcccctcccctcccctccccttcactagaagggtggggaagaggattgaaggaactagggaactggagggattgaaaccacaagaagatctacagagtcaaataacctgggatcaagagagttcacagagactgaaccacggaccaaagaacatgcagggcctaggcctagggtcattatatattagtagcagacatgcagcttggtcctcatgtgggtccacgaacagttggagcaggggctgtctctgacttttttgcctgccattggttccccttccctagtagctgacttgtactgctcctggatgtcatgtagaatagtacccagggagtgggggcttcctcttctctgaggagaaggtaatgggggagggattttaaggtggggctagaagtagaggagagaggaggcttctattgggatgtaaaatgaataaataaattaatgaaaaataagtaaaataaaatgtaaatgtatcttttagtcaccagatggaattgtcatctctctaacccgactgatttaacctggttttgtttgtttgtttgttttgtttttgtttttgaaattgaacatcaaagtgccacagactcatgcctttttacatctcagaggtaacggcagacacatgcctgccccatgcttttctgctgtcactgatgtttgatattcattgatttatttcactccagtctgtgtccaccataacatagcacttcctctatgcatctgtctgtcttctaatctggatactgatgcttttggattggtgaccaccaaatgatcgactgttatctcattagaaaagataagtttcaaagatcattctcagaactattggggtttgcacaacaatgcatttttcaaggttcacagttcaagcttaagcaataacaatgtctgtaagtcatttgctgatgaaaatggattctggatgtgactcattcagttgtgtagaaccacaaagccatagtctgacatagcgtttctttccaaaaatctgcctggaaaagactgagtcctcggtgaaagagtggagtagaaggcagataaaggtcttatctcttgggggattgaagatctagctgcttaaaatgaatccagaaaatacaggaagaagggcacttgcattcagggtcctacactatgacatatgctttggaatccatcaagctccactcacaaaataaaaatccaaagataaaattgttaacatttacctagcaactgcaaagtattaacaactgagagtatgcagagtatcagagatacctgtatgaaaggtgtatacatttggatgttggacatggtagtcctgtggggaaattagtaaagtgtggcaatggctacttaatctctcaggtggacagcattatggtatgtccttctgagaaaccagtaagaatagatccttttcactctacatctagtatctgaaaatattctgaagcagaggtcacagcaacactgactcccaaagacgaggtccagggaagggagaagattggataaatttttagcactgtctgagtcatgactattgatggcttcttgacaagtagggctgcaggatctgttagctagtgtggtggagtaattatccagctgaagggcaaaacctctggtccttgtgtggttctacactcctcttgagaacaaacccatgcttgaaggagttgaatggaattttaatatgttgtgactgataaagggggatctcaaaaaaagaaaaaaaggtttatatttttatttaaagtattttaagtgcacctttaaaaaaactcctagttaaataaagaacactatgtttttattttttactaatctgaaaaattatatagttggatctgctaatcctccactcattaacatcatttttctttttctattttgactgcattcaaaatctgcgctctcattcttgagttttagcaacttgattgccaatgataaaagtttaaaaagtgctttgaagggaaaataatataaaatcagcaacaaaatgaaaacccacaaattattattcagttattctctacttactaaatggagttaaattaagctgatcatacttgataagatacattttaaactctgctcatcatcaggatgaattgaaaatgatctagcaagctgctaagtggttgtagaaatgtcttatgctgggaaatgatagaaagttctagaagatacagatcctcagtctcttgaacatgtctatattgtagagaatataaagatccattcatgctgagaatttaaagaactccattatgttgtctaagaaaagacagacaggcacagatgctcaaaagataaattaaacaccatctgtcaatctgaaataaagctttaacacaagccttcaaatattcagcttcccattcactttctcacttcggtcaattaggaaaagaatgtggggtaatatgtctggtagtttgtgggtaattgttagagatgactgagtccagcaatcttaagtggctctatttccagaagaacaaatttctttagggtgtaatattctatggcagcatgcaaaccttcagccacccagaaatgaaaattcagggtttctctgtatagccctggctgtcctggagctctctttgtagaccaggctggcctcgaactcagaaatctgtctgcctctgctcctgagagctgggattaaaggcatgtgccaccacgcccagctgaaaatcaaatcacatttacagtttatgtcgtgtgtgtgtgtgtgtgtgtgtgtgtgtgtgtgtgtgagatgctggggttggcattggtttacgtcctacatctctctctacttaatgtactgaggcaggatctctcacagaagccagagcttactgccaaccattaacccagggatctctgcctctacctcccatgtgtttgactaaacatcaccattcctgtctgtctcttatatgatgctgagaagccaaactctggtcctcatgattatgtcacaaaactttcctctaagccctctccctgtgctcatattcatttaagttttatacagctaatacaagcctagtgaaaattgtaatttttaatttcatgcaaaattctttcagctgtttgggacattctatgcaaagtattttcagcccatttcatttactctttcatgacctgttttttttttctttatgtaatgattccatgtgagtatatgaatgcattatccatggacagttgcaataaatagtttttcagagaaacagaaatatttctgaaatataatggactttgtaaatcaaaacaaaacaaaacaaaacaaaacaaaacaaaacaaacaaaaaaaccaactctcaaggtctcaaacactatgaattcttttagtgttttaactctaccagaggtagttgctaagatggaaacacagccagcctaagtgcaacaggattgacccacaccaagagcttcttgaaaacagaattgtgatcgtttctttgttattagaaaccttcttttcagtgacttgtgtatatagaatacagaaagcccaattacaaatgtacagctattctgtgaatactggttacattcacaatggttctgtaaagtattataatgtctttttttcttgtggaaagataaaactattgtgacagtacaaagtacttttgtgaaattgtcgattttatttctattcaaatgtcatagagatgccacatttctctacttcttcacattttatcatttattcttattgaagaaaacataataaatgcagtcattgttacttactgacagacttcctcctttaaaataagctgatatgtgatatccttgttgtgggaaccttaggaagtgagtgtgtacacacatgcctagaggttatgtgtcaatcacttgaagattgtatgctaagcacacaatggtagatgttgctgctacattgtttggcatactgttttacagtaaactttctctgtaagcagataatgatgaaaaagtcatattggaactatcatattgctatactcttacatgatggcagatggagaaatgacacaagtctaatcacagatacttgataatgaactgaaatttccgaggtagctgcatattcttgttgattgtctaagactacttgacttcaactgactagaataccatcatcgctgaaataaggactgttgtgaatcaagaacccaaattactctgggctatcttataaacttttgaagacattacctctactctttggtcatgactgctataacaacttcttagaatgttttgctgaacttggcagacttctaacttccaccaatcctaaaagcaaggaatgttaaaaagataggctccaaggaccacagaaaacatgtctgacttactgaagtttgcttgcttcatatacctactgatgtatttggtaaatatactgctttataatttaattttgtcctgtgagttttaaaatttacacatgcccctgtggtgggtgaaaaatggtatgtgggaaaacttgaatccatgttccatggccttgaatatgcatactgggccagaataaactgtcttcttgtatcttttaacacaaagttgttatttttcattgacatgaataatggatctgagcaatggttttgacagatacaacatcaataattggtagagatatttctgctctggaatactcttgtggaactacctttgcatatgtggtccatcactgtctgatctgccattatgcaggacattctgtaattggcatctgtaagattgttattcattacatgataatgatgattaatagtgaaataatttgcagcttaaatagaaatctaatttatcacttttatgaaggaacactaatatccttacttgtaggaaacctacatgacagtctgcacaaaaatagacaaagtatcaacttgtcaggatgtttttgacatttgttgtttttttttttttttttcctgagagttagtatttcctagttagtagaatttataacagctgggatcttataacgttttttcagccagacaggggaagttcaaaagagtctctctaatgatttggaaattattaaaatattggtggcagtttgcagaaaattatcagttcttttaattcatagtttccctacttcgaagtttgagcttctcttcataatgatgtgccatttcctatgcaaagatattctcaaacaaaacttcattctgcttcagttatattctttttgaagcttttgctgccaatgctttaaaaaaaaaactacagacaccgaagaaaaccctaaatttctcaaacaaatctattccttaatcctggaattctctgcccccatcctccatgagggtccctgttcatgttttactgattctgcacaagtaaaacacttattcaaccaaaggaaccaatgtcaggatataacttctgtgatgagaaagcctgaaaaactcatgctttttgggtcactcagtgaaatattttatttaataaaacataggaactaagtgagaaggctatttgcttatgatcttcctagggcattttgctcctatctaacattcagatataattttatatttattaataaattaacaaatttaactccataaaaatgtagatatttatcctttaaatatgacaaactagaattttacattctgttctattgcttataagtatggtctttaatcagttaactttctgaaccatggtttgttaaatgtcgagattattttcaaatctagactgtaatcttcttagaagcttaaaattaaaaaagtaaaacaattttctttattgatagcaagctcaatatattttgatactgtgtcatattttatattgccccacattcttctattagccactgagaactaaatcctggaaattatggcaagttcatactcaattttcctaaagtgttgatctaagagtcaaagatcagaaagggcttttattctttgtgaactgtgaaattaaaacggcacttataaagtggaccagacttcagaatattctaactgactgactgctcaatgcttccagaattggttagtatttgaaaagttaggtgctgtttcagtaagttcatacatacagcagcccttttatgtctgaaaaatgctttttctgtggatgcattcaccacctttggttcttacacctgtcaatcttttctacgtgcatctctgatccttgagtggaggggtgtgatgaagacatcccatttacggctgtgtgttcaaaagtctctgcctctgtatactgtacagttgtgaatccctgtgttaaattcaatctattgcaaaaaaccaaaaaaaaaaaaaaaaaaaaaaaaaaaccatctctgatgggtgggggattaagcaatgcgctgacctgtgggtacagaaaaaattttaatgaatcattttattgctacattcatgctgcagaatgatagtagtaggttccccctcaccccaaggacccttgacctatctagttttaggctcttggtcttattaacagtatgggttctaagctatggagggagccttaattaaaatcaagaaagtggttggttacatccataatctttgtgctacttctgcaccaatgggtataatttgatggcagatcattattatagcttccagggcttgtagctgggtgaaatagataaatgagcttctcctctgatagcatgtataaatacctctccacactatgaatgcaagagaggtgaatcttctagtggagtaagtagatgggggatctgggaggggccagaggagtggaaatagtggaaataacatgatcaaaatatattttataaaaattgaaaaataaaaatgaacagctaggtactgggttaaatcacatatatactgaagtgataagtcttaaaactatgagtttgaatatttttttctgttacagatatccgtgaatatttggctccaagctaaatgatgtgagaatgtcattaagaccacctcatgggcttaggtgtcaattttgtggagtgtaacaaaactacagtcaaccatactaaaactcaagactcacttctaacttactgaaaaagtacatgtgaagtaggaaatctgtcttggatttctcaaaatcacaggatattaaataattttaaaagcccaagactggaacaatacaataagctcttagtggcaaattctgagagcactacagagcctcactcattccatgcagagcagtgaacatttcattcacagctgcacacagcataggcggcctgtgggtcagggtcatggtacagagtagagacaggatcacaaaggagatattaccattctcttgcttaagcatgagcctagagacctctaacataacacacacacacacacacacacacacacacacagacacacacacacacacacacacacagacacacacagacacacacacacacagacacacacacacacacacacacacacatacacgcacacaaatacttaacagtctttacaataaattatgtgaattgcattcacaagaagtttagaaatctggttaatgttctggttataattagcaattctactctttatcctgcaatctaggctctgtgcccacaatcagccattccattgacagagcacagagatctaggtaagagcagaattgtaaatgagatgccacaagcaaaatctactttagatgcaaaaacatcttcattaagatcttattatgattcttcccttcaccttatatgcaaagaaattactctgaaattacctaatttattttagtattgttcttgcaatgctatattacagatttttggatatttggtatgtaattacacaccagcaacaagagggagggctagatagccagcaggactcttttgaagtgattaagataaaataaagaatcttgtctccgtgagtgaactgtccaagagtctgctgtcaacgtagtccaggtatggtttctggcaaaaattcagcttctttctttatcagccaaattgggacaatcttagtgtatatcaatgagagcagtgaaaggagggattgtttggtagatagatatggtcagacagaagaaacaaaagggacaaataccttttaatatgaccaatgcaggtatactaagaacaaagtatctaattataactaaaagcgttactttaaactactgcctaacacattgttcatgtgatgggttatcattgactaagaacttctaatatggtgaaagtattgagaacatgtgactgctgagccttatatctgtcaaaaggtacagggaacatcttggaagagagggtaaatataagatcaggagggttggaggagtgctgtggaatgagtctgctggacatgacatagcctttgcctcacagaagttgtggttacctacacaagatgtgaccaagatcaatccagccagttttcccacgtggagagaggagaggcttctcagggcttgcttgattggcagtcgatggctctcaggtgtgaggaaacatttttcttcatgagtaagactgttggtacattgtccatgctttagtggatgttcctgtatctatgcctatgtaagaagcactaatatgactgttgattattaaattaacaataataataataataacaataataatgatgatgatgatgatgatgatgatgaaagtagaatctgctaacaaaacatcttaggaggtacagaagttcacacataggccaacacacttgggttcagtccctaaatctcaaaaattgttagtatagactcctgatagctgtcctctaatctccacttatctgcatacaaaccacccacacaatataataatatattaaaagcataacaaaaaggagattgggcaggtagaattggaaaaattagggtgatgttggtggaattcaggtagatttgatcaagatacattgtataaatatgtgaaataacaaaaataataaaataaaaaacataagatgaaaaaaattgtttgctttaagagttactctgaaaatatatatgcatgtgtcttgatattgtttatatccactcctaactgctttcctccatgtctttctagatactcatatctcttccccaaatttcattccttcattgtcttatttgtgatgttaatatatacatgggtgtagggtcagtcattagtcaggggtagccttcttttttccctggaagtcatcaactattaatagcttctcagttaggaacggggctttggaagcctctcccctctgtgttctggaattttaaactaacgtgatcacatttggggcttgtatgggttagcacggatactgtgagttcatgtgtgagtccatgtatgtcatatccagagtacagtatgtcactaccatgttgctcttgtgttctttcctcagattctgtgataatgctagatgccccgccattgactgaacactcacagagacctatcctcagcactttgaacagtcatgagtctggttaaactactgcccattacagtaaaaatcttctatgaccagggttgagagtagcccaaatctagggatacagtattaatcaatatttaaaaggtaatttgccaatataaatacttagaaaaactatcatgagtttttcccctagggcttatgacttttgtaaccataggttttcaccacacttctatactcagcatgaattttctcctgtggaaaagcccttaaaccagtcacaaggtatttaattggattcataaacagtcttgtcttcactgaataagttcacacattttgcatgcagtatataattctggataagatcaatcaggtctattctttccaagtagcctgcatattatcttctagcactacaaaatctatttagaatggagggagtttcccagtctgcttaatattgattcatctatttcatgcaccttcagtagcaagatattgccatctagttatggtgggaaaccaaaagcaatggcaacagttcgtattgtttagagcacctctgagacctctctgaccactgattggttggaaggtaacctgtgcctagcactgagatgtatatttttttttttacatgaacacattatctttaccattccaaagccccaaaagcagatttacaatgattaaaatcagggatagggagataatttcagttattcaactgttcggtttcccagagaccctaatctgaccttaattacctctgtcctgacagaaaacccacagacatatcacgataatgtatatttgtaaccagaaatctgaagacatagaaacaagaactcatgttagcctacttgttggaaattagtaagaatatcccccacaaaacaaaagcaagcatggctcatctgtgatgtgtgtagcatgggcaaaacacaataccacttttccccaacaactgttgattgtcaatattctttctaggaagcaacagaattgaatgttattttatgcaaataggctgaccttgatgtaccaccctcttgcctcagcttcctctgtatttggattgtaggtgagtgccaccacagctatcacagtaattgtaagaactgaaagaccagtcttctgtgccatattgtcttctgtatatgtcagggaagaaaaacctatgaaaacttatctaaaacagacatacaaaggataccagttgatacaccaaagtacataggagaaaatccacaaggctctatagctagatgatgagctatgggcaattactggctaataagtcttctccagaaatgaaccccctgatcagttctccaatcccagatggtcagccctaaagaagtatccttatgagtaatggagtcagtggactgtttatagcaaaagttgaagaaacttttgagctcatgaatttgagatagagtggaagggagatgggttgagtttaaaaggctaagatggaggtactcatgcatgaaattctcaatacttttttttttaattaaaaataaaagtctacattcaaaaacaaagtacccaaatatttatcagctaaatatgtacacggtgccccagtgagaattaatcaaatatagttataaacacaatctcataaggaggtagagtaggtatccttataacatatataccttgtgcaatttgttttatatgaaagtaaagaaaattctaaactggcgacatattgtaattattcatgtttaggtggtaaaattgtaattataagaatttagtagttgctttcaaggagaccaagagttagccaggcatgatggtgtttacctaaggtaacaagctatggtaggtcagatcttgatggcagcacttgggagggagaggcaagtggagctctgtgattttgaagtcaaccttaaaattaaaagtaaaattgtaggctgggcagtgctacacaatgagaacctgactcaaaagcaaaaatgaaaaccaaaaccaaacaaaataaaaccaaaccaatccaaatccaaatctaaatcgaaataaaataaaataaaataaaatcatccactcagcccctttcccaaataaaccaaaatcaaaatcaaacctaaatcagataaaatgtcaataccacatccaaaggagagctgagcattaacttcagataatcttcagaaaacttttaagattctatttatttctctatttcctatagacaaaaagtaaaagataaaatggaataggatatctttaaacaatttatcgttgggcaatttcttttatttttataattacattcagctcacatctgtccctcttttaccttcctcctattcctattgaacaccattctcccaacccctaacaaccatgacatcaacaacagcaaatccttggagaaagtgaaggagaaaaatgggtatgaatgtatcacatttcattgtatccacatgtaaaattctcaagagtaaagaaaaaaatgaaaaggcttttatgagtcagtggggccacctacagtcttcgtcatcagcactgactatgctatgaagctagagatagtcatacacatagttcaaactcacacttccagaattaaagacatgtggaccagaagacaatgaagagtgtgttaaaattccctccatcagagtgtaccctcttgctaccaaggattcacaaacatttcacataaaaaaaaaatgtgttcactacctttcattcaaagccagaccaagattaaagtgctgctcaggttaaacttctggctagcggaatgcataaacactctgggtggaatctatgtaatggtgtgccataccacaatgaaatatagaaatgaatgtaataaagcacatggtgaccctataaacataatattaagcataacctattgaagcggtgaacagttaatctgccctgagctcccagtggcacctgcccaagtgctcgggactcacgaatgaaagacacacacatgcaacctgatttttaatatgtcttaatatttcaacacctggtcttctccctaactccacatggctaacacactttcccctctgatattcctgagttaacaccttttgaattctctatttcatctatggtacaccagacccaatagggctactttcccagaaacttacatgtcagcaggttcttaagtctgacctctctgctcccttgttatggctattctgcctctctccctctgtgtttctttcccaggaatcctaaaagtcccacctctgtccccctgcccagacattggcctctggctctttattgatcaatcaaaaaccagttggggacagagaccctcagtgtctggacatgtagaatcccatgtgattttggaagccaaattaagacaaagcaatagaatcaatccccaacatcatacaattcgctttagaaaaacaataaagcagagtttagaggcatatagtgagataatgaaattattagatacaaaataattttgttatcataaacaggatagctaacagcttacaaagaaaaagagattggttactaagagatttgatgtgtgatagggctcatgttgttgatctaaagagtagttttcattttcatttatttatttagctacaataaaaccgattgaacttgatattcgtagaatttaaagacatggggaattcacaattctggtggttcaaggtcctagcacaaacctcaccttgggtcaggtaaccttgggtcagcagaatgaagaaaacatttgacatctcaagaaaggaagctgaagtgagggtagatctctcccacatgaccccagtctttgtggccttaccaccttagcagcactactctgaagacattttggaaatagatcacatctaaactgctcataataaaatttttagttgatcaaacaacaaaattgacctttttatgtacatatatgctatatgaatgcttcatataatgaataaagaaactaagtaatagttgattcattaaaaaatcaaaattcaatccttaaagttatattgattagagtaaaaaatgtgctttctatctttgatcatcagagaatggaggaaaagaaacaaattcctaaggatggtattaatcaaaaatggtaagattcaatatcctggcaaattatatgtgtgccttttaataattattttgttgtgaaaattaatcttatgtaatttatctgacatatcttgaaggcatgacttttaaaatggtttaatagtctttattgatggataacatcaaaaatttaatcgtgacagaaatttgaaacatctactttcctgagaagtgtacataattaattaattaactaactaactaattaattaagtttatttaataaatttatttatgtatcctctgggtttgatctaaacttctgcatacatgatctagtaaactatttttgtgtgtgtgtgtcatttcatctaaatctttttggcatgtggaattagtgaaataaatttctaattttaaaaaacttcacatagctcatagaaagaacgtccttctgtgaaatgctaatgctaatgagtatgatcatatggaaggaatttcagtgaaccttttatcttccattatacttgactgtttcgcataatttaatttcattttatttcagtctgacataatatgaagaattccattgtctgctttgctgccatttctcttgatatttcaaatatatttaattatacaaggtcacatctgaagagataaagctctctggggagaatataaatgaactttccctctcagatctctgatgaattctttattaccctaaaattacatgatattatcctgaagtgacatgaaatgtcttacttcttgttttgcccattcctagaatggaaccggaatatcagagacaagtgcttgtgagaactctttgctccagggggtacaatccttcatactccacattccctagctgccagagcacagtgggagaggccattagaatactcttgttacatttaaaggtaggagttctggatttgctctctatggtatgctgactgtaacagttgtttgcagcatgttagagacaccagagttctgttcatgataatatgtttcacgtcattggagaagaaactttctattaataaacactgaaagatcttttggggacttggtgtaaggagtgaaaaaatgacaaaagagaagatcaagttgtcttaaatgtaatatattcactttgttcttttaatatttattaaatttaaatttatttgttaaatttatctaccttccatatctatctatctatctatctatctatctatctatctatctatctatctatctatctatacattcatgttatatggtccaggtaaaactcatgatcctgagcggtaaaactacagtgcctacaacatccagttcaatattcccaccttaagtggacaaataagtaatgaagtgagacgactatatcccccatattatggtctctttccatttttagcctgtgtgtaccttgaaattgactagactctgaggaaagtagcattttgcaaagggaaagaaatatctttccagcttgttctctaagttcctacaactgaagtgtcataactgttggggtagaaaaatctacctttagggcaaaagttcctacttgccctctcctacaggactggctgtttgagaacatgcaaccttgatgcttgcttgggtatgtacttgcttggacttttgtgaccttaggtcattagaaagatgcaaaatatatatccattaaaaagtaagtttgatgattaattatactctgttatacttgcagacaggagcaagatgtcccctgagaggttccgtccagcagctgactcagacagatacagagacccacagccaaaccctggatggtctaggggactctaatggaagaataggaggaggattaaagaccctcaaggggatagaaactccacaggaagacaaacaggaccagcaaacctggacccttggggccctcagagactaaaccactaaccaaaaaacattcacaggccagacctaggcctcccaatatatatgtagcagatgtgtagcttgaccttcatgtgggtagaacagggctattccaaatattccaaaagctgtcgcttgtacatgggttatgtctttctagctgagctaccttgtcgggcctcagtaggaaaagaagcacttagcttcacagagttttgaattgccaaggttgggggatagcaagaacgggtggcccctcattttctcaaaggagaaggggggtgactgggagtagggcagtcagcaggatgtaaagtgaataagtaaaataaataaataaataaatttaaaaagtaagtttgattttagcaaaaagaaatagtactcaaatctgtagtacttgataaagcagatggatatagaaattgtcaaaagaaaaatttgcaacacttcattgtaataccacttatatcaaaaagtttaattttgaaattaatatgaatgtgaagctctggttatcaaactacagttttacaaagaggaaaataagatacataaaaatatttttaatgaagtggaaaaatgtgaagaacacttgagtcataattctctagccaaatgtgctaagaaaagaagcaattagtaaataaagaagtaaacaaatcaatttggagttcagtggtataaggctcataagattcatttcaattattctagacatgcattatccatctctaagaacacagctgtcttagggttttactgctgtgaacagataccatgaccaagacaaacgttctaaagataagcatttaattggggctggcttacaggttcaaagattcagtccattatcatcctagatgcatggaagtatccaggcagacatggaactgaaggagtagagagttctacatcttcatctgaaggctgccaatggaaaactgacttccaggcagtgagggtcttaagcccacatccacagtgacacacctactgcaacaaggccacacctcctaatagtgccacatcctgggccaagcatatagaaaccatcaacaagcacaaacaacagcttagccttatatagaacagaaggctatgtacctagagattcatgtggacaagaatgtatctgagttgaagagtatgcttttagcatataaaagaaaggcccgaattggatccttagcagggtgtgtgcgcacacaccacgggcacacacagacacacacacacacagacacacagacacagacacacacacacacagacacacagacacagacacacacacacacacacacacacacagacacacacacacagacacacacacacagacacagacacacacacggacacacatacagacacagacacacacacacacacagacacacacacacacacacagacacacacacagacacacaccaccaccaccaccaccaaaagcaaaataaaaaacaaattagagctttgagtctaactctttgctgaaacattgaagtggggatagtttaatttacataggtagaaataatataggattaagacattctggtatgcatgaaggccaactattgacaacagttgtttactaacttttccctgaagaaagaagtttaaatattctaggcacaaaaagacaagccttcaagaaaatagataagtttagcttaatttaaactttatacagtgtatatgcatattgaaatgcaaaatgttagtccataagtctatacatttttatgttttcacatgtttataagaaattaattatgtaataagatcttctctgtattagtgaaccatcaaattttctttttgcaatattgaattttttggcaaaacttaagaaaaataaagactacgaatttggcttgtacatcttaaaagcgattttttttgagatttcttcatatttatcttactctatacatgtataaaatttttatgactctatttctttcaaaatgtaatacttctgagaaatccagtgatttaagtcttcacaggttcactctttaattatcaactgatctcttcattgaaaagtttgacccaagcagatagatattttatccatattgtttttattgtgctgttataacttaagaggattattgaggttaagtttctattttctggatgtagcattttttaaagatattattagtttatttgacaggccatcaagaagcaaaatgtataaaagtcacaacctctgttacaagaaaagtagaggaaatagcaacagaaatatctgaatatccaagttggccaaagaatttccaacagttcagtttcatccattttcaatgctctgtaattctaaaaatatttcttttaatcatatattatgctactctaacttaatgaattggggagcatggcaaagatcagaagtacctttgccaatgtgaaaactattagcaaccttttgtaaggctgttgggagacatggattgtggctgcaattgaacattagagaggttgttttcctgtacagctctacctaataaaagatgaaaattcaccatttgaagtattgtttctagtaaatatgtattattgtttgttcatccacaagcacagaaatctggaagttgaccattcagaagttggactccgtctacatgctaccttatctctctttagaagtagcttaagtaatgacttcacctcctgagaagttttaatgacttatcaattacatgtgtttatttttcatgaaaagaatatcgaatctgaagggcctaagatcagagaatcaaaatatttttttcaaggataagttgaattttataatttaaagcaagacaatcctttgaactctgtagaaatgacgggaatatgatcacagtcatcctctctattctccaggttctaagaaaatgagggaaagtttgcattatgtatgagaacagatcttgtaaagatgagaaaagaataagtcttcaatttataatttatgctgttttccttaaaagtggaatgatgtctgagaattaatcgaaaggaggcccacactgctcatttgagtctgaattgcttatgcagaaagaatccaacatcattcttttgaattgatacttttgagaattatataaagtatttttcagagagataggaaagaaaatggataaaattattaagttttttctctgcttgtcatcagttttccaagattttaagtttgtatagtttagaaaccacttaaaaatacccagggtctctttggtgaccttgattttacagcttatccaaagaaaggtacatagtcttcaaagcccttatgagtgcactgaggctccgcatctgaatggaaactattttggaaaatccaataactctgtgttttccagaaccaacacagagtctatggctatacatatttttaaagaatcaatttgaacttggcatattttggggtcaaaaaattgaaatgcttgtcaaaaaaaatatgaaatgcctgtcaaaagtaggatttggagatgagaagaggatttacttgtttcaaatgcttgctactcaattctagcctgaaaatggattgtatgcttaataaaagccgaagtttgaaaaaaaattacctttgctaactatttgttctctcagaaatttaaaatcactctagcaagtgctaagagctggctgtttgttaatctagtcttctttggtactggtgtgtgtgtgtgtgtgtgtgtgtgtgtgtgtgtgtgtgtgtgcgtgttttatctagcttgataaaagtgatgggggcaagattttgaaatgtttaacagtgatagagataatggtaaggacagttaggaatttttctataactgtagtaaaacttgtgtagaagctgctttagagcacagatctgtagttttcttcttgtggaaaaatttcattgtattagtagagcagttgtctattgctctgttcagatatttgtttgaattttaacttgaagcttcatccctttgctttgtcagtgtgggaagtatgaatggatcagacttattgtcattctcagagtccagaaatttgagttcttacatttcaagaatgcccacatatatttagcatagaaagaataattcatgtttataggaaaataatatgagagaaggtacaaccaagcagcagaatattttatagatttattcacctaatctgggaataaattatcagaggaaaaactgtaaatgaaagagagtattatgtaagaaatacttttgcaattgtaactgaatcccaacagagatctctgtttcctcagctaataagatgcagcaagcaaaactagagatatttctccacttaggtcaggatggccagacttcctattcccatttacttctctattcttactattcttgaaaatttataagttactaagccgtgccaggcggttgtggaggaacttatgcatccaaggacgaggcgtaagtctggcagcagacaggtgtatgttcaagggcccgcatggtgtccacttccaacaaaaggtatgaaactttaatttataaaatttacaaaactacttctttcaccccagattgtgcattgccatcccttatatcacccatatcacatttgttgactaaggagaccaaggcctcacctacaccacttggggtgtgacattcttcattcagttttctcttccaaataccagttcaatgtctgatgctttggtgcacaatggccactgaaaactcatttggaggctcagtatcaaagttaaagaaagctattcttttgtagttagaaagaatgtacaaattgtctttaaaataattgaaacaatttgacatatatttattttgttgcaatgagagttaaaactaggttcatgcatatgttgagcaaacactgtgtcaggacctttatctataggccagggagggtgtccattctgattatctttgtacttaatgtgttcatgattcaaagtcctttcagagaagcaaggaaaaaaacagccattgtctggcctagagaaatttacaaaggattgactgtagcttgtgaatctgtgcaagaattactctggagtagtggaatctgggtggctgctttctgtcagtattgaagagcctcacaatcccaggaagcatttttatgaattaatatctggatgtgtggaatggctatttagagctatctagtttaacaaaagttccatgttaatagaattatttttcagattattcatgagccagaagatagaacaaataagtgattgactaaacctgaactgctgagtttgaaaatgataggataatcagttatgaagaagaataatttcatctttcttcttcccagaagccccgttctcagcaactcttcaaaccattatttataccagtcctcatttaccagatctcttcagttcaatattgcaactaaaagacaataaatttaatctgtaaacattttgtacagatggcatatttttaagatatctgtgttctgttgaacatgcatatgtataaggtccacataataggataaaacccatattttactggacattatttaaatggtgtatgtaaccattccatggtggatactgtgctggaaatttcaaatggaaaacaagaaatccaattaacttagttgttgataaaaggctctgttgtcccaccattcattttcttagaatgattagctttttaaattatgtaatgctttttcgttttttccttttattgaaaatagactattttctcatacaatataccctgattatatttcccctctgtctactcctctcagttgttacccacctcccatcatgtcgggatccactccttttctgtctctcattagaaaagaaccagcttctaagagataacaactattcacttcctaaaagacaagacccacggactttcaataactagaaatccttcctcagattcttagaaattgtcagagatgtgttcaaaaactaaataatccattctagacacaggatttatgactaatttggaatctgggaactatcatacgtgaaatacagtcaaacacaggagcaccccatgttcctgccttctctctgaaagcaagaaacagacatttgggatcaggttgctcccttccatagcttaacataacaagaccaaaactttgtggaccagaagtatatgcatatattttgaaaatgtaccacaaaattcagctgtatggaattttgaagagattgagcaatggattaatgagtaggttataatacagcaatacatagcaacctacttaggaatcaattataagtatggcttgcctctgacaatgtaggaaccaatgggtgattagcagctttctaatgttaatctttcaggtttctttattttgttttatttattttatatttattggatgttttctttatttacatttcaaatgttatcccctttcccagtttgccctccgtaaacctcctatccaatgccttccttgcttctaagagggtgtccctccattcaccctcttctgcctcctcacctcacattcctgtacaattatatatatatttatatatgcatatacaactaatatacatatatctgaatataaaatataatatatattaatatatcctccatttaattttaataatttgtttttcacctttagttttgtgcagcaaattttgaagtccacagaatggtagaaacacacattctagacagcaaaatagatgacatttagaaagatctgtatctattcttgattattcttttacaatgtttcccctttaaataaaggtcttgggcattaattggtcaatgtagtgtcatttatgttgaccctagtatgcctcttaaagtgattcttcagactaatgtcttatgatcagatattgcatctttattaaatacacatgtgaaatagactggagtctttattgttgagttcatttctgtggtgttttatattctacaaaatgctacatttatctaaagtctctgtagtgatttttgtacattagtagctacaagaagtggtaagtagactgtgtttccatacaatccttttttgtttgtttgtattttgtttttcgagacagggtttatctgtatagttctggctgtcctggaactcactttgtagaccaggctggcctcaaactcagaaaccagcctgcctctgcctcctgagtgctgggattaaaggtgtgtaccaccacacccagctgtttccatacaatcttacatagacacaatatatatatatagtgtgtgtgtacacacacacacacacacacacacacacacacacacacacacactgagcaacgagagattcaggacgagaaattggacttgtacccagaattcatggaacatttttcataccaaatacttactaagaattttgtttcattctgtcaaagatgtaagttttatttacctgttaatggtaccaaggacagttttctctaggtgtaaatttttgggatcaagagtggctttcactagggataaggaaacacacacacatatagcatacacacgagaaaggcccaatgtaaagcagagtggggacttgggaactatatattttaattcttgcaacgattcctatcttttgaaattctagtttattaaaatagttttgatactgattgcttcctagaggctcatggattaaagtgtagttcccagggaagccttgatctagtatggatgttagataccattggtgcttaggcagggcttttcagagttgattaggattaggtatagctctttgagtggaatacctatggttaaatattcacagtcatataacaagagaaatatatatatatatatggtatacatatatgccatagaatatacatacacataaatgtatatataaacacacacacactcttcctgtcactcatcatttaatgctctatggttccttaggatttagccgcattacggctattataatatgtgatccctagacctgaccctccagtctttgaaccagaataattttttttagaacttctgtaataaaataccccagttactttattatagcaatgaaaattggactaatgaaatcaaacaaaccaatttcatattgattattatacaaatatgtaaaaacaattgttccacattcaaatattgtcctgtaagacaaaccccttagtttaacagatatagctccttccactactatcattagttttcaactgcttatgagcatagcattctatattattatgttatttattctacaagttgacatgatttatattatactagcatcatatattttcttagcccttgtcagattttagctgccattttctgtattactaatattactagaaactatttaagtaaaaacactttattttaaactatctgcttgagaaatacaggacaagaaccaaagttatggtgagctttgttcaaatgagtaacttcaagtattatgattagctaagtggattagcttgctataatttgattatctcaattaagcaacatgtgcacaacgtatctgttaaatattaaacaggattatttgcctccctagattttactttaaagctaatggacaattaattttctcctagtcactctagtaagtaaataataattttagaaaatagtcgttctttagacagtcttatcagctcctggccaactcttcccatactggttgctctactttcacatcttgactgtatgattcaggagccacttttctttaaccttcaattgtgtaaactcccttctttcatcaccaggcagtgtatgcaggatcttgttctttttctgtccggggcagttttggacttttaaaggttatctacaatttccgcaacatttagctcactatttcttcatgcatacttacagaattattacattaaatctattcatttaagaagattaactctgattctgggttgaaaatgttggggatgtgctgtttctgaccttgcagagttcccactgtggtctgtgccaattaagtcagcctctacctaagcttcagtgtattgtacatgatgctaacatccaactgacccccaaataataagcttcagtgtataacacatgatgctaacatccaactgaccccaaataatggtgagatactctaagatgctaagtgttcaattttcctttatgcctttagtaaaggtacattattaccatcaaaccaacttgatttgaggaaagttgtaatatttattaaaaccaaggtcttttcattattatttttttttacatttagctttgaacaaattaatggtatttcaggatggaaggtttttgggtgccacgtttagcttgttgaaggtatatttcaacccttctcttcatcccccagtggaagaatcaactgtactgtaaattctgatttttaaaaatgaataattttaatcaatgctcatgcagttacaactcgctgttgaaataaattacaactcaagtgggaaagagatagttcacaacagcagacatggaattagaatttattagctgtacctatggagtctataaggcaacataaaataacgttgaagcattgaattacatgaaaagtttagtaatggtcaaggtagttttgttatggctttggcttgactttagcacagtatggcacaaagcatgggaagtcaacaaagctgctatttgtattagatactgtcttattaggataatggtataatgtttgcaagcagcatgcatacaaactttttctatggtacctcatgtatgtgtttactttgtagttaaactgactttataatggtattcattacatgctttcaaatacatttcaaaaatattttcatctaaaagctgtccatctctttcctccctccccccaagctctcccatggctatccccattttcaagaacaaaaatgttttaacaaacattaaaaaaacaaaaacaaaatcaaaaaactaggtagttgcatcagtatttattaacaacttagtcactgctcaaaatgtgaggaaaacttacaatttcactgtgctttgaagttctatcataaagcagctacagcctatttttaagactacacatgtgcttgtgaacagaggagattgagatgatattgtctggctcccatagtgtagacaactctaaggatcttaatatgtgtccagggatagcaattttacagactaagtcaggccagtgcagtcatcatttgagtgatacccgattatttgcactgtggcaataaggtcactgctgagagaccatcctgatgcagtgtgatcgtccactctcaggatttcttgagaaactccgggaagattgattggatgggaaaccatacagcacatctctcaaagtttgcacatgggaattttaagttgttacagaaaaacacatcagtctttctgatttacacttaatatttccttccctgactgattgaaaatagatttttttaagtattattggcatttttcacataacttgttttatttagttagtcacgcctaaagatacaggcatacttatattctaaacaaatattgtcatataaattatgaaaatatttttatattttctacttcgactgtacttgaatatgaaagtaagattttaaaacaaatttatttttaagtaactgtagactgacatgcatttaaataattaatagggattttgtatatttttatatttaacaagaaagctcaactggtttacatgggagctgggagtctcactcatgtacaaagtgttcttactcatggagctatctttcaagatctgtacttttaggatactttcttgttaaatataaaaataagtgtttaatttattttcattgcttgcttttatggtccttgaaacatattggacatttttcttgtctccatggtttcgtaagataaaaccatgttttaggttcctatgtttagatttctctgtaagatacatatttttttctcacttgtagctttgtagctttgtttatttttctctcttctgttttcataactaattgcagtgtgccttctatgcattttgaaatggctttatttgatttatttagcttattgagtttctcaattctatttgaacaaattgtgaaatgttcacttattaatttctttaaataagtgattttgttttattttactgtatatgactgatttctctacctgttactcctttggaagaacaataggtcttttaagaggctcagtagcatgctcctataacctcagcatttgagagagagagccagggaggcttggtgctccatgttgtggtttgctgtgcagtgagttccaggccagcctgaaacacatgagatactgtttctacacagccactccatcaacaaacaaataaactcaagttccaagcacacacgcgtgcacatacacacacacacacacacacacacacacacacacacacacacacacacacacagacacacacacacacaggtaaaaacactcaagttacaacaacaagcatatctaagcacaagtaaacaaactacgtataagctcactaggacatccatgttcagtgactcatcttggatcaccatgctactgttgagtaaattcagtcatctttgaaatttcgatttctattaaaatcttcaatttctatggtgcttttcttttttataagttcaatcattcctttagaatttccttttgaatttggaaagtttttaacaatatgtgaattaaaacccgcctagcacacatgggattaaataatttaaatgtttgacacactgtatgctagcatatgttgattgtcttttcatcactcaagtcaattttcttttcgtggtgtgactggtggtttggaaaattctatcttgaacacagtgaatattatgtaagattttagatcctgtttataatagtcaatttggttgacttaacaaaataaaagtatgtggcttaaataacaaatatttcttgcatttctgaagcttgagaaagcagaacgatattgatcagtatttgtggcatagtgaggaacaatctgtttcttttaatttatcatctatgtatctatgtatctatttatgtatgcatctatttatgtattatgtatgtatgtatgtatcatctatctatctatctatctatctatctatctatctatctatcttttatctatctatctatgactgctgataggcattttcatgttatatcttttttgaacagaaaaacagttcatctctttgttttctaatcacaagaactttttgaggttttttgttttgttttggtgttgctgttgtttgtttgctgttgttttgaggctgaagatcactatggagctctgaatggcctggaacttactatgaagatgaggctggtcttgaactcctagagatacacctatttctgtcactctagtacaggaagtatagaatgcaccaccatatccagattataagggcttctatgaaggctgtatttttaattactgctttaaggctccaaatccaagcattggatgtgatgcattggagggcatgggcatacatttctgtgcatagtgaaattctgtttttgttatggatgaaattaaattcttttatatgctcaaccaatgctctaccactgagctatgctgccatctgaaaacagcattatttaataatcctccccccacttttttgtcttttcaagcactgtcgcaagtgaagtatacagagagccaagcaggggtgagtgcagagagccaagcaggggtgagtgcagggttctgtagcccctgtgctgatgggggaggggcattcggaattgcctgtcccaccttacatagtcccattctgtctcttttatgccaaagttaaatctgttacactttgaaataaaatcttgaaaacatgtttatatcattaatatttttcagtgttagtttagaagccaagcataaaccttttaaggaagtgttacaaaacagatattacagttcataatggtgtgacttatttatgtatgttctctcctttaaaaaaaaatgaagatcttactcagtttataaaaagtttgaacgtgtgcagccttgaaatatctattcattgtgaatttaattgattgtgtagctgaactcaaaaaatacaggtcagttagtttgattccattaagctacaatacttcatatgacatacttaaacatctcttgcctttgttaattttgctaattaataggtatttaaaatgaattttctttggagacctaaagacaagatttacctagagtcactaaaaactgtatatatcattttatacttttactcacagatggttacatttctctttgtaattcacaaaataactaagtaactaggaaagaattatttaaagcagatgaggtctgtttgcatgatacattttagaatataaatcttatagaaatgtttaaaataataacctttcatatttatttctaagaaagcacactttgaaggcagtttacctgaacttgtatagacatgatagaggttataactaaacataactcaaatttaatgtctgcatctcttgatgaaagtcaatattctggcttttcagagtggaggaaaccttcataaatgattcccagtatattctcaaaattaatgttagatgctataccttcatatattctaaagtctgcagttgacagcatagagcatggtaattactccattttgttactttcatgcattttaatccaaaagaatatctaaatacaattaccaaagcaagcttcagagaattaaaaaaaattaagaaacctgtgataagctgagatgtttgtttaataaaccttaactgtttaatgggtgctaaactcaacacaatctgtcatctcctgggaaggtgctgaacaagaacctagccagaagtttggcccttcaaatgtcccagtgaagacagagaattaaaaagcagctggtatgagagactaagatgatgtattattatcatgtgttcaacatttgtttcctatcagagtccccagggatctacacacctattaaatcagagtctataggagcatgtttgacagctcatttttttttaaacttggaaaagtaaggtattatcttattttttactagttattttatttatttacatttcaaatattatcccccttcctggttttccctccaaaacactcctatctcaaccttcttctccctgcttccataagtgtcctcccccatccacccactcccacctcactgccctgcactggcgcatcaagccttcatggctctgacagagccttaatgatacagatggggatgcttgcagcccaaccatcagactgagcacggggaccccaatggaggacagctcaactttcaacaaaacagttttgattcaatgtgaattttcttcatctcaatgcatcataaactcatatttaacatcattagtcaggaagttgtataattatgcaattttagcaggtaaaaagtatgatcaaacatttactgtttattaagttaatcttcattgaatccataattatatcttcatggttatcaatgattgtctatatcaatttggttacatagtttcacctacagtcatgatagaaacatcacctgcaatgatcaacctagaaggaagattgcagtttcagtaaattgctcagtcaatgcatttagcattgtgccagagaaaagttacacagattaattgatgacttctgtatattttagtttagaaatgaacattaatgagggaattgaggtttcacagtatatttccaaacttcagttagaatttggaaaataactgaatgtgctttaagacccatttttgattctaaaaccaatgaaattataatactggaaggaatcactttattatatttgtcatcctccatctgagggttgtagaacatgcatcaagcatttctcagagcattggcacttagtaatagtaatgatagaattcaaacctaactcctacaggcatgttaacagtatagagaacactatataaacaacccaggacactggggaccttgagggatggagctgtggatggttcaacttacagtgtaaaaagatgcagaggaatggagtacaagagaggatttggtcaccatgcccaagggtccacttacacatgcttaagtggaaaggctgactttggccaggttatattagagattatttggggactttcttctctccatcacaggagtatgcagttatagtaacactgtcaccttccatagttccctcctaatacccaattccactgaaatgtccaatgatttttttctttgactcttttcttcttatttcattagtgatttgtttcaaggtgtatttcaccttttccctgtgcagaagtctttccttgacttccaaactcggcccttcagcatggatatttgcttcttctgctgtattataaaagccttctgcatattggccttcatctgtgttccctaaaaggaactgtatatcataaccactccccaacttctcaggtcctctgctcctccgtgcactagatgaggatgtgtggagagatgctgtggaaagagttggcacctcaacttagtattaataccaaacaaagcagctactggggagaaggagagtccacttgtctgaccgttagtcttgggcattctgtttggttatatttttttcttttgtttatcaaagtttccagtattttttaatttattttttattaggtattttcctcatttacattttcaatgctatcccaaaagtccccgatacccaccccccaatcccctacccacccactcctcctttttggccccagggttcccctgtactggggcatataaagtttgcaagtccaacgggcctctctttgcagtgaaggccgactaggccatcttttgatacatatgcagctagagacaagagctccggggtactggttagttatagaagagtgttgtctaatataaaaaggtccattattgcaagagtgtcacatagtactgatatatgtatttactggctgtagaggctcacatctataatacaagcataagagagtgaggcagagtaatccctgatttcaagacacatttagagtttttaccaacatctcttgtaggaatattatatggattcatataaaataagatattggattctttgttataaaaggaaatttgagaatttaccccaataaaaagctgtgctagtattatatgaatatatatatgtatcttaaagtgttccaaacagtaaacttaaccttaaaaggagaatgtttgttgtcaggagggtggagatgagtgtgtgaggaaacacagtgctaatttaggagtttgcagtttaattggatacttgttgattttaaagcttagtatagatcttgaaattaaactacaagttgcactttggggaatgaatattaaaacagaaggtattatttatcacagtgcaccatagaacccacttgttatgttacctctgacaaaagatcatgtttcagaatgtcctttctcagttcccttaaggttataagtacactcttgttatgccccaaatttttctcagttaaagttgatatcacatcagtgctgtaagtgtcagttttctagctataatttaaaaaggagaaaaatacgtaacttctgccaaacaaagccagaaacaaaacaaaacaacaaagaaataagcaatcaatttttcataatgtaatttttttgtaacacaagaagtttttgtgtttgcatgaatagcaacacaatagtttgcatgtatgttctctaacatacaaatcatatgctatagtgattttccggagccatgttccaaggtagtaaaaataccatttcctatcaatcacagcattgcacttaaatcttcaaatcattagttacctttgagttaatagaagaagaaaaatacattttgctaaacattctattttagggtttgatgaaactcaagaagaacgaagaccaaagtgtggacactttgccccttcttagaattgggaacaaaatacacatggaaggagttacagagacaaagtttggatctgagacgaaaggatggaccatctagagactgccatacccggggatccatcccataatcagcctctaaacgctgacaccatttcacacaccagcaagattttgctgaaatgatcctgatatagctgtctcttgtgaggctatgcaggggcctaacaaacacagaagtggatgctcacggtcagctattggatgggacacagggcccccaatggaggagctagagaatatacccaaggagctaaaggggtctgcaaccctatagttggaacaacaatatgaactaaccagtacctcccggagctctttagctgcatatgtatcagaagattgcctagtcggccatcattgggaagagaggtcccttggtcttgcaaactttatatgcctcagtacaggggaccaccagggccaagaagtgggagtgggtgggtaggggtgtggcggggggtatggtggacttttgggatagcatttgaaatgtaaatgaagaaaatacctaattaaaaagaaaaaacaaacgtaactgatagaatgaacacatttatatgtataagtatattaatatatatttaatttggtgtgtatatcattttaggattgagcaattagaattataaaattaatttagaagatctaacccgaaagagtcaatttctgtctaattgaagttaaggttcatcaataggagagacattatgcctgatagcaaaacctgaccaaccagctagctcttgttgggccatgcatcttagaagagaacctccagcaggaagacaggacatcaagtgagggatgggattgccatcccacagtcacatctctgacccagagttgctcctgtctgtaagaattacagggatggaaatggagaggaacatgaggaaaataaggtccagggacaggcccaaagtgggatccacctcaaggggaggtcccaaggcctgacactatttctgaagctatggagtactcacaaaaagggatctatcaagactgtccccctgcccctcaaagacccaacaagcagctgaaagagtcagatgcagtttttgtacctaaacaatggacagaagcagctgacccctgttgttgaattagggaaggcttaaagaagcagaggaggagggcaatcctgtaggagtaccaacagtctcaattaacctggactccagagatctctcaaacactggaccaccaaacagacagtatacagcagctgatatgaggcccccaacacacatacagtagaggagttccgggtctgtgttcattcagagatgatgcccctagccctcaagagacttgaggccccagggaatttagagctcaggtggtgtgggggatggggtatccacgtggagacagggtagggtcggaaggaggtgtgggaacagtcagagggtggatggggggcagggaatggaatacggagtataaaaaataaaataaaaataaaataaataaaaacgaagagaacctactacagttgatttactagaccatcgttattattaactaaattctaaaacttatctgtatacttactgataagtttagctctcaccctcatcaaagaagtttctctattcagcaaacaaagactgttacggaaaaataacaacaggtcataactcagaaatcaatgggtatggtgagcccattgccatgtgatatatccacaccatgattttggcactgtcagagaggaagagaggacagaagactgtgagaactgtaggtctaggaagtacgctgtgaaaatctagcctcttaaaaagaaagctaaactcttcattataataactgaagtttctgttaagcaatattgacattttaaaaacttactcaatagcaaagtaaagaatggaaaaaaatgaaactacctactgcatattaccattttcttgagagtttataaacaacattctcatgtttattacctgctactaggaggcctgaaatgaaaaccatcttagaagttaaatagaagcattgaagttgaatatgtaattgaattattgagtacatgtttacagtcggggatggagagatggctcagctgttaagagcccttttctgaaaagaaatgaatggacagtggatctgtgagagagggaaagtgagtagaaggaggggtaaagattaggatgtattgtgtcagagtggaattaaaaataaacaacaacaacaacaaaaaaaccaacacttgttgttctcacataggaccaagttttgggttccagcacacacatagtcactcacatccatccataacttcagggatctgaagagttctctaccagccctgggcaccagaacacttacagaaaacacattcatacacataaaataaaatatattttaaaaacaaaatcacataacaagataagattgtatttaatattaaagccagacattgaagaaaaatacaaattaagaaataataataaaagcttgactattaaattctactgagaaaacaagtccttgaatttgaaacaatacttcttaccatttttaaaatacattgagaaattaatttagaatatccttaaatattttagtaatacgtccagaatcagatattttactgactcactgtgaaggcagaataaaatacaaaaatgaatttgattataaattgaaatgtcttccatcattcattttcgtttttttctttaggaaaattggtgcccttagtaactgatattaaaaatgaaaaattagctatgtttagtaaaacatttcattaatggaatctatatattgggcttacaggcacacacttccaccactacttccacccctaccaccatcgcaccccccaccagacaaagattttgttagtttaggaacataataagcaatttgttgttaaaccaacttcttacactgcaaggagagagctgagtgtcaactgcataggagaatagctgagcattgtatatataccagttattctatttttaaagcttagcatagtttccggtgaactataattgatgaatatttttggaataaatggaaaaacagccatgctcctttgtaggattatcattgccttcagttgtgaatacgttgatgcagaatcttttcctaagtaattttgcctggactgaaacaagattgttaggaaaaattttaagcatttaaagtatggcagagtaaaaggaatgtcaattcactgcttacatgacaaacctgattctttcatcttctgagctccagcttatgttatctcctacttgacagatggtccctgtggaatgtttgtccccatatatctatttatcaactctcctgataaaagataagcttcacacaagagagcagctgagaaggtcagagtttccacttttgccctcgtaaacttttgctgtactatagcagagagagaatgtagaaaaattctacattgtttatattactttgaataattttttaaaactaaaaacagctacaaatgttgttatcctcatttacctatgccatatctcccctttctgtttttatccattaagaaaaacaaaacaacaacaacaaaaactaaaaaaaaagagagagagactgaatttcttaaatttgtaaatcatatattgaaggcaatagagtttttaatcaattaataagatataattaagtgatagtatgttatatttagcaatgctttgatgattagtggatgtacactaaactagtctaggcactagattcctgattcgattttgtatgtgtaaatacaaatgttttttccctttttatcctaagatgcaatatcatcactaactaatttcaaggtatttcaattttagttcaactgaaacagattatttttttctaatgctgcttcagtctttcatagtgggaaatcagagagtttatataatatgcatccattaagaatcctgaggcaagacccctgtggagatttttcagcaattggtctctggatgttgctggtagaaatactctcattcaagaatccagttctaatcctttcaaccagaggtcaatactaggtgcaatagctttgaccagtggagactattggaagcaatatttactctttcccttctttttctaattattttacataccataggtagcatgttaaaatatatggcaatgttcatacaaccatcttgcaagagtgatgattagtgtactattccatatgtatattataaccaaatgttataaccacataggcagtacatatataaataatgaaatagccagtgcttttatttctctataaaatgtattcctggttgaacagcacatgcttagagtatgtaatatgactctaagttaaaacacatgctaaaggtgttttattttaagtgttacacgtttaaagaatgtcaatttataataatggataaacaaatatgtacatattgaaagagaatacatttttgttttgtagtcataataattattctctttacgtattcacaataaatgtgtgtaagtgtgctgttacaaccatcaacatatctccctattacctatctatgcacctactatgtgtatataaaaatacactgtatataatgtctgtgcatttatttatacaaattcaaaaatcaatttaaaagtaattctctataattctgttttacaagtattatttctaactcactataagtacttctttgtttgttttttttaagtgtacgtttttatcaccctgtggtaatttcagttgtccttaggagctacactatgaaggtagaataattagaaaacattttggtccccatgaattctcaagatttgctacactagtgttaggattcttacttgtagatgggtagaattgatagttaaataatggaggtaagaaggtattcttaaaaatagtgaaatggagaaggtatataaatttcacattctatttttaaaatcttcataaacaattttatttctactttctttttttaaccttttggtttttcaaatagggtttctctgtgtagctcttctggaatttgctttgtagaataggcaggcctcaaatttagagatccacatatcggtgcctcttgaattctgggattaaaggcacattccccaattcttagcttttaattctacattttgagtagaggatggaataaatgggggccttgtgaatattcagatactagtctttctaggtcacgtgttaagcttattatcttgtggaatacatttctgtttcttccatccattaagctgtgttcaccttcaagcttggttttcatgttttcctgtacttcaggtatgtatgaattccttacctgctgaggtgacactaacatctctctgcaatttttttaaaattaattaatgtattcactttacatcctgattatctttcagtctccacccagtctcacccttacaaatccctcctccaattacctgcacttctcacaaaaggaatggaaactcctggttccttgggtagcacctaaccctgggacatccagtaacagtctgattgaacacttcctttcccactgaggcccaaccagccagtccagttaggagaaagaggtccaatggcagcctctgttccaattgttagggacccacatgatgatcaagctacatatctgctacagatgtgtagggggcctaggtccagcccctgggtggtctttggttgacagaccaaactctgtgagcccccaaattgaggcaatggccaactaatgtctggctcaacttacattagacacatcccatgtaagagaggcaatccctgaccctattaatgatactctgctatgcatgcagatgcaatcctaggataactgtcttctgagaggcttcatccagcagcagatagaaacatggagatacccatagacaatatcagaatgtccccaaagagacttgtggaaggaaaggttgggtagaattgagctaagcagatgggtcaaagatgccacaagaagacctatagattctataaattctttatcatcacttccatcaaatgataggactgtgttccttcttctgggttagctataacaggtgaggtccaataaaatgatgctgtttgactatggcaactaagtagagaaggagcacattgcatcattgtgttgttcacttttgggttgctaagcaaccagatagctatgactgtgacctagtggctatatttcaaagacaggtttcaagaagaaattatgtgcatgtattccaggtagcagggaccaattcctgaggcctaatgttgcctttattcctaggctatcttctcattcccatacagcaccctgttaccaagcagcagaggaaagccatctctaccaagcttcatcagcattctggaccacaaaccaggagcattgaaaagaacactaatgcagtgggatcattcagaacacacaccaattgctttaaggaaacttgtctttcctagatttgtgaaaagacagctgtttatttgttgataaaaccatggaagatgtactagtgagaatagtaggttgaagagcccctcctggttcagtcctgtgactgacaatgtagttcttaggttctaaatgttcgttttcatgccaattttgaggctacaacaattttctttattactcaaaatagtaattgaggattagaattcagatataataagagggaaaataactacaaatggcagtttgactacattaggtttctattgtgttttcagaaataattctaggctgatgtataattctaccaagaattagtctgaggataatcacatagggctaagatacgaacactttgttgataaatggttctatagaaatatattacaattgttacatgtgcttctgcacttgaatcacttttgaaagtttatatatattgaggatacaaaataataatttagtataagaatgtaaagtataatgattaaattagtatactcggcctttctttttctttaaacctttactgtttctttgtgttggaaaatttcaagttcttctgttcttattctttccaaaactacaataaaatgctgaaagctatagtgacctggctgtgacatagagtcttagtcctactccctgtctgacctagttttacctacctctcacttcactcagtttagtctctaatgatcactattctaccttttatatctgtgaattaaaattttaaaatactctcatcctgagttgattctctgtgcactcaggaatgagctgtgacaaagtaggtcaccaaagaagagagaaaaggcagcacagatattccttcttatttttttaataattatttctttgaatttactaattgttttgtccttacttgaatcatttcatttcttctgaacttttatatgaaaatgtgttactcatctcaacctccactttccagtttgtagtttgactttgatcctcaacatagggagcctgtgttacattaagcaagaacatataattatgtaaatcttatgattattattgaaagagatgatttatactgttagtcaatcttgagaaaaaatatattccagcatactgcttagatagtttaagataagtctcttctgtgtattgaaattttctatttatctgagaacatcttgaatttactttaagaaagttaagtctactttgctaaatgttcaaatggttttgagagagaaatgggacatctgttttttatgcataagagcatctcagcaggtcctccgcaagaaagcagaaggttactattaaaggaacggttgtgcacgacagaggaaatatggggagaatacttaagctgctttgaatacaaaatcagtctagcagaaagcaaaagaaatgcagacctgcatgcaaggtcattataataatgatcgaggctgaaactcaagacaatccagtagtgccccaggaatgacagggcacttaaaaacattcctgaatctctatctatctgtccactcaagagaataaaagtggtagtgatttggaagaactttcaaataagatgtggggtgacatgcatatgtttcctatttcatatttgtgctgagcatattttgtccaatagtttgaaagtgtctcctttctccaggaagctcctgaattatctaaggtccaatatggttatttgcttttattgttttcttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtttggatgctgattatggggtggatccctggatatggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttacctattggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttatcacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttctttccacttggttgatttcacccctgagtttgattatttcctgccgtctactcctcttgggtgaatttgcttcctttttttctagggcttttagatgtgttgtcaagctgctagtatgtgctgtctcccgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggcttcccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattgttttccagcctttcactctgaggtagtgtctgtctttttccctgaggtgggtttcctgtaagcagcagaatcttgggtcctgtttgtgtagccagtctgttagtctatgtctttttattggggaattgagtccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaacttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttctttaagagcctgtaactctttagcagtgctctcctgtaaatctttaagtgacttatgaaagtccttcttgatgtcctctatcatcatcgtgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctatgagcagacctggagggtagcactctccttagtttcagtgggcagagtattctctgcaggcaagctctcttcttgcaaggcatgtacccagatatctggtgttcgaaccagactcctggcagaagttgtgttccactcactagaggtcttaggatcacgtgtggaatcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccacgcgattggattggggtaggcgctgtgttccactcaacagaggtcttagggtcccgtggggagtcccatgtgggcccttgcgggtgttgggcaagactgctgtcaaggtagcccggggctcgagtctcgagtcgagcggaagggacttgtgccccagatcaggcccgggtagcctgcttccctatgtaccgcagtctcaagttccgcgcgattggattggggcaggcactgtggtccactcaccagaggtcttagggtcccgtggggagtcccgtgtggacacttgcgggtgttgggcaagactctgctggcaaggtagcccggggctcgagtctcgagtcgagcggaagggacttgtgccccagatcaggcccgggtagcctgcttccctatgtaccgcagtctcaagttccgcgcgattggattggggcaggcactgtggtccactcaccagaggtcttagggtcccgtggggagtcccgtgtggacccttgcgggtgttgggcaagactctgctggcaaggtagcccggggctcgagtctcgagtcgagcggaagggacttgtgccccagatcaggcccgggtagcctgcttccctatgtaccgcagtctcgagttccgcgcgattggattggggcaggcactgtggtccactcaccagaggtcttagggtcccgtggggagtcccgtgtgggcccttgcgggtgttgggcaagactctgctggcaaggtagcccggggctcgagtctcgagtcgagcggaaggcg

SEQ ID NO: 210 - DNA, 3928 bp, Mus musculus
gaaccgccgtcatttcgcaggcagtggcagccgcacggtgagcaggggcccacggctgcagccggcagaaccgctcagcccagggtgtatgtgctgagagcctcgtgtgtatgtgtgtgtgtgtgtgtgtgtgtgtgtgtgtgtgtgtgtgtgagagagagagagagagagagagagagggagagagagggagagagagggagagagagggagagagagggagagagagacaggagagagagagagagagagagagagagagagagagagagagagagagagagggagggagggaggcgtggatgcgcttggggagggggcaggagaaaacgtaccagtgtgtgtgtgtgtgtgtgtgtgtgtgtgtgtgcgcgcgcgcgcgctaggctacagcatcccttttccaagacagtggagaggtgggaatgggggtgcacagggagtgggggtgcagagggagggtaggcagatgtgtttgccctcctgcccaacagacaaagaggagctacaaaacaaatgcttgagaggggggcaagtgtatgtgtgtgtggtgtgtgtgtgtgtgtgtgtgtgtgtgtgagagagagagagagagagagagagagagagagagagagagaggagagccgcaggcttgtggggaggaggaagggggtgtcccagggaaggcccaatcctctgccagctagggaagccaaggccccacaggtcatggggcccgggacacaggggcagcctccaggatctagaagtggcagaaggctcctcccctagcaaactcaggctcctttccatctgcctctccttctgacaatcccccttcccatcactgactagtggagatctgggaccctgagctttttctaatccctggttgggtctccctgtcttccctctctcccgtgcctctggggctctggcttcaggagtcctggatgaatcctgtcctctatcaggagaaggctcttgctcgctttccttccagaggaactgttcactgctgagctgacctactttggaagactgcattttctgattccaagaatttgggatgggaggggccatgaaactttgggctgccaatccttgcacctctctctcctcaggttctcttaaatgtttcagggcaccaggataagctctgctccatttgatttgagcaactcagtttctgttttcagtgtctgtggtgggtagggtggaaatctgtgctgtaaattagtggactctcgtttcccccatttcttcccatgggaattatctgtacttttagaaaggaagttggggggcgtgtgctttcagaatcaggttctatgagatggtaacatcccttagtagaacgagaggcctcctctctttatcaggtggccagtgggggaggcggtgacctgagaaagggccagtaaaaaaccagacactggggacaactctctgctttcggatcagcccaggagagggatggaggtcaaaaatgggttcttacatgccctattatataccctcttggccatgtctggccctgaagggggcattctttagacctaatgtcagtgctgccctgactttgtctttttgaaggtagctgctgacatctggagttctcaaaatacacaggagtggtttgagtttcttattcggagactgtgctgggtccacttcgcatcaggccaggcctgcttaagcttggtttcatagcacagtgaagcctcagatattgcctgctcgcgtccaacatactcccgagacacgactgagaagagcccacggcacatctccctagccgccttcatggcttctcgcttgccttccttagggcagggattggattctatccatctgacagtaaccacccagcactaacaactgggtccttggtgttcttgttgctcaacagtgaataaacctgactgaactggaggtgggagagttggctggttcctcagaagggcctctttcagttaaaacagcccacctgaactatgtcattctgtccagtatgaactgtgtcactctgtggcagacacgacacacctgtacctgagccagttccttcagtgtcggtatctttctgtgagttaccagaggatgagggtgattctcacgtgtgtctgactgattttaccctctccatctgtacatgtcaataattcctttgttggctccactttagagtaaacaaaataactcatagtccattttcacaatggcactctggcttgctctactgagacagactcttcacattctgtgtcaaccagccttgaattcataatcttcctgcttctacctccttgctgttgagattacagccatcataatctttactgtactttgttgttgttttgagacaaggtcttgtgatatatccttggctggcctagaactacctatgtagatcaggctggcctagaactgcttatgtagatcaggctggccttgaacaatacatagagatctgcttgcttctgcaccaccttgcaagactcaacatttctactttttaattttttaaaaaaaattatttattatacctaagtacactgtagctgtcttcagatgcaccagaagagggtgtcagatctcattacggatggttgtgagccaccatgtggttgctgggatttgaactcaggacctttggaagagcagtcagtgctcttacctgctgagttcttttaacttgagtttgtgccaccatataattcaggatggcttagaactcacaatctcgccttagcctcccacagactagtattaaagatttatgatatcatacctgtttctttggccctgacattctaatagggttttggtttgtttgtttgtttgtttgtttgtttttatcttaaagactaactttcaagccagcctggacagtacacatttataatctcagcactttgggagtggagggagggacaccgagagttcatgtccagctttggctatatagcaagtgcagggcagaccaggctataaaagtctccaatctcaaaggaaaaacaaacaaacaaatactaactctgtcttaggctctttctttactcagaaaattggcctgatgaagctcctgacttcataccctggaatggcagggtgcttggtttatggagtgctgaggtcaagcagggcctggtacatgtcaggcaagtagcttacagagccgtaccccagtccctccttatttctttttaacttattaaacttgattgttctgatacttctacaatgcattcttgcaataaataggtaataatctattcttcttcctctgtaaagatatttggcaggtgtgagcagcctataacatgatatcttgtggaataggtccaggagaatgagaactgggttctccgtccctgtctttaaaggatacaaaccagtggcctcctggctgaattcagacagcatcaattattatttttgtttgagacaagatctctctatttaactcaagctgtcttgatctctctatttaacccaagctgtcttgaaacttactatatagaccaggcagttcttgagcctacagagatccatctgccttgcctccctccccccgaacccccaagtgatgaggacacacagacctgacttgccacatgggcacttttaaaaatattgagtgattcttttacttactttgggaattgtttatttctttttatttttaaaatgtatttattcttattttatgcacattggttttgttttgttttgcctgcatgcatatttgtgtgagggtgttggatcccttggaacttgagttacagacataaataaaatttgtaacaggtatgtatgtatgtatgtatgtatgtatgtggcctggaactcattgtgtaaaccaaatttgcttcaaactcacagaaatctgcctgcctctgcctcctaagggctggtattaaaaatatgagctatcaatccc

SEQ ID NO: 211 - DNA, 22699 bp, Mus musculus
ggatttggagggtgctggaatttgctgtgccttctaaataacagcgagtggaccaattaaaataactaggaagaggggagaaacatgcgagaagaaggagtgtgcaagagcacagggactttacctgaaaaggcaacagattgttaccattatcggtccggaaagcgttatcctccatccaggacttggaggtgagcggggctgcacgagggaacttgggtggagcgatcacattgctggagaagggctttttgagcggcgagatggggttaagcggggagggtacccccacacctacacccacgcccacgccgaccgcgcggcgagggtctcggcccgcctgcaggccaccccacgggttggacggagcactccaggcggcgttcacgctctggtgcgtgttccagctggacgaggccgaagaggcagcggccgcggccgcagcagccgcgaccgccgaggatgaggacggcttgctggtcatgatgggctggtggccgtaggcagcggcgctcctctgcgcatagggcgcctggctggggctggcgggcgagcggcgttgctgcgagggctgcgcctgcgggggctgcgcgggctgcggcggctgcggcgcgggcggtggaggctgctgatggtgctgggtctgcgccaggccgatctgcggcgagaaggtgcctccgaagaccgggttgacgtggtgcgggaagttttggaagagcatggtcccgttgactggggtgatcccctggaagaagctgtcctccaccgcgtttgtagtgcctgtggaccaggtgctgccgaaggacggcgacagcgacgctccgggcgccgtgggctcctgcggcggcggcggctgctgagggggctgatggaaactcaagcccggcaggagcggcgactccatctgcatcttgtcggggccgttgggggctggcggagccgaggcggggctgagggccggcactgcgctactgtcttcgggcttggggatctctgaggagaggggcgtggacggggcttcagctgcgccgggctcgggctggagctgttgctgctgctgctgctgctgccgctgctgctgctgagactggggctgggttttgcttttgtccatcagtaaatcatcctgcatggtttgcgcagctgaaacgggaagaaagagagatgcgttattgtcagtgtgatcatgaatgcccctcactgaagcgggcgggtgttttacttgcgaaaatccagtgccaccgccactagccaattgcaatgcaaatccataatctcgcatttagaagaacaagtcgggctgggaggggggtggggggagctggagggatcgagcaaggtctctaaaaatactgtgagagcgtcttcaccctttctgacgtctcggccccttttctgtgttagtgagagatgtgcttataagacagaaagacagcaatttcgccacgtctcttttcccttcaccggaactcagagcgttcaccctgcaatgagaaactgattctggttcctgttttttcccaagcaccaccctcccccagttatttgcatacgtcaataaatagtgctgcgtccttcagcaaggttaaaaagacttggtacacgaccctctttcccccttccccagctggagcacttagaaaccattttttaagccgacttagccctcttgattagcaaactgccttcttgcctcggatgattgtttcatttggctgcagcgaacctcgagagacaaaatctttggcatttgttggaagaactcagctgcacaatcattctctggcctctccgtagcggcagctactccattttgttaggagacgttttaatataaaagaaacctcagtttttagaaaaatgaaaatcgccgggcgtggtggcgcatgcttgaaatcctagtactctgagggagaggcagaaggatcaaaaattcaaggtcaggcttaactatttagccagttcgagtccagcctggtatataagaaacctgactttaaaaaaagaaagaaagaaaagaaaagaagtaaaagaaaagaaaaaaacctactgaaacgtttagaagtgtttgcttcttattactctaaggattgtgggttttctgcttattctccgattttctcctctccagttctgccgcccaagtgatttactggcttcttggcatttcaggtctctacgggagcctgagaaattctctgcagagtggagaaatgcttctgcttggatttgaggtcagagggaggaaggtggggagtgaggaggggaggggagggagtctgtgagatggagagggggcgggactttaaaaatgcatctgagatttaagtagacagtcaagataattctggggttgccagattttcatttttgaatcctcctgctgctgcctcggtcacaagactggcaaatttagaatccattcttttatcactagtattagcaatgaaagactatggtttgacgaccctgaattaccatatgctagcaactgttaaaaatagaggagtacaaagtcccaaattctcatacattgtaattatagtgcattaccctcactgcttcatttagccatataaggagtgtatggtattttccacttcacatagcagggctatattcacctatgtcatacaacctgttttcttactcaagggtgaaaacagtaatcattcaaaaccaagagatttccatgcatgtagttatcattgaatgagcttgtctcagaatatgtttaattgctttaaatatctgaatattacagggctgagaccttgcaaacaaatattttgaaattttaaaggagctatgaccaaacatataattatttttagatgatgattcagtataattgcaataaagttattaatatatttaatatagttaattaactcatatactggagaagcatcttccttgggacatttgtaaagggcattcagacacacacacaacagttctgcctttggactattcaaaataacaactcttaaaatggaggtggtatcgctcttaactattacacaaaggataacagacaagaagttggattcacagttctttttttattaaagctatgattaaagtacttaacagataccatctttcaaagttttatatacgaagagcatagtgagcttcaggaaacaccacttctctcagccgccttactttcctttttattcctctcttcccctctcctaaaaaaaaaaaaaaaaaaaaaaaaaaaaacccagcccagtataatagagcatgcaccagggattgcctgctactatcaataaagcctgcttcagattgcttttcttttcctcagttccctctatctggaacaatggctttgattagtgttataaatagagcacagagaggagagtggaccttggagtcagacagcacgaagttccatccctgccaaagagggtggtcacagagtcatctcctacctcctccttacggtgctgcagtagaccattgtacctctggaatttgagtgctttgataagctagaactttctttacaatagctttatcatcatggctgaaatatgtactggattataattttagtatcacccagctattctcattgcttgtagtcaacacttttgttaatgcctttagcttaaactgcattaaaaccccaagccaaaaagtaacctaggcttagaatattttataatggctttaattaatagtaacactataacattaaattctcaaaatattctaacaaaacactccatgtttttcagaatgctctttaaaaataatacaaatttaactttctgtattaaattcactcggtcaaggtcaagacccaccttttaatatgatcttttaaacaaaagctaagtcagtgactaatataaaatttacaaagtcaatatgtaacatccttaaataactgcctgtataatttgatttggaggtttttttttctttgcttatatatagcaaagtctgagaaatagattcctgtttcccctcccccaccgcacacaatagaccggcttttacatgcaattgcccaatttcaagtaacaaattcatagcagcagttacctttaagtgtccagtttttaaagatcgataaaattgaaaaaaaaatgaatagtatttatttcttctttcgggttgattatgtgaccgctctggaaaagcactttgacaactgtaagaagagtgggcatgcgcacacagagaactgtgggggctgaagtccttcacacggtactctgcctctgcccggcttcagcacgttcagtcaggaaaggaggaagcctcgtaaatacagattccaagggggagagtttgtgcccggattatattatcgcttcctaaccaacataaatcaggagttgttgaaataaaagaaggaaaaataaactggattgtcaacttgatttaggaagcaaggctaaaagagaaagtagattgtaagactcggaataaatagatccagcagagctaccttaaatggtattatgatggtaatgcctgggtagccagcaataggaaccctagccgagagaaagagatcagggtgtggaagaaaaagaatagatggagaactactagggaatgaaaacacttaaagcccccatccctgctgctttcctggcacagcagacaagacaagactacatacactaggctaatctggatcctccagcctcgacctcctaaaagctgggattatagatatgtactgccacacctgcctaaaggaaacacttttaatacagaatctttaagtataccttaatactaaatgtactactgaccttgaagacaaaaatccgttttaatcaccaatgctggacaccttatgtaccacaaccgatggatggagatggggcctccctatgtatgcacccctggctgtctggaaactggttgtgtaaatcaagcaggcttcaaaagtggaccaatcttcctgcctttgcttccctagtgctggaattagaagtttgtgccaccacacccagttcaggatttctttgtatttaattttttactggatgagcaaagcccacatcccagcactgggatcccaggctgggagttctgacagccagagctatacacaaaccataaaagggctgaggagataaattagttgataaagtctttgccctgaatgcacaaatgtataagaacctgagttagatccccagaacccatgtttaaaaataaacaaacaaacaaacaaacaaacacctaggcatggcagcatagcactcttataaacccagactggggagtccctgggtctctcttgctggccagcctagcgtaataggcaagcctagtccaagttgagaggtagtctttaaaaacgtctatggccatgttaccctgacctcaacctatctcttctcatctaagcaaggcttagttagtacttagatgggaggctgcctaagataaccaagtactgtaggctcttggcctcccagtctttccattttggccacaacctagggccactctaacatgtccccacctctctgtaccccagaaaataaaatagtagactgctcctgaagaagcaacctgaagttgacctctggcttcaactaagttatacacacatatatagacacatgtgtataacccccacatatataaactctcatacatatacacatgcaaaaaaaaattctacctgtatgttctgattcaacacactttatttttacctagtaaaatgaaagtgtaacttgcattattgatatagtaatcaaataaaattcaattctttcactgcaaaataatatttgatcacatactaattagtaagtaacttaaaacgttaggcatataactcattggacaatgacatacatacacacacacacacacacacacacacacacacacacacacacacacacatatgcaggtactagttagggagaactgtattggggagatacttggttgctttgaaacagaagtttgtgtagtcctggctagccttgaacctgctatgtagctgaggatgctcttgaatttctgatcctcctgtctctacctcccaagtgacaagataatagttgctaccacacagagcctttacttttttttttattaacttcgtatctgatttcccctatttttacctaatctttccaaggccagatcttgcaacattagcatcaactgtcattgtgtctcgctcctgaaagcaacagctcaagctaaggttgctctcacatgggcacaaggtaatgcttctgtgcgatctggtttcatgcggttcatccatggggttcagagtgagcatcacttaatgacttagacttgaaaacaccaagtatcatttacaacagtcacaattttctatttcccttcctaacttgtaaattaaaaggacagtgttatcagacactttgtgtctagttattttgtttgtcattccttccttttgtttttgggtttgttggtattgttgttgcagtgagtttttggtttggttttgtttgagaaagggtctaactgtgtagccttggctggtctaatattttctatgaccagactaacctcaaactcagagagatgcatctacctctgcctctcagttactgagatcaaaggtgtgggcgggcatcacacagattgtttttgttttgagtcaaggtctggcctagcctgcaacttgccatgtaaccaaagcagactttgaacttcaggtcctccttccttttcctccccatctcatgtgctaggattacatgtccccacccatctctaccccagaaaataaaatggcagactgctcctgaagaagcaacctgaagttgacctctggcttcgactaaatgatgcactgccacgtctagtttatacggtgctggaatgacctcggggcttcacgtgtgctgagcaagctccatcaactaagccacatcctcaaactctctgtccagttatttaaggaataggaagttatataagaaaaaaaaaccaaccctaataatttaggtaaaagttaagtgcagtggtgtatgtctgtaatcccaacacatcagaggctgacaccggaggattcatactagctccagccttgactatagagactttgttgcctagctcactaccttgtaccaccccccaaaaggttttatctattttttaaccattcagatgcatgtttgaaacagtttacttgaacatttagtaatccaactaacctcaagtgcagatctactggtaattcacaggctaaaaaaagataaactctgatgagtgataatgagcactggctggaaacttactgtacttaagagtgagtaattaatctttgctttttccccctaaaatgaacacttagacccaaaaagaacatagctcaagcaagaataccaaagaatacataccaagaccctcagcaaggacaaaggctctctctctctcaataatcaaatattgggtgttgtgtgtgtgtgtgtgtgtgtgtgtgtgtgtgtgtgtgtgtgtggtattcatgactgcatgtataatcacacatgtgaaggccagagattgacactggttttgttgtttttattgttctccactttatattgaggcaaagactagcctcacacttgatcctaggatggctaattctgctggtccaactagcctgcttactccaagcctgcttactcagtctcctaagctctagaaccacaggcaagctgccataccagcctatcgtgttcatggcttctcgagataggtgtatagcacatgcctttcccactgagccatctttctagcacctcattttttatttaaccaaaatagtcaaatacattttttgagacaggatgtctgtagcccagactagccttgagcctctgcctcccaggcatgaaacagcacactcacgtacatctttctgggctgcgttcctctctccttactagcaccacactgcttataaataaacatggacagtgtgtaagctttttctttccttttacatgagggtctcactatgttgttcaggttagtctcaaacataggggctcaagtagtgctcctgtctcagcttctcgggtatctaggaacagcattggcagaataagagtgaacacaggctgccttctgagaactgaaattaatagatatgcaccaccattcccagttccatatataaatagagaagtggataaatgggtggatttttagataaaggatatatttatatagaacagccaaaattctagtataaactacacttcacttagaaggataattacactaggtgactaccacaggcaagagaactagaggttcaaggtcttccttagctacacattaagttcctaggcagcttgggctacatgagaaactgtctcaaaaaccaacaaaagaaagctaaacaacaataaataaataaataatgcaaaaatttagaagaacgactaagaaagagtaatacatagggagtacatatagtcaaagtatataatatatgcatattaaaatggtgtaataatgcccattgtttcgtgcaatgaatatatactaatttttaaagtattaaaaaagtttagaaacataatccagaactgagaatatatttcagtggtacactgtttgcctagcatgttcaaggccctgggacagatccccagtaccaaatgagaaaaaaagaaaaaaaaaaaaaaaaagaagaaaagatctagaagaatatcttcacagcattgaggtaaacaacaatgtacttgtttgggtagaggattgaatctaagctcacatacactgaggacatattctgaccactgagttacacctccagccccatcagtcctttaaaacaaatcacaaaaatgatagccataaataaaattaacaagctggactaattaagattatgcttcgctaggtgtggtggagcacgactttaatcccagcactcaggagggagaggcaggcagatctctgagatgaaggccagccctatctacagagagaattcctgtgcagccagggctacacagagaaattctatttggaggtggggggaaaaagaatctgtttgctactggacctactggcctgtgcttacaatcccagcattttggaggctaaagcaagagggatgaaatagtgaaagaccctcagagaagttgttaaacagagttgtagagttcagcaaaagcatttgacctggatatgaggtatggggagctctgtggatacatctgggggtacaaagtaggtgacataatatccaattttttctctctctttttttttaaagatttatttatttattacatgtaagtacactgtagctgtcttcagacacaccagaagagggcgtcagatctccttacagatggttgtgagccaccatgtggttgctgggatttgaactctggaccttcggaagagcagtcgggtgctcttacccactgagccatctcaccagccccctctctctcttttttttaagacttagattctttctttctttctttttttttttttgaagatttatttatttaatgtatatgaatacactgtagctgtacagatggtacagatgagccttcatgtggttgttgggaattgaatttttaggacttctgcttgctccggtcaaccccgcttgctcagtccctgcttgctccagcccaacgatttatttatgattatacataagcacactgtagctgtcttcagacacaccagaagagggtgtcagatctcattcaggatggttgtgagccatcatgtggttgctgggaatttgaactcaggaccttcggaccttcagaagagcagtcgttgctcttacctgctgagtcatctcaccagcccctaatatccaactttctaaatccctggggaacacatctgaattacctctctccttagtaaggcagagcatcttttcacatccctttgtccactttaattcttttgttgtcaaagtctcatctctacccttgttgatttgtaagaaccctctataaactcagattaaaagcctttcattggaatacagagatagatgtgtgtgtgtgtgtatgtgtgtgtgtgtgagagagagagagagagagagagagagagagagagatgattttgtatatactctttcactatgtggatttttagtctaacactaaaaaagtaaacaggtttctgtttgtgtgtagtttgtgtgtccacctgctgcctggaacttgctatataaccatgttggtggctgacctatcctgtttaatggtcctgccctcagtctcattattcagtgttaagataagaatctggacaggattctgtccttcctcttctcccttactgagggagtctaattggtcactaaaacttgttcattctgcctcctcaatttctgcttgcatcccttcctctttcttttcagccaatataatcctgtcccttaactaccgacagtaatataatatatatgtctctcatacctttcaaatgtggcttccatactaaatcttgaattatcatttacatgtgggttttccatggaatcgccttcatgaaactattctttttgctaaaaaataagctataaaattcttctactttttcccccagccatgccaacgttggcagttccataacgatgtctctgcctttaccctggaatacctttctacctctgaataacctgcttctattcacttctgctctctgaagcttaccctgaccatgtggacagaactgccccactccctgtagcacagtgtgcttccaggacaatagtccctgtatgttttgcttacaagtctgttcttggtttggtgccactgtataggtgctggatgggagtttgttgaccaatcaaagaaaaaggtaggatttccctcatgaagattgagagaatttttttcaagttacagtagatgaagaaaaattcttacttttcaatgtatttcaaaaatactacgtgtaatgagcataacatgattttagtatgactagtccaccctttctcctgctgtagggtatttgtttctagggttttactgttttctaaaccaattgtttccttgaaccatatttctaaagaaggacttactcactaaagaaggagaaaattaaagttttcatatgtgctaacaaatgccttaagtaaggttccatcactttagacttctaccagagaagaacctctgagacatcaaatgagccaggtatgacgatacatgcatggagttccaacacttgcgaggtgaggcagaaggaccaggagttcaaaggaccacctcagctacacagtgagtttgtggctgcctgaggtacaaaagatccgttctcaaaaatgaataaataaacacgacagaggagagggagaaattagaacaaagtataatcacacttagatatgaaaattccataataaaacctattgctaacttgctagatatgtctttattttctattgttattattttaatattttatgcacataggtgttttgcctgtatgcatagctggaagagagcattaggtcccctagaactgcattgcaaacagctgcagttaaagactgttgggaatcaccatgtgagttctgagactcagagccaggtcctccagaagagcagccccagtggaggtgaaccatgtctccagcctcccctcccacctctccccaaaagaaagaaagaaagaggggggggagggagggaggaaggaatgaaggaaggggtgaggtgttcacatgaggagacagaaagacagagatgggggggggggcgatgttcacataagaatgcagctatacagatgtcatggcatgtggagattagaggtaacccaggtccttatttctgaccttgtttgaggaaggacctctctcatgtttgccattgtgtatagcagactagctcagacaagcttctaagggatgcagtctccacctcttagtgtacactaggagcactgggattctagatccaagtcactgttcacaaacataaccaggcttttgcatgagttccacagatctgaactcaggtcctagttgaacagcaagtacttcacccactgcgttaaggtttctcatgccattctggagcttgagtgaagggccctccctacacatgctagctaagtgttcttcctctcctactgttccccttgtgatttattttgagtctcagaaaatccacacatagtaacacaagcctgcagtcccaagtcagggggtagaggcaaaaagatcaggagcgcaagatcattctgagctacacagtgagctgcaagccaacctaggctactaaagaccctacctattccaaaacagaaaacaggctgagcatggtggcacaggcttatacgaccaccacttcggaggcaaatgcaggaggactgaaataaatcctacccagttcatgcttttaattattccagagactgggtctatagctcagtaaaggggtgcctatctaacaagactccgtgttcaatgcctagcactgaaataaaaatcactatgtggtcagagggcaacttaaaggcgttcattctcgcggggcgtgatggcacatgcctttaatcccagctcttgggaggtagaggcaggtggatttctgagttcgaggccagcctggtctacaaagtgagttccaggacagccagggctataaagagaaaccctgtctcaaaaaacaaacaaacaaaaaacaacaacaacaaaaacaaaaacaaaaacaaaaggagttcattctctttgcttaggctcaaactcagatccaacaggcttggtggcctgtgccttcacccactgagctgtcttgatagaattccccatcacacactaagttttgagagagtctccaatagccactggctggattagaattcactatgcataccacactagcttctaacttgtagcaatcttcctgcccctgtttccaagtataggcattcactactaagcccagccaagactatgtatcccttcacaaaacttcagagaagtaaattctacacagttcttaatcataccagcttttaattattctagaggctgggtctatagctcagtaatgaggtatttacctaccaaaccctatgttaaattcctagggttttttgttttgttttcctttcttttcttttttgagactgtttctctgagtagcctttggctgtcctggtactcactctgttggagaccaggttaccctcaaactcaaatctacctgcctctgcttcccgagtgctgggattaaaggtgtgtgccagccccacttggctaaaactcttatcagtttcaacctttcatttgaaatgttgttcaaaagttgcttcacaaaccaggtatacttcaaagctcaagaggttaaatcagaacaatcttgaatttaaggatagcctgggctatacagtaagacctatctaaagcaaagcaagagctgggaagccgctcaagagcaggatgttgtttgtctagcatgaatacgacccccaggtttaccccaggacaggaaaaaagaagttgtagtcataaacttgacaccgagaggaaccctcaagggacaggctttggagggattttataagctttcataacttcaccttccactgcagaagctgaagctatgactttgatgcgatttaaggatttcctccatctatctattccagttacatcttgtcttacttacactgctgtctatagggtatggtcaaacactcaccctagaattcaggactctatctagtcccaacctatgattccaggtagcatcatccctactctaagcaagctagtctactgagaaccatgagtctccctagggttccaggagtgtaccactaaaccctgctgcctgttggtttaatgtgataatcttcagatctatcccttttcctgcaaatgatataattttgtcctttagagctatataggtaatatatttcctttatccagtcatctgtaggaggacatctaactcagccttttcacctgaaagggcctcactaggttgtccaagctggccttggactcattcattaacctaggctgatcttgaatttgtggtcttcccgcctcagccctcttgagtgattggtgtggcctgcctgtccaaccaggccaggctttgcagttaatatttatggagcttacattatgtgctagacacaatgctagctgctttccacatattaatttagtttttttttttttttggttttgaaataaaaatatttttcttctttgttttttactttatttttgaaacaaggtttgaccatgtagttcagactggcctgggactgcctgtgtagtccaagctatgcttaaactcccgatcctccttcctcaatcttctgaatgttggaactacagaactgtagcaccacatctgtcttaattcatttcattcacccttgcaatcctttcctccccaaatcacacagccacagaagcagtttgacctttagaggtgaagaaagaaggcaaatggtggtttagcaacttctctttctaccatggatacaaagttgtaggaaaaccagattctatccatggcaagagagtctctctgtgggatgtcctaaaataagcatgactatctcccagaaaacgactcatcaaagcccagtgcaacggcacatcctgataattccagcactagaggtggaaggaagcaggaggatccaaagttcaaggttatcttcaatcccgtagtgagcccaaggccagcctgggccccaggaggcctggtctaaaagtaaaaagacaactgatttgtcttaatagattgggagaagaggtagtcagactacaggcaatgaagcaaccttttctttgctaccatgtctacagtggcagccagcaactagcaggttctacaggaacctgatgagtcacaggaatcatcacaacaaggacaaggtccatgtgtctgtccaggtagcccttggatcctctcatttggtgccaaagtagtgtctgtatagtatctgtgcctttcttacatggggaattggactttcccaaactcctctacttttataatctgacgtgatgctaatgcttatgcagtaactagactgcacagagccctcactttccctttcacaggctgtagaatatgcccctcagcaccagaaagtgagcagtagggactgaaatccagcccatattcttctaagcaaggacatgaatcttattgaagagctgcatcctgaagggacaatccaaacaggatgcatgaatatatgagtgttcccaacaatgggaaagtcagggctaagttcagaagggtataaaacagttcctacacaggacatctggactttccctagggtgttgggagaccctggatctgatctccatcatgtagaaggatcaagaagaaatgataatttaattctcttaattgacgtgtgagttttgtttgtttttgggacagggtctcaatatacaggccaggctagccttgagttaacttataggtgtacctacctcagcctcctgaatgctggcttaaaggtaaatgccacctgtcacttttgttactcacactataactcatgtagtagtttcatttatggtaggccatctttgtctagtattgaagattggcttccttagggttttgctttaaccatatgaaccaaaatccagaggtgtttttacattttttttttttttgcttgtttgtttgcttgagacagtattatcctaatgacccaaacagacttcaaattcacaagcctcctatcttagcctcctgagggctggaattccaggtaagtgccaccatacctgactctgataccttcttgggggaatctgagaaacaaatatgtgtggtgactatctctaccaccatttggggggcggggggtggggggaagaatagactacctgccaaaatgctaaacagaaaatgacattatcacagtagtagggggtcaacttaatattgtaagagctgacatgtggaaagggcatgagattatcaaatttaattctcatcagacatggtagcacatggctgcaatatcagcatccagaaggctgacacaaaagggtcagtaattcagggatggccttggctccctggtgagtttgagttaagtctgaaataaatgagaccctacctcaaaaataaacaaagaaaatatatctccatctgattgtataagcacagttattcccactaccacttgcctggtcctaacagtaacaagtaagcaggcagcactctgttcctacccggcccattgtcctcttgcagagaacgcaataccctcgtcttcctaaaaatctctttaggagcagtggtggacctcgtatttccaagcactaaaagactaatacaagaggagtctttgagcccaggaatttgaggccagcccaggttggccttgagctcactctgtagaccaggtagaccttgaacttggtgctcctcttgcctcagctccccacatgactttgatgacctgactaagcaaccaggccagttacaggttgtaactctgggaagcaaaggtgcctgaacttatacatagacaacatgcccgaaaggcccaagttccagtttcttagtgagcttcctctaaaaataaaatggagacaattttaaccactgctgtatctagatatccaaaatgatgttagtatgtataaaagcatttttaacaaactaaaagtcaatgtttaccgttaatactggaaggcagttgagctgcctagaaatgctgctatactggggaaagattctttgcccttcctctccttcctacttaacactgatatcacccaccagccatgtgagtcagttcactagtgcaaaaataggaccctactagccaggtacctacctacctaccttcctacctacctacctacctaccttccttccttccttccttccttccttccttcctttctttctttctttctttctttctttctttctttctttctttttaattgagatctactatatagtcctggctggccttaaactcccagatattcacctgcctctgcctccccgctcttgaattaaagacatacaccaccacatctggctccagatacttcttgtaccgcttcgtcctacagactgtatttcctacttctggaggagaaaacaaagtatgaggaatgacttcaaccaccacagaatgcagatattcttaatagtttctatttcttttttgtttattagctttaaacttttacgtatagagagtttcttcaccatccgttagtgatgtttataatagctaacatcacataagaaggccttatgccttagggcagtagtttccaacctgtggatctcaacccctttggcaaacctttatcttcaaaaatgtttacattatgacccataacagaaacaaaatgacagttataaagtagcattgaaaataattggtgctggagagatgactcagaggttaagagcactgactgctcttccagaggtcctgagttcaattcccagcaaccacatggtggctcacaaccatcggttatgggatccaatgccttctggtgtgtctgaagacagctacagtgtactcacataaaataagtaaaatcttaaaaacaaaaagaaaggaaaaggaaaaggccagacaagacttttatggctggggtcaccacaacaagaggaactatccaagtgggttacagcactgggaaggttgaggaccactgtcttagggagttaatcttcacatcaccccaaataataaaagtcgtcattcttttgctggagctttcaagtttgtttcatatttattgtggggggggggatagaggaagggagagaaggagggatggagggagagagacagagctagcaagctagttctctccctccagcaccagagtcctgggcattgaactcagatcatcaagtttagcagccagtgactttaactgttgaaccatccctgcctgttttgttttgttttaaggaaattcaggcttaggaatgctagataacggctgaagaaatggctcaacagctaaggtcacttgctgctcttccagaggacctgagttctgttcatagcagccatataaaaagtggggcatgatgggacatgttggggaaagagagatgggaggattcctggggcctactggcctagcctaattggtgaatcccatgtcctggtgaggaatcctatttcaccacctcagggaagtctagctctggaggaccctatacctcaggcctgctccggcacccaccaaaacatatacatatgccaacacacatacacacaaggggctgaggacatagctcagttgtatagtactttcctagcatttttggtttggtttggtttggtttttttgaagtgggggtctcatgtagcccaagttagcctcagactccctatataattgagacagtccttgaattttggacctcctcctaagatcccagtacttggcagcagcaagtgccctcccctctgaatcatcttgccagcctaccccgtcagtttttgaacatttctcttccctgtgcactcactatatggttcggccgcagcatcctagattcggggattacatatgtatgtcaaacacaatcaacttgaacaacttccctttgtgactggatattcctgacttaggtccttttcctgctgcagttaggaccgaacatttcttccaaaagcccttgctgtctttattagaaacagcagcaaacatatctccactgttctgaggtgccctgtctaaagcactctgagcacatagagacagaacataaccaggggcctattaagctcttacaacattctgcagcttctctagccccaatcaccaaactgctcaaaaacaaacaaccccaaaggctgtgaaccacatgctcaggtttagtcagttattgagtggccaattttctgtgttagttacttctgcttcattgtgaccaaaataacctaacagaaagcacttcagggaggaaaggtttattttggctcatgttttcatcagtttagtcaatcatagcagggacggcattacagagctcacagcaagcatgtggcaggaatgcctcccatagtattgaacaggaagcagagagcacagtcagaactcgggtaggaatcacgtccattggaccatttgccccggagacctacttccaccagacaggatccacctcttaacagcaaaacaacaccatgagtccattttaaagaaactttcatggagaccaaggtgtattctataatgtggagtggaatattctatggacatctagaaggacttttgagtcaattatgttattttacgatggtgtttctggcttcttgttgttggtttgtttgatctggaagacatgtccattggggaaagtagagtattaaaatcaccctcaacttcagagttggggttaatctgtggtccaatctctagcaatgttggttttatggagttgtgtgtaatgtgtgtatgcctggagctgtaatctcctcctagtggattttaacaatgagaagaaacagaaactgtatgccatgagacaccgtggtacaagcagcagagcagcagaatcggatgccccgtgtcactgactgacagaatagccatacactgctgtgctgttaactagcacactaaatgacattcttatgcgcacggaagatcaaatgacaaggttactctgttgtgcctaaccttaaacttaggactttagaagcttgatctgctcaattacagctccaaggacaaaactatgaggagaatatataataagtttcttaaacattctatgtaagtcaggaattgttctcattactattattggaaatatttagtcaattaagtatcaatattaaaatcctctttaaacgagagagagacagagagtgacgatgatgatgatgatgatgatgatgatgctatgagataaacgctcagcagtgaagagcactggctgctcttgcagagcgtttgactcccagtaccacacatccatccatccatccataattcgcgttccagggatcccgtgccctcatctgacctttatgagcactatgcacctatgtggtgcacatacctacatacatccaaacaaaataaaataaagcttaaaaaagaataaagcagcacaaagaccacgtgtggtgatccatatctgaatacttgatattctacttcccaagggctgggattacaggcatggatcaccaaagctagactgtctcgggtattcctcataaccaaaaaaaaaaaaaaaaaaaaaaaaaaaaaaaatatatatatatatatatatatatgtatatatatctgactaaaacccctcctttccagcataagagctgttaattttgattaagcccagtttgttcttctgttctcactcgtggtggtgttgtcatctgtgagaaagcagagtctggtcccaggtcctgggcatttatgcttatgcttttgcttatgctttcttgaagtagaaacttaatggttctttggaaagtggattggatgctgttttgctgaggcaaacacgtgaaggaacatttcattaaagtggacacaggtataaaaggctaaggcagatttatgaaggaacttcactgaagcagacacagaagagaggatattctgctaaagcaagcacgtgaaaggtcacatgaagaattttttgctagcaacacacatgtatttgtccaccttatattgcacagttgagctgcatttgtcaggactccatagagagaaacacaccaaaaaacttctagtggtgtgctgcagtttcttgccacttgagcggtctcaggctgattggatgcatgtgctaagtcaaggcacatggaggacacgtgatgtttgcagggtataattaggacttcatgggctggcagagcttggctttgctggtacagtaactgtgcaatgcttgtgggtctcatgtcttcactgagcttcacttccctgagagagacgcacaactaacaacttctcctggtgtccctcctggtccctcctgctgactttagccaggctgaggcctggctgtctctttgtagatcctgtcactgctgttgctaacccaactctactgaacttgactgctggtgtatctcgaatggattgagctgccactgcctgctaacctatgaactgaactgccgatttccagacaatgcagatggggtcactacaaagaatctttctaaacaggtccacttcccctcccaaccccccacacccctgtattctttcttttccactacctctggtgggtggtgggctacaagggcggtttaagaaccataattaaaaataaggtttggggctggagagatggctcagcggttaagagcactgactgctcttccaaaggtcctgagttcaaatcccagcaaccacatggtagcttacaaccatctgtaatgagatctgatgccctcttctagtatgtctgaagacagctacagtgtacttacatataacaataaataagtcttaaaaatgtttaaaaaaataaggtttgaaaaaattaaagttatactttcttctacatattttatacttttggctctaacttttggttttttttaatcaatttttagttaatttttgttgtaatgtgaggtaagagtccaatgccattcatttgcatggactgcctagctgaaatggaaatatatccattctgcctattagattattctggtgcccttgttgaaaataacctgaccatcggaatgtcaggacttaattccagacttcctggtccactaatcaaaacaccttacaacactattataccatcttcatattgtggtattttagtgagctttaaaatcaggaaatcgacaccaataagaaggcccagcagctaaaggcaatccctgccaactttaataacctgagttcaggatctgcaggacccacatcatcaaaggagagaaccaacttgtaaaagtgactctctgggctccaaacacctgtcatggcacacacacacacacacacacacacacacactgacacactcgcgcacacaatctttgatgaactctttccatttactggatgtctaatggcttagttttcagatgttattcactgcttttgttaagctgatgcctttgtgttgtattttcatttaccatcttctttgtatgtacatttggcatgtgagtgagtgagtatggatgcatgcatgccgaggtgcacataccgaggcagttacttctctcctcgcaccctgggacctaggattggaaaggagtccctccagtgcttctacccactgagccatcttgccagcccaatgtcactgttctcacgtagcccaactaaccctgaactcactatatagctgaggctaactttgaacttctaatcctcctgcctcaactccccagtgctgtgactagtagcatacactgccacacccaggtttatgtggtgatagggattaaagctagggtactgtgcatgtttagaaagtattttacacgcagagctgtattcccattcttagtgtgttccttttgatgtttttataaatacaactactttttcttacttttattcctgtattggtcactgctaatatacagatatacaatagatcttccattttgatcttataacttgcaatcttgttaaacttgcattttggttctaatatgtgttttgtgcaattccttgagatttttttcattaaagttttcatagtgt

SEQ ID NO: 212 - DNA, 14238 bp, Mus musculus
gccattgtcagtgttttaatcccaaggactgggaaagagttccagcagtagagaagaagaggcatcctttgcagttcctttcatctggtcactactggctgtcggcacagcttctgtcactcagttctcacaatcctcatagcgatagttttctgtctcagaaatacgatgtgtcttgtccatgggtgaatgaagaacacttgtttctgtataggaaaggacagtttacccaaagcaggtttaggagactgctagagagggcctgtaattaagactcaagtggaatagaagggactggcattggaaagaagaggtaaggaaaattaggaccctgtcctgggcttcctgatccagaaagtgagcaggatttggatctaggcaagatggggcattagactactgtctctgtccactgctccctgaaaagacctgctgctcagttgcagaactgcctatgctacaaggctatgctggaccctcatggtaccctccccagggtgtgtgctcttgagctctgaggctcaccagaaagtcttgtgatccagctttcagccatggggaaggaagcatgggccttgtgtggatgagagctctgctatcctggggctgcctcatcccacccccaacaaactctctgaaattttcgtcatcaagcaagttagaactcttcgaccagcctgatgactttaattggaaagggactgcaaaagatttgtctaacaggcacttgacagatgaagcccatgggataatgattctgagctcagggtgggtaccaggcctcataccctgctctcagacaagggtactctcagtctggttagcaagatggtgataaaaatgggtctgtagaactacagagggaggcaggccaaccacaagtgtccaactgctgctctaagcatttagtgctaagaaaggaagcccaccaagtagtagaccttggatagtttggtgagaagttgctgtctgccccaaagtccacccacctgtggcttctggagcaggctatgctagtgtttcccagtgtgaagcaactggcatgataggatacattgcagccagtctgccttcccagagtatatgtgttaaaacattccagtgtcttaaatggtgtgtatatattatatccatgtgtgcatgtatgttgacctttgccctccaagaagtctcagcaggattccttaaagcccagacaggtatgggtgagcctttgggtctgtctcccaatcttagagctagtgctcaaagatgtggctctatttacctacctccttacgtgtttttttgtttgtttgtttgttttttttttttctattttgaatctactattcccgaagcttttcctcactgatctgagactaggatcttggctgcctgctctccctagcattcctcactgagcactgtcctgacccctcctgcggtgcaagccaggacactgttctccatgtagaaaataaagtccagagggtgtgtcctctacataagtccagcttggcttgccccaccgtggatgggtgggtaggaagtggtgctgtgaaggctgaggactgaaggcaaggggtgggtcctgctggtggctgtgggacctgacacaccaccccttttgagtgacttgttttgtccttgcagcccaccaccctccctcagggcaccatcaacatgaaccagtgcacagatgtggtggatggggaggcccgcacagggcagaagttctccctctgcatcctgacacctgacaaggaacattttatcagggcagaaaccaaggagatcatcagtgggtaagttggccagagccacaggaggcactgtctgtttgctcacccatttctggggactccagggcttctaggtcttccttggaactcttcactgattggtcgtcctcccaccccacacctcatcctcaccctgtgcctccttggcactcagcacacagtgctgctcctgccttcccctcaagtaaaataagccctcttttctaggctgtgtatcaggcagcctgcgtggcggcccctttgagaaacgtcccgtgtagcaccaaagcctccaggtgattcacatgcatgtattttcggtcctcagtgattaaccccattcattctctacggctggaagagggcaggtgtgtcatcaaggctctgtctgaggttgaggggtataggctgtgtatagcacagggtagagggaagtaaggacatgaagccatctggtttaagcaagtacaaggccattgggagcattgtctttttctagcatcctttagttgcatctctagtgttgcttttcaggaaaccagactatactggccaagagataacatttggtaggtgactgagaattctcctttctaggttcctagaacaacctgaaggagtactttgtgtgtcttcctgaccttaacccagaacccaagatttaagagtttccagggcttctaatgaacccatcctctataccaagcaatctgacggtcaagagtaagggagcagtcaggtgtgagtgatcatctgtacttctgactgcagctggtgctacctggtctaatatagcacacatttcccaagtggatcttcctagagagcctcatcctcctagacttggatctaggagagggcctgaatggcagatgggactgaaaaggtagtcagaggtctctaggacaagcagggagtatctgaaactgggttgatgatgccatgtggctcagagagatgatgtttagcatctgactgattggtcctttgacaactaccttggggtcctggctctgctcttgagcctctctcctaggttacttctctgtcatctgttctgtcagcataccatggaggcctgctagatagacatggttattaattaactgaccaagttaccagaggcatataacttcaaaatcctgtatgcaggctcatactccttggggtccacagcttatacggcagcttgaattatagcaagtctactgaaactctttctctcccctcattcttgaaaccccttttctgacccaagcagtagcttcttttttgttttgttgtgtttttggtttttggttttttgagacagggtttctctgtgcagccctggctgtcctggaacttactctgtagaccaggctgtcctcgaactcagaaatccggccagctcaagcagtagcttctttagccttgcccacatgctgggatctttgatgcccagagacatcagacatggcacagatgttccaaaaccaggtgcttataataccctcactttctgtctcctctaacctcggtgccctctccagtgctgttatggttcttcatcttcatctgtggactccaggcccattggcctacatgctctgtccacatccaaaaccagttcctaaggagaaggcactttcaccaagcaggtagggcatctaccacctacccagcctccctccctcatgccatgagtgtctttcatactgctgggactatatttgacacaacttttctaaaggattggttgggactcattgttgctgtctggctcagccagaagatagcattctcttctctctgccctgccatcagctctgcccgttttctcattctcactgatagctctgccttctggagttggagaaaataagtccccaccaacctcatgtgtactaactggccctcttctcttcactagattgttattcttaacatttctgacacaactaaatatgttgggcttccatgacaaactcacatgtagctgagtgtagaagcacacgcctgcaattccaacttttgagagactggggcaagaggagagttccaggacagcccagtagcctgggctacatagcaagaccctggtttgttttaaatggggggaggaaggaagagatagcaatgtagacctgttccatcatggctcagccctgacaactctgatgctagtcatggcaagcttggtagtgaccaagagtcccaggcttcccttcctcaaactcttcccaagcttctagctaacttagcaaccaagttcctcttgatggatgactccaccctcccaaggctccttggtgttgataatggctagagcatatgaaattttaagcacttgagagattctacaatccctgccatgtaccccacatacctgaggtccttgtgggaagataatcttgatttaggattctagtgaagttgtaggaatcactcccttcacacacacagcctcaagtatctgaccgaaatatcagctgacatggaacagttctaagatccaggcttcctggagaaaggatggagtaagaagataggagctcaatgccccaggaagtctgcccatctgctgtcttccagatataactccttcctctcattggggccacggagaggtgacctacaagcacccctaagactcggagggaacttgtaggtccctgggcatgggttgagctgaggtgagcagccctttgttcagcagctatggttcctacacttaaacttggcttccctagctcccagctcccaagactgctccaaaaagcaatgcaatgtttctctccccatcctgcagcaaacccaaattatagaggcaccttaaggagcccttctcttgccccaggggtactgataggtatgtggatgtggccagcaccatcactactctaggcctggacccagcctggggcctggtgttctgtgaagtttagagccctgtctctcttgtggttccagaagttattgcttgtctggaaggaaggctggctgttgtaccccacttggcattagctgaggccaggtttcaaaagcaagccttcttctgtgttacagtccctctgtccttctgaaattctggacctgctctcatttagccactggtctccctaggatatggttacatagagtggcagtgccagatctggggtcttaaccttttgtctatagatctttccctagctaccagctccatgctttctgttgctggcccagaatggctttctagaatgctgggtctagtgaaggatcctttgcaactgtgtagctttgtttaaacctggtgtgtgtggcatttttcctctgtaagtggtggtctgatttattagcctcttactcctgaggtgagccaccatgagaactttgctgatagaactccaaattttttacctttcagccagtgtctgccccagtagccctaattggccgccagtcattgcctggttgtgcaatcactaaatccaaatctgggtgggcagtttttaagttgagactagaccagtaatggcacagtgctctccctgtgtcccaggatgcctttgttagaacagagaagtcatcttgctctgagtccatagtggccagggaagcgtcattgtctctccttgtcctgatacagccagtgcttttcctgacttgtgaaatgacacagtctcaacagctactgcactctgatctggagtaacacccaccttgctcagtgtctgaccactggataggtatctccaaaaagagtacctaagagcctgaggtctttgccaacccagcaaggcgtggagtcataggtcctgaaaggcagggatttacctggtactatttctcatcctgtcttcccaggtggttagagatgctcatggtgtatcctcgaaccaacaagcagaaccagaagaagaaacggaaagtagagccacctaccccacaggtaggctgggcgacgtgtcccctagtggaactgggcctgggaagaagtgagggcaagagggtggagaagatctggccagggctgaggtggtcacactttgcatgcctcttcctccctcctgcctgtaccctaggagccatatttaggtcactgagcagactagcctgctagagtgccctgggctgtcttcaggagggtttgaaccagcaggcaaatagtgagcaatagcagcttagcctgtgtcccttcccctggcatccatcccatctacttctgggaacggaagaatggtgcactcttctgccacttccagaggaaagaagtaaccctgagcaacagggaaagggaaacctggtaggtccctgccctgactagtccctgtgtgaccagagctaggtaggtggctggggcagacgaaccaggtccagtccttccctcccttcctccttctctgcctccctgtatccctctcatcctcattccctccctcctcctagccagtatcctgggctcatggcaggaagtgcgctgcccctattcttgctgtgttcaccacacccttaggctctggaagggtgaagtcaccattctgaatttccagcaagggccttttgctagggtggttgtaggtacttaaggttcatcttttcccctctgtaccaaatgttgctttcatcaggatttttacctacgttggacaaatcaagtcagtcctaagaatgaacaaaattcattcttgaatgtggtcttatgagcctcacaaacccagagtcttgtggaagcagagaggcagcccaagataggagcctgcgtccctgagccaagcagtctttctagcttctctagcttcttgggctgcaaaagaaagacagccagaggctgctgacctggatctccacaactctagactactgtggacagttaatcctactagtaggatgtagcccaggtctgtgtctggtgaccagcatccatcctgcatctcatccttacccaagaagccccagagggcacccaagccagccttccccagataacagtgcccccaactggagtcatttaaaacatgcaatcaaagaaatttaaaaatgtagtcagtttcccagaaactgaaagtagagccttttgcttgggagcagcagttaatgctcaaaatctcccaagctgcctggtttgagagaaaagtcctggctgagtaacagtggttagggttacgccttgtttccatggtgatgccttggaagcattgcagcatagagcttctgcctccaaatatggtaactctctatgtaccagagacagcctgggtcaggctagaaatttgggtgtatcccctcccccacaactttgtctcttccaaatgaagctgccctgtggccaggctccaactttctgggccagtagaaagagccctatgatcccagaacaggaatcaccccttccctgaggatatgcctcagaactagggcacagagttcctagcctcctctgccagtgttatggcatgcctctccccttccccacagctaacctctggtgagtctcaggaaagagatttagattgaagtctctgggtacacccacacacacttaagcaacctgctatcagagccatttatgtggcaggtgagcccgaagctcagtttccatctctctcccatatctctgcacaaagcctagaagagtttcaggttaaaccactcaggaccagaagcttggtttctgctgggcccaagctaaattcttcaggttgaacctaaagaaacttagatgatagaggtgatgttcaccagacatataggtccttgaaaagaaggcttagagtagaaggaaacaagagtcccccaaggcagagtgagagcaagtttcctagctctcccaagagtctgttactcatatgggacttaggagggtggcttttttctctgccagtcccacaggctcgaggcccttggcagagacgtgggtgaggttccctgttcatttctaggattcatgattttttaaaagttttttttaaagatttatttattttatgtatatgagtacactgtagctgtacagatggttgcgagccttcttgttgttgttgggaattgaatttttcaggacttctgctcactctgatcaactcagctctctctggcccaaagatttatttattattacaaataagtacactgtagctgccttcagactcaccagaagagggcgtcagatctcattacagatggttgtgagccaccatgtggttgctggggtttgaagtcaggaccttcggaagagcagtcagtgctcttaacctctgagccatctcgccagccggattcatgatggtgccctctacttcaagacttctttctcactatggccccttctccattttcatgccagagaaatagagaatggcacgctgaagagagggtgcggactcccttttccttggttctggaagcccttctcagtgccagggtccatcacagtctgacagcatgaacatagctggctcctcaggaatagggcgcaatgaacctgggcttccataccctttgctgacccaggctggctctgtgcagtctgcacctctttgtggccacatccaccaaactagatctttcatccacctgctcagaagaaaaagaatctagcccaagaatggggatttgtttacctgtcctccagaagacagaagagagaacaagctcctttggggtcagcggtgtgggtcagccccgattatttggtttgagaccacatgggagtgggatgtggatatttatcatcctctctgtctttgtggcaagatagtaatcagctaaaaccaccctcttggcagccctctctggagattggttgggcacagaatgtgagtgggtactactgggcagctgggattgccatcctgtctttatctgggttcaacatctaaagagtccaattctctgtttactcagaaactggatttgtatgtctgctgagttctgttcagggccgtgccacttttgtgccctgggaaaactgggaagtgacttgggctaccaataaagaacaacttgtgcttgagaacaaggtgttcatgtgacaggtgtgggtgtgcaggtttcagtgagatgctgtgtgtctcagagtgaggtgctcaaacaatagacattgggattttctcagatctgggaactgggaagttcaaggttaaagaagcagcagatgtgggcccacttccacaaagtagatctcctggcctctttcacaggtcactaatttcatttgtgagggctccaccacctccaccacctcctcctcctcctccttcctcctcctccttctccttcctcctccctcctcttcctccttctcctccccccccctcctcctcctcctcctcttcttcttctgctttcctcctcctcctccttcattattattattatttattatcactatcattattattactatttttaaagatttatttatttattatatgtgagtacactgtagctgtcttcagacactccagaagtcagatctcatttcagatggttgtgagccaccatgtggttgctgagatttgaattcaagaccttcagaagagcagtctgtgctcttaaccactgagccatctctccagcccttgaggggtccattttcaagacttaacaaaatcctaagggccccacctccacaaatcatcatcaaggggataggatttctaatgtaaatgagcaacaactgtcaggccttagtgtctgtcttatttcagtagttctttcacatcatcccttgtgttccatttaagctaagagtgggaaaaaccacagggtgctgtgcaattcactttctacattttccccaatgatcttgatagcagtgggcctggctcagaggagtgtgttcctcttttgtcttgtcctgtccccctttgtttatgtctcaagtacctatgagtataggaatggcagactcctatgagcttacccctagtaattgggctgatattctaggcactgtctggcagtatacagagagagcttttagatacttggtgacatggctctggtagaaatcaagaacctttcctctgcaaggcctcttggacaaggcactggtgggtgcatgacttctcatcccccaacactgttttgatgtttttatatcccttgtaatttagcagccagaacctgtgtgctagcttgggctatgtgctcatatgctaccaccctcactgctctctctctaggagcctgggcctgctaagatggctgtcactagcagtagtggcggcagcagtggtagcagcagcagcattcccagtgctgagaaagttcccaccaccaaatccacactctggcaggaagaaatgagagccaaagaccaacctgatgggaccagcctgagtccagctcaaagtcccagccaaagccagcctcctgctgcttgcaccccacgggaaccaggactagaaagcaaagaaggtgagtagcagctgatcagcctgcggacctccttgttgtggtgatctgtcttgctctgctggagtgggcctctgtccaggaaataggacgggacactgggcatgtgatacagggccctagctagaggcctgtcatgggtcctgaactcttcctccctctgtgcatcgtgcagcatcagttctgggcagcactggcctggcatgactagttcctggcctatgagattcagcttggcttctctacctcacctgtgaaggagaaaggtgtagcacctactccattggcctcaggtgatctataaacacgattctttctgcctctgtgagatctctgttcctgtaccacaggttcctacctcattagctcttagaacctgctgggttgggtgcttcctgtctttagagggatagcagttaggacatcagtgcccctctctcctcattgttaccatcttggtcagctcctggctaagaagacgggccagagaggacaccattgacatcaccatgccctctccacttagaatgctgtgctgccctagcagagttagtccccttctttgcctctctcaattggagttctttagcatacacacctgtctacatttacagtccaggtgctctacagcatgcctataaaaggcctcctccctgcttcaaaaaaaaaaaaaaacctaagcctgaaaaatgtccttttggttggtttcttcctgtggtctggtaagaaaccattggttaggatggaatcctgcttccctaccagaactgtacgaaagtccctgcctgcaaagtgaccagactggaggaaagggtagggagtaaaggcaatggagatgggtggtccatttctgcccacaattttctccttttacctctagcccattcatagctgtggggtgtgagtatggagggtgttgaggcagcttctgggtgatcatgtgtgggcttttggaaagttctgatgacagaactgacagcagtctgagcaagctttctcttgccttctagatgaaagcaccataagtggggaccgtgtggatggtggtcggaaagtacgggtagagagcggctacttctccctggagaaggccaagcaggacctgagggctgaggagcagctgcccccactactctccccacccagccccagcaccccacacagcaggtatggttgtcctggatcgccctcacaggaactcagccacccccttcactccccaggtcttccagccccaagccgaatggtctacagcatctgccctgccagcctgggtgaggccagcaggtcacctaaccacatggactccagcagtgctggggggtggggaacagagatactggggagcacctttgcctttaaagccagcaggcagtatgccgccctggccgacgtccctaaggccatccggatcagccatcgagaagccttccaggtggagagaaggcggttggagcataggactcgggcccggagccctggcagggaagaggtggcccgtctatttggcaacgagcggaggtaaggagggcactagagggctaaaatcatgtatgtactcacacaagtgtacttcaggaacatgatttctattcagtgtgtggagcatttcctctctgggtcccagtctgtggtactagttctcagctcctggcagccagatacaggactaagtgctggcttatgtaggttgtgcttcccagattaggcccagtgtggctgagtcttaggcttcttggccttctctcttattagagagaacttctattctctgagaagactcagagctgcagatagggactaggccctcctcatgctgacagttctgcagttgtcagagggcactgaagagattccaagatacaggaaagtgagggggcagcatagatccttcccaccaagatgcaagaggcagccagaaaagctgctgtgtgtctcagctgccacttttataaaacctctgggttttgctgaaaggcttcccaccagtggcagagatagagtacttactgctggaaagataaggccctacctgcttttcttttgccccaaagtaccaagcttgaggactagggaatgttctacccgtgagtccccctctgattctctaccatatctctgagctgtgttttgtgtccaggccaggtttcttgcttaacaccagacaggtttctaaagatccatggctgcccccaggagagtttaaaagcacatctgtgtgctttgctgtgggtgggagcactgctttcattagctttacaaagaagtcctctattcagaaaggcaactccagaaatatctgcagtgtcttccctgccctgagtgcaggctgaagttcagtcaggtgttgagggcaggatgagattagggaggactttctcttgtccccttttctcaactcagttagttgacacccaacccagcttgtttcaaatggcctatggaccctcaggaagacagtggacactaagtgctccctggtattccatataatcgtcaatcttcacagtccaacagtggctcaggaaagcacctgttactcttacccttgcttcaaggatgtgaaaacttgggtgacccccatccctcatggtgaataacagctagtgggtgggccttcagcaggaagtctctgattctatgataggaaccagcatcagagctcctgatgtccttctaaagcatgtgggtagcagaaatgaaaggtcttgttaaccattaaggaggccttcagggtgggcaggggcaggtttgcgctggctgctgagcaggctaattctgatggttccaaaatggggtcaactatgctttacgtttagtggcaggccagagttaacattttgcccacctgcttggctaggctccttgtcagagatgttaattttgaatgcattcttgtctacctgcctgagatagatgcagtctctaggctttgttcttgcatgttcttcaccactatggggatgattctcagctggtgttggtgcctggactacttctgcacattaaccctgtaactatcccttcctgaatgatcttgctggttggtgttgctctttgaggactgctatctgaggcccaagtagtccacctggtgctggactggatcctggtctctgataagttagagtgacaagatgccagttactttgcattgagttactgtagccaagacagacctgccacacagtaaggaagttgaaaacctcagggttacttttggaaaacttcagtaagccagtaagcaaccctacctgagtaccagcagccctgagcttggaatttgctcttgagacttctgagcctttgaaggagttcttataggaggttcttagacctgtgtctgctaagtgtggagatccttataacacttttagtgactaacagaaagctaatggaactctgacctctccaccttgtcagagtagcttgagtgaagctactctgtcacctctattgtttcagaaacaccaacttagccacagagaactagctatatgcagaggttgcccaagctcctggtctcatcatgtcttggcagcatctctgtcaagcagctatagcaagtccccccaagcaagtagtttctcatgctaactactctgcttggaaccctataaacctatattccatggtgccagtctggcctggcacagccctcctactatcctggggccttgaagtactctagccagatacagtgctctcagcccgagaagaaacagcggccctgggatggtggtgtccagctcttctgcagcagtctagctatacaggacaccttggctgcacttaaaagattttcctctacctggcagccagcagctgcttagctcactgctttcccagccagtctcctcacctcagcctctataggcacagcaagctaacccagcaccagtcttctaacgaccccgagtatggaggcagaacacacacaagccctcctgagccctggctgcctttgccctcttacctcccttgaggaaaggaactgttaaggaagatttgtagtgacctctgaaaagagaggttcctgggttctaggccatgacttcctcttgcctattagagattttaactttctgaaagg

SEQ ID NO: 213 - DNA, 10100 bp, Mus musculus
agtaggcggtccgctcgtttctgtctccaaggtttgagtcttgtgcttggggtcttttccacatctctatgagtgtctgcctgtggaagaatcatttcctgaccgcaaaagcattgtcccggagtgcggaggatctgcggcctgaccgctctggtgtcgcagggcatggggggagggggagtcagctggcccccacccctgggaaatgctggcactctcaagacgtgtgagtaccacctgccctgcctaaaatctgaaggccgcatccctgaagacaaagcataggcccttgactgacttctgaggctcttcacgaaattgacttgccactctgcaacctctcatcccaagcatcctcaggcctctgctggtgttgtggctctcaacttctagcttacgtcagaatctcctggaagatgatttaaaaaacagcgccagttctcactcctggagtttagaacctccgagaattaaatttttcaacaagttccgctgctgctgctgctctgggatcacgcttggagacccaccagaccttagcatatgctgttttcgctccaccccatcagtgacatcttggcttgtgcctcgctagcacaatttaagcatctggtggtaatttctctgcgaacgtgcctcgttcgccattgaagccttggccctcagctttaaagctcagtaaatgttaggagagtagggagctgagagaacccacctggttgaccatactgctttctggcgtgttcaagagccgtgtccagtaaggactaaacacacccggggcctcacctgatcccagcagaccacggtgggcagtggaaggaggtaagaaggtgcctgccagagcaaggtgactagaggcaacaaaacccacagcagaaacgcttcacattttaagtaaacaaacaagcgagctatttgatccagttgccttgctgtgctacctggcctgatctgccttacactaggactctcaccaacttggtaaagtatttattgtctacagtagcttttaattcttgactctcccatcattacctcccaagtgcaaaacagaagtttgtcttcgtttgtctgagatagtgtctcgtgtatcccaggccagcaaaatacagctgaggttgaccttgaacttctgatctacccgcctccacttccagagtgctaggataacaggcccaaggcatcataaagaatttatacatccgtggaatggaagggtgataaggttataaagaagattttggaaccactgtaagagatggctcagtgaggacccaagttcagtccccagcacctacataaaaagcctggagtggtagtattttattgtaaatccagcactggggagatagataggtgtatctttgaggctggctggccagccagcctggagttcatcttaaaatcacaaagtaggtggcctctgagaaacagacctctgatatgcatgcacagctgcacataagaccccacctccacacacacatacatgaaaaaaaatcatataaattaaattgaaaaaaatttaaaaaacacaatcaataggtctaggaaaagagattatatccaaagaaaaggaaagtccaaaaattttagaaacaagcacggcatgatggtgagtgcctttaatataacccagcacttaggaggcagaggcaggaggaactctgagtttgagccaaggctggcttacaaagtgagttccaggacagctggggctacaacagagaaatcctgtctcaaaaacaaaacaaacaaacagacaaaaataaacaaggaagttaaagacaaaagggagagtggttaaagggcagaccaaagaaaatgatgtagcagtgtagtcatttgatggacctctgtaaactttctctaagcctctcccagtttgtgccttgttaaaaagggaaattgtaaacaatgtttcagatgacactttgggtacttaggagaatttaagccttcaaggatttggaaaaacatcagttgacatgccaacaattgatatgttaattaaatatcgacctgtgtgtacattaaatcagatcctagagactgctacctgccgatacttttccccagcgaggaaaacagctttctttcccttgatcatagcaacagtagtcacaggagctttcactgtctaagaatcacttgcaacccagagagtaattaccattcaaattatgctatgctgactctctgtgagcctgcacgcatggctttgtttttgttgtatcttctctgaaacaaagtttcacgaagcccaggctgacctgtaactatgtagcccaggatatgttgaacttttgattcttcagcctccacctcccaagtgccagaactacaaatgtgccattttacaaacaggtttcatttttactctttgaagggatcataattttattgggggttgggggtgtttttaagctatcatattataaacattttttttgcattttgcttctttatttaacataaatacatagagattccccctagttgtgtagaataggttaactaattcatctcttttaaaaaataactatttatttatttaatgtatgtgaatacactgtcactgtcttcagacacacccaaagagggcattggatccccattacagttggttgtgagccaccatgtggttgctgggaattgaactcagaacctctagaagagcagcagtgctcttaaccgctgagccatttctccagccctcagccctcagttcaattcccagcacccacatggtggctcacaaccatctgtaatggggatccaacgccctcttcaggtgtgtctgaagacagcgacagtgtacccacatacatgaaataaataaataatctttagatagaagaaggaggaggagaaggaggagggcattatttaggttcccaggtcttgtcagtgccacaaggctgtaataagcatgtttccaggtctgtccctatgatggatgcttttacttttattgtagtttcctggaaatgagattacttgagaaaccaggaaaaaaaaaatcctaagtatttctgttagtggacttgggatgtagctgagcggtacagtacttatctagaacatgtaaggctctgggattcatctcccaggactgaaaaaaaaaaaaaactggcctttatattttgagggactggatagatggtttggtagttaaggctacttgctactcttgcagagggccagtattccatttccagaactcacaggatggtttaagaccatctgccactccagctccaggaggtctggtgccctcttctggcctccttgagcactgcacacatgtggtgtacacacatacaggcaaaacactcatacacaaaaaataaaaatagaattaaaaaacaaaaaacaaaggacagtaaaaacacttctgttgaactatagttatacatgtagaactttatacaaatcatgagcatacagcttcataaatattataaagtgaacacatctgcatccatctaacagtttttaggtatttatctatttatttattttatttattaagatttatttattattatacataagtacactgaagctgtcctcagacacggcaaatctcattaccggtggttgtgagccaccatgtggttactgggatttgaactcaggaccttcggaagagcagtcagtgctcttacccactgagccatcgtgccagcccagtctttaggttataaaacagaacattgccagcactctagaggcccctgctagtctcatccaaagccaaagaagcctggagaaaatgcataaactatggttccacttatagaaagcacaaaaccagacaggcctggctaatgacaaaatcaagctgtgatagttctcactttggggaagagagagagcggatggaagtgcgtgaggattctctgttgtactcattgtgacttcactagggaaagagagatttgaagttttgatacatgttgccagattgcttacctaaaatgaagtgacattcacattttaacagtgtctgagagtaatatttttcccgtctctcctccagcagcaggggttattctgtttttaatttcagctggtaggtgagaagtgagctcattgttttttttaatttacagttctcttctggacactgtggttaattggttctgcccctcttggaactggttattttaggaattacttcattcctgttgtattgtcttcttgagttagcttttttttttttttttttttttttttttggagacaggatgtcatgtgtcccaggatgacttcaaactcaccatatatggaggatgaccttgaacttttgatcttcctgcctctgtctctcaatttacggagtcaaaggtgtgcctcaccatgcccagctagattcagtacggggatggagcccagggctttgcgcatgctaggcacgtgttctgcccactgagctacattcccagccctttttcttgccacttttaagagtttgaccatttaagttttattttcccttaaattaaccattgcattttgattttcaagtccagtctaaaggctgtagacagtattctggctgccctgctctctgcctcttgtggtaatgggggaggggagcagtgtatgatagcatgcatgaaggtgctgtgtattacttttgtattctaaataataataatgaaatgactcattatttttggtgctggggatttcactcaagcctcaagcgggctaagcacattgtctgccccaaagctggttccccagccccgatgtcttttgctaacagggcctgaatatcttgcctgtcactccggtgagtgctgcctcagcttcccttctggctgttgggattacaggcaccgtgctcctgctccttttgattgtagtataagctgagttgggtttgagcgtttttaaagcattttgattattttttttatagttgttaattcagagcatgcacgtgaaggtcagaggccgcccttcgggagtggtctggagcttgcacttaggccatcagcttggtggccagtcctttccctgccaagtcaccccactggccctggcttcagcttggtggcaagtcctttccctgccaagtcaccctactggccctggcctctgcttattctaactagggctttatcatactggagctgttctagaagctgcagattggcgacctgtgagtcttgtttgcacgacaaggtttagggcactgggattcaattcctaaagaagaggtactctccggtcccttcacattcccagtcatctcagagacacccatcatgtcacttgctggcttttaatgacacttgactttattcctctggtctatggttttcttccttcctttctttcttcagcaggacttgagataattttacactataaggcaggtcagcctggagctcactatgtaatccagcttacccctgaacttgctgccatcctcctgcctccatcctcttgccttggattccaagtatcaactgccatgcctgactacctcactttttgaaaaaataaatgtttttaaaaaaaatgctagggagttatgcatgctatgtaagtactctaccacttagctataccccaggcctcctgtttttaatcctcggtagctgtaaaaatgggcttatacccatttacaatacaaatgcaggaatattctgttgttactttcttaaaattaattttgcattacattgtctgttttattttgtaggtgtatatgcacatcccaccgtacgagtggcggtctgttgtgtgtgttgtgtctgttggttctttccctccaccccatgggtctcagggatagaactcaggtcgtcaggcttggtggcaggttcctttaatctggtgattctcaagcttccgaatgctgtggccctttaatacagctccttatagtgtggtgacacgcccatcactaccaccataaaattatttttgttactacttcataaccgtaactttgctgctgttataaatcataatgtaaatatctgatatgcaggatgtctgatattcgacccctaaggggttgtatcccacaggtagagaaccactgctttacccactgagctacctcaccagtcctgcttattggtttttaagaaagtgtctgataacagaccaggctggcctacaactcaccaggtagccaaaaatgaccttgagctgatcctcctgcctctacttcctgaatgctgggatcacaaataggtgccactgcccccagatcatgggatgctaggaactgagcctggagcttcttcatgcatggtaggcaagcaatcaaataaactaagctacaaccccaggccctttgttctgatgctaagcccagggcaccacacattctaactctccggtttctgtccctgggctatctgccccccccccgccccctcccccaactctcaccccattcctttctattctttttgaaataactcatttaacaatggatactgctattcctaaagtagatgtaaacccttgccagcaaaaacgcctagtctgggcaccctgtagggatctaatctttccatcatcctgtcccggttattgtctgttcaggattttgtgcttctcttctggggtaacactttaaccgatgagtatttttctgttgaagatacaaacactccactgcacctcaggtttttattccacagttagttcgtttgcactcttctgaaaagtgaaaggatggcattccttctagtctgtcatttagtcagtggagagcctatgagggcattttagtcagcagagagcctatgagggcattttagtcttcagtttgatcctcgctccctcttcctctccctctccctccccctccccctccccctctccctccctctccctcttcctctctctctctcccttgctctgtgtgtgtgtctttgtgtttgtgtgcctgtgtgtctatgtatctttccctgcctctgtctctcctccactccttctctgaattgtccttctctgaattgtctggccagatatagtggctcatgcctgtaatggcagcactcagaagctgaagcaggggaatttctgtgagtttaaggctagctttggctgtatagtgagttccaaaccagcttgcactacagagtgagaccatatctataaataagtaaataaacaaacaaacaaataggctgcctttggtgggtaaatgcagttgacaagagctgtaaccaggacactggagtggaacagtctgtgcctataagccattttgttgccattaagtcagtctaagaagctgatctgtaataacaagttcccccatgggaatttccttcagtgagcagcctgctaagcccatacatgtccattactgggactagcagagttgaagtctcaggccttaaatgtttcaaaccccagcttcttcccgctagtatgtttccattgttaaaaaatgaaactttgtctcaaaatggcttaactgttaaagaggggaaagttggggattcataactctgacatgccctcagtatcagctatttttcctgttgctgtgataaaccacctgacaagaagcaacttcagtgaggaagggctgcttacagtttgtagggacactgtcttggcaggaaggagtggtggcaggagctgagacagctgctgtcattacatccagtcaggaagcagaaagcgggtaatactggtggtcggctccatttcattcagtttagaatcccagcctctggcatggtgccacccacattcagggtagatctctcctgctttgtcaaacctttctggaaatgcttccatcgacacatgcagagctgtgtttaccttatgactctaaataacttcacagtgacaaggaagatcaacactttcttttttgttgttgtttttgtttgtttgtttgtttgtttttgttttgttttgttttgtttttgagatagggtttctctgtgtagccctggctgtccagactggcctcaaactcagaaatctgcctgcctctgcctcccaaatgctgggattaaagtcctgcaccaccactgcccggcaagactaacactcttaatgctactaaacaagtaacattggaagataaagtttccaaggtatgaatgccagcagaaaacaaaaacaatgtgaagcagatcactagataaacacctggtggacagacataaagaactagagagaaaagtggtgagcagagccaaaccctgtgggctgatgggaactaaaatgtcacccagggaacggagtgaagggattggtaatatggccatttattgtggaggaaggctaaccacagaacacaaggaaaactatccagcagaaactgtgggcagagggatgttggaggacagagacatcatatatatatatatatatatatatatatatatatatatatatatatataattatttttaatgtatataagtacactgtagctgtcttcagacacactataaggggccatcagaccccattacagatgattgtgagccaccgtgtggttgctggaaattgaactcaggacctctggaagaacagtcagtgttcttaaccactgagccatctctccagtcccctagagacatcttcttaactgtggtgctttgaatgagcatggctctcaggggttcatatatctgaagacagtttgtgaactgtttgggaaggataaggaggtatggcttcattagagatgtgtcactgggggtagactttgaggtttcaaaaacagacccattaccagttctttctctctctctctctctctctctccaccccccagccccggtctggtgcttgtggctaaggatgtgagctctcagctactgttccagcaacatgcctgcctgcctgccatgctccctacaatggtatcctactaagcattttattgctgtgaagagacaccattaccaaggcagctttcacaaaggacaacgtgtaattggggctggcttacagtttcagaggttcagtccattattgtgatagtgggaatcagggcggcaggcaggcagacatggtgctggatgacttgagggttctacatcttgattcaaaaacagccaggagaatactgtctcttctgtacatacaaagcctgagcatatgaggcatccaaagcccaccttacaatgacacacttcctctacaccatactacctaacagtgccactccctatgagccaagcctattcaaaccaccacatgtggtcatgaactctaatcttttttttttttttttggtaacaattttcattacattttatatattttagtaaatagttttacttctagagatttatttatttatttatttatttatttattttatgtatataggtacactgtagctgtacagatggttgtgagccttcatgtgattgttgggaattgaatttttaggacttctgcttgcttcggtcagccctgctcgttccagttagccccactggctctggtcaactcttctcactcagtccctgcttgctccggcccaaagatttatttattattatacattaagtacattgtagctggcttcagacacaccagaagagggcgtcagatctcattacgggtggttgtgagccaccatgtggttgctggaatctttggaagagcagtcagtgctcttatccactgtgccatctcgccagcccatgaactctaatcttataaaaatgttttttctctaagctgccttggtcataatgtctcttcacgacaatagaaaaggaactaagacattaaccaagagtggcccaagcctttctccagctgtgtcactaggtctgcaatcctccagcgtcagtaaagggcacgagggaagctctgtgctaggatatatctgtgacaagcagaaaactaaaaccaccagacaaaaaaggaaggaaacagaaaaaagcacaacgcaaaacccaaaatgcccagcccagaacccagattccaggacatgaaagaaccgaatagtagaaaatggaaaaacaaacagaaacacagccaaccgactaacagtgtgtagactcatctcccaaagacttgaaaataaggatgtttgaagaaataaatgaagaaagtatttgtcaaac

SEQ ID NO: 214 - DNA, 2180 bp, Mus musculus
gaggcgcggtgtgtgcagcggtactcagacaggaaagcctcgggatccttcgggttctttcgttttccctcctgggtaaagttatgttcagtcttccatcaactcgtttatttttccgcccgactcggcgcgcgtgcgcagtgcctcccagcccaggctgttcctgaaatgtaatcgtgttgagacacagggagggaagctgaacgtccattctacaggtcagtgcattccctgcggaggctcgggttggttgctacttcctgcaggccccaaaacagggattctaaggccaaaaaaaggttcagtgaggtcccaccgagatttgaactcggatcgctggattcaaagtccagagtgctaaccattacaccatgggacctgctggcggcttaaggcgcccggcagccttctcaagccacatgacgttgggcaaccttttctaagcttcgctacacttggcttgggcccgtggccggtggccgcgatggcgggcagacacggaaccaccgagattctcatgtccttacgaattccaaacgttcatgggccccgaggtgtctgtcacctcttccggtgatcctccaagggtcccggctcttgaccccaagtctcgagggcggctggtcgtccgatcggaccaagtccggagaaagccggctccggtcccggactccgggcaggaggttcggcgcacgcagcctgggctttctacttgttttctgcgtttatatcaggagggctgtggctaggacgctttggcccagcggggaaggacgcggactggcacgtggtggcacagccgttcaaaccccggacgaaacctggggtacagacggggatgctggagagtgcgccgcacgtggatgccgcagcccctgctccgcgctatgcaaattatctgtagggagattggcgcttccaattcagcacttccccccgcgcttcaaaaggccggactaccgaaacttctagtgtgccgatccttagaaaaacccagtcagaattttaacaacagacacccaccattcaacacaccacgcgcacacacacacatatcccgcaaaacaacaacaaaatccccacttctgcactgtctagtctttcattttccctaaatgtgtttctgcaggtcagtcaacactttgactcagcagttcaccttcggagcattaccctagtggacatccatctgtgcctcgaggctgcttcaaggatgctctggactatgtattgtttattataatatagtgaggcttggccccataatgatggctattgtataagtcctctacaagagtttaagaaataacctgtgtgcgaggctcagataagcactagggacaccaggaatgttaactacacaggaatgtctgtttagtgagagagatgtatgacgtgtcttctgcccagaaggctgggagcagatgtgggtaatggcctgtgacctgagactgataggctgagatctcaccagttcctccctggactcttatcggtgagcatgtttttctcagtctatagaaactatctttctggaagatgtcacatgtactttacaaagagttccagtgcagtggtgtcctaagctgtgctgtgcacaggtgattgggttaattatcaccaggtaagttttcaccaaataaactacttggggtcaggcttgcaaagtttgaaccaacactggctgcttaattgtattgaattgagcaaccttgtttcctacagatcaccactctgtagaggtcccctggcaccacttacccgcccccaaacatgtattgagacaaaagaccaaaccaaacagctctgcttttcacttcttttttttttttttttttacaattttttattattattatttatttattatatgtaagtacactgtagctgtcttcagacactccagaagagggcatcagattccactacggatggctgtgagccaccatgtagtcgctgggacctgaggaagaacagtcggcactcttaaccactgagccatcttaccagcccgcttttcacttcttatacacaagcaaacagaagagctatgtaccgtgcagtctatttgctgtgtgaccttgtactagggttctataggatagcaacttatgggatgaatatatttaattataatagactattacatataatataaatatttctgtatataagtaatc

SEQ ID NO: 215 - DNA, 6181 bp, Mus musculus
ggcgggcggagccggcgatggcggagaagtttgaccatctggaggagcacctggagaagttcgtggagaacattcggcagctcggcatcatcgtcagcgacttccagcccagcagccaggcggggctgagccagaagctgtgagtgacggcccggcagggctcggcgcgtctgtgcgaagcccctgcccgccggccttggggaccccactggggctctaacgttcatcccgggtccccgaggggaggccggttctatcctgaccggacctcacaggggaggcgagttccgtcctgaccggggcggacgggctccatcctgaccccactggaggccggttccaccctgactccactgggaaggaggatctgaccgcacaggagaggaggctcagtcatgaccccgctgggatagaggtagctctaggtccatcctggccggacgtggaaggccggttccaccctgaccccataggggaggaggatccctcctgaccccacaggggaggctggcaccactctgaccctacaggacagtctgggactaccctgatgccgtaaggggaggtaggcaccacggacactccaccccaccccaccgcactggggaggttgacttcacacctcaggggggccctgagccacctgctgcataggcctcgctgtggaagaaggccaccacagagggttgatttcttgacagtatcttgtgtaggccttggaatggcctacagggaaacaacacagtgttcaggagaaggcctcaccgcttatatatgggacactttccagggatctggagtggttctggagggagccgaggttcaacccactagggatgggctttttccttgctgactgtgggtactgcacttaaactggagcccacttctccacgctgtctaccctgaaactccattcagtgacatgcactccagaaagctctgctctctcttcacctcctttctgagtttagaagggaaaaattaagcatctgaacatattttgtaagtccaaaggtgtccccagaatcccgtggcaattaagggttcaggtgtgtgcagcattagggaggaagaagcctgttaaggtagctagcgccagtctcccgacttccctctgatcccagccactgagctgccttggtgctggtgctcctgggttaggaaggtaacatgaaggtacaggcagagcagacaggtagtcaggttcatctgggagaaggaagccagcatagccctagctgagacacggccagtcctgcctctagtgtctggacctggaagccgcctctctgtgttcccacccaggggagacccttttctggaatgagagactgcccaagaaaccatctctacccacagttcagtctcttaaagctgggtacaggattgtgtctcacttgggatgtttactaaggtatagagttgtggtcttgcccctcaaggagggctttgtgggatgggaacaagctggcgcattgcctagaccagagcctgctgtgactggccttgttctcttatccagttcccgtggctatctcatacccagctgccacctcagttatctgccccggtgtccttgaccttggccgttttaaccctcaggaattgaagcacagtggccagtgccgtgtaggggtgtgctgtgctgtcctctgaactaaccacgtaccccactctgcctttttcccagaaactttattgttacgggcttacaggacatagataaatgcagacagcagctgcacgatatcacggtgcctctggaagtttttgagtaagtatcactgggtctctctgattcttggttagctgtgagtgccagtgagagggagggaggcgaggcccaggtgccacaggcaggaccaccagtcttctagggttgtagtaggctaatggggttaaaaaaggataactctctctccagtgttgtgttgttgagaatagtgtcacatgaaaatataaaaacatgcttccgagttcagtggagaaaggccttcaggccacaggaaaacctcataattcttaagagctatacctgggtgtgatggcataagcctttgatctcagcacttgggaggcagaggcagatggatctctgacttggagataagtttggcctatagagagttccaggacagcccaggctagacagagaaaccgtcttgaaaagcaacaagaggtgtgtgtgaagtgtattgtctgtctgtctgtctgcctgcctatctatctatctatctatctatctatctatctatctatctatctatctatctatagatataaatatagatatagacacacacaaacgtggaaaaatattgtagtctgatctttgagaagcttcccgtggtaagctgagcctggaaggtggtccgtcttgtgttggaggaagatctcagtccaggtggctgtggggaggcatctttctaccagagtctgtcacagcagaagctcagaggaaagtgttctgcaaaatccaaggagctggtgcctttagcttgttcccaaacaggccttgatcgtatcatgggagaaatttccatgttcccacaaccttgctcttgcacacttggagagcacgtggactttccagagccagggtaatgtaagctcttagcaattcagcccagtgttttgctctgtgcagccacagaggtcacagtcaacttttgagccttaaacaccacagcctcccttgtgttgaggagccacccgttaacttaacacacatgaatgataagcttttcgtgctctgttgttgcttggattgcacttacttaaaagtaatcagatgctgctttcattacattattacagaaatatcaaaatgaaatgggattcctacaaattggtatttttgctatttgtcatacagtctagttgaatggatattaacctgaagtgatttatgttattcttttatggtttttcaagacagggtttctctgagtagtcctggctgtcctggaactcactctgtagaccaggctggcctcgaactcagaaatctgcctgcctctgcctcccaagtgctgggattaaaggcgtgtgccaccactgcccagcttgttacttttttaattgaacttggtgtggtggtgtcctttctctataatgaccaattaatatagcaaatgtgacagatttactcagtatacagagatatccaagaagtctattcttgaaaaatctggatattgtgggcagtgggctttatgacatgaagatatggcattttggtaaaagtattgactgtcaagagatagttttatcctatggactaactggagagaaacactaataatgcagtgtactgagaacaccctctcccaccagtggacactggtgtcctcatagggctccgatgctcctcccttctgacttgtccacccagcatgtcccaagtagtcaggctggcctggagtacacggtgcatcccggctgtgcctgtcacagatgtgcgcccttgcactgcattgaacagtaccagcttcgttatcaccatgtggagaatccaaaaggtagcatcatagatttgtgctgcacccttctcatgcactgcgtttcagtgtgagtgctgcacagatgtgagtgggtgtggcttgtcatgagctgctggaagaaactagagagaagcttggagaaactcaagcgtgtaagcacacccggctcctggaccaggtcctgtgagggcatatctgctggatttttattttttgtcctagtttccagaaaactgaggttaggagagtcagccgtgtgtttactgtgatgttcttcttttcagatacattgatcaaggtcggaatccccagctctacaccaaagaatgcctggagagggctctagctaaaaacgagcaagtcaagggcaagatcgacacaatgaaggtgaggcagacaggaagtgatgtctgcacacggacaagggagctcctagcaagcctgcggacaggcttagcacccactctgtggactgctgagtactgctacactgtgggctttctagcatgtataatagttacattgaatgtcactgagccatagtcctgtggaaaacaacacaaactgacagtgtgacagtgaggagaggctgagtttatctggcaatgtccccgccagccgtggtttcactgtggctttcctgtctgacttcccttgggtgacagctgacatcagtgtgcctgttgtgattctgtgtagaccctgactggaggcctttctggtgctaaaggtgctgcagttggagggctctggatggtgtatgttctagtctctcacgtctgagccctgggctcctcctcagcgttctttacactgtgacacggcacacagagaacttggctgctctagggagctgtgtcttgacatggactacagttttctcactgaggtcactgacggtgcttgcttttcagatgggtgctctgtgtgtggttacagggacagcactgtgtgcccttgtttcctggctccccgttagccaccaggccctgttttgggttgttctcctcggcctggaattcatgttccttttgcacagtgagcctcctcctcagctcagccagctttgcttcctgtgacagctcagcctggccttcctcaacaagagttccttgtgcagggtgctggttggggtgtccgtaactttctctccacccactgtccactgccctgccagcctcactccagcattgcttgctctacctgtgctgctcgccacttgcctgatgccagcctggcctacacgtgctgggtgtgtctgctgtgtgcaggcagcccagagagcctgcagctggagtgagcaaggggctctgtcagatcatgtgctgcagagtggggttggtcaggataaccctgagcccctgcatcatttcccctgtcagcttggactgaggaattcctggatgtccagcagaaataccctttggattgtgactggcccctggggcttcggtcctacctgtatctcagactcattgccttgggccgtgctggagtgcattacccattgatggtgctcatgtggttaattttccctgagcacttgccgctcttgctgccatttctcacctgagacccgtgacagtctcaaggcacacttctgaggcctgcatgcccccattgggcaccagttaaagtttttcagttgttgcagtgggattgcatgtgtctttgtgacactggctctgtgaccctgagagtagagactttttttgactggataaaaccactgtgagggataggtggctggaaaagtggataatgcctctccagggctagagaaaacttgggagatgtttgcacttgtgacctgtgtaattccggtgagtaattgcttcagtgagcgctaagattctggggtgtgtgctgcctgcagacggcctctccactgcagtgggagcacctggttggaggtgctcagtcgggtgtttccttcttaagccaaaaggaaggaattgttttaaagatacagtcccctttcagagaggtgacgtccctttaacaagttaattggagacattgagtagttgactctgggtgttaacttgtggaagataagtgacctggttccatccctttgggtggctgtctcggttggattctgggttccttggatggggtgtgttgtgtataacttggattttttttgacacagctatttttgtttttagaaatttaaaagcctactgattcaggaactttctaaagtgtttccagaagacatggccaagtatcggagcattcggggggaagatcacccaccgtcctaagtgaagatcccatacccttgtaataaccagactgagccagtgagaagctgtgcctgccactgctgccttccagccacatgaactggcctggcccctacctcctgtttccatcattttgatcttgtgggactcgggctgggggagcagagctgtgcctcagctgtccctgcagctcttagaccctcggtgaccccttctttctccaggggaacaggcaggaagacaaccgtgctgaaatgtgaaatgtgatggggctcctacttgacatttcctttttatgtatgctgttctgttacactatccataagagaaaactcggttttatagttacattttcagatgttgtgtataagaacataactgttttcatgggtttcaactagacataataaagtccaaagtttt

SEQ ID NO: 216 - DNA, 2950 bp, Mus musculus
caaagctttacttatccttaggtttgacctttaatttgaacccaaatattttgatctaaaacaaaatgatatgggctggaatgatatggctcagcagttaagaacactgacagctctttccagaagtcctgagttcaattcccaacaaccacatggtggctcacaaccatctgtaatgggatctgatgccctcttctggtgtgtctgaagacagaaacagtgcactcatacacataaaataaataagtctttaaaaataaataaataaaaataaaaagtaaaagcacacatttataaaaagccacatggtggctcacaaccatctgtaatgaaatctgacaccctcttctggagtgtctgaagacagcaacagtgtacttatatataataaataaataaatcttaaataaatagataattaaataaaacaaatgtaattgaagaattgaattcctggatcagtaatagatccttggtacaaaaattcctataaatcagtttcatctaaattattgagtatgactgcccagtaggaggagaggcatattttgacaagtttaccaaacaaacaaacaaacaaacaatgaaggtaagtttgtctggcatggtcctgtaataccaatactccaaaagctacagcagaagaatcatggattcaaggccagcttggagtacacaatgagtcttcacaatatagggtaagggaaaaaaaaagccatctcaaaaaacaaaataaacctactaaaagtaattttgtttgtttttttgttttttgagacagggtttctctgtatagccctggctgtcctggaactcactctgtagaccaggctggcctagaactcagaaatccacctgcctctgcttcccaagtgctgggattaaaggcgtgtgccaccacacccggctaaaagtaatttttaaaaaatacctgtcacggccaggcagtggtggcacacgcctttaattccagcacttgggaggcagaggcaggcggatttctgagttcgaggccagcctggtctacagagtgagttccaggacagccaggctatacagagaaaccctgttttgaaaaaaaccaaaatattaaataaataaataaataaataaataaatatttgtcacatttccaactcttatcagttataaaattaacaaggggtaattttttttttggttattttacttcattaatgtgcttagaagttccattttaagtgttgaactcaaggaattatgttcaagaacttgccagtttcatgtttgcttccacatgctgagttaacgttctttcacatttttaaaataaaaacaaaacgaacactcatttccaatggtgaaaataaatttcaagcatatagagaagtggaagagaaagcttaatcgactatctttaagtgaacaatcatatgctgataattgttgaagctgggtaattgctcaccttcactagatatttagaagcaaactccatttttttttttttctgagacagggtttctctgtataatcctggctgtcctagaactcactttgtagaccaggctggcctccaactcagaaatccgcctgcctctgcctcccgagtgtcgggattaaaggcatgcaccaccacatagaagcaaattccaaacattattcctttcacatttcaaatgaccttgggacatttggaaaccaagctgtttattaattcttgggtaaatcaagttctgagattatttcagttactttccaatcctatttcagtttggtccattttcttgacaagaaatcagtagtggcactttcatctatgatgtagctgaaattctgcttccaccacaaatacatgctcatttctggatgtgaacaagtgctaacaaaccaatatttatatagatgctttataataacatttatttatcgctataatatatattatattatattatattatattatattatttatataaatataaatttatataataaatataataacatttatttattgctataattcaagcaattagtagtccaaactaatctagcatatacctgcactttatttataacctgaaaatttccctgagattaaaaaaaaaaaggaaggaaggaagaaagcactgtaatccctcggactcttgggaagtttcatttaaaaatcttttatatccctggcatagtggcattaacttataattctaatactctggaggctgaggcagagggatcaacaaattcaggacagtctgggctatactttgggacactcacaaaaagtcttttataagatattacaacaatgatggtattatcacaactttcaaagcacttatacaattttgcatggacttttactattcactatggactgaataggatgaagacagactaatgaacagtgtcagatcacagctagccataaggcttaagcacctgtaggtggttatattggtaggtatatactgtaccttcctactctgaaagcacttaaagggaaagagagttgggaatcagggactgggtggttgttttgatggtggtgcaagactttaatcccagcacttgggaggcagaggcaggtgaatttctgagttcgaggccagcctggtctacagaatgagttccaggacagccagggctatacaaaatcctgtctcgaaaaaaccaaaacaaaacaaaacaaaaaagacagtgtctcactacccaggccagactggccttgaacttgaggctctcctgcctcgaccaatagagtaagtagttgggatttccaggcatgcctttattagctactatgctatgatattctgctatcaagaaagttgttccttaaaagtacagggtcttgtctaacaatcagattttagagatggaaacacacaaggcagttcattattgcagaggcttagaagagaatgaagtgtacaggaaaaaaaggtttgatatttacttaaagc

SEQ ID NO: 217 - DNA, 15941 bp, Mus musculus
agagcttcaccatatgtttattgaaagttaaattaactgaaacttccataagcataaaatgtgggatctcaagcaacaaaggaattttaatctgtagtagtgatatttccattttgtatttgtgataactgaaagaatcatcgaagattgtgaattctgaaattaacaattctgaaagcagaatttcctgcaggatagaaaagaaagtaattatctttctaattgcctttttaggataagaaagagggcagtgacaactgaatcagtgggtcagtcacacactagcttttagtggaagtgcttgatccttttgataactgcaagcttggcattatgaattgattcacactccacaccacagtccatggaactggccgaatcttctccttggcagccttctctactgcccctcctccacgtctgcctcacttagaggccgagagtcccatctggaatgcctgttgccacagaatacagaacctactgggaactggcaagtgtgtgtatgcctaggcttggctggtggctcatagaatcagggaaaccatgtggaaagcctgctcatccgtgtgcagagcctgtgctgtagctaagtgttagctgctgcagggctgtgggccccggcaccgtgctttaggcctgcagcatttgtagttgatcctaaagactggtgagggtggccgctttgccattgtaagataatgagtcatttgatgcctgtggaaggacagccagagcccactgttttgttgtttttgattaaatgattcagttggtcataaataactataaagtcgcactctggtctttttctttttccttttcctcctcctcctcctcctcctcctccttctccttttccttttcctttcccttttgatgatctcttctaagtgacttcccttaccttctaagaaatcaaaggtgacctaggcttttggacccctgtctgactgacaagccgtgattctgctctctgcctcttggtgctgtagccttgggtgagcagtaaaccaggtgactgagcagttccatactgctgggcagttccatactgctgggcagttccatactgctgggcagttccatactgctgggcagttccatactgctgggcagttccatactgctgggcagttccatactgctgagcagttccatactgctgggcagttccatactgcttagacctgctgggccgagaggacgagtctcagctcctgctgttggcttacccgtggttgggcttctagaaagctctgacagccccagttagcactggggacagcgatctcttctgcgtgggtgctaaccatagagtcagagtgagagctggactgcgcatgctccttccatcccctcctgtgttcctccttcctccaagaagtgcacagccacagaggctgagctgcaggctgccttccactgccctgcgcacagcagggccagggttatttgagcggcgttgtccatcttttctatatttgcgcagtttgccggtcctggcagcccgctgcttcagtggtagtgacatctgttgagatgtggcctcagctgtggcaccaggtgcagggggacatcgtgtagtggctggctataacctgccagtttgctgggtggagcagagaacaaaagtcagtgtgtttgcaggcaggttggaagtcagtgtgttggtttgtgttctctctttgcctttcctgactgccgtgctggccagaagccaacctgctccttccttactggagttctagaggagccacaccaaagtgcttgtgaaattgcttgaggaatttctctcataccattcaaacttggttcctttgtcagcatattgtgttgataccttcatgttccagaagttaggtactaattctctcttctttctttctccttagttttaacactggtaggatctagaaaggggttcactaactgcctatatgccaaagactggaattctactttcagcagcatatattataatatatgaagagaaaagatgcttgcttggctgtggttgtgagttgtagccacagagtgcatcaaagtctgtcagcaacagccaagaagctgccatccaagacgctctaaggcaggaaggagattaaggtggagattaggtttaaagagctcttaggtaaaggggatagttgacatttaaatctgttttaaaatgagaaatagactaaaccaccaaagccacaaaccctgcagctagcaattcccatgggccatgccctccttgcattgttataaaagatgtgtgtaagaaggctgtgaatggcccaggcaaagcggcatcattcttcatatatacatacatatgtgttaacagtacagtcatgcacacaagcatgtagcagttagtaaacgtcttgatggaagctctgcttttatgtgctgaaagcttacatgggccacgaagtgtcacacactgaggagtcatgtgggataagtaggtccccaatcctgagtaggactattaagctctgtcctactgacaacggataagtgttcagatatgcccctgatagccagtttccttcatgttggtggagagagagaagagccttcccactcaggcactggctgcctgtgagcactcagccagagccttcctccaagtgactgctcattccttgggctgcctgagtcacagatcgtgaaggttgctgtgggaacaaggaatggactgaggggtgaaagtggagcccttgtttattttcgtgatgcagtactatcccagttgctcctgaatatacaagaaatactggtgtaacttaaagctgttttccctccgaggtctgtgctggtctgcttttctattctctgtcttacttcattcccaaagtatcaacttcagcttcacatatcccttctgacgagatatgtatttacataaagtcatgaataatagttccccaaatcatttccatataaatctcttattaaagcaaggtgttgaggcaaggggatgtaataaataataaagccagacatgtagacacacacctgtagtcacagcacttgggaggtagagacagacagatctgtgagttctaggtcagacaagatgccatagaggggcccctatcttaaaacaaataaataagttggtttatatttttcttttttattattttgccttctctctttccatttcagacttaaagttaagaatttcaacttcaagtttctattaattgtcgatgctcatgactttttgatcacactgactatatcaagtaactgttgcaagagaaggacctggtaatggacagtatttgggttttaacatttaagagattaagtattatctcttcttgtgtttaatttagatttcgacacagtcccaactgctggtacctaagagactggaccatccacagctggattagacagtgtctgaaatacggagcacaagacaaagccttgtatacacttgttaataaggtgaggggtacctggccatcccttgtatgcattggctcataagggaagtgtttccccatgtgtgtcctgagtgtgtgtgatctgctatttgtgcctgtgacagtaccaccagaaaccactttcctattaaggtctcccctcagattccttgtcatgctgtttgtagaccggagctggttataaactacccaacaaataaaacagtaaaaacgtccatagctgcttcttttccaagcatagagattaagagaggatatgtgaccatggagcacggtgggaggacatgtgaccatggagcgcggtaggaggctgcactggcagtcacttgtcttcagccttaagccctgccttgcttgtctgtttccctttcagaagggttgggtgagtagtgaccgtttctgatggaggataatctctaggtcattcagaccatcttacacttttttctagaagatgttattcctaggtaataatttgtcctttctcctaagccccacagctctttctccccaagccccagagctcctaggattaaggttaaactccacccagcacttcagtctccattgactccagtatattcaaactaagcacacaagttgtagagtgttaactattgccagagtcaacctaaatactgttacaagccattagagaactttaacaatatttttatgaaaatatattatgttcatagtgtcaccagactttgaaaatcagagttcagtcagaatactgatttatctttgattcttctctgtgaagaatgattttcatctgtaacttagtctcacaacaaatcatcatatgttgtacacattgttggtgtgagatgacggatcgcttatcgaagtgaggacagaaatgaatagtacctcatccttaccttgcagaaatcaaggcgctctcccttctctctggtaaacctcactctagaggattccatgggccatacaagaggaactagaatgatggaatctagctggaaggaaagaagtagtggagatgagtgccatgtaagctagttccaaaagctgtacacgggccgaatgtgctgcctttgtctgcagtgctggggatttcaaggggactgagggagggagggagggagggagggagggagggagggagggagggagggagggagggagggaccgtcaaggctcagagctgcagtctcaagaaagaaaggaaggaggccccgggggaagacagataaaatcttgttctcttcattccagaaattacatgcagagttaaagctccctgtggaaacagattcaggagggtctggaaaagcagagcagagggtctcttttctgtcgcttccaggcctttaaaaagagacattaccagatgagggttcaggaaatgtagcctgtaaccacttagttttgtcagttaccccgaatgtcaggcaaatacttttctctgcctatgtcctggttttctcaattccaacttgagtgggtgtcagtgatttacaacctgagctgccttcttagagttacctgagattttttacatttacagatgctcagggctagagagatagctgagttggtatgcttaccacatgagcatgttttgagtctagatccccagcatccatgtaaaaaattgagcaggacaacacatccttgtgtacaccacacacacacacacacacacacatacacacacactgtgttctaagtcagtatgtcttttctgggcctaggcatttgaaattcagagcatcactgagtggacattatagagattctcacataccctgtccccgcacacagccttgcctgaccagcatcctgcttctggaatggaatgtggtagacacagtatcagcacccagaacccacagtttctatcagggttcattcttgctgttgtgcatcctgtgggtacagatggaatgctaaatgacatgtggtctaatggaaacagtctctgtgccttttcatccttcctagagacttgacttgacccatgaccaaggttggaaaccctgactggctcattctttgttttgccaactttaccctgtaccccaggtgagatcttcctgtggatcccaaattaccctagaacctgagtctggcctcagccctctgaggcatgaggaaccacacttggccaagaccagttaatttcaagttccttcctggctctaacgagttactgttctaaaatgttttggctttagcctgccttggattcaagctgatgggggtgagttctgagaatcacaggccccaccgtgagccagtgctcccttagtcagttctgggattcccaatggaggtttaggaacctcccaaggcagtaagtaggtgggggaaaaaaaaaagttgcccagttgtttttggtagttggtgacactatggaacagagagattaatcctattgaagtaagagttttgggtaaaactgtaaccatgatcgaggcagtaaggaatcaggctcaagtgtaagtgaaaatcagagaaacccactaaaacgtcaaggttccatcccagttctgatgctggggcctgagactccaagatctgagacatgaaaatactcccaccaagccctgaagcagacactgacgcatccttgtttattcctaaaatattcttagattctgacatcttaaatatgaaggcaaacagagtcctaggcacttggtgtacagcgaagcgtaggcacgtttcttgggcatttagaagtcagaccatgtgctgtgtaactcatgctttttccttaaggtctgtttgggattttcattcagaccttgtaaaaagagtcactgaaccagctgcttgtggagggggggtgggggtgggttgggtctctttctgttgttgtttagctgcgacaggactaagatgatgacagtcgggctttacagtttttacctgtcagttgtcctctgtcaggcacctgctcaactttctcccctgaccgacagacagttccagtttgcaaacctcgtgagtcacatcttcagtctccctgctgccgatgctgcaaatgagagttatgtagttttcctcagtgggccaactctcctgactaatccatgaggttatattacagacagaattagagatgatttcattctctgttttcacttttattacaggttcagtatggaatttttccagataactttacattcaacttactgatggattatttcataaagaaaggaaattacaaaggtaagaagccagatcacgattcagttaatacagggctttcagctcccaaatggaagtgtataaatgcagacagcttcctcctccttcagttcttaattacatctccttatgttactcttttagtcaggaaagtttacatggagattattatcacttctgccagcagttttagtatcacctttctgttgctggcatggaaaatgtacatacagaggaaactctaggggacaagttaattaagggccagtctgattccacttcccaagctgatggaaatgcaggatataaagaataaagtaaaaatcgatttagttttcacgtgtaactcttctgtaactatgagtgtacgcagtgagctcagtagcacatgcagtcagttgaaaacatttgttgtgcttgaggcctgtgcaagcatcatgtttcttcgttagcatcagcattctctaccttgactattgattactgagggaaaaagttgtttgaacttatgttcccagcttttgcctgtgttgtcgaatatcaagggaaagtaagagtaactggggcctggttttctatgaccagctcgtgtagaaataaataacacgtgctgtgcgttatactcagtggtttataatttatgaagggccttttcctttcccttgtctcaattcttttcaactgttctttgttatccctgtatccgtctttgaaataaaacctaggaattgggagttcctctagcctttgtcttattttgcctcaacagtgagaaagtgctgggcggtggtggcgcacgcctttaatcccagcacttgggaggcagaggcaggcggatgtctgagttcgaggccagcctggtctacagagtgagttccaggacagccagggctacatagagaaaccctgtctcgaaaaagccaaaaaaacaaacaaaaaaacaaaaaaacaaaaaaaaaaaaaacagtgagaaagcatccaaatggagagagaggcaggcacggcctctgcttgcttgtcaggtaaccttacagtgatgttcctcttcccccagtgctcagctcttgtaactgatggacactgtggggcattttcttaggcattatcttgttgaagtaaatagagcaaacagtgtttggtcatcatgaagatgctacttactgtgagccaaaagccgtggctttggtccatgtgtgaagaccctgatacagaagcctgtgactcagtgtgcatgcagtgtgtgcagcaggtgtgaatggcttgacaaggacctgcttcgtagaacagctaggaccagagcccatgtttcctacttgattctgcttggtgtccactgccctgcactttgaacgtgtttacatttggagacttggtgatgttccctacatctaattccccctcgctctcaccttcatctcctgggcagatgctttatccgtggtttttgagatcatgatgcaagaagcctttgacgtgccgtccacccagtttctctccctctatgttttataccgttgcctagcagagaagacggagctcacagtaagtgatctgccctaacacaggcccgagagcttgaggaagccaagcagtgactgcccagttaagacgacgagggccaggtggccggggaaccttgctctctgaacctggagaatatccatgtgccaccagaaatgaacgttcattccgtgtgttttgttttctggtctctaacagtggtactgggcacttcccaagtaaaagccctaaggtgcatttgtcagggtaggagggcatttttgttttgatattggggtagaactcaggtcctcttgcatgctaaggcagcattttaccactgagctacaaccctaggtcaggtgacctcaggaagttcagaaatgagacattaataatcactgagaggcagacatggcaggctaaaggagcaggtgggcagccagttctgactatgagctagcgtgtgtcagggtttcctgtgttctagaatgtgcagcatgccgagctctggcttgctttgagtaggacattgactgatggctcactgctgtcctgagaagacagtggtgagaacagcggcgactgatattcacatagcacttgctcggcactacactgtgctcctgggttgtaaacatagtgatgcctttactcttcacagtcactctccagagagagggagacggaggcaccaaggtattgcagaatagtcatggcactagtcgatgatgccaggcattgaggccctgtgatctgcccctaattcagtaccaggttgaaaaactcagtttggatctgagctgaaatgtcatctagtccaacccgcatcctgaaaacctgacatgttgtgctttactgagtgacatggcctaagatgcagccagtctatgtagccactaactgatatattgtggttaagctattttttaaaagatttatttcttttatttatatgagtacactgtagctttcttcagacaccccagaagaggtcatcagatccgattacagatggttgtgagccaccatgtggttgctgggatttgaactcaggacctctggaagagcagccagtgctcttaaccacttagccatctctccagccctcgtggttaaagtattaatatatattgaacctacttactcattctgatgccaagttctacttatttaacagtaaacacattgtctacttacagtctaccactttaaaacaggacaaggggctagagagttggcttcatgcttaagatcacctgttgcccttgcagaggacctaggttcagatccctgcacccgtgtggtggctcacaacagtctaaaactctggtctcaggggatcagatacctgctttgacctccacagaccccaggcatgcacatgggccacatgcacacgtgtaggcaaaacaagcatgcagctataacgcatgaaaagcccttaaagagctttatttgtattttaaacttaaaatgactgcaaaggggaaatgcctaaagaggtgtttacaaggttaatgtttgaaaggtaaatgtcactagctagttaaaacggaaatgcatatgtctaaccagcagaaaaaaacatggtcagcaagaaggggttgacagaaactgggcacatttctgtatccctgctcatcgggagactgagacaggggggttgtctgagttcccagcactggagacttattaccagggcaacatagtgagacccaggtgagtgggggagaataggctggaggaactacttgacgtgggagatgccatgatcatgatggctgatgcccctacaacatagagaatgtctgagaccgtggggtgtgaggtaagactgaagcacctaggccattttgctatcatcctaaacatagtgaggaattacctgaagttttaaatggggggggacacgacttatagtcagattgtatcctgaagccatcctcagctgtaaggtgggacagagatgagagcagggcaggttagctgtgggtcagatcagcttagagactgtcacggagtctgagaggagctgatgctagtctagcagccttggagtggtggaactacagtccccaccggatacgtgggaaggtcagcctcagcgaaagaagagctagatagagtcaggcagatggggctcaaccaccagaccctcagtgtccagcccacctggacaggaggagcatggtatgtgcaaagggagctctgcagaaaagatggtttgctggggaatgaatggctaacttggctctgaccaggttgtaaacttggatactttgaagcggtccaaagatttctcaagcaggactgttttggagctgatgtatcagtatgtaatgtgtgcaaatgaaccggggagaagaccgagcagaagtcagtatcagatacatgtgtcagcataccacggcaaatacatgcacacagatttctgtcagttgataatcaaggaagaaaatttggaatgtattggaccacacaaaccatgaaaaaatggcctagaaaaaagggtaaggcagggaataaggcaaggccatagaatttaatgatatcagagcagtaagtggtccactttatatccatagagaaacagccagaaaccagagtaaaatgattaatgagggatgtagaagtatacagaaaagtcagcaagtataggtgactcccggtgtcagtgtgaagagaagtggcgggcgtggggcaggggacagaagatgaaggctgcctttgtgttgatgggcaaggcatagtgtaacatgggcaagccttggtaaagtggcctctgacctagcccatactaccagtagagtctcctttgaagtgcttaggaccaaaagtgtttaggagttcagattttttaaaattgtggaatatttgcacagtgagatacattggagagagtcaaatgtaaacacaacatggtccatgttttatgtatacttcagacataccctaagggtgatttttacacattgtgcttaatttgtacatgaagtgtctcatgtaatgtggcactttctgctagcagtgtcatgtcaaatagttttagagcttgggacatttggagttttcagattagggttgttcacctgtatcttctcagaccctgtgaacaatgactgctcctagcacgccacagacagcagctgcttgaatatttactgctcattcagcttttagtccccagtgcatcctgatactgtagctgttgtttactctaaagaggaaaaaaggtttcacacagtgagatggctcagtggatagagtgcttgccctcagacccgatgacctgaggtctgtgtgtttgtgtctctctctcttacacacacacacacacacacacactctctctctctctctctctctctctctccttctctctctctctctctctcacactcacacactcagacatactaaacaaataaataaatatttgaagccagcctgatctgcatagcaagttgcaagccagccagaactacacaataaaacttttcttaaaaacaaaattaaattgaaaaataagtaagtgtaagaaaaataagtcagacttcttatttattctgtaccagacccacttttcaggttattggtgggagacgtgaacttccctagatttgactgtcggctttttttcagttgtagtttactgatcggcacattagcaggcataaagccctgggtttgctttctagcacatacacaaaagctagaatggttttcgttggaaaagtggccaggtccttaattagaagttcttcctcctccgtgctgtggaagcccacatggagtccttttccaggatccactattttccaagatgtaggaaaaccccaagaactggggcctgtgctccataaagcatgaccagatctgtgcttttaatgctgcacggagcctcgctccctggcagcagttgcggctgcagaccatccctagcttctcagggcagagaccatgagggaaagggctatagctcttgccttgtgtggggcattagagaattacagctcctgatgtctgtgttcttttcagacttcctcctctgagctctgagctcagtgttcaaggactgccccagtcacgtttgttactggtgtgtggcaggcccagcgagtcctgtggctttgccctttttttttttttcatgtcttctcaaaaggcttcaattttattgacatacaattttacaccctaggttgaaagacacagtgactaagtgtttctgattgcctggtttgtctttaagaggcacaaatctatctaaaagcaacttaatggtggtgcttactttaacagtgtgaggaggcttctctctgctgtgctgttagcgttctctctcctctggggcagggtaaatgtgaagctggcagcctgggggcctctttgacgctctcaagtcagtgtgggtccagagtactctattctcttctcttttctgactgtaaaaggctctggctcattaccaaaatataaaaaatcatgagaagcacaaaggagaaaaccaaaaccacttaatgaaatctcaccacccaggagtccttagttatatagagggcatttctgttctgattttttaaaaatatgaataccttttatttatagaatcgggataacttctacacagtttgttattttcataaacttaatacatgcttttggctgtcatatttttaaaaaatcacatttagcatgaagtatccacgtttaatagacagtgatctgctgtattctgttgcagtgggaagaagaaagagactttggggcgtccctcttgctttctggcctgaaacaaaggaacacagtgggcctgagttcccagctgtatggctatgcacttctcggtaagctaagtgagccttgttcatactgttctttgtggaaagatgtagcacagccttttgtctcataatagaattaaagcttcatttaaatttactagtgaacatccagttataactcccaagtatagtcaataaaataacactccagttatggatggtcaagggatgtcattagacctgtcaccaccaaccagctcagaactggctctggtaactgtaggaaaacttatttttgatcagtgtgaggaagggacagcatatgtgaacttgtggtgatctatcaggattgctagccaatactttcccagtgtcgaccaacgatcatctgtgtctttgactttgattccaggtgagggaggaaggtcagagagcacctctcaggaacggtcacctgttggtcccaggtgtttgtacagccaggtggaagggtgttcagattagtgttcaggactgccgtattacacagatcattcagaaagttggtgaggctaaggaatgtacttgactgttgcttatgagaagaggccctggtcccttgcgataggcagccatgccatcagacaccccacctctgcccctgctccacagccttactcgactcaagccagcagcccagcatgacccgtgtccagcccaagcaccttaaagatctaaaattagccatctcctgataagctttgtctgctggcatcctcttccagcttcccaaatcctcccttccaagaaagatgagcagaggcaaacttagaccgagccactcaaggtgactttgctcatcagtgctaagatcagtgcaggtggccctgtgcttcccggggccctgctgcctggccacagctgcgtggcagtttgagcaacctggccctgtgacctcaaaggtagccgggacgctgatgtaagaactgataacactcaagaaagtgaggggggaagcagttccttttcttattcataaagaaaatagattgtatgtttgacacttttcaaaacaagtcacacatttcccggcagggaaagtcaccgctgagtcacagggtcctcagagtaggaagctgtgacattgctttttctgggtatggttttggccttgaaacatacgtagtataattttcttttgtcttaagggtggccttctgtaggaacagctctgtcagactctcaaagttcctcagcccaatgattcatgggccctggtaaatctccagccagaggaaacacataacacaagttcaccaagcttccttttaaggtgtgcgtggtgagggtccttgcctaggctgctgttggctggggccttccaagcctttggctgcagacccagtgaggaggcatggctgatcagtctttgttgctcttttggccacagggaaggtggaactgcagcgtggggtgcgggctgtataccacggcatgcctctgatgtggacaccaggctacctcgacagagccctccaagtgatggagagggtggcctcctcccctgaagacctcaagctgggtagagaagtggtatgtttttccaccccactcagtcaaatggaggcttcacaggcatctgttcccatggtctttctccttccgctgctttctgtatgtgtgcagaattggtatttattccgtttaaaaggatgaaaagaaaccacaaacattttcagtgtggctgtcaaaaaggcaatggaaaatcagattattgttgattcatacatcattaagtgaaaggaaagctgtctgctcccttacattcaagctcagatcaataaataccaccctcttcaccacctcccccatccaaaagggatttacggcggtggaatagaaacttaagtagttttggtggatttacccctcctgtagtatggagagactacatagcacttttctccattatccttggctattggtaaagtatctgtctcacaagcttacgtacctgagttcagatccccagaaccacttaaaaagccaggcccaggagtgcagttatcgtccggtaatggcagggagggagcagagagacatgaagccctgggagctggctagctgcctagcctacacccttggagatgctcttctgtgtggccttgactctgaaatgccaaggctcaccactcagctttcatttctgtcctgaggtcctcaacccagtgtctcccatggcacattatgctgatatcattaatgctctttctcagtcattataaccaaggaacacacactttgaagttggcctgcacacagtcaagtctataacagatgtcctcctgactctcctgtgccctacagctcgatgtgctggatggagtcctgaaggtggtgacgtctccagatgtccagacttcagaggcacagcctcaggaaggtgaagatggcttgggctcagcaaacctggtggagcagctagacactgaggaaccagaacagtccaagcttccccgatacctcgagcgctttcaggtgattcgtagtagaaactgagccttttcctgcatcagtcacacacaaaggcatgaaaaactcgcatcaagaattgcagttgtgttccttcccacagaccgtggccttttgggaaagcagtggcattgttacgacttcatgcttgagctgatgtcacggttccgttccctggggcagcacggcaccccagcggcttctcaacagcagcctgattcccactcagggtggcaagtgaccagccatttctctacactacaccaaatgtgctgggtcagtcacagcttcagcagagataagactcacgaatcctttgtggcgcttagctggcagctttgtgctgttcagcagggccattagagacactgcctgtggacaggtttccagaacagtgctgagcactcaaactgtcagtgagctctctgtcccaaatgctctgctgtttgtgtcagggaagaaaatccctgagcctgctctctgctttgtttcttgtctctttaat

SEQ ID NO: 218 - DNA, 72964 bp, Mus musculus
caggtttccgcgagacagaggttaaactttattaattatcaacaacaataattaaaataaaagctgtgacgcggtttctgcttccggccttccaccacagtttggcgcggtgaatggggaggagtttggtggggggctgcggcgctcactcgcggcttcccaggaaaacgtgagttttatttcccatctcttctaaagtttaagtaaaatgttcatttcttccaaaaagaaaaatcgttgagacaagactttaaacccgcctccggcgagtgagcatgcgcagattccctatctgttcctgtcccctcaggcggccatgacgccaaaaggtcaaatgtaagaactgagaacaggtagcttagcggttaagggcacaaacggttctcccaaaggtcatgagttggaattccagcaggtgctgtcatattttgtaccttctttttggtggctggacagatgactccgtgtcatggaatctggctccctcttgtggccttcaggtgtaaaagcaggcagtactctgtatacttaataaataaataaatctttaaaagaaagaaagaaaattccttatggaagtttcttatagatttgggagtgatgactggatgagcgatcctgcttccatttctccttccaggcgtcttcaagagctgagggtctgctctcagggcggctcagagggagacagatatgctgcatttataggattggaagggaagcaaggacaggcgctgtaatgggaagagctcatcactggtgggcaaccttcccgagatgggaactggaagtagcagcgccacaccagcgctgccagcgcctgccgcaactaggatcatgggggtccaggtgcagggacagagcactcgtgtacgttcgcgcgtgtggcggggcgggggtctgtgggacaggcagggaggcggggcagaacggtgagggcggcgaccctgagcgctcagcaggatcccagcaaaaggcatggccatttggagagcataggggtcatgcggggtcacacccatgtctctgttttccctcaggtctgtcctgccagtgccagggctctcccctcaacaccctcccacctctctcttccccctgggtcttgggtcacacagctgtcttgggggcggggcgagggggcagggctggagggtggccagagttcacccaaggtctcgtggatggcatggtgatcccagtccctggcagcagtgaccaatagccacctatgtgatcccttacctatacttggaccccaactttagacctgaccctgacatcatatgtaaaccccaacctttgaccacatcatgacctctatattgccctgtgaccaggatgacactgtcctataaccctgacaagaccccgacactgtccaccacactccaaaccagcctctgccctgcccactatgcactccaggttctgacccctagcccccaccacatgcatcagtgattccctggtgacgttggaattccgcacttctgccccccccccatgtcacatggctaggcccagtcttcccggggaaggaggggtgtcactcaccactctgtgtcccatcatcatcccaaggccttgctaaggttgggcgctgcctggggcgcagaggagcagcgcagggttggggtgtctttgggtcaggagtcacacggtggggtgtcactgtggcacgtggtagtcatgggtgacgggatcagggcatgggggctattggtgaaggttcagcctcagttttaattgacagctcaagaatggagaggtcatgaaaaagagttgaggcttggcgtgatgagagcctatgagaggctattggtggggcctattagaagcagaagaccccacttgttagagatgccagtaccacggtatgatctccaagaatagcagcatcagtgaagtggatccacctgagcctagagtgctgcaaagggcagagctggaaacctgaaaccagccccttggaggaggccagaaggtactgcctttgaacaaccaccactccaaaattttaaagctcattgtatcagagtcaaggcttgtagtaaaactccttcagagggatcaactgataaagtatccatataatgaacaatagacactgaaagattcaatgtcctgacttcttgtatcgaaccagcaacaaaattttttacataatggaaagctattagccattccttggggcgaaagtttccaatgaagttgcttcatgggtacctaaaaggaagtgaggaaggggacataatgaaatggaaggtaggatcaggtatgggaagagacaagagagaagtacagaggatcaggaaatataaatacgtagctctagaggatggggaactgggggtagcctctcgaaagtcccagacaccagggaagtgagaggttcccaggacccaaggggaatgacattagccaaaatattcaacagaggggacatagaacgtgtagaggccacatccagtagataggcacgggcaccagttgagggattgggccaccatccttctcaaaacttttaacccaaaatcatttctgtctaatcacaggcaagaccccgtcagaagagttaggaaaggactcacagaaatgaaggggattgcaaccccataggaagaacaaatcaacccactggaccacaaagagcatccagggactaaaccacctaccaaagagtatgcatggagagatgcatggctccagctctatatgtagcagaggatggcttcatctggcaccagtgggagaggaggcccttggtcctgtggaggcttgatgccccagtgtagggcgatgctagagcagtgtgaatctggagtgggtggaggcaaagaggagagggggatgggatggtgagtgtgtggaggggaaagagggaaggggattatcatttgaattgtaaacaaataaaatgattaataaaaagaggaaaaatgtgtccattatatcaaattaatatctttctgatgactacaacagaccaggaaggtcagataatgataattgagagaaaatagaaaaaaaaggcaaagcaaggcaactgtggtaagtgcaacagtggtgtatgtaattccaactaaaatgttaaagaagaccaactaaggtgcatatgtaaagaaagcagaaaatggcatttgacagtaatcactccctgggacagcattttaataatactgtgttatgtgatgagcttttaatctccttagtcactgctattttaatgtcacactgatttcttgctacttagaaggaagcttcaggaatctgttagggagaaaacctcacatgtgtgttttgcttgctcaattaagcatggccacgttctctgtgacaattatttttcttttcaaaggtgctattggtagttcaatcataaatgcaagtttataatcacaaaagagtttcttgtaaaacatacatgaaggcaagtctgtttaatcattgataatttagacgttaacattaatgtctcatttcttcatctggtggccattatgtttttagaaaatgacttctacatactgggcgccatcctggagaacttcatgaaggtatgatgtcatccttaatgtcatagagcattttatttgattcatcacaggaatggagctgtacaatgtacactgatggtcttctctcattttctattattgaacataggttgcctctctccttacccatctccttccagattttcctgccctgtgccacacattcaaatccataccttttctttctttttcttgttatagactaaacatctaaattattattgttgttatcatcatttttattaattataaaaaacaaataactggaataagacaaaatgaaaaataaacagatgaaaagaagataaggaaaaatataagaaacctatacacacagactcaaattcacaaaaagaatttacataaaaacgtaaactataaaacacagtacacttaaaaagaaactttgggattaaaaacaagaaacaaaacacaacaaaacaaatgaacacagaaaccaaacaaatataaaagtcctggaaaagcataatgagacaaagaaccaccaacaatgtctttgagtttgtttggtgtttcccatctgctgctgggcataaggtttgcccttaagagtagtttcaataccccgtgaatgtcctactattgagtacatctcttgaaaaaagagattcttttaaatcatacctgaaagcaagtcatttagatcatttttaatataaacaggaactttaatgtctcctgcttcattcatcttgtgaccactatgtttctataaaatgaattctacatataggatgctatcttcaacaacttcatgggatagatgcccaggtatggtgtcatcctccatttcatagagcattttatatcataaaaacaattaatattgcttttttgtaaatgactatcaactggattggaatggttatgtacttcattcccctctgagtattgagaccccattttcaacagaaccatgcaggccctgtgcatgctgccacattctctgtaacttcatatctgcatctatctttcatgttttagaaatcctgttttccatggtgggtgttctcaatcccctctggcactgatatacttctacctaaacttccactgtatttcctgagtcctgacccaagggatattatgaagacagcccatttatgaatgtgtgttccaaagtctttcacattctcaaaactgactggctaagggtgtttgtatttgtttctatctattacagaaggaaagatctctgatggtggttgatcaagaccctgatttttatcaatagcagaatatcattaagagtgattttactgctatgtggcctttcaaaacataaatatatgcaattttacacagtctttacaatttttgtttaaaaatataaatgtatatgcaaatatgtgcacattcagtaagaattaatgaaataagaggccatgtgcattttaggagtgcaggaagtgggacaaaggttgttttggagacagcaaatataaaaaaaggagcaattgaatgacaatgtcaaaaataaactaccaaataatatttaaaaaataaagcagcaaacagtattttgagataaaaatgacactgaccttcaacacctgacgtaaagaacaatgtgtgtgttttatgtgcatgtttgtgtgtgtgatattaaactgaaataatctttagtctcatattttgataaaatttatgaagagacccttcatctagagtgatttatatgtccatagaattcactgacctcactgtggtgaaggtcttgtgggagacatttccattagtgatttttctcacttaatgaaacacagtcatttcataatgaaactgtcttttcacatacatttacaaagccttattttgcaggcacaatctgaatctcaatgtcctttccatagaatattcccgtctttgtatgttatctggtattcttagcatctccctagtacattggaaagctatcccaaagtgcagtgcttctgtgctatcatatgcattactgtcacggtgcttctcactctgctaacatgcattcttctttctcttttcaaatcagtgccttttattgcatcaggaagctatgagattccaaatcccaacagtggcaatttaccatttaggtgatgtcttagattctgttgctgtaaaaaccaccatagccaaagaaacatgtgagaaaagtgtttatttacttatgtaccttggtcacagtatattgtgtgaagccaaggccttatactctacacaaaggataaaccggatgagaaagaaattagggaaacaacaaccttcactataggtacaaataatatgaaataccttggtgtgattctatctaagaaagtgaaagatttgtatgataagaacttgaattctctgaaaaaagaaatcaaagaagatctcagaagatggaaagatctcccatgctcatagaatggaaggatcaatacagtaaaaatggctatcttgccaaaagcaatctacagattcaatgcaatccccatcaaaattccaactaaattcttcatcgaattagaaagggcaatttgcaaattcatctggaataacaaaaagacctaggatagcaaaagctattctcaatgataaaagaacctctggtggaatcaccatgcctgacttcaaactgtactacagagcaattgtgataaaaactgcatggtactagtacagtgacaaacagctagaacaatgaattgaagacccagaaatgaactcacacacctaaggtcactagatctttgacaagggagctaaaaccatccagtggaaaaaagacagcattttcaacaaatggtgcaggcacaactggcagttatcatgtagaagggtgtgaattgattcattcttgtctccttgtacaaagctcaagtctaaatggatcaaggaattccagttaaaaccagagacactgaaacttatagtggagaaaatagggaaaagcctcaaagataagggcacaggggaaaaattcctgaatagaacagcaatggcttgtgctgtaagattgagaattgacaaatgggacctcataaaattgcaaagcttctgtaaggcaaaggacactgtcaataagacaaaaaagccaccaacagattgggaaaggatctttaccaattgtaaatcagacaggggactaatatccaatatatacaaagaactcaattagctggactccagaaaatcaaataacccaacttaagaattgggtacagagctcaacaaagaattcacaactgagagttctgaatggctgtgaagcacctaaataaatgttcaacatccttaatcatcaggggaatgcaaatcaaaacaaccctgagattccacctcacaccagtcagaatggctaagatcaaaaactcatgtgatagcagatgtggcgaggatgtggagaaagaggaacactcctacattggtggtgggattgcaagcttgtacaaccactctggaagtcagtttggcagttcctcagaaaattagacatagtattaccaattgatccagcaataactctcctgggcatatacccagaagatgttccaacttgtaataaggacacatgctccactatgttcattgcagccttatataataatagccagaagtggaaagaacccagaggaatggatacagaaaatgtggtacttttacacaattaagtactactactcagctattaaaaacaatgaatttatgaaattcttaggcaaatggatgtatatggaggatatcatcctgagtgaggtaacccaatcacaaaagagcacacatgatatgcactcactgataagtggatattagcccagaaacttagactactgtcttagtcagggtatctattcctgcacaaacatcatgaccaagaagcaagttggggaggaaagggtttattcggcttatacttccatgctgctgttcatcaccaaaggaagtcaggactggaactcaagcaggtcagggagcaggagctgatgcagaggccatggagggatgttctttactggcttgccctcctggcttgctcagcctgctctcttataaaaccaagactaccagcccagagatggtcccacccacaaggggcatttcccccttgatcactaattgagaaaatgccttacagttggatctcatggaggcatttcctcaactgaagctcctttctctgtggtaactccagctgtgtcaagttgacacaaaactagccagtacaattgaccccttgtcaacttgacacacaaacacatcactagtaagcctcaacccttaatttcttattcatccccaagatctaaacaactttaaaagtcccacagtctttacatattaaaagtcaatcccttcaaaatgtccaatatcttctaaaatccaaagtctttttacaattaaaaatctcttaactgtgggctccactaaaatagtttcttccttcaagcgggaaaatatcagagcacagtcacaatcaaaagcaaaagtcaatctctaaccatccaatgtctgggatccaactcacaatcttctgggctcctccaagggcttgggtcacttctccagccatgccctttgtagcacacacgtcgtcctctaggctccagatgcctggactccactgctgctgctgctcttggtggtcatctcatggtactggcatctccaaaacactgcatgaccccttcagtcctgggccgtcaattgcaactgaggctgcaccttcaccaatgccttccatggcctctcacagtggcaagcctcagctgctctgcgtgaccacttcatgccttcaaactcagtaccacctgggtgacccttacacattaccaagtcccactgcagcaggagtacaaccttggctatttctggaacacagcctctttgtgctttcataaaacactttccagaagatgtcacctcaatgatgctggtctcttcttaatcactgctaatttcttagctccagctaaccagcatcaatagtcccagtaatgcaaagtttttgctttggtagttctggtatcttgttaatcacaggtgattcttcagccccagctaaccagaactatagaatcttcacaatcaaaacagcaatggccctgaaaagagtctttaattttccctctgaaatttcacaaaccagacctccatcttctgcagtgttctcaatattatcttccaagctcctacacaacatccgacagagcttttaacaacggatggatcttcaagcccaaagttccaaagtccttccacagtcctccccaaaacatggtcatgttgtcacaggaataccccactctgctggtaccaatttgtcttagtcagggtatctattcctgcacaaacatcatgaccaagaagcaagttggggaggaaagggtttattcggcttatacttccatgctgctgttcatcaccaaaggaagtcaggactggaactcaagcaggtcagggagcaggagctgatgcagaggccatggagggatgttctttactggcttgccctcctggcttgctcagcctgctctcttataaaaccaagactaccagcccagagatggtcccacccacaaggggcatttcccccttgatcactaattgagaaaatgccttacagttggatctcatggaggcatttcctcaactgaagctcctttctctgtggtaactccagctgtgtcaagttgacacaaaactagccagtacaactacccaagataaaatttgcaaaacacatgaaactccagaagaaggaagaccaaagtatagatacttcgttccttcttagaagggcgaacaagctaggcagtagtggcacacaccattaatcccagcacttgggaggcagaagcagggggatttctcagtttccaggccagcctgctctacattgtaagttccaggacagccagggctatacagagaaacccgatcaaaaaaaaaggggggggggacaaaatacctatggaaggagttacagaaacaaagtttggagctgagactgaaggatggaccatccaaagactgccccaccaggggaaccatcccataaacaaacaccaaacccagacactactgcatatgccagcaagattttgctgagaggacctggctatagctgtctcttgtgaggctatgccagtgcctggcgagcacagaagtggatgcccacagtcatctattgaaggaaacacaccccccccatggaaggagctagagaaactacccaaggagctaaaggtgtctgcaaccctataggaggaacaacaatatcaactaaccagtacccccagagattgtgtatctagctgcatatgtagcagaagatggcctagttggccatcaatgggaggagaggacctttgtcttgcaaagattatatgtacaggggaatgacaaggccaggaagcaggagtaggtggtttggggaggaaggctgtggagggtataggggactttctcagattaaactaggaaaggggatagcatttgaaatgtaaaggaagaaaatatctaattaaaaaaaacttttaaaaagaaaaaaaagagaaggaagaatccaacccaaggaggttaatgatatatatgaaaacagagatagtaaataataagtaataataaatagtaaataatgttgtattagctgcaaaaaagagaaagcacacacacacacacacacaaacctcaatatgaccaccagcagcaagaacaataagaacataccaggagttagccatcactgctctttgatattaatattaatgacctcagttcgccaataaaacgacacaggtgaacagaatgggtgctaaacgtaatctaaccttctattgtattcaaataatatagctcaacatcaagaataggcattacttcaaggtaaagggtggtaaaaagacattccaagaaaatggaccaaagaagcaaactggtacagccatttacaaatacagcaaaacagattttaaccaaaaagtaatcaaaagaattggagaaagacactatagattcctcaaagggagaaaaaaaaacaccaaagatgacatttgaatttttaacatctatgccttaaacatatggtcaccaacctttgtaaaagaaacagttttaaagctaaaatcacataatgagtgtcatacatttatactcagaaattttaataccccactcccaccaattgacaaattcttcagaccaaaactaaacaaagaattagtccagttaactgacaacatgaatccagctggtatttagagaacgttcaactgaaatatacgagaatataccttctgctcagcacctcatgaaacttacttataaactgaccacatattcagacacattgcaattctctagacatacaataaaactgaaagaacaactgtatcttatcagaccaccatggataacaactggatatcaaaaaaaacaaagagaacacaaagcttacaaactcatggaggctacacacctcactaatgaatgaaagaaatgttaagacagaaataaaggaagaaattagagactttttagaatttaatgaaaaggacaacaattgagcaacatgcacaatcttatggaacacaaagaaaatgaaagtggtgctaagaaaaacattcatagaacagaatgtcttcatgaaaaatttggagagctctcatactggcaatttaacagcacgctttaaagtctagaacagaaagaagcgagggagcaatgaaaaaagggagtagacatccggaaattatcaaattgggggctgaaattaataaaatagatagagaagactacaaagaattaatgaaacatggagatggcctttgagccttttattagtcaagatagacaacaacttattgaaagatagagaatatccaaattaatgaaatctacaatgaaaatggggacaaaataaaagacaatgaagaattccagagaaaggtaaagacatagttttaaaaagcatgtactccactgcattggaaattctaagagatggataatttactcaataggttccacttatcaaattaaatcaaactaagataagcaacttaaacagacctaaaaacctagaaaaagagaagtcattacaaatctgccaccaaaaagaactcaaggccatgagttttggggtagaatcctagcagactttcaaggaggagataacaaggatactcctcaaagtattcaacaatattgaaagagaagaaacattggccgatttattttgtgaacccatggttactcaaatatccagtcaataaagactcagcaacaaaagagaatttcagaccaactttccttaaagtgactgacacaaaaacactttataaagcaaaacaaataaaaaaagaaagaaaatagaaaaaaatatcaaaagatcatcccccatgatcaatgaggtatgcttcattaaatagatgcaggaatggttcagcataatgtgcttaaagtgtaaggaaaaaaagaagtgatcatctcaccagatggtgaataattctctgacatgtccagcatcactttatgataaaattcttggagtgattatggatacaagggacgtacctaaacataatattgttactttacagcaagcttagagaaaacattaaattaaatggagagacaatcaaattaattccactaattcccaaaaaagataaggtggtccattctctccatatctattcaaaatattatctaaaagtttaactggagcaataaaactgaaggagatgagggtaatatgaattataaagaaggaagtaaaattatctttatttgcagatgaagttatactatacataagtgaaccaaaacttcccaaaggcaattcctagagctgacaaacacttttagcaaacttgtggggtacaggattaactaaaaaagaaaaagaaaaagcagtagccttcgaatgtgcaaatgagcttgcaagtgcaaacaaaaaaagagatatcataatgtatgaattgattgttgatgcttgtcacttttttcccataataatcttgaggaactcaatataagtgtgtaggctaaaatcttaccacattctttgtagtcacagattacttttggtattattaaaggtcatcaaagactactgtgatatgtaatagctttgatatattgagtccatactaaagagtttactcttgtttaaagataccaataagtgcaaaaccttaacctattgactgtgtttatgggttttctctgcattatgactttttctcatggtttctcagcttactgctatgtccaaaggcttgaacacattgcttatccataggctttctctccacgatgtgttcttttatgttcatagataactgtgttgtgaacagtttttttctccaatatgtattctgttatgtattggaagagaactatgatatctaactgtcaggaacaagcaaaagaaagttatcctaaggactgcctttttcttatcactctccatttaacctgaggttgaaactaagttcaagtcccaagtcctagtgacctgtgtacttaacaatatccagccaggtttcactattcatgttttgttcccatcaaaatgatgactgttcctaagtataatttctgttacttgtgttttattcctcaaaacatagtgcccgttcctaatcacaaaagaacaaatggctatgatatgctagaccataaaacctacatcttgtatcatttgacataaagtaacaacagagaaaaatcatgatgtggggggatgtagctgtacattggcacaggatgttgtggtttcaatcctgcagcttatatacttttatataacctgaaggtttggaagatgtataactttctgattcaaggaggggctggggtattgcagctaagcttctgagtatatttttggcccttaatgatgagcagtgacttgattataataaattattatcatttgcattgtcctgtgtttgagatgtgttggacctcagttaccccataccataaaggctttatcacattgctggtattcctagaatttctctccagtattaatagtttcataatgtgaaactatagaggtgtgcaaaagtttcaccatactaactgcattcacaaaatttcttcccagtacaaattcttatatgatgaagaagaatacagaattgtgcaatggcttcactatattaactgcactcacagggtttctgtcttagaatttccattgctaggaatagatttcatgaccaaggcaactcgtaaaagctaacatttaattggtgctggattacagttttagaggattaatccatttttatcatagcaggaagcatggtaggcatgtaggtaaacataatgctgaagaaggagctgagagttctgcaccttgatccacaggcaaccaggaagagactgtcttctagggatcacacaggagggtctcttcagcattggtggaacttcaaagaccaccctaacattgatgcacttcctacaacaaggccacaccttctggcaatgctactccttgagtcaaccgatttcaagaaaacacattccacttgctggcccacatttcattgttcaaacacatgggtgtagggggaccacacttacacatagcataaaacagaatacatcaaaatacatgagattcaacttcaaaaggactcatcatctatagcagtctcacaaataaataaagtccaaagttcatcatctgagattcatccaatcacctaactataatcccctatatttacaaaaacaaatagcacattacatacttccaaattgacaggatatatttcccttttccctgtgtaggcttggctgtcgtggaaataactctgtaaacaaggctggcctcgaactcagaaatccacctgtctttgcctcccatgggctgggattaaatcgcataccaccactgcccagctacttttctattcctaaatagcattgtgaggaaatactggaccaaagaaggtcaatctccaaactctgcatatccatgtctgatttcaagtattcttcaaaccctttctgcttatttcactccagcacaattctttctctttggctggacttatttcaggaaagcagttttcctgagcacttatcccatagctctagcatctccaaatcttggagtctccaaggtaactacaatattaaatcttcatgttccactgtctgggatctatacatgatcttttgcactcctcaaaagaaagtgggtgacttctccagctcttttctctatagcaccctaggttctggttgacttcactctactgctgttgctattctttctgctcatctcatgggacttacaccttcattatgctgggttttcctgctgtaacaggggttcactgctttcctctcaaatactctcttcattgtgccatgtcttagctgctctacatgaccccttcatgccttcgaaactaacaccacctgggtagttctcacacatgaccaagtccagaagcatcacaaggtacaactttgggcatctctggaacacagcatctttgtccttccagaaaacacttaccagaaggttccacttcagtgatgctggtttcttcttcatcacccctaattttttatctacagctaaccaacatcaatcgtctcagtagtcccttctacgcttgcctctaaagccatggccacagggacaaagctacttgctggggctgaaccatggcctttctattacatgatcaccagctttcaaattttcaacaacttcactgcctaagcttggctgtcctggaacttgctcagtagatttaccttgaattcagagatctgtgtatccctgtttattgaatgctgggataaaaagcatggaaaaccatgcctggacttatgcttttcttcacctaaaattctgcaccaggatgacttgatccagattatctgcttgactctcatctcctgggattaacagcatgtaccaccatgcctgaacctaagaatttccatctagatgttaaattgaaaactcagaacagtagtcacagtccatcccttgttaatttgaaaaatatttatatctccttatgtccacatgaaaagaataaccaggtaacaatcattcctaatgtgatacagttctccttaccaaaactgcaaatccataagtttagctggatggaatcttgccttaacatcacctttcccttaatgtcatataatatcttttctcacaagatttaggttcattaaacatcctagtgagtctgtctttttctttcttccttccttccttccttccttccttccttccttcctttctctctctctctctctctctctctctctctctccctccctccctccctccttccttccttccttccttccttccatcctttctatctttctttctttatttttttgaggcagggtttctctgtgtagccctgtctatcctggaactcactttgtagaccaggctggccttgaaataagaaatctgcccgactctgcctcccaagtgctgggattaaaggcacgtgccaccacacccagtgagccttttcttattgaaccttacattttatatttttccattctaagattatgcttgatcaaaacaatcatcatgagagtaaacaaaggacaaagtctatgttggctttcctgataattcttttgtcaatgcaacactcttcagacaaggtcaaaaagcaacaacattcttaagcaaaacatcataaaaaacatatacagagttcaaattgctctccagtgcctatgtgttccacattcctcctaggatgtcaacattaagttccacttaatgcatgtacaaatccaaagtctaaaattccacattgctccaaacaaaaacatggccaggcgtatcatagcaatacttaagtctgaggtactaacttctgtcttagaaagaatttccattgctcagaagacaaactgtgaccaaggcaactgttttaagggtaaatatttaattgggcctggcttacagtttcaaatacttagtttattaccattataacaggaagcatggcagcatgaaggcagctatgatgctaaagaaggagctgagagttctccatcttcatgagaaggctggcaggaagagactatcttccagccaaacagtaggtggggctgttttatactggccaaagctccaaactccaccaccccagtaattcacttccttcaaaaaagtaacatctattcctacaagacacacctactaatagtgccactgcttagggccaaacatattcaaattaatatagcttatatctactataaatactttcatacatttaagtatgattaggacatgcaaaggctttaccacattggttatattgacaaggtttctctctagtatgtgttcttttatgtattcagagactacagtggcatgtaaaggattttccaacttgacaacattcacaaatgttgggagccaacctgcagctcacaagaaaagggatatacctgggaggcaaactggagctgaaagagaactagacggtcaagagaaataatggagctaagtcaaggttcctgatcaaagctcaaatgtttaatagcaaatgtgcttataaaggggagaagaccattcctgccaatccattcttggtgcctggaaccagctgcaagtgaggacagtgcaggacagggtactgtagtctctggaatatctcaggggcctctcagcaggcagcaacctcttgaaggagaacagcagcagtggcttaacaacagagccatctaggcaggaaggctccacccaaggtggtctaattctcagtggcagcaaggtcaaagtctggatcagcctgcttcaggctgggagagccaagtcaaaatatttctctccattatgtattcttttatgtctttggggactatagtgatatgcatagacttttccacattcattgcatttgtaaggtttctctaaaacgtgtgttcctttaaatatttaaagagtacagtgacacacaaaggctttaacacatttattacaatcacagggcttctctcaactatgtgctcatttatgtacttggaaatgactatgatatgcaaaggttttctcatatcaattacattcataaggtttctctcctgcacatttttttttgtgtgtttggagatgactgtggcctcgaaaggatttacattattcattatattcatgcaggttttctgccatatgtgttcttttatgtatggggtgatgactgtgtcacccaagggattagtactctggaaaaatggaaagagttacttttttgaatgtgttcttttaagtagttgcagatgacagtaaattgccaaggtttttaccacattggttacaataatgagggttctccccagtgtgctatgttttgtgtacgtgggaagaattatgacatgcaaaggctttactgcattgataaccttcatgaggtttctctcttgtatgtgatcttttatgtcattgcagatgactgtgacttgaaatgctttacaacgctgattacattcataaggtttctctcctgtgtgtgtactgttaaaataatggagattacaaagttctgaagtgtttcccacattgattatattcatgaggtttctttccagtatggtatcttttattttttggagactagtggaacatgcaaagacttcattaccacattgcttacattcataaggtttctctccaaaatgggttggttcttttatcgttttgagataattactttgtgaaaaggcttttaccacattggttacattaagatttctctccactatgtgtttttttatgtctttgttgacttctcccttgtgaagagtctttccacattgataattatcctaagattactctccagtatgggttcttttatgacattggagatgagtggatgtagcaaaggctttaccacattgattacactcataaggtttctctccagtatgagttcttttatgaatttggagatgagcaggtcttgcaaaggctttaccacattgattacattcataaggtttctctccagcatgggttcttttatgacattggagatgactggatgtagcaaaggctttcccacattgattacattcataaggtttctctccagtatgggttcttttatgacattggagatgactggatgtagcaaaggctttaccacatcgattacattcataaggtttttctccagtatgggttcttttatgatttctgagaccactgtgacaggaaaaggctttaccacattgattacattcaaaaggtttctctccagtatgggttcttttatgatattggagatcagcgggtcttgcaaaggctttcccacattgattacattcataaggtttctctccagtatgggttcttttatgacattggagatgactgggagtggcaaaggctttaccacattgattacattcataaggtttctctccagtatgggttcttttatgatatcggagattactgggagaggaaaaggctttaccacattgattacattcataaggtttctctccagtattgcttcttttatgacattggagatgactgggcgttgcaaaggctttaccacattgattacattcataaggtttctctccagtatgggttcttttatgaatttggagattactgtgagaggaaaaggctttaccacattgattacattcataaggtttctctccagtatgggttcttttatgacattggagatgactggatgtagcaaaggctttcccacattgattacattcataaggtttctctccagtatggcttcttttatgacattggagattactgtgagtggaaaaggctttaccacatcgattacattcataaggtttctctccagtatggtttcttttatgatttctgagaccactgtgagagggaaaggctttaccacattgattacatttataaaggtttctctccagtatgggttcttttatgatattggagatcagcggggcgtgcaaaaggctttcccacattgattacattcatagagtttcttccacctatgaattcttccatgcctagaatgataattggcacatgtgaaagcttaacacactcattacctttatcaatcgttttatccatattaattacttttacaggttggtctaataataaagaattatcagatctcaagcttttatcactttgcatgttcatggtgttctccctcactatgggttgttttgcctctttgaaaacagatgtgatgttaagagcagttataacatggctcatatatatatatatataacaacctttttctatatcagattcctatatgacctatttcctgtacctgaagaacaatgaaacaatgcagagctttttacaactgatagcattcataatttccctgtagtgtgaatcacagcacattagcactgtgaagcaggacaaacagatgaatttccacattttttcctcagtgtgactttgaagatattctcagtaaagtaagaaaaccaattaatcaaaaactcctatcatgttcagaaagtctaacaaagtcagaaaactacatatcttctcattgttttggaaagaggtgtgttgctattttcaatgttcatagactctcatggttttgtccatttgtcacttgatatacccattaaaagaagaacaaatgaaagttttccacattgcattcacaacagttgacatattgttccttgtagacatgctatatatggattaaggtttctccactcaacattcttgactctcataaactgacctctcaataaagttaggaatgagactgcaagaatataagtatcaccaactttaccttggaatatttgctttctagaaggtaatatatatatatatatatgtatatatatatatatatatatatatatacacacaaacatcactattcaatgtgcaacatttaaatattatgagactatacagagtgatagttccatagcataggtttaatggagctacaaatcaaataaagggatctcttaaggccttgtttccttctttccattcttagaggaatgccttggaaccacaaatcagataatagactctaaggtacacggactagcgagaatatcataatcatagctacaggtaatgggctgatatttgacactcttgcttttctttagaacttccagaacttattacaatttcctcacagacatatttgtatcagcttgaacatgaaaattaccttgtatgtcttcgagaactttggcatggttcttcaatatgatggtcttcccatttgtagcctaaaatacagcaacagaaaatgaatgatatgttattagaaattaggaataattgaggttactgtaaatattcacagctgtgaacctgatttattcacctcagtcttacttgtgctcaatttaaataacagaagatcatcaataaccaaaaaacatttgttcccttaatttgaaaagcaaaagaaaattcacagtcttacctatagaagtaaggttccagtaggtctccaacatcacgtctttgtagagattcatctgggaaggatccatcaaattccattcttctttagtgaaattcacatgcacatcgtcaaaagtcactgcatcctaaaatatcccagaaatgtgtatgatacaaagcatgatactaacatcactactaatttcctgacacagatattgtattctaatcaccatgtctttttagaaggaaattgaattataatgttcacctctgttgctgttgaaccttttgcctaggagatagccttgcaagggaaatgccaattgagagggagattgcaaggggatacagatcaacagtaccaagcccacatctgagaagctgtacgaacaattactaactacaaaaatattggacaagatgggggtatttgctcaggactttaatgcagagggacaggaaggtgtatttcctcaagctggaggcctgcatcatctatgaaaccgattccaggacagcaaaagttacatattaagactctcactccccctgcaaatatcacccaaggaaacagaaaggatagaaagaacccatagttctgcactgaagttcctacatagaattatacattaactgcagttctgtattcatcttgtacaaacatgaaatacaccagtttaaattgtaacattaataaaattttgctaaaagagaatgaatttttaaagagttacaaatggaccaattaaaatactagtagtataaatgttgatcacaaatatgcaacatagggcaggagagatagctcagctgtggaaagctcttgcttgtcttccacataattgtggtcaatatttagcatttacatggggaccagcaactacctacccattacttcaagatcaggtgttctgataccacctactgacaacagtagaaatgatgcacacatgatattcatattcatgcacacaaaaaaataattacatttactcaaaaatcaaagaacaaacaaaagagttaggcagatcatcatatacccagaattcaatgactctgaagcctcaggtagtattggtgtcatgagcatatgtcatcctggaaaacagaatataacctatagattttgtcaaatttcaaaattgaagatgtgaataaagaattgcacagaagcatatgcttattgtacaaaaacatgataggtggctgatgtggtgtctatacctactaacaggacagaaagggtttcacagagaaattttatctcgaacaacaaaatccaaaataataaaattaaaaacataaaaccaccaggcttgcaaaatagcttagcattgaatagcaaatgtgtctactggtgagagcacggggtctgcctggcctgagaggtttgtggcacaggcgccggcggagacttttttggctccgggaatccgcggagggcaggctgcacgggtgaccgtgtggaatacagagtgccagctttttttgggacgggcgagagagtcgcagagcttctgggcggcgccatctttagctccagacagccggccaccttcctggtgagagcacggggtctgcctggcctgagaggtttgtggcacaggcgccggcaggagccttcttggctccgagactccgcggagggcaggctgcacgggtgaccgtgtggaatacagagtgccagctgtttctgggacgggcgagagagtcgcagagcttctgggcggcgccatcttcagctccagacagccggccaccttcctggtgagagcacgggggtctgcctggcctgagaggtttgtggcacaggcgccggcgggagccttcttggctccgggactccgcggagggcaggctgcacgggtgaccgtgtggaatacagagtgccagctgtttctgggacaggcgagagagtcgcagagattctggggcggcaccatcctcagctccagacaaccagccaccttcccggcaagagccacagagcttctgaggctgcgacatcttcgactccagacaactggccaccttcctggccaaagcaacacagcttctgggaaagatcctgttttgggccttcaccttcagccaggaggaggtccaaacaccagataactgtacaccttccctgagagaggagagcttgcctacagagactgctctgaccactgaaactcagagaagagagcttgtctcccacgcctgctgatagagggtaacaaaaatcaacagaggaacaatcttttaacaaagacaactataacaactaactccagagattgccagatggcgaaaggtaaacgtaagaatcctactaacagaagccaggaccactcaccatcatcagaacccagaacgcccacttcgcccaatccaggacaccctaacacacctgaaaaggtagacctggatttaaaagcatatctcatgatgatggtagaggacataaagaaggaattcaacaactcacttaaagaaatacaggagaacactgctaaagagttacaagtccttaaagaaaaacaggaaaacactgctaaagagttacaagtccttaaagaaaaacaggaaaacacaaccaaacaggtagaagtccttatagaaaaacaggaaaacacatccaaacaggtgatggaaatgaacaaaaccatactagacctaaaaagggaagtagacacaataaagaaaacccaaagtgaggcgacgctggagatagaaaccctaggaaagaaatctggaaccatagatgccagcatcagcaacagaatacaagagatggaagagagaatctcaggtgcagaagactccatagagaacatcggcacaacaatcaaagaaaatggaaaatgcaaaaagatcctaactcaaaacatccaggaaatccaggacacaatgagaagaccaaacctacggataataggagtggatgagaatgaagattttcaactcaaaggaccagcaaacatcttcaacaaaattattgaagaaaacttcccaaatctaaagaaagagatgcccatgaacatacaagaagcctacagaactccaaatagactggaccagaaaagaaattcctcccgacacataataatcagaacaccaaatgcactaaataaagatagaatactaaaagcagtaagggaaaaaggtcaagtaacatataaaggcaagcctatcagaattacaccagatttttcaccagagactatgaaagccagaagagcctggtcagatgttatacagacactaagagaacataaatgccagcccaggctactatacccagccaaactctcaattaccatagatggagaaaccaaagtattccacgacaaaactaaattcacccattatctctccacgaatccagcccttcaaaggataataacagaaaaaaaacaatacaaggacgggaaccacgccctagaaaaaacaagaagataatccatcaacaaacctaaaagaagacaaccacaagaacagaatgccaactttaacaacaaaaataacaggaagcaacaattacctttccttaatatctcttaatatcaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggtctgaagaaacaggctggagtagccattctaatatcggataaaatcgacttccaacccaaagttatcaaaaaagacaaggagggacacttcatactcatcaaaggtaaaatcctccaagaggaactctcaattctgaatatctacgctccaaatgcaagggcagccacattcattaaagacactttagtaaagctcaaagcacacattgcacctcacacaataatagtgggagacctcaacacaccactttcatcaatggacagatcgtggaaacagaaactaaacagggacacagtgaaactaacagaagttatgaaacaaatggacctgacagatatctacagaatatttaatcctaaaacaaaaggatataccttcttctcagcacctcacgggacctgctccaaaattgaccatataattggtcacaaaataagcctcaacagatacaaaaatattgaaattgtcccatgtatcctatcagaccaccatggcctaagactgatcttcaataacaacattaagaatggaaagccaacattcacgtggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctctgagtacctccaagaagaaacgggagagagcacatactagcagcttgacaacacatctaaaagctctagaaaaaaaggaagcaaattcacccaagaggagtagacggcaggaaataatcaaactcaggggtgaaattaaccaagtggaaacaagaagaactattcaaagaattaaccaaacgaggagttggttctttgagaaaatcaacaagatagataaacccttagctagactcactagagggcaaagggacaaaatcctaatcaacaaaatcagaaatgaaaagggagacataacaacagatcctgaagaaatccaaaacaccatcagatccttctacaaaagcttatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccaaccaaaaaaagcccaggaccagatgggtttagtgcagagttctatcagaccttcaaagaagatctaattccagttctgcacaaactatttcacaagatagaagtagaaggtactctacccaactcattttatgaagccactattactctgatacctaaaccacagaaagatccaacaaagatagagaacttcagaccaatttctcttatgaatatcgatgcaaaaatccttaataaaattctcgctaaccgaatccaagaacacattaaagaaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttttggaaagatcaggaattcaaggcccatacctaaacataataaaagcaatctacagcaaaccagtagccaacatcaaagtaaatggagagaagctggaagcaatcccccttaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagacgatatgatagtatatataagtgaccctaaaaattccaccagagaactcctaaacctgataaacagctttggtgaagtagctggatataaaattaactcaaacaagtcaatggcctttctctacacaaagaataaacaggctgagaaagaaattagggaaacaacacccttctcaatagtcacaaataatataaaatatctcggcgtgactctaactaaggaagtaaaagatctgtatgataaaaacttcaagtctctgaagaaagaaattaaagaagatctcagaagatggaaagatctcccatgctcatggattggcaggatcaacattgtaaaaatggctatcttgccaaaagcaatctacagattcaatgcaatccccatcaaaattccaactcaattcttcaacgaattagaaggagcaatttgcaaattcatctggaataacaaaaaacctaggatagcaaaaactcttctcaaggataaaagaacctctggtggaatcaccatgcctgacctaaagctttactacagggcaattgtgataaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggtacaggggaaagattcctgaacagaacagcaatggcttgctctgtaagatcgagaattgacaaatgggacctaatgaaactccaaagtttctgcaaggcaaaagacaccgtcaataggacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacctgaaaaaatgctcaacatccttaatcatcagggaaatgcaaatcaaaacaaccctgagattccacctcacaccagtcagaatggctaagatcaaaaattcaggtgacagcagatgctggcgtggatgtggagaaagaggaacactcctctattgttggtgggattgcaggcttgtacaaccactctggagatcagtctggcggttcctcagaaaactggatatagtactaccggaggatccagcaatacctctcctgggcatatatccagaagatgccccaactggtaagaaggacacatgctccactatgttcatagcagccttatttataatagccagaagctggaaggaacccagatgcccctcaacagaggaatggatacagaagatgtggtacatctacacaatggagtactactcagctattaaaaagaatgaatttatgaaattcctggccaaatggatggaactggagggcatcatcctgagtgaggtaacacattcacaaaggaactcacacaatatgtactcactgataagtggatattagcccaaaacctaagatacccaagatataagatacaatttcctaaacacatgaaactcaagaaaaatgaagactgaagtatgaacactatgcccctccttagaagtgggagcaaaacacccttggaaggagttacagagacaaagtttggagttgagataaaaggatggaccatgtagacactaccatatccggggatccatcccataatcagcttccaaatgctgacaccattgcatacactagcaagattatgctgaaaggaccctgatatagctgtctcttgtcagagtatgcctgggcctagcaaacatagaagtggatgctcacagtcggctattggatggatcacatggcccccaatgaaggagctagagaaagtaccaaagaagctaaagggatctgcaaccctataggtggaacaacattatgaactaaccagtaccccggagctcttgactctagctgcatatgcatcaaaagatggcctagtcggccatcactggaaagagaggcccattggacacgcaaactttatatgccccagtacaggggaacgccagggccataaaaggggagtgggtgggtaggggagagggggtgggtggctatgggggacttttggtatagcattgcaaatgtaaatgagcgaaatacctaataaaaaatggaaaaaaaaaaaaacaaaaaaaaaaaaaaaaaaaagaaaattatgaatcagtttaaaccacaacgctgtagacacaaagaacatatttgtcctgtcaaagagaaatgcagaggcaaagctggatcagagactgagggaatggccatgaaaacttgcccaaatagagacatatcccattttatttgtaacaactagaaactgcaaacaatccagatgtccctcaaccgaaatacgtatacagaaaatgtggtttatttacaaaatggaatactaataagctattaaaaacaaggacatcatgaattttccagaccaatggatacaggtagaaactatcatcctgagtgaggtaacccagaaacaaaatgacatgaatatatgtactcacttacaagtgaacattaaccataaagtacaggatatccacactatattccatagaatcaaagaagctaaacaagaagaaaagccctaatgagcattgttgaatctcattcaaaaggggaataaaacagtcagaggaggcagatggaagagagagagagaactggatgggagagtggataagtaaggggaagggcgagtggccaggaacaggtgttgtgagagacaagagatggtcagagggtcaggaatatgaatagaattctgcaccttaacggggagcggtatggaagggtggggaatttttagggtgtgccagagaccaggaatgagaggtcaccaaggataatatgggggtgatcttagttgagatgcatggcaaagagttatggaccctcaagaggccacatcttgctaccaggaaggacctctagtggagaattaagcacagtgaatgaaccaaatacatttgctcccaaaattggtcctgtctacaagaaatgcaggcacaaagatggagcagagactgagggaatggacaaatgatactctgaccaacttgagacccatcccatgggaaagcaccaatcctgacattagtgacggtcctttgttatacttgcagacaatagcttagcataactgtcctctgagagtctccatccagcacctgattgaaacagatgcagagacccacagcctatcattggacagggctcagggagtcttttggaagagttgggggaaaggattgagggcctgcgaaggaacaggaagtctattagaagatccagcgagtcaactaacctgtacactaggagattctcagagagtgactcaccagccaaagagcaaacacagggtgggccaaggccccaccgtatatgtagtaaatgtgcttcagtcttcacatgggtcctggaacaaatagagtggggggatgtcccttaaggagttgtctgtctgtccaccctgttcctctaacttggctgccttgtctgacctcagtagcagagacctgacttgtcatgtttgggggatactcaggtggtccccaatctccctgggtagatgaaaaggagttaaggatgagggactgtgtaatgtggaaaggggagggggttgcaattggaatgtatattgaatacatatataaatgggaaaagtgaacaaatacatataaatagaataaaaatatacaaatcaggcaattattttttaaacttttccctactcaatatctcatagaaaaacctgaataagaaatatttttggccaaaatgttacacaaatgacctctagctaaagttttcacagagtcgatttcccacggacatactgtgacctccacttcctctggctgcattaatgccaacactcgaatctttcaggttctatgactacaaccgttaagctccatctacagctttctatgacttttgacatctcaatttttgatattttccacattcctccaaaagagaatatagattctgtccagcagcaaaatcacctttatataccaatttttgttgttgttgttctaacttgctactctgctgctgaatagactcctgcaagcaaaagcatcttaggcagtagatggttgatgtacatggttcagtcagatcactgtccaccattctggaaagttagaatagaaactgagctagaatatgaaggaaaaataatgaagaacaaacactgtttcttggcttgttctcttacttggtcactgtcctatgcccagctagctctcatccagcccaggcccacttccttaagaatattgcctccctcagtagaaaagccttcccaaaataccatcaacactatctctcacagacatagcaaccagccattctgatgagggcacaccttcaattgaggttccttaatatgtctgtagctctgaaattttgagaactgaagacaattatgacatggagacaataataaatgaggaaattgtaaaagcccaaaaccaatgtgctaaccatatcaattacaggagcccctgccaccaaaagagagaggtggagttgtggctgagccaggaaaaaatggggaggtcacctggcttagagcagggcaggatacagtggaatgaggagttcagaggctttgctgctctggtgtgaggtatctttaacccctcattccctggctagtgctaccaaagaggtagctaaagcagctggaaggtgaacagagaagcacattgcaccacatgcctacaattaatactgctggtctaatgagatatgttaactttgttgcagtggatgaagaacaactttccctctaatgacagttctgagtccaaaactacagagtcacatatgaactgggaacagggttgatcaggacaggaaaatgaggtctttgtcctttgcaccctgtaaaacaggatagggagagcctgactttgccctggattgggtctccaagagctctctataatgggcaatctagtgcgtgtaggtcctcttaggaagaaggatttaaccccagatgatgattaagtaactaaatcaattggaatggaaaaaatcttatttcctctctctcagtcacagaataataaagtaccacacacatgagagaaagtcacaaggtgtcagtaaaggctacccagcagattcatacatgtgtacagaggagaagatgaagacaggatggcagctgtgagtcatgaagcagggtttcaagtctgctctaaccctccaagcactttagaccaagggcgcaccatctctataccagactatggaacatcttccaaggccctgtggctacaactctccagggcacccactgtaccatggttccaagttcactttagtcatctccctccatgaataatcaagaaaaataggaaaaacaagacacaccaacacaaatgtgacagacaagccattgatacaaagaacaacaatgacacattctaacagctggcttttcaacacctctgttctgagtcctggaggtcttggagtttcagtcaacgcaccaagatattatacccaagtcacaggaacctcaatgacaaccaaggatcttattgcaatgcaaacacacaaggttttttattatgggctcagtaacaaggtctgacaccagtcaacctggcatcgggtccaaaatgagagaggtgctggatatatattgtagttacagcaaggctggggaatttccatacaggtcagcaacctaatattttgaaaactgtatatctggcataatctgcaggaaccaaacatgaggcaaaaactatctgacaaccatgatggctaagctaacattttttcccttcaaagaatattagttatctatatgtagcttgaccctgttgctgtaccttcactggctgctcataggatgtttgctcaagtgttctttgtgcactctcaaaaactgcaattggttgagctttacaactcaccctgtgcctgagcccattattattggaaaatactcctgttcatcgacaagccatgcctgccagtagactaggtaatttgaccaaagacctacctcactatctgttactgcagaccctaatatcagtgcctgccagtagactaggtaatgtgtccaaagccctaccccactatctgttactgcagaccctaatataagtgcctgccagtagactaggtaatttgaccaaagacctacctcactatctgtactgcacaccctaatataagtgcctgccagtagactaggtaatgtgtccaaagacctaccccactatgttactgcagaccctaatatcagttgcccttaccactggacaaaataccagtacaagtttcctctccccctgtgcatgcctcctatagctaccacagataatccccacctacccttcttttcctgcctcatccttctgctcagcccccacttgggcagacacatactgctcaacctcatgccatgcctgaaaggacacaaagtaagcttccatagatctaccacactatgtgctatcccagatgtaatttacacagttatccctagcactttaccaaagaacaaaggcagcttaatctctctcctgactatgtctccttgtgggttgctaagatcatctctttctgcctgcctctttttccagcttccaacattaagcattccctcctgaacataccctccaaacaggtccatcaaagaggcaaccctcagtcaacacagtgaaaatccaggtatcagctgggcgtggtggcccacgcctttaatcccagcacttgggaggcaaaggcaggcagtattctgagttcaaggcctggtctacagagtgaattccagtacagccagggctacacagagaaaccctgtctcagaaaaccaaaaataaataaataaatccatatatcaaccagtaacccgggtataaaacacccagccaaacagcacaaacccagaaaccaaatcacctcaaacatagaggcctagacaccagcaaatgaataaaatgaataatagccaggaaaatatatcaccaagaaatctaagctatcctatcacagcaggtcctgagaaattaaaacatgcaatagatacagtggaaaaatggttgtttgggcgaagggaaaagagtgaaaacatagggaaaggtatagctgtgcacaaaagagctttagacaggcacacagacagagagcagagagagacagccccaagggtagggaaatagaatgggggttggggggggagcatgtgcagagaacagagacagggaacaaagcacagagctgctgtagctggtggttcatgtatataaagcacacctgacaacagcagcaggtgatggagacaggtaacgacttaagcatttgctaagtccctaagagaaggccattgaatttgctgtacattgacaactacagaggcaaggttcacccatgggccaggaagggaagagagactatcaggcattaaagatgaatagaaaaaagtgataaattgctcaaaaaatatggattccaaatgtttcctggcattaaataaccaggaattctgcaacatatgagaaggtgaaaagtagaaattattgaaatagaagaagaatatcagctcaaaggtccagaaaatattttcagtgaaatcataaacgaaaattttctaaactaaagaagaaaataccgggctggcgagatggctcagtggttaagagcaccgactgctcttcagatggtcccgagttcaaatcccagcaaccacatggtggctcccaaccatccgtaacaaaatctgatgccctcttctggagtatctgaggacagctaaagtgtacttacatataataaataaataaatctttaaaaaaaaaaaagaagaagaagaaaatacctattaaagtacaagaagcatccaaaatagcaaacatattggaccaaaaaagtccttgtgccacaaactgtcaaaactctaaacatataaagcaaagaaatatgaaaaactgcaacagaaagaaattaaaagctaaacaaaacaaaaacaagtaacgtatggaagcagacctattagcttcatatctgtcttctcaatgtctactagaaaagacaacagtgtttggaccgttttgtgctgcagagtcaaagaaaccactcatgtttctacaagaaagcaactggtgcaaatgttttggacagattcagaatcagctatgataatgaagttattcagaggtcactgcctgagacctcacacgtgttcccatctgggtgatgcttcccatgcagccccagaaaggacccaccaccccatctcccacggctcaaccacctgcccctacccattgtgggcagtgatcctgtgctcaccatgtctaaatctcagagcttcctgaggtcccctcaatgcacccaacagcagatctcagagcaggacacagagaaccattcaagcctgcacagccacagcgaactcctagaaaggcatccggaagatcccgcctctctgtctgactggcatgtcttcctggagaccttgattggccagtgagtcttaccccacctcaatgttaaagtgtgcttcctgtcgaagggtggagcttttccagatctcctgagcccttttcagctcattagcatttgtgcttgccctgggggaagaatccaccattccagctcaggctattctgctgccagctcctcccctctgtgagcaatgatcctgacttcagaccttgcctgaacattcctcatagcacttgccttctttttcctgaaatcatggtgagtagcttcaatagcccattactctagttgcattgtaggtatcaatctgacccaggaatggaagggtgcccaggctattaacattaaaaaggaattttagaaaacaggaggctttttttaatatatgtagattgccaaaagaaactatagcccagattaaagatggatctgaacatctcaaaagatcaatattaagacagggtttctcacctcaaaaggtataattaagaaatatcccccacagaaagcagggttagaattaggattaggtgattagagggttatggtaaggattaggataagggttgttgattccctccttgtgaacattttcctgaaatcataacctttcagattaagcagattctgcaatttattggatagtttaaaggcaacaacatcagaattgatgtattatcacataaatacagtggtatatttacagagtgttgtacacgcctcttctggcctcactgtcagttatttacacagctaattttcctatgaaataaaatgcccttcagtattcttttgctctagacacgtctgaattactttctacccaaacgaaaagtatgcttattaaagatctgtatgtgaagttttcacatgacaatcaaaattatgaaaaaggaatcttagagaagcagtaaatacatctttatggtttattaatatttgctttttataaatatacacatatacacatggtttagaatatacacatggtgtgtcattcacatcatgtaattaataccaaagaaattttaagtaaagtaaactggttaacttcgccaaagttaattttattcataataaactaaacttaaaaattaatatgaaaaaatatatttaatcaataaatcttcaaaggtaaaataaatttgaaatgataatattggtctgaatctttctttggaatagttaacatgagcatatatatttaaattttaatgtctacttttaaggacatgatatatgtaagcctagagatctggtcacagtgatatctttttgaccctatcccaattctagtatacctgtagattctaaattagtttgaaagagtttagttctggggcaggcgggagactctgcaggatctgcggccctgagcatcggagcggtgaactcttcaagtctccgattaaatttaaaaaatggcctccaataaaactacattgcaaaaaatgggaaagaaacaaaatggaaagagtaaaaaagttgaagaggcagagcctgaagaatttgtggtagaaaaagtactggaccgtctagtgaacgggaaggtggagtgtttcctgaagtggaaggggttcacagacgctgataatccttgggaaccagaagaaaatttagattgttcagaattaactgaagcatttcttaattctcaaaaagctggtaaagaaaaagatggtacagaaaggaaatctttatctgaccgtgaatctgatgatagcaaatcgaagaagaagagagatgctgctgacaaaccaaggggctttgccagaggtcttgaccctgaacgaatgatcggtgccacggacagcagcggagaattagtgtttctcatgaagtggaaggactcggacggggccggcttggtgctgccaaaggaggcgaatatgaagcgtcctcaggttgtcattgacttctacaaggagcggctgacttggcattcttgtcccgaagatgaagcacaataattgtttgcatttatatatataaaatctggatcttgggttttgaattactagtgtgaaaaaatagcaatctagtaaaaatcaagtttgatatgctggttttgaaagtattgacactagttgggatatttttggtttttgttctgcatcaaaaggcactgattcctttgggcaagtgagaaccttctgtagttgcttcccttaacaatagaatatatgataccatgttgtatttcctcagctttgaagaacagcttttcttaaatgctggggagattttacagttattactcaagtcagaactgatttttaactgggacacagaaggaccattctgggttttttttgtttgtttgtttctatgcggtgtatgcataaaacacataacttgtttgttttgttttgtttttaactgaagatgaaaatacaagttgatgagattccctccttgtgaacatttttctgaaaccataacctttcagattaagcagattctgcgatttattggataatttaaaggcaacaacatcagaattgatgtattatcacataaatacagtggtatatttacagagtgttgtacacgccccctttggaaaaatggaattagactaagtaatagtgtgctttaataacaagacttgggctagaggcagatagagctctgacctaagaagccagctgagaggcagaggcaggtccaggtcagccagtctgtgtaaaggttcctctggtgaaccatccctttgtagaaagttaaagtctgtactaaaaggttatgattcatggaatctgtttgatgtggaaatagaatcgtgcttggagctgacattgacaatttaagacctgctgactaagtgagtgaaaaaaatttgctaatatcatttaatgacctgcatgctttttctttaccctgactcattccttactggtaggatcaatcttttcaatgtttgggttaaggttcaatgagccagaaaagtaactttgtagtttcagaatgtcatccaactgtatatttactctattataaataatggtgaacagtggtcaataaatagttttatattcctttaaaaaaggagtttagttctgctagaccaggagatgatattcatactggacactatcttcactcatacaagaataacatacctgtgcttttgaagatgaaatatagacatatgaatgattattcagacattaaatactttaataatttaaataatatttatgaccagtaagccctcattgaaaacaaatgaatatgcaaagattgaaagatcatcaaaaggcttgtcttttattatctaaattaaacaacaaccattttcatactttcagctctgttgaattaaaataatcacagcaggcctttttaaatatcactaaaactctacaaaataagaggacgtgattggccaatatttgtataatttggaaggggaataactacttataatgtaattttcctcagatatactgaataaagtatttgtaatttaccaattgcaggatatctatagtctcataagaaaaactttgtcaatttgctgtaatttcacttttatcctagggtgttctttgacaattttaaaatgtggtaccattgataacttagaaagagggaatatgtattgcttattcccaacccctgaataaatattctcacagtactttgtgaatttatatgttaaatctattgtatcttatggtattacccggcttccattagtggaggtattcgactgtgacagggggacttgccttgtctagcattcatgtctcaacttgccaaccaggaagtcagttgcccacatgcacatctccacatgcacatgcccacatgccaagtaggatgtcagttcctggggaggtcttggaacttacactttactagaacccagcaaattggtgcaggtgtctctcttatgttggggatccattcccagggcagcttataagagcaaaagccataaaagtgtatacatgggtgggtgcaggaaatgcttctgggtggtctgttccaatccaaagcttattctgagtaactatagaacaaaggaagcagtttgacaagcttctattgtgattggttttctgaggacacagaaccaaacagaatagataatcaactctgggagtaactgcagaagcaacatatgacaacgtgtccttgtaatattagtaacagcacaaaatggcaggctagccaggtaagagttacctagtccttaactaatctgacctaggccttcacaatacatctaggtcttactatttgacctagaccttaactgccagcagctttgccctctgagccaccgcatgcacatgcatgtatagatggatgaatatattttctgtatttatttattcatttatgagaggcaaagtctctctacatggtgccaaaacatattagatagtccaggcaggcctttcaagtgagtcctgcctctgcctctacctccccagtgctgagatcaaaggacaccttccttttattttacctttctttcattctagggaggttgtgtgtgtgtgtgtgtgcgtgtgtgcgtgtgtgtgcgtgtgtgtgtgtgtgtgtgtgtgtgtgtgtttgatttcttgttctgtcagtgtattggcagcagaatgttgaccccagaaacctttttgtttttgattttatagttattatctatttaatttaatttcaaaatatatccatgtgtgtgtgttcgtgtgtgttgcatgtggtgggtgggtgtgtggtgactgtgtgcattggtgtgatagtaggaaactgtatgtgtgtatgttgtgtacgcatgttgtgtatgtatgatagtgcgggcatatgatgaaggtcaggggtggatggcatccaaagtctgtgtataggaccatgcatttagttccatttattgtatgtatgtatctatgtatgtatgcatgcatgtttatttgtatgtgtgttattacttagtttttatttatttattcccacggcgccccgccccctgtcatcactctacccacagccccgctctgcgcaggtgcggccccgccccaagcccctacacccacgtccccccaccccacccctgcactgggccccacgcaagattaacctgagcatttttagactctggtggcgacagcgggagcggggaagcgtgaccctctgacaccctgcgtcactcctcagtcctctttccggttactctcaggcgtgcgggagcgcccactgctgtcgggaagcaccctcgccttcctctccctcccctcgtggcccagtgacgtcacacacagcctccttagacctgctccctcaaccttcaccactcaggtgcggatccgggatcacagagtcctcgcgtggcgtcccgcccctcccgtgatccccgagactccgccccgtccccctgcaactgccagaagtcacgcagctgcttccagaaccgcgacaggaattggaagtcccagccacccgccagcgatgcccgcttggggtcgcccgggtcgtgacgcagggatggggcttgcggggaggccgcgggggtccggactgcggggtaagggcgtgggcttggtgctcaggggtatccatgcggagcagcaggcagcgcggccatagcggagaggtcaggcgttactgatatcacgctctctgtctgaggctcggttctgcctgtggtccaccctagggtgccctcttgctccagatgtccctcattcccctactgcccaggtcacgtgactctgaccaggctgtgcaactttcgcagggaagaggcgaggggtaccgacaaagctcatctggggatcacactgtctcccagatggttttgtgaccactgacaccaagggtgacccctgacctatcacaagaaacccgacctcacacctgacccctacatcacatgtgaactccgaattcagaccccaacatgacctctatgttttttgattcagactctctgccatgaccctgacattgccctgtgaccccaatggtacaccatgaagttttaccaatatgacctccaaaacatgagaaaaggggtcactacagtgtgcatgccagcacggaaggaagaaagctgaaaatatatagcctacacaaccatttataggaaactataaaccttggaatggaagaggttgtcatcttcagggacaaccagagaccaaagattggccatatagtaccaaataatgagccttcagagcataaatatatgcaatgttacacggtctctacaatttatatttcaaaatatatatgcatatgcatatatatatacacattcagtaagaattaatgaaatatgaagccatatgcagtttaggagtgcagggagtggtacaaaggttgttttggagacaggaaatataaatgaaaaacaatttaacgacaatgacagacacttttgtcaagagaaagaaaaagatatgttgagtatcatctaaccttttcatactacgaaagtttcaataaagcaatttacctttgtagttctgtataaaatttgtatctggtgtaattaaaataacataacactttgggacaaagataacattagtaactctgcactagaagccaagatggaaaagacctccacaaccaccatgaccttccccctggtgctatggtacacagggaggaaggtgatccagacactgcagaacaccagcatgctgaaagttaggaacttggcttcattgaatctgtcaggaaggttcctagccaggaaagccacagtgaagctccccagagtcaagaaacccaagtatcctaggacaaagtggaaggcaatgacagcctttgatgcaagtaatgacagtcttcctatgttcagattgtacatctgtgtcaatgaagagaggagatgctaccaaccagattccacagagaacaagttggattagggtacaaatgggaaggaccaacttaggtgcccctgtcatcatcatccctctcatccttcttcctggagtagtgagattgaaagccatgaccacagttattgttttggccaacactgtagaaatagccactgtgaaaaatactccaaatgtggtctgctgcaggatgcaggtggcctgattgggatgtccaatgaagagcaatgagcatagaaagcagaagactagagcgataagcaggatgtagttgagaatgcggttattggccttcacaataggagtatccttgtacttcacaaaagtgactagtactagcattgtgatggctgaaaaggacagggaagtgcaacctaaagccatccccaatggatcttcataagtaagaaatgacacagctctttggaggcagtgggttttctctaagttggtatatttatcatgtggacacatcatacactgttccatatcgctggtgaacaacaataaacctgtataagatatcatagttatgtagttaataattgtgaatttgtattattcagaggatatataaataaataatttggtgttgagcatctttatctttccattccttatggctgtaggaaccatgaacctaagattgctgtctattgaactatgatttatagtggaagaaaaaaacatcatagagaatggaaaaaatatttattaaacaaaaaagaaaatattatgaaaattaatatgcatactctcagattatttaactcctcaaaccataaactcactattcacagaaaagggtagtttgcagacatcattgttggtgccagttgttgcaacgcattatgtactttgttgctttgtggattgtgcctatgtctttatttacatgtaggagctagaacatttaatttctcatgcaaatacagtttgcataaaggaatattttcattcttgaaactgtatgcctcatagacatatgcatgtccctctcattgtggtacaatctctttcttcccagctatacattccaagctgtaggtcatgaaggctattgaaattcacattcatccctctttacttaggtgggctgtgattgatgataagcactgtcccatctcttgttacgttctggaaatcttcactcttgttctaagtctttcacaggaaattcttaatcctttaaaccatctaagctcttaaaatatatttcattaaacaacaactgctaccctgaacatctggtctttgtcaggtactaagctgggtactggacaaaaagattatggactgattatgtagtcaagttgctttgtataaaggatcaatgaaaaataaacatatgcatagattatgcctaaaatttttgtttaaaaatttgttacatgcatatatccccctaaacattttctatgtaacataaaatcagtaaccatcatattgtgagagaaatacacattgtttgaagaagatattgcaggttatttgctgggtccaaaagcagttgatattatttaactgattaagttctgaaacctgaagattttaggtcttcaattttcatctagaccatatcatatttcttgtttggaaagagaaggtattcaaatttagcaatttttcttctgcatgcaagcatgtacctgtttcattggaaacttcattttctgggcactgaacacaatcaaagcagcagtctgctatttcttcctgatgaattttcctgaatccagcagtacatgccacactacacgtggaggagggaacctgaggcaatgactaaattgtatatgtttgtgtgtgtgagtgtagttcatgtgtacatcatatgcataatgacccttagattgatatatgggacattaacagatatggctataaatattcctctgataaccagtattacttaacaatttcaggcacattattatttgtattaccctgcagtacactgaatgtcacaatatttaatataccatataatattagatatgtaatatttatgttaaaacaatttaaaattttccttcctaaactgattaatctaaaaggaatgtttatgtggcatcagttctctaatgatttacaaataaaaaaataacaatactgaggtgtatggagaaataaggtaggataagtcaagaaagatttgtttgatgaacatgaacaaaatatgcatataagactctcataaaattaatgaagctttcctaagtttaaaagaaaaccttgaaccccctataccttcctccctttcccctggtttttatgagagagctcccctatctactcacccactcctgcctcaccaccctagcattcccctattctggggcatcaagcatgcacgggatcatggtcctcccctccctctgatgacagataaggcaatcctctaaagaagaggggaaacatggaagcaagataacatttgaaatgtaaataaataaaataatccataaaaattacacaaataaaaaaggaaaccttaaatctggagaagatttctgttaatgaatacatgctatacttaattaggctatgaatatgttcacacagaatcagaaaattccattgtgtatgtgtgtatacaaaattttaatatatatttaataaatatatgtaataaatatattcctatactgtaagattaataggcatgtgggtacaattgaacatggaatcaagagaccttttttccctatgaccatttttactcaaagtagtgagttatgaaatgtttgtgcttgtaattgaggatactcttttgtaagattagcaattggtctcaaccacacagctattacttcactgcctcatattttaaaatttaggtatcatgaaaaatataaaattgtggtatacacaccgatgtccctcctgtgacccactccaggtcttcagatataagaagttgttggctctgtgggaaacaaggaaaatatcttcctatttttacttttaatccaaggccttgtggaaaattccaaatggtacaaatgtcatactctacacactgatattccctatgattcacgttcaccagttctccaacagggttagtaaatacctgggctttcagcaaggaaaccatctaaaagagtaaaagagattcatgattacatatgcatattaataaagggaagacaaaattgagaatttgctctaatttcttaatgtctttcagaaaagacagctgtatgaagtaatcctgtatagtaaaatataatatagctctttgataatttgaaatttatatacttcatattaatgtttgatggtaaaatgtgctagaaaaaaatgattaccagataaccagtaacatggtgtgtgagtgtgtgcatatgtttgtaaaaaatactttttttcttaactttggggaagacccctctgtgttgttgttgttgttgctgttgttgtttttaagatttatttattatatctaagtacactggagctgtcttcagatgcaccagaagagggcatcagatctcattacagatggttatgagccaccatgtggttgctgggatttgaactcaggaccttcaaaagaacagtcagtgctcttaaccactgagccatctctccagcccccaaaatactttttaaaaaataaagccagaaaagaaattcctcccaacacataataaccagaacaacaaatgcactaaataaagatagaatattaaaagcagtaagggaaaaggatcaagtaacatataaaggcaggcctatcagaattacaccagacttctcaccagagactatgaaagccagaagattctggacagatgttatacagacactaagagaacacaaatgccagaccaggctactatactcagccaaactttcaattaccatagatggagaaaccaaagtattccacgacaaaaccaaattcacacattatctttccatgaatccagcccttcaaaggataataacagaaaaaaaccaataaaaggacagaaaccacgccctagaaaaaacaagaaagtaatccttcaacaaacctaaaagaagacagccacaagaacagaatgacaactggaacaacaaaaataataggaagcaacaattacgtttccttagtatgtcgtaatatcaatggactctattccccaataaaaagacatagactaacagactggctacacaaacacttgctgcttacaggaaacccatctcagggaaaaagacagacactacctcagaatgaaaggctggaaaacaattttgcaagcaaatggtctgaagaaacaagctggagtagccattctaatatcgaataaaatcgacttccaacccaaagttatcaaaaaagacaaggagggacacttcatactcaccaaaggtaaaatcctccaagaggaactctcaattctgaatatctatgctccaaatgcaagggcagccacattcattaaagaaactttagtaaagctcaaagcacacattacacctcacacaataatagtgggagaattcaacacaccactttcatcaatggacagatcgtggaaacagaaactaaacagggacacagtgaaactaacagaagttatgaaacaaatggacttaacagatatctacagaacattttatcctaaaacaaaaggatataccttcttctcaacacctcatggcaccttctccaaaattgaccatataattggtcacaaaacaggcctcaacagatagaaaaatattgaaattgtcccatgcatcctatcagaccaccatggcctaaggctgatcttcaataacaacataaataatagaaagccaacattcacgtggaaactgaagtacactcttttcaatgatactttgatcaaagaaggaataaagaaagaaattaaagagttttttagagtttaatgaaaatgaagccacatcatacccaaacttaagggacacaatgaaagcatttctaagatgaaaactcatagttctgagtggctccaaaaagaaactggagagagcacacacgagcagcttgagaacacacgtaaaagctctagaacaaaaggaagcaaattcacccaggaggagtagacggcaggaaataatcaaattcaggagagaaatcaaccaagtggaaacaagaagaactattcaaagaatcaaccaaatcggagctggttccttgtgaaaatcaacaagatcaataaacccttagtcagactcactagagggcacagggacagcatcctaattaacaaaatcagaaatgaaaatggagacataacaacagatcctgaagaaatacaaaacaccatcagatccttctacaaaagactatattcaagaaaactggaaaacctggatgaaatggacatatttctagacagataccaggtactaaagttaaatcaggatcaggttaatggtctaaacagtcttctatcccctaaagaaatagaagcagtcattaatagtctcccaaccaaaaaaatcccaggaccagatgggtttagtgcagagttctatcagatcttcaaagaagatctaattccagttcttcccaaactattccacaaaatagaagcagaaggtactctgcccaattcattctataaagccaaaattactctgatacctaaaccacagaaagacctaacaaagatagagaacttcagaacaatttcccttatgaatatcgatgcaaaaatcctcaataaaattctcgctaaccgaatccaagaacacatcaaaacaatcatccagcctgaccaagtaggtttcatttcagggatgcagggatggtttaatatacggcaatccatcaacataatccactatataaagaaactcaaagacaaaaaccacatgatcaactcattagatgctgagaaagcatttgacaaaatccaacacccattcatgataaaagtcttggaaagatcaggaattcaaggcccttacctaaatatgataaaatcaatctacagcaggccagtaaccaacagcaaataaatggcgaaaaacaggaagcattcccactaaaatcagggactagacaaggctgcctactttctctctacctattcaacattgtacttgaatacctagccagaacaattccacaacaaaaggagatcaagggaatacaaattggaaaggaagaagtcaaaatatcacttttggcagatgatatgatagtatatataattgaccttaaaaattctaccagagaactcctaaaactgataaacagcttcagtgaagtagctggatataaaattaactcaaacaagtcaatggcctttctctacacaaaggataaacaggctgagaaagaaattagggaaacaacacccttctcaatagtcacaaataatataaaataccttggcgtgactctaactaaggaagtgaaagatctgtatgataagaacttcaagtctttgaagaaagaaattaaggaagatctcagaaggtgaaatgatctcccatggtcatggattggcaggatcaatatagtaaaaatggctatcttgccaaaagcaatctacagattcatgcaatccccatcaaaattccaactcaattcttcaatgaattagaaagggcaatctgcaaattcatctggaataacaaaaaacctaggatagcaaaaactcttctcaaggataaaagaacctctgttggaatcaccatgcctgacctaaagctgtactacagagcaagtgttacaaaaactgcatggtactggtatagcggcagataagtagaccaatggaatagacttgaagacagaaatgatcccacacacctaaggtcacttgatctttgacaagggagctaaaaccatccagtggaaaaaagacagcattttcaacaaatggtgctggcacaactggcacttaacctttagaagaatgagaattgatccatttctatctccttgtactaaggtcaaatctaagtggatcacggaactccacataaaaccagagacagtgaaacttatagaggagaaattggggaaaagcctcaaagatatgggcacaggggaaaaattctgaatagaacagcaatggcttgtgttctaagatcgataatcaacaaatgggatctcatagaattgcaaagcttctgtaaggcaaaagacaccgtcaataagacaaaaaggccaccaacagattgggaaaggatctttacctatccgaaatcagatacgggactaatatccaatatatataaagaactcaagtaggtggactccaaaaattcaaataaccccattaaaaatggggtgcagagcttaaccaagaattcgcacctgaggaataccgaatggctgagaagcacctgaaaaaatgttcagcatccttaatcaccagggaaatgcaaatcaaaacaaccctgagattccacctcacaccagtcagaatggctaagatcaaaaattcaggcaacagcagatgctggcaaggatgtggagaaagagaaacactcctccattgttggtgggattgcaagcttgtacaatcactctggaaatcagtcttgtgtttctcagaaaattgaatgtagtactaccagaggatcccacaatacctctcttgggtatatatccagaacatgttccaactggtaagaaggacacatgctccactatgttcatagcagccttattgataatagccagaagctggaaagaacccagatgcccctcaaagaggaatggatacagaaaatgtggtacatttacacaatggagtactactcagctattaaaaacaatgaatttatgaaattcctaggcaaatggatggacctggaggccatcatcctgagtgaggtaacctaatcacaaaacaactcacatgatatgtactcactgataagtggatattagcccagatacttagaatacccaagatataagatacaatttgtgaaactcatgaaactcatgaagaatgaagaggaaagtgtggacactttgccctttcttagaattgggaacaaaacacccatggaaggagttacagagtcaaagtttggagctgagatgaaaggacaggccatttagagacggccatatccagggatccatcccataatcagtctccaaacgctgactccattgcatacactagcaagtttttgctgaaaggaccctgatatagctgtctcttgtgagactatgcaggggcctagcaaatacaaaagtggatgctcacagttagctattggatggatcacagggcccccaatagaggagctagagaaattccccaaggagctaaagggatctgcaaccctatacgtggaacaacaatatgaattaactagttacacccccatccccccccccgagctcgtgtctctagctgcatatgtatcagaagatggcctagttggccatcagtggaaagagaggcccattggttgtgaaaactttatatgcctcagtataggggaacaccagggccaagaagtgggagtgggtggttaggggagtggggggtgtatgggggagttttgggatagcactggaaatgtaaatgaagaaaatacctaatttaaaaaaaaagaaggaaaaaatgaagccctgtatgtgcaaatgaaggagaattgtgaatgtgtgtgaagataaagaatagttgtgggtctttcatgaatagacagtaaacgtatatgagataaacataaacttaataaaatgtacagtcttaatcatttatggttttgtaagtaattgtaaagttcaatgagtaactatttgtactgcacatgtactgatccctgagaaacttttcttttttgttttttgttttttgttttttgtttttcgagacagggtttctctgtgtagccctggctgtcctggaactcactctgtagatcaggctggcctcaatctcagagatcctcctgcctctgcctcccaagtgctgggattaaaggcgtgtgccaccactgtttggctgagaaattatgcattaaaaatattctagtctagtcatcatttaaggattttatgataaaactcttggttcctattttaaattttgaacttatttatggaaatctttagacacgttttcacaaaactcactgctatcattaaaactgttttgtctcctattaaacgttattttgtacacgatattcattcatgtaaatgattatttagagagttttgcaatgtagacctctttccactgacagaataacctttgacaaatgtccagttgtttcactgggtccatttaaaagatcacattgatatatataagcataatgaaaagtaagaaactttacctgctgacagtcagtgaataatcctttgggttctgctattttctgagactctacttgttgaagtcatggtaggtgtggaccacaacatgcacaacattatacagactgtaaccttcttcacttagggccatgtcacatttgtgcaatgctgtccattccgatgtgttgttgaatgtaaaatgatccattttattgctgttcttagagactgaacaattaaaataattccactccagtatagactcagaaatgtttactggtatttgttggttttcattgtttgcaaaaaattcctaaatttagcaatctcacctttgtggtgtgcaaaagtgacagtcccatgaagaaatcaaggcgaaatctcttttaattgtgatgacatcccattgtgaggttgtgattcaaattctccgtgcacttaaatattcccatcttctaaagctgacttctagagttgagttcatttcaccataaaggataataacttttgctgatgatgtcataatttgcttatcatatgtcttagcccttgtcacgtgtatgtgcatgttttctgggatcacattcacaaaagctaaacagatcccatgtctttgcatttcttctgttgagtctgagagaaactgaataccctggccatcatctaagatgaccagtcctatccaagtccatctaaaatgaagcatcaaggagaccatgccatgggacaaacgtgtgtccttggtggctacctgatggacataggggaacaggtcatggtcacttaggttagaattaaatggtccaaagaaaacctaaaggatatagaagagatgataaaacatctactgaggaatatgattgtcaggatgtttggacttatatacaagtaacattgctcacctttcagaactcctattaaagatagtaagattatactataaatatcattcctattagattgttgactatctctgatacatcccactgttctcaaaaacagtttgcctgtttgcctactacatctatgatctatttacttaattctttatttcatataatataaataatatatatctattttaaaatatctgtgtgtgtgcatgagagtgtttgtgtgtatgtgtgtttgttttgagtatgtagcaacatactcatcactcataaatgcatgctgttcaagttttcttgtaggcaaatgtaaatggaatttaaatgttgttaactcatccagtgttacacattcttacatatggtgtcctagaataaattgacagttttacagctgttttccatgatggtcctataagatatatgtttcaatcatcctccaattcacagatataattaaaaaccaaatgatttttttcttctaaatatattttacccagagtcccaatttatcttcacacaggccatccatgaaggagaatagcaaagacgtgttgggtaaaagataaggattcttgttgatctcgtcagtagcaaaaaacattaccagagaaaactcgtatcttctcgatgctattctaaaacaaggcataatgatgattaagaacgatgtttgaaacaaaattccaattgcagtaaagtttgtaatatgagaaatgctaaatttctgtctaaatgtcttgaaataaacctcatatattagcaatctttagaggtgaatacaattcaagaattcatagatataggacactatgatatgataaatattttgttcataaaagttaataaggattgttttatctctgaatgccacccttgaactagattacagtcctattgagaaagactgctataaaataaccttgaaattgtatttccacagatacataaaaaagcatgacttaaaccatataaaatatataagagaatctccttaaaattttttattatttaaatgcatttcatgcatcaggcatcttaataatactgaatattttgagaaccaaataatacatcaaaattttgttcaactttcatattcctgtccttttataccttaaaaatatcattaatgcatatttaataatatccatacctgtggatcctatgtctactgttgagtactaaattgtttgaaaccatacaaaatattctttgggatttatgcatagtaaaagaacatgattttgatattttcaactattaatatttaaccaagagaataattacaatgagatatatttcacttaaatttatttatccatttcaaaatataaaaagtgatacaatgtaccatataaccagaatattatcctgtaggctcttttacacatcaatttaatgttaccttttagtttgttgttactatgtcaatttcataaaaatagtatcagatttctcttaactccccagtcttcttaattctttgagatcctttaagtgatgtctgagcatagagaacttctctccacctgaaatgtgtacatctgtcccagaatagttggcagttcatttgttactattaacaatgacctctaatcaggagtaaaaataccaaacatgctcatttgctgaaatttgcacttttaaattgagagtttggagttaagtgtttttctttctaaaccagcaaagtgtgttgaaacagtcatatatttgtaattttaaaccttattatgacttataaacgggtcaccaatgagaatttccacaatttttccaatgagatgtgtgacaatacataatgcatcagaaatgaaattcctattaacctaacagagaagtataagaatgtgaagccacagctgggcatggtggcgcacgcctttaatcccagcactagggaggcaggggcaggcagatttctgagttcgaggccagcctagtctacaaagtgagttccaggacagccagggctacacagagaaactcttgtctcaaaaacaaaatcaaaaacaaaacaaaaacagaaacaaaaaacaaacaaacaaacaaactaactaacaaaaagaatgtgaagccaccatcacgatcaaagtgtacagagtgaactgtagctaacaattggaaaatgtattttttaaatcccgaagatatgaaaattgaatatgagatgggataagaatcagaggcagaaaagcacaggaaacctcggttcatgaaagaaaaaagtcccaagtcacattgtttagctaaaagctgagtgatttcaacaatccttccctcatgatctgcagccacaaatggtaacatctcacacttgggatctcagaactctgtagccacattgagaacaacttcttatccacaagaagtacatttattcctctagattttctctaatgctatatttattcaataattaatagaaatgttgaccctctatctgatactgataataagcctaaatgtgactgggcatttgcaaaactggaccaaaacattattctgggatcagcctatgaagcctggcagtctttttccatatttcatgtcaactccagaatggcaggaggggctcatttacaaactattttacaaagcaagtatatgcatattcacaagtatacatctaatgttatacatgtaatcagatataatagacctgcacatgcacaattatttcagtgtatgaatgtatccccaactgttggagaccaaaattagataacctttttatgaaggcattttgatgcatgctcatacaagaatcattggcagacaattgaatataggtagtgatgctgtctcttcatattcatctctttccaaaggtgagaattgtgaattcaagggaggtgaatagataactttctacatatgatatcctcaaagactcaatagatagaatccagcctctcgcgttgtccatcattatgaactggagctcaatatgctaaagctaaactaacctatgacacacttgaaagtattaaaatagagattaatgttatacttaatgttcagtggttcctaaagttacaggggaaaaacaggacagaaccccactgtttgtgtacacagctaaaaatttctaattcatggcattgaagcaggaagtaaagttaatgacttacctaagactaaaactgcaatcatataaaatgtcagtaaaattgtcctccactgtaaataggtaaaaaccacagtcacttctcaaatctccatgattgtcctcactattcatcatccttcaaaagcaaatgggttcagtcaaacagcacaagatgagagaaaccttcaggagaaaaaaggaaatagtgaaagcacacagcttcttcatgtcccctaggttctatgatggagcacatgtgaaatccttttattctgcacagagaaatcacacacaatttatacctatgtgtctgttttaaggcttgctgtttgcagatccacttaattatattctgcagctccttcccactcatcctgtgttaggtccctggatacatctggaaaattttgtccttaagcgctctttctgaggtctgaaaattttgatcaagacatttctgaaaacatgctgtgaagatcattttctccatcttcaggtgccatgatttcatgcatatccactgcatatactccagggacaatcttctgagaagcttgggccagactacgtgtcaacagccatatttatgaacacaattggcaatcatgataatcgatttcatcagaacttccatagtaatacaaaagttgagaaagtcataaatgtcccgtgtcatttggactttgagttgaatcataggaaattatgtcttccattttctttttttttaaattgtatttacatagaagcattcagaatgtcaacaaaacagctgcaattttttattttgcaattacagagtggtattcacttaacagaacaacaattatcttcttataagctgcatcagaggcaactgaagatgaaaaaagaaaaacaaaaagaaaactgaaagaaaaataacaaaaacaaaaaccaacctactgtccccatatataactaatttgtgctgtgctttaaattttcgtgccaatttacaacccccagactgtgccaggcaaggttagtggctattgaaaataccaccaggacaggggtatctaaagacacattcggtagtgtgttaactatacaaaaaaagacactgtacaatttaaaaacaaatcttacacagccttacatttctatttttttctttaaaatgagtgagttgtgtacagggggttaaatgctttataggcaagaaaaaaaaaactgtgctagagccaacttattcatcatcttcttcaactttgacttcctcttcttcctcctctccctcatcctccttctcatcttcttcttcattctttttcttgctcttttcagccttgaccacccccttattctcagcatcaggttttcctttagctctgtaggcaggaatatccttcttgtacttctccttcagcttggcagccttcttctcatagggctgcttgtcatccaccgcagtgttgttccacatctctcctagtttctttgcaacatcaccaatggataagccaggatgctcacctttgattttggggcgctactcagaacagaataagaagaaggaggacttttgggtgcattggggtccttgaacttctttttggtctccccatttgggggggatgtaggttttcattttctttcataaggagacttgtcagcctttcccatatcttcaaatttccccttttcttaagcagaaatggtcttccacctctctgagcacttcttggagaactctgagaagttgacagaagcatccgggtgcttcttcttgagctcctctgggcaggtttgcacaaaaaatgcatatgaggccattttgcctctcggcttcttaggatctcctttgcctatgtttacttgattttgctcagcaaggcacagagttgcccagtgcctgtctggctctcgcttgcccaggcgctgtctctatggagctcaattactgcaatggctgtgagagcaggcttccattttctagtgtagacaaaaacagtctcacatgcaacattgagctaggagttgagctttctctctgttgttcatatactattgtgtgctagtcacatttgcaaaatctcctcaaactttctgtgtatgggacacaagttatgttacttgaactttctctttttgccttaagcttctgtcactgacttgacatgttgaaaagaatacagagcacataccaccgtgtccttcctgattaataaggaaaagctttgggcttttttcccctgcagaatattctgtgagcctgcaatctgaagatagtcaccacaatactggatgagtatttaaaagaaaattgtgcttccatgtttaacaaatattattttatacttccttctggttttctctctctctctctctctctctctctctctctctctctctctctctctaccccactacagcatgcttggataacctagcaaaactgaaatacaagaaaatcaccttaactactatcttacaataatcatagaggccttataataggaaattataaattccttaaagaaacactggaaatacaatcaaacaataaaggtctttaaaaaagaaacaaataaattacttaaagacatacagaaaaataaaattaagcaggtaaagaaagcaaataaaactgggcaagacctggaagtcaaaatagaagcaataaagaagaagcaaactgaagaaattctggaggcagaaaactaagggaagacaacaagatcaacagatgcaacaagcatgtacagaataatggagatggaagggaaacattcaggcataaatatacaatacaagaaattaatacatcagtcaaaaatgttaaatctaaaaaactcctagcataaaacatacaggaaatctgggactccatcaaaggccatcaaagagcaacaggaataaaagaatgtgaagactctgtgatagtttgtatatgctgggcccagagtgtggcagtattagaaggtgtgtcccagttggagtaggtgtgtccctgtgggtgtgggctttatgacccttattctgactgtctaggagccagtattctgctagcagccttcagaggaagatgtagatctctcagctccttctgcaccatgcctgcctggaagctgccatgttcctgccttgaaaatacttgactgaacctctgaaactaagaattgccttggtcatggtatttgatcacagcaattgaaccctaactaagacaagactccaagctccaaggaccagaacatattcccaaaataatcatagaagaaaagtacccaagaaagagatgcctagaaatgtgtgagaagcttatagaataccaattagactggaacagaaaagaaaaccctcctaatacataattatcaaaatacaaaacctaaaagagaaagaaagaatattaaaggtagcatgggtaaaatgccaagtaacatacatagacagatatatcagaattacatctgacttgtcagcatagactgtcaaagttagaagggcctgagcagatagcctgcaacctctaaaaaatataagtgcctacatacactagtatgcccagaaaaactcacaatcaacttacatggcagaaagaagacatttcaataaaattccaaaatcaaacaatatcacttcatgaattctactctacagaaagtactagaacgaaaactccaaaccaagaaacataactacatccaagaaaacacaggaaataagcaatcccataccagcaaaagcaaagaaagcactgacaaagacataaacacacacacacacactaaatcatcaatatcaaaataatgaaaaattacagtcactggtcattaatatttctcaacaacaatggactcaattcccaaataaaaagacataggctaagagaatggatggaaaaagaggatgcattattctgttgtatataagaaacattcctcaggaagacaatagacatttcctcagagtaaagtgctagaaaaaaagttgtctgagcaaatgaatccaaaaagaaagctgggggtagtcattcttatgccaaacaaacaaaaaacaaaaataaacactttcaagcaaaattaatcaaaagagacagggaaggacatttcatactcattaaaggaaaaatctaccaagatgatatctgaattatgaacatctgtaccccgaacacaagggcacttgacaactgtaaaagaaagactgttagaatgtaaatagcacatcaaaccccacacattaatagtagggtatatttcaagacccgaccagcaccaaatgacagcacatccagactaaaagtaaacacagaaataatgaaactatcaggcactgtgaatcaaaagtacctaatagacatgtacagaaaattcacccaaacccaagaggatataccttcttctcacaaagcaaatctcgaaggtacaagaaaattgaaataatgccttgtatctaatcagaccaccatggatttaagctggacttcaacaacagcaacactgtatgtaaagcctacacactcatggaaattgaacaagtctccattcaatgatctctggggcagggaagggagagagagagagagagagagagagagagagagagagggagggagggagggagggagggagggagggagggagggagggagggagggagggagggagggagggaggaaggaaggaaggaaggaaggaaggaaggaaggaaggaaggaaggaaggaaggaaggaaggaaggaaggaagggcactttacacaatacaataaaaatgaaagtacaacataacccagttttatgggacacaatgaaatcagtacaaagaggaatgttcatagcataagtgcccccataaagaaattataaatgctgaaaccagcaattgaaaagtacacctgaaatctctagaaaaaaaggcgcaagaatatcaacaaggagtagaaggaagaaaatagtgaaaatcaaggctgaaataaatcagttcataacaaagaaaacaatacaacaaatcaaggaaactaagagctgattctttgagaaaaccaaaaagatagacaaaccctagccaaataagcaaaggacagcgaaacagaatccaaataaacaaagtcaataatgatgagagagacaaaacaagtgacatcgaggaagttcaaagaatcattaggtcttactccaaaagcctatactccacaaaattgtaaaatcctaatgaaatgggtgattttctaggcaaataccaattggaaagttaaatcagggacaggtaaactatgtaaacatctctatagcccctaaagaaatagaagcaggtattgaatgtctcctaaccaataaatcccaatagagagatggttttaatggagaattctaccagactttcaaagaagagctaaagccaatactcttcaaactattccataaaatagaaacaaaaggagcactgccaaactcatgctatgaggccacagccactctgatacctaaaccacagaaagactcaacagaaagaaaactttcgattgatttcccttattaacattgattcaaaatactcaataaaacacctgcaaaacgaatccaggaacacatcaaagatgtcatccctcaagatcaattaggcttcatcaaagagatgcttagatatttaatatatggaaatccatcgatgtaatctatcatataaacaaactgaaaggaaaaactcacatgatttttctcattagttgctgaaaaggcctgagattaaatccatcgcctcttcattttaaaggtactagagaggggctggagagatggctcagtggttaagaacaccgactgctcttccaaaggtcctgagttcaaatcccagcaaccacatggtggctcacaaccacccataatgagaactgacgccctcttctggtgcatctgaagacagctacagtgtacttagatacaataataaataagaatcttaaaaaatatatattttaaaggtactagagaattcacggatacagggtacatacatacacataatcacagcaacatacaataagccaatagctaaaaatcaaagtaaatggagaggaacttcaaacatttccactaaaataaggaacaagactgaccttcccactctatccctatctatcttttgaaaatatcacttaaaattctagccagagaaataagacaagtaaagaagatcaaagaaccagctcctggtttgattgattctttgttcagttcttttagtttctacttgattgatttcagtcctgagtttgattatttcctgctgtctactcctcatgggtgaatttgcttccttttattctagagctttcaggtgtgttgtcaagctgctagtgtatgctctttccagtttctttttggcagcactcagagctatgtgttttcctcttaggactgctttcattgtgtcccataaatttgggtatacccattttcattaaactctaaaaagtctttaattcctttctttatttcagtcatagtggtgtacaacgttcatgccagcgtttgaaaagcagaggcaggctattacaggattgaggcctacaaagtgtcttcaagacagccagggctgtttaaactaagaaccatgtatgaaaagaataaaaataaatttaagaatgaaagaaagagagagagaagaagaaaaaagaaagaaaagaagaaagaaagaaagaaagaagcagcagaagaaagaaagaaggaaagagagagagagggaaggaaggaaggaaggaaggaaggaaggaaggaaggaaggaaggaaggaaggaaggaagaaagaaagaaagaaagaaagaaagaaagaaagaaaaaaaggaaggaaggaagaagagaaagaaagaaagaagagaaagaaagaaagaagagaaagagagaaaagaaaaaagaaagaaaaacaagcagacttaggagatagtattagttgattggagatatagtttctctatgtatacaggcaggcactgatattgttgttcctcctatagggttgcagacccctttagctccttgggtagtttctctagatccttcactggaggagggggtgtgtgtttcattcaatagatgactgtgggcatccacttgtgtgcttgccaggcactggcatagcctcacaagagacagctatagccaggttctgtcagcaaaatcttgctggcatatgcagtagtgtctgggtttggtggttgtttatgggatggatcccccggtggggcagtctttgtatggtccatccttcagtctcagctccaaactttgtctctgtaactccttccatgggtattttgtcaccgcccttttctttttggacagggttcctctgtatagccctggctgttctggaactcacaatgtagaacaggctggcctcaaaactcagaaatccgcatgcctctgcctcccaagtgctgggattaaaggcgtgcgccactactgccctgcttgtttccccttctaagaaggaacaaactatctacactttggtctactttcttcttgagtttcatgtgttttgcaaactgtatcttgggtattctatgcttctgggctaatatccacttatcagtgagtgcatattatgtgtgttctttttgtgattgggttacctcactcaggatgatatcatccagatacccaattgcctaagaatttcataaattcattcttttaatagctgagtagtactccattgtgtaaaagtaccacattttttgtatccattcctgtattgagggacatctgggttctttccacttctggctattataaatgaggctacaatgaagatagttgccagggactctggtggagtcagcttgacaaagcgaaagctgggaagctgattcatgaagcaaagagtttcaaggaaactcccttcccgggggcttggcattttctccctaatctatataaaccataaaattaattttccattcccacattagtctagtgtatagatccacgtgcactctatatagtattaccttatagtaaatgccttttaagattgtattctaacatagctaaagcctttttccagtgttcttagattccagatagcagcaaggagcttaacctattcagttaacaattaagcacttgccattttactcagctgtttacagatagagactaaaagcctcactgagatagaaatcttttactacaggctacttccatgtcaagtataagttgatatactaccctgataaggggaaactctccagacaagataagttttattagacctaagaatttagagctctgtgatagcgcattactcttaaggcctgtcaagagttaacaaccccctgatgcttttaacattaaagtgtgaaattcttgcctggcattaggctgatcctaggcagggcttgttatccctaatgtaaacatttaactagtccctgtaaattcctttctgctgtaactggtgaatttcagtgtatcttgtctttttgtgatttgtatcctctgataattcgttgttatataagtctgaagctcaaccagaacaatacattcagattcaacacatttctcctgtaatctgtctgtcattttcatccggaatctttgtccatctgcctaagaaatcccgttcttcacagaccagggacccagattgtctgtggcagttggtgccttcgaacagggacaactgggcagattagtcttttcttttcttttctttttttctttctattctttattttctcaggcaaagataggacctcgtcaaccgcgctgcagacgggctgatacgtatatcagttaagaaacgagtaagtttttatcatggggcagtcaaaatcaatagggaatattaaagcatgtgtagatgcctcactggctgtaatgcaggaattagcttacgccacagcaaggaaagggaagaaattcggcgctacgtgtggaattacatgtttcggttgcaagaaaccggggcacctgagaaaagattgtaaaaatctctcaggagacaagaagagcattcctttgggtccctcccagtgttgtgacaagcactggagaagtgaatgtaaatcaaagtcccataaggatgggactcagctcactagagaagctggaaagacaaagaactatagaactgcatgtttcggttgtgaaaaaccggggcacctgagtaaggattgtaaaaatccctcggggaaacaagaagggcctttctccaggtctctgtccaggctgcggtggaaacgttgggggaatgattgcagatctaagtcccataaggatgggactctgctcactaagaagcaggtaaggcgaaaaactaaaggggcagtctcttagccccgttcagaaactgtggagctcattataggacacagctccagttataagaaaaacttcaagttgtgaattctgatactttaggctaaattaaaagttatggttaaattatggtcaaagtataaaaagagacttcttcttactgttaccttatttacaatttcccaatcctacattgtgctaaaaatccgtagaaaaggctctattgaaagttaagtaatctcctaaaacatacataattcattccataaatggtatttttgttggttgcagaaaatagcattttttgcaggtgactataaaatatatgactaagtgtggactgatgatggcttcaaaaagattcagtatggtaaacttttaggctatttgagacattttagtgtatagagattgtgtgttttctcaaaaatttgccctcagattaaataaattagaagtttggatgcttgccagagctgttagaaaattttggattttaatcttgatttgacaacctgtctcttacaagcaggaaaagaaaggaagggataaaagaaaatagattttagaattctcccagggacagagagaaatcgggggacgccctgtttcattctctctggcccctacaggagaaattctttaccccctatatgtattgtctaatgtcaattcatgtatatctcttttgtttcattgtctgaatgattgtgtcgttgtctgaatgactgttttatgtttcatgttgaaaaaataaaacaaaaataatgggtaaaactttacctgctgattcactctcagtttgcacaaaggaggctgaaaaagagccttcactatagccataaatcaagcactgcaagagaggccctactagaaactgtttttaaagaaaaggaatctgcaacctcttagttctaaggcaaataagctgatagttgttttttcctaaaactttctctgcaagtttgtgatcattgtgtttagcaaataacaaattgcttttttatcttacaagtatagctataaaaggtaaaactctttaattgatctaaatctataagattcatgtagccacttcatttggtttttgattggtcttaaaggtataaatatgatctaacatgtcttggtcatagagaattggtttataagttatttgggtataattaaaaagatgtaacactggttacaaagttaacttagaagtagtaactcagagatagagtcattttcaaacaaaagcacctgacataaatcagcccagaaaactagtcctctaaagatacttctaaattgagataacattttatgtaattcttatcctaaaagatagacttataaagataagattttaaaacaatgtctctttaatgaaacattaaaatttaaactgtcatacattaatgaaaatttcgtaacgtggtagtgatgtttttagtattgattttaaggagaataaattgtttaaaattgggtcttacttaccaaaagttatagatatgttctaatattgcaacaaaaacttaaaaattctggttaaaattgccagtgtcccattgactgcagtttgcagtttaatcaaaagcttaagacttttaactcacccataattaagattattactaaaataatcaacttataagagtgctaatgctgctcacttgggacattcagccatacaaaacaaagtaaaattaactagatatattcatctttgtgcagaaattagaccctcacacaatcagtttgactatggctgtggccttgtaggaccataaaaggtcataaaagaaaatgtttaaggtataagtcatcttaagaaagattgtccaaaatcagaggcatggacaaacagttaaattgctcctttagaatctgtcctcattgcaggagggcaagatgctcaaattaaaaaatatatacatttgggttaatacaaagcttaaagcagcctcagagaagcttgtgcaaagtttcttgcgttttacagactgcgcctagaaaagttcttgaaacttcaccctccctgccttcagggagaatttcttttagctaaacaacattttttctttccagatctacccaggtgttgttcatgattaagtctaaactcaagatttataaaaagtcaatcaggctataaaacttataaaggcattacaaaataacttgcctacttcatgtaaaattattatagatttaaaagtctattttttccatttataaagagtttacttctagtgaactggtgaccattaaaggttttttacccctaggtatggctaacatagtcttatattatgtaagaaattttcattgtccaggcttcaatacaagaagcaaaaaagtttaaatctttcagtatatattgtttcctaagtggaaagtattttattaactaatgtctctaaagagaagtttaaagttctggaaaatagttgttgcttcataagattcagaggcaatgtctttttttaatatctagagttttagttatattggaaaattggtacaaatttgcttcaaaattttattttcaaaaagcttccaggagatgttaattgactaagacctcaccttaaattcaccacaagagaacctaagcctttattaggtactatcaagtgagattcaaattaactggagagaactaaaaaggctttaacagaaagtagagaaaacttctataatatattgatatcgattgtaattgatggcaatcaaatattagctacatattctagttattgttattaaatgtgtccacagctattttttgacaagaaaaaacattaatgtaaaaatcatctttcttcacctcaaagttttaacatcctattatatataaggctgctgtggtactaattaagaattaaaaattcttttttccaaacagctattagttattacaaaatattgatatttgacctattgcataccatcattttaaataaaattaatattcatcttaaaaataagctaattgcttattatacatacttttgtaaatccatacatacatgcatcccatttactgtatttaaaaacaacctttctatggaaagaaaaatatatgtaaattagatcacatgtttattcttttgagtttctgcctacttcagcacagataattaaattatgtgctgtagatagtgttttaaaatgttaaagattgcctggtaaaaacctcttaaggcaatgccacgctagatttctatcccaggtaaattatagatcttataaaaaaaaaataaatgccatataatctcattctttacatcatcaaaatagtaatgcttgagataataatttggtatttaaaataaataaataaattaattaattaatgtgcatgtcatattgtaaagatttgatctcagtgtcctcagtttctacctgttacacacattggtattaattcttgaggacgtatacttaatcaattattacaaatagatactttttaattttacaaaaataaatcatgcacatgtgactattgatacctttttaatctttctacttacaactgctctaataaaaatagcaactaaaagtatagttgcctatgttgatttttttacttggtgttccaaatcaattaaaactggctattatagccaagcatttgagatgttttatcaacaatttaatgttatccatgttactgagatttttattattcccaaggaaacagtactgtggaaccttaaatctatatcttttaaaaatttagatgtcaaaaatctctctaagtgtctatggcaccctacaatcagacatactcatgagataaagggatccacttattggcacatggtatgatcctgttcagatacttaatatgggggaaagggggcaatatttctgttttttccacagaatgctacaagagcgtgctagctcccaaaatgattcatgtgacaggctgacctgtgagttcctgagtgccctgacagtggtgaccagaaagctgtattgagtgcacagagaaaaaagaaatcagtcactcacaagcaaaataaagaaactcttcctatctccgccatggactacaacaaggagagcagacctggtgtcaacttggagacaactaaaagagctgactcgtgaggtggaaggactgctacagagtattggacaagatttcatcagagactgtttttggccattcaggccaactcccctatagctgtaaaagcttgtgtaccttacctgtatgcttattgttagataattttaagagttaagatcaccaatcttaacaagtctttttatatacattgtaattcctgtcaattaactaattgtgtagatcctaatttaaataaggaatctactgttatgattttgttaaaaagattctgcttatgttttactgtctgtagagttaggaaacgatccttggtttgaaaattcaagattacaagctttaaaaagactaaatgaacttattagacctaagagatttgtagcagctttgatcctgaaaattactgctttaattgctattttaacttcctttacgttatccaccacagccttagtacagcaacaacatactgctcactttgttaatgacatgcataagaatatctctgtagctttgtcagagctgtattttatagatacaacgccacgactaactggaaaaagacaaaaactcatttacagggtatatggaaagatactgatatttctcatgacttaaaacagttaaaggtaaaaatttcagatattagtaaaagccatctggacacttggaacattgatgaattggctagagatttaaagaacaacttaagtacattaaaccctctggattgggttcaatatattatcctacttgttattatttttggcattactttattagtaatcattgtgtttccactcatctttagagtgctcctgagatctgtagctacgacgaagcgggacatcctggaacttcggctgagaaataaagataaattatcaattattaaaaaaaaaaagggtggaatgccagggactctggtggagtcagcttgacaaagcgaaagctgggaagctgattcatgaagcaaagagtttcaaggaaactcccttcccgggggcttggcattttctccctaatctatataaaccataaaattaattttccattcccacattagtctagtgtatagatccacgtgcactctatatagtattaccttatagtaaatgccttttaagattgtattctaacatagctaaagcctttttccagtgttcttagattccagatagcagcaaggagcttaacctattcagttaacaattaagcacttgccattttactcagctgtttacagatagagactaaaagcctcactgagatagaaatcttttactacaggctacttccatgtcaagtataagttgatatactaccctgataaggggaaactctccagacaagataagttttattagacctaagaatttagagctctgtgatagcgcattactcttaaggcctgtcaagagttaacaaccccctgatgcttttaacattaaagtgtgaaattcttgcctggcattaggctgatcctaggcagggcttgttatccctaatgtaaacatttaactagtccctgtaaattcctttctgctgtaactggtgaatttcagtgtatcttgtctttttgtgatttgtatcctctgataattcgttgttatataagtctgaagctcaaccagaacaatacattcagattcaacacatttctcctgtaatctgtctgtcattttcatccggaatctttgtccatctgcctaagaaatcccgttcttcacagaccagggacccagattgtctgtggcagatagtggagcatgtgtccttattacaagttggaacaacttctgggtatatgcccaggagaggtgttgctggatcttcaggtagtactatgtccaattttctgaggaaccaccagactgacttccagagtggttatacaagcttgcaatcctcttattcttttgaatttgatttgccaatgaatgtacagtgcccttttttctacctgcttttggagtgtcaataaaagactgggcaagaaggcgagagagcctgagaagagcaggtggagagcgagtgagtgaaggaagaatgcatgtggagtgtgtgtgtgtgtgtgtgtgtgtgtgtgtgtgtgtgtgtgtgtatgtgtgtgtgatgcgtatgaggcatgtgttgaggcatgtgtgaggcatgtggtgtgtgcgtgtgtgtgtgtgaggctagtgtgaggcatgtaagacatgtgtgaggcgtgtgtgtgaggcctgtgaggtatgtgtgtgaggcgtgtgtggtgtgtctgtgaagctagtgtgaggcatgtgagagatgtgtgagaggcatgtgtgaggcgttggaggtatgtgtgtgtgtgtgaggctagtgtgaggcatgtgaaacatgtgtgagacgtgtttgtgaggctcgtgcgaggagcatgtgaggcgtgtgtgtgaaaagcacacaggagaaagcagagagcgcagccttgagctgtgagcaaggcagtgaggagtgcagagagtgagagagaaactctaagccttgaaaagccgcctgtcagcttgcatacaaaaaaagcagtctgtgtctgtttattacgtgcctcccagatagccccacttccaggtgagaactccgatcccgagccgaggctagactcctccactgttcaggatcacgagtctggctccaggttagaaattcatttcacagcctcttagagatcctcggtctttgttttctctctgtggacaccggaagtcatttataaaccgaggaagaaactttatttccaggtttccgcgagacagaggttgaactttattaattatcaacaacaataattaaaataaaagctgtgacgcggtttctgcttccggccttccaccacagtttggcgcggtgaatggggaggagtttggtgggggctgcggcgctcactcgcggcttcccaggaaacgtgggttttctttctcatctcttctaaagtttaagtaaaatcttcatttcttccaaaaaagaaaaatacttgagacaggactttaaacccgcctccggcgagtgagcatgcgcagattccctatctgttcctgtcccctcaggcggccatgacgccaaaaggtcaaatgtaagaactgagaacaggtagcttagcggttaagggcacaaacggttctcccaaaggtcatgagtttgaattccagcaggtgctgtcatattttgtaccttcttttggtggctggacagatgactccgtgtcatagaatctggctccctcttgtggccttcaggtgtaaaagcaggcagtactctgtatacttaataaataaataaatctttaaaagaaagaagaaaagaaaattccttatggaagtttcttatagatttgggagtgatgactggatgagcgatcctgcttccatttctccttccaggcgtcttcaagagctgagggtctgctctcagggccactcagagggagacagagacgctgcatttataggattggaagggaagcaaggtcaggagctgtaatgggaagagctcatcactggtgggcaaccttcccgagatgggaactggaagtagcagcgccacaccagcgctgccagcacctgccgcaactaggatcatgggggtccaggtgcagggacagagcactcatgtacgttcgcgcgtgtggcggggcgggggtctgtgggacaggcagggaggcggggcagaacggtgagggcggcgaccctgagcgctcagcaggatcccagcaaaaggcatggccatttggagagcataggggtcatgcggggtcacacccatgtctctgttttccctcaggtctgtcctgccagtgccagggctctcccctcaacaccctcccacctctctcttccccctgggtcttgggtcacacagctgtcttgggggcggggcgagggggcagggctggagggtggccagagttcacccaaggtctcctgaatggcatggtgatcccaatccctggcagctgtaaccaatagccacctatgtgatcccttacctatacttggaccccaactttagacct

SEQ ID NO: 219 - DNA, 40563 bp, Mus musculus
tttttaacatttttatttgggagttgggggagtgccatggaatgcttatgtagaggtcagaggccaattaatagaagtggatgctttccttctaccatgtgggcattgaactccgtttatcaggcttgacagcaagcatctttccctgctgatactgatggttttaaaacatcatccttgagtttgcaagcagaagacttctcagctccaggtttgacctcagagttcccagctgagcacttcacatcagctttgctgtagggaacagaaatcatactcccagtgcccggctgcaagaaccactttcaaactctggagtagtttgaaaactctaggggtgtggctcagtgggaaatgcttgttgcccaaagaggaaatcaagccccttgctggcactgcagctgtatgtcacagctgtatttttagtgggtatgctccggtctcacccaaactgaatccaatcaaaggtcttagtggggaaaagcacaggctttggctctgggtggacctggagccagaatcctggccgtaccctcacgccattaccttctgcctctctctgcctccgctcttcagtctgtaaattggaagtcggtctcagctgtgggcaacctctgattgagagacagtctacataaagcaactgcctgtatctgtcccacaacaggctcagtgaatgtctgttctcttcatttgatacccctctgatcccagaccttattctttgctatgcgaactgtcctagggaaaccagcatggatacttgctgtcctgggaatacatagttctgagaagtttttccatccagggagttgctaggttcctaagtcggcatagcagagagttcagccttgctacataggaacatgtgacatggcgcatggtggacactgacccgagatctcagcagcagaccagagcatacaggaggaaatggtgcctttgcaatctagctacggagatcattgcttccggccagcaactgcctggtctgcagagctctcctgttctctgcagccccagactgtgtgactatagagccatgggaactgcctgtgttggggccttactcagacccacaggcagacaacaggggctctggtaagtgacctagtgatgtgtaaagggcccatgtccctggctggtcatcgaaggatggttccttggtagctgtgcctgaacatacagaggattgaggtggggggatgggactccttccagggttgtgctggcgcttcctgacctggcatatgaagtttgttcaaaggtagaacagttttcgccatctttcagtgcaagttggttcacattcctgacacactttaaagagaaataatgtgtgtacacaggggtgagtcaacattgcgtgcagccagccgtggccactgggagaagagtcagccacggagctgcgagctcacctgcctcccactgaggcaagccctgtgcaggaactaccagggagccagctgggcaggtccaggctccctccagtgcttagcagcctcctggcccagcctgtatgcgtttctcaggcccattctctcttcaaccattcttcccctgattataaaaactataggaaacacatgtaagacggtggaaagcaaatagcaaaaggatctcctataacccaacctacccagaggcaaacgtgcttaacatttgtcttacgtttttattatttgttaattcatattgttttaattatgtgtgtgtcccaccccccacccctccacacaagcacacattttcatgttccaaggtattctcagaagaccagaacccctgaaagtatagttacggacaattgcgagccaccatgtaggtactggagcgtggacatacgtcctgtggaaaagcagcctgtgctcccaatccctgagccatttgtagcctcagtcccgagttctgtttgcttacttacttctttatttatttatttatttatttaaaactttaggaagctgtcgggtgtggtggtgcacacttttaaaatcccagcactcgggaggcagaggcagttggttggttctctgtcagtttaaggccagtgagttccaggcaagccagggctgcatcgtgaggcctgcctttaaatataactaaaagacttgggaatttctgttcccaccctcaggtgtggatgaccattggatgtgagagacatggccttcattggagccacttcacctgccttttgagccccaggcagatagtctcagtgaagtggggtacacatacccacccatgtgctctgactccccgtccaaggctcctgtgcacctcacacgtcagcagtcatcttcagtgcagaggttcccggccagaggctgatatggtaccgcccgcctcaagactgctcctcacaccacttgtcttctcatctgagaagtgtggggagtgtatgtgtgtctgctcagatatctgtctgtcctcactctccatcatgttgaggctgagccagactacctggcccatgagttgtcctccattctcctagctctgtctcccctttcttcctgtaggaattgcaaatgtgtgcagcttcttacccgggctctgggagcccaaaccaagctcagaaccctacagtgtattatttgcatggcaaatgttcttcccactgagccatctccccagcacaaagatattctttctaaataaggtcacctctagagtctgcagctggacatgtatttgggaaggtgaatctgcagtaggtgaagctaccaaggtcgctgccactggggagatgacttcccccaggtcacaaagtgagaaagtaacaagaattggcattggaacccaggtcctctgcttatcgtgtgcctttaatttgttaagaacatgactgcagccccattgtgcttggttatgttgttatctgcctcgtaggaaatgagatttggtggctattaccctaagataccttggacatcctctcaccattgctcccttactgtaatattgacaatgacattgaagccattagtgcagatggaatcccttaggtgggagtcactcccttatattcatatggtcacattcacccaccgggcctgggtgacttgtctagagtaaccagaaaagttatgggggaattctggttgtaacattttgattcacaatctctattctaacttttaacatgtgtgttgtcattgatattacaaattataaacatagcttgattgtcctagtgactatgctgtgttaattcaccacaaagtgcttagtacatccgtcactgtttaacagtgcctggtaatttcccgtgttcaattcagcaaccccaaacccaaccccataaacatggccacacgtggcacactggtccatgagcctttgaccagcaacccgccctttctcacagcagttataaggacctgtgcaaagcaagaagatgcgccaccaacatacccggcagtcagtgttagtgctggtgttcctttaccatgctggtgcttggggggttgctttgttttgttttatattgtgtttttcttttcttttctctcagttcacttccaaagctggaagactagatcttttcaaaataacctaatggccatagcccaaacctcacaatcaagtggctgtgcatgggattagcttggctcactaattgtcatagatcattaaaaataatctgagtaaaaatatgtgtatgtcatacatacattcacgagtcgtggcagatctctggagtccaggcccctttgctgtgtagcacatctgtctgtgtgtggatcatgcagtcatttgtcacagaggtaggtgctgagaaatttgttcattgtctggaagtttgttctttgaatatcctaaccctactttctggtacaagtcaaaatagcacacacaagccactcactggtgttgccccccccccccaccaccttttttgtttggttggttagtcgatcggttggttgggttttgtttgttgtatggcaggattttgatatgtggcgcagagaggcctggagttcacagtgaccactggcttcagcctctcaagtaccaggattacaggcacgagctctgatatctcttggaattaggggatacagtaaacacaagctatgggaggctgctgcttgaggaacccaataactattatatagtcaacttctttttaataaatagaagtatgctctctaaagtagcaatgatatataaactaataacagctgctcattatcactaccaagtatactgcacacaattaacagttgtccttccttgaagtatcttcattgtacatggtactgggttatagaaggacattgcagtacatgcatataatatacttagacaggctttgttctgtagcctaggctgtccaggaagtcatggcagccctcttacttcagcctcctgagtgctggagctacaggcatgagccctgctcgaatcatgcttctgggtgactgaaagcatggggctgggggctaggggggctgtgcttttaccgacatcccacagacctgtccgtgatgcgttgccctgggataatggctgtgtgtcacttgatgatgggctgtccaattccgttaactcgtggaacaccatcttctacgttgtgtggcgggtgaatggagtttctttgggagccagcctaaaggatcaagaggagaagatgaaatctttacatcctctcaccctacctacccttctatcaggagccacgctggtataggtaacataccgctgacttgttaacggtatgcttggggacacagcacagctagtaaccagtcatattagtcacagtcctctgggggatagagccggtgggggttctatagatggacaggccaccctgagcttatgaaactcaggaacctgggaagagtggctagcacaggctgccaagctgggagctacagacactggaccaccccaggcctggtgctttccgaatctcagcatcaacccctaagtgcacagggagcaggggaggagcctgctttcccttcccggccacttaccatcttaccccttcctcctctttttaatcttagttctgtcttctgcctgtcttggccccggatgaccaggctctggcacttagtccagtggctccctactcaagtgactgtcacctttcccagatgaacatgatcactcagttcccagatctgttggagtgagcatgaccagtgaagtctgggctccttggaccctagaggaatccaagccccctaggaacttctgagctatccagagggccaagtgtgtaaacagcatggggacatggatggggatgatcggttggctccccagattagcctgggtccacacatgagcttcaaaccatccctaaacatcctgaaatcacttgcataatttttatatgcaaacataatttcccccagtgctagagaccaaaccccagagtctctgtagctcacatttattagccaggcatcctgccactgagccacatcccagcccttacaggtacatgtctgtctccccctcctctgtgtgtgggggaggtggagggttgaatgtagagcttcaagtaagctgggaaggcatcctacccctgagctgtaccctcagacccagttacaaattttaattggtaaatgcatagctttcaccagctctactccaaaagataaagttgccttctgcactgtcagactccggggctctgtgctcactgccccttgggtcattgcccagggtctccccgagcaggtcagacttgaacccaaccttagaaaatgagatttcgagaattatagcagaagaggcaacccgagagggaccatttcccaaatgaagaccaattaaagccagttaccctttgtctctctggctcagatgtaggtagctgcgtcttcccagagttctgtgaactcagctcctttcccccttacactatttccccattcctcagagcaaggcttgactcatatcagagtggacactaatcaatgtttgatggatttgagtcagatggaacagtgggcatgagagagtctgaaaacagcttcagcaccaggccctaaaccaacaccgttgctaagcggtgtaccctgagttttccaaatagcctgctctaggtgagcatttcctggctccctgaaacagtcctatctccataatgggacacaagcatcccctgtccaaaggagtgtcttgggctaatcaaacaacaatgctgacaagatggacagtttcctaagcgccagaagtgacctcatcctccaagggcttagcctcttcacccagcacctgctgattcctacgtgcctgcaaccctgctcacatcccactgtgggaggctcatcagactagggctgccccaggaaagggtctcagagcctccttagggcctcctcctagcaggatgagggaggctgtttcctctctgcagcatctcaggacaatggaaagcactgagagctccatcactgagcactcttgggttccctcacaccctgccctcggctccttagctgtgcctgtgttaagagactagatctattggtttgtgttctcctgagtgccatcaggtagacagggtgactcattgccgtgactacaatattgtaaggaacgtggactggtctcggggtgtgcaggcttttgaaaggcatcggttgaaggtaacatgtattttcaacacacattagggaagatggagttgatttttacatataacttttccacagcaggtgccactaaaagaagcgctatgggagctaatgggacaagctccacactaggaattaagagatgtgttccagatctgtcatttacagactccaaatgtgtcacttaagcttcccatgcttcaactcccctataaattaaggcaatacctgtaccacacccggggtcattgtgatggtcagaatgtatggcgctgcctccagtggtgaaaggtgaacttacttggcactgttaccatcaacacaggtactgttgtcatagcctgcagtgctgggaatcaaacccagggcctcccacatgctatgccaagactctgccactgagccataccccgtggtattaacatgcctgcagacacacccattctgtgtggcaccctcatgtgccaggtgctttcttttaaccagcacaatccttgccgcagctctgaggctctggtccttttgcgctctgcagggtgaggattccgaggctcttgccttgagttaggcagctagtacagctgaatgagtgtcctagccaaggtcagtttccagcccccacaacctcatcccataggaggctgaggtcgctaatgcaagaccagcctgggctacccagtaagagccggtctcaaagataccaaagagtacacgctgctgtggcttttaccctctgtggactgggccctctctcccaacccttctcgctataactttttttctgaatttttttttcttttcccctgcttgacttcagtcctcttgtccctacttctagctcccttccctgacttgcaaacacagcatgtgtgaacacccttctagaggcaggcaccctgcgcttgtgacaggagagtgggtcactccttgcctaggcttccaagctctgaacggaagctaggtaaacagagaaagaatggccaccttttcttctgctgttactaagtgtagatgccccaggttgactctcggatcttctcactagagcatagaggagctcagcttcctcaggagagccttgttgagtgttttcgttccttgagacaggagtagagagtacttctcctgtcagtcccaaagagtcatggctgccacctcagacgtggatgaagcagctagtggagtaggactacatctgcaagcttaatctcttgaggacacactcctgggagctgttgctaacactggagtgtcagctggggccttggctcctgctagtgcatagctgtagttcagcttaggctctttgaggatccagtgacactcattcccaaccacccaagtccagtgcgtggttcctcagccccccattccaaccctgcccagtggagggcagctctgcatgttaagggcccacctgataagctgagcgcaagtaccacaccctcgagtcaggctccttcctgaggaggtttatcggtagatgctgtccactctccctgtgccaggaatctacctcacaattaggtgagaaataaatcaaagccaaagttgcctgatgaaattcaggagccagcagtgacccttgccacacatataaatccccacgggccggccaagggcctttgtctggtcagagagttcaggattatcaggcccactttgctgatgtttggaggcaccggctgtcggagtgtttactaacggttatcacctccatgcttcggccgttatcacaggcagggccgcccgccggggccgaggctcgcaccctctctattaccacctgtcagtggccgcgagtgtgtgctgacactgcccagtcctgcccggcaaggaaagatagtttctgacggctgatcaaagagaagaaacaagacctgataaagagtgtgcgtttcgtgtacttttaactttggggaaacatcggcatttgcatttttttctggtcttcctggtgctggcaggaaccaagctcaataaatgtagtggattcagttacctaatcgctagggaaatggtatgtgcttaaagcagcagaccatgaccataatctctttccaagagagactggatgaaataagatttctcagtgaacttgccgtagaataaagtcaaatcatttcaattcagtctttgaagtgatcttgcacgtaacatctaatcttggcatccagcggaacgccgtgtactttctgggacttgggaaccaggtttggattaaggaaggatccttgttgaagatgctatcacccagctgtatcgctcacatccttgaaacggtatcccggatatgcctatgtccctgacggctaggagccaagctgcagtgaagcagaacgagttccagacctaggcatcagcacatctgcgtcctggcaccaggtctgtcatggcctgctgtttatgctaagcccttgacctctctaagcctcacctgtaaatgaggctggggataggttataaaggacagtggcttaggaaggcttttgcttttaagttagtctgtgcaaacatccccttcattattgatcttgatagtggtggtagtggggtgtgtgtgtgtgtgtgtgtgtgtgtgtgtgtgtgtgtgtgtacacgcttacatctatttcacaggacagtcgttaccttccactttgcatgatatagagtgtctttgttgctcactatgttagccagcccacaagtttctaggaactctcctgtctctgcctcttgtctcaccgtaggagtcctgagattaaaggtgcttgctctactgcacccagccctacccaagttctggagatccaaacctaggtacttacacttgagttcaagggctctagccactgagccatcctcccaggccttcttttattttagacagtgtctaaagtgtcatagagtatcagagtctagcctaaacctcactgtagagctgaagatgaccttggacttctgatcctctggcctcagcctcccaagtgctggtgtgccaccaggtctccatatctgaatttggcgggggaaactgtatgacctcatgcatgctaggagagcattccttgagctgagctacatctctcgcctgtaacctgtaaccattcagggttgtaaatggagagcgatcgggtcagagaaaagcagggttgtttgggttgaaccggggagggttcctttcctctgccttagctttcagtctctgactcccataactcctcagactgtgcagcagtcggcccgtgtgtactctgatccgctgtcacaggctgttggacttcacatacgcattcctgtgatatagcagtcagccttacacgtgtactctctgatgtagcagtcagccctacgcgtgtactctcagatcatacacattcctgtgcctggggaacacacccctcattcttctggtggaaagacttagtggccctggacatgacaggacacaagggtgggtagacagagaacagcctgccctctgaaggtacagactcaacatcgtctgtcctgcctgtatcacaggtacctttgaccggagcgtgaccctgctggaggtgtgtgggagctggcctgagggcttcgggctgcggcatatgtcctccatggagcactcagaggagggcctccgggaacggcttgcagatgccatggccgagtcaccaagccgagacgttgtgggatctggaacaggtaaaggcgtcaacagacttgtagcctgacttggttgtgactggagcctgttggcattgagctggaggggagaggacatctgttggtttttaaccatgtttccctggctaggcagcctgagtgctgcccattatagaaacctctgctactgggaaatcccagcagaaccccctctcctacctagagcagcatacatagatacctggggaaatacaactttaggcctggggctgtagctccacactggagtccacgcatggcatgcatggtccctaacaccacaagacagacagacagacaattgtacttgttagtcattcccaaaaccatctccaagggaaaaaagacctaagaagtagcatacctttccttcatgctccagtttccacagaccaggacctgccagcaagcaggcagagcaagctcaagtgcacacccacacccacacacacttttctttcatgtccctttaacccaggactagtacctgaaagtccagtaagtccaaagtggcttcctgcatccatatgctaattataagacatcctttgactggaagtgagctctaccccacctaagtgaatacacacacacacacacacacaccgtagtcatccatcactattcaactataatacaggattcttctgtccctcctatttctaaaacacctctccctccccccccccctctctctctctctccctctccctctctctctctctctctccccccttcccccctctccctccctctctcattactaatgctccatccctacattcacatccacctaacaggccctgtcccagtttgctggagtggatgggttccctgatttcaggccttctctctctcccctgagtccgctaagagcatcatctccactgtgacctgtcccatcctggccccactctactgtagaagagggtcctaataaagagaaatttagaatccttgggtgtgacatgcctgacattggtaatctgccctgctgttcggtgggttcttgagttcaacagtgagcctacacacgcgcgcatacacacacacacacacacacacacacacacacacacacacaccctctggtctagttcttctgttcctttactaagagaacagagtgtagcatctgtatagcctagtggctcctgcctagatagccatcggctcctgcagagtgcagtggatgggggagaggggttaagctagagatagggagcacttaccaggtcctggatgacagctatctcagaggcctagtctaccctaaacccatcttccctgcaagaaaaggagatgtggacctccaaagctacagcaaactgtaccccccccccccatcagacacactcatgcatagaccacctgcatcctcacaccctaaatgcatatcaaatttatcccaaggcctctgtcctccctctaatcccagaggtagcagctcatccccttcccagatatcaccctgggagctaacccagtaacagtgttatgtcagcacttctggtcagccatggttcccaagaactagagtctctgtcccagagctcccccaccaccaggagcctccctcttctagggactgggagctcctaggatgaccccgcctgccaccaccttcttcaaagtcttgtggacacctcagccgcgtctgtgggcagtttagcaggtaaatttagtcacaggcgcttcagcttctcagagagtaacctgattcatctgtcagacagctgagggacaggagtttgtgatcttaataactaggatgtgaaatttaaaagaatttaaagaaaaaaggcagaggaaattaaaagggcaggctaaaaaaaatagatttcccgcccctgcccccttatttattccagctaacttcccattgtcctcctcacatggtcaccaaaagggattcctttggttttccttggccatattagatgaatgtttggttggttggttggtttggtttagtttaacttgcctccatttttttaggtcagtaagcaaagcagataaaaactaactcattgcctcctctgtggctgacaagcaccaccccccttctttgctgatgtgtccacctggtacagcaaaggcaagacagtgcagtgcctgtagatgagaatttccagcgagtccctgtgcccatcacgcctctggtcttctttcaccccagctctgcttctcttggtgactcaccagcacacagatagggcagtcctgggtgcgtgcctctgttgggcagtctggcactagataagttgggcctcctgtgccttcccaggcaccttcgtgttgatgtatgtcatgtgactaaatttaccccttatcagcttgtgactgaggccatctcagagcttgctctccagacctctcacacagtggccctcctgtcgtgttaacactgtcaaggctgggttggcctgcactgggtatacaaactgcctaacacccagctctccacagggatgcaaagagcaaccctcccccaaacagacagcatcccgacttgtagatatcagcagtgtgaaaactcctattatcgttgtttattaaaagctatcagcatgtcagacaggtcactgggtgcctgaaagcataacagtcaacagtcgctggctccaggatctcccgaagagccataggacaaatgagctctcacaaaggaaaggaaagccctcctgtccaatgccgggaggtggagagctgttgatcaaggaagcaaaactttggttaaataggacaagtgcattgagggctgttgcaccatgtgttagccattgagaataataacatgccatgttcttaaaatggcgagtcaaatatgttaaatgtcctcaccagcaaaaaccaaggtaagtatgtaaggtaatgtgtgttaattagctctgtttagtcattccacaatgtctgtgtgttacaaaacatcatgctgtacataatgggaatatacttgttttattcaaatcattttctaaagtgctctgcagaaggcagtaccattcttgcccaggagctgatgaagtttgcaaagttggttgagggtgtagcctgtacaagtccttcagtttggtcttcagaactaaagagggaagaggagaaaggcagaacccagccctggtctatcagcatcgacacttgtcctttttcttccagtgctggggattgaacccagagcctcacacacaccaggcaagcactttaccactaagctataactccagcccagcagcggcatcttaacatgcatatattaatgtttgagaagatctgtttaaaatgtggtgaacatgaaatgcagatgtcagttcagccctctgtggtgactgctggccagttgatccgactagcttccacatgtgaattgcaagtccatctgtgatgtaattggccaaattgctttcttgctgatcgatcgcccagcgcccatcttacctgtcacctctgcatcatcctttccataatgtgccagcttgagggccatctagccctgctcttgttcgcttgggcctgcacagtggttccctgcccctgagctgagctgagcagttcatagtgtcccctcttccattctcagttggcacctgtctgctgcagacaccagtacctggaaaagaatcgtgcttatcacagatacagcatctgtctgcccactgtttcctgaggtctacatctacctagtgccagttgcttactaaggagggtctacacccacctgtatgccaactgactgaggtctgcctccacctgaatgctgtttactgaggtctgcacccagctaggtgccagttgcttactaatgggcatctatgcccacctaggttcctgaagctctacatagcccctccttgttaatggggtttctggcctttcccttcttgcagacacccccagcagctccctgatcctgtcactgctgtttgtttagtccaatactcagtctccaccttaacatcagccactttccttctgcagtgacactgtttcagcccgcccaccaccacccagctctcttcaaatcacactgtcagagaatggttatcatttgagaattttgtcaacttcctaccacccagatcctaactatccctcttgccaaagaggagcattctctgaccccagcccagcactgttccccctggagtcatcactggtcatcttgggggcctgtatctgggcctgtgagcccccacccttccagggctggctccatctttctccagctcctagctcttctgatgcctctgactgtcctttatcccttcccatcttccagaatgctgctaaaggcccttcccttctccttcagcacatgacaatctctgcttctgtggcttccaagccagcctctcacctgatttccataacagtctatccagtcacttgctggtaaacccacacttctgagagctaacccatggccttagctgttccttctctactccatgtatacaaagccatcctgactaggcgactctctccagacctatttccactgcctctgagctagtcaggctgggaccctggacacatgtaaggctctctgcatatccttttcctcctgtctggaatgttgtctccctgagccctcttccctctcaactgtctcccccaaaattactgaactaattcctgcttagcagacattccttttaatactgcctttacttcaaaaacatagcactctttttttttttttttttttttttttttgagacagagtttctctgtatagccctggctgtcctggaactcactttgtagacaaggctggcctcgaactcagaaatccacctgcctctgcctcccaagtgctgggattaaaggtgtgcgccaccacacccggcagcactctttaaatagacaaaatatggacttatcacaattgttttctgtctaggtaaatatataatttactactccctattaaagggggaatttaaataaacacctggatatatgtagagtacattttaaacttaagctcttctgatcactaattcaaaccctcgttctttcttgtcttctccaacacctaacatcagaagcccaagccacttgctctcgaggccaagaagggctgtctttgcctgtgatgttctagtctcctttccagtccctactaaattatcagtcaaggagaggcgccgtcttattccatccaccatcgccttaactctatccagaaatgccgaatctccacctgacactttctgctgtaaatacggatcacaccctgacccagtttgccaaacactcagtctttcacagtacagtgccccagatgtgcacgctaggcacactgctttgatttcatgatacttccctgaattaagatttgctacttgaaaaccaaggctgtagttggttctgctagatcctccaagttccctatctgtctatcagtgacccagcatccaagcctgaaaaactattttcagttaacgtttatttattgaaaggactggctcacccctcccccttcttaacatgagaagcatattttgagcatcacatagtttttcgatggttacaggaagtctcagtcagttcattaacaaatgtctgtgatttcccatgctttgcacacgatgattttaataagctgtgtgtgcacgtggagagcacgtgcttcactgctgaccttcgctctgggctgtgcacagtaacgtctcaaggatggccgctgaggctggagagacagcgcagtgcttcagaggcctggatactcctccagagaacccatgttcggatcccagcactcagacagagctcgcatatctgtgtctgttgctccagccccagaagatctgataccctcttcttctctctgcagatgacacactcacacacacgcacactcaccatgcacacataggacacactaacacacacgcacactcaccatgcacacataggtacacatgcaggcaaaacacccatactgggttttttaattagtaaataaaaatgaatgggagcttttgtgaggagatggttaagtgtctatactaattctagaacctctttgtgttgcagcccaatgctgccatgaagattggcaatcccagtaggccatgggcctcttgcttgtccccctgctgatgactagagatagtttcttatatttctgggaggagacagccccagcacatcacaaggtaccgcacaggtcgtgacaattacaagtactcagatagtgaactcatttgccaagccttcacaggacccgacgtgttgctttaccccattcaaagcagataattgggtcatcactggtcttcataaaacctagctactcgtgttggactttgtagacaatcagaaggtgaaggatttatagaaaaatgttggtgtgcatatctgtacatcccagaaggtactggccagaggatcagaagtacagggtcattctctgctacgtagtgagttcaaggcccatctgggctacatgagaccttgtcatgcttgtacaggtagagggctgcagagatgacttagtggttaacagcattcgctggttctgtataggacctacaacacgcacatggtgactcataaccatctgtaaatccaacatctctttctggcaactgtgtgcaccaggaatgtatgtggtacacatacatacaagcaggtaatattcatacacatggataaaaataaataaaatattttctttttaaatatattttctatttaaatattttaaataaaatattttctttttgtactcagaaaaagttacaactcgggagaatgctataccctggagcactctctccttgccagtggtgtaggagctagcagtatggtgtatgggtccctcgtgttccttttccaatgctgtggttcattctcttctcttttcctctctctcttctttttcattcttaaaagaagaaacagacattgggacttagagttcagaagtccccatgcctgatctcatgggtctgttgtttctagactgtggtgcggcagagcatcaggcagaatgagaatgctcaccttgtggtagacagaggcagggatgaccagtgctgggcctgtggagaaggctcagtggacaaagtgtttgttcatgcaaatgtgaggactaaagtgtaaatcccagaacctgtgtaaattccagatggcatggtggcatagccacagtttcagcactgggaaagagcatagacaaggagccctgaagcaggctccatattgagagacactgcctcaaaaactagatggacagtgaattagggaagactcttgatatcagccttgggcctccatgagcatgtgcacacacgtgtgcctaaacacaacaaacatgcacgcatgcacacatacataccaccctcatggaaacatgtaagagaagacagagacaacactgagatgatattagtgaaggttgggcccttctccagtcccaggttagccaacctatccttatcctgagcaggctcaagatacaaggccagggtggctccttctaccataggtcacatgcgctatctgccatgcatgaccaccaagaagctctgatcgatcaccccatataatcttcctgtcccctccttctccttagcccctcttcgtttcagtggttatctccaaagtacccaggaaaaggtttccatcttcaccctgttcgttaaagatattttaaatgactttatttattttttatttatgagtgaggtgcatgtagaagtactggacagcttgaagaagccagtctctccttccaccatgtgggtcctggaaactgaatgcaggttgttagacttgttggcagttgccttcacctactgagccatctctctgggcttctttctggtctcttgagaacgacagtatctctcctcccctgaccaccagtgtagtcaatgtatatggcccagtcttttcttacattctctctctcttacctctcttcctctcccttatccagatggaagagagtgatctatctaacccaccattctctaggctgggccttgctcccttaccaaggactctgagcatctctggtctcagtgcccactattgcctgttcctctcagtaacaggctccctggaagatgccattatcatcaagctaatttagtcaggtgtctgggccttctcctctgctttgtctgtatgtacccagggtttttccttgtatagcattcacacacacacacacacaaagaatggttttagtgtcttctctcaatggcctctttggtgtccccacacaccctctctgtggttgcaataggcaggctgactctctaagcatctgtcacatctcttacaagagtaggcgagaataggtaagccacaattcctttcttggaattgacaaaagccccaggggaggtgatggcactgagctgtggtcttttcctctctggcttctctccctagccacagggcgtgcatggtctttctagaacacttgtgtcttagtcagtcttctcactgctgtgacagaatacctgacagaagcaactaatggcaagaaggattgatctgggctcatggtctcatctcagcgggacagtgacaggagccttaggcagctgatcatgttacatctgtggaagcagagagtgggatgaagtgctggcactctgctccttcctcctttttattctttccggaaccccaggccatgggaaggatcccgcctcaactaaagctccctagaaacgccctgacagacatgccaggtggagtccaggcgatttcaaaactgccggctcataaacgtaatcaccgcgctgtcttagttttctgactgctatgagagattcgggagaacaaattaaagcaaaggttcatgttggctcatgatgtcagaggggtcagtccacgcttgctccggagtggatggtcgagaagcaacctcctgtcagacagagcagagtgagccacttgccaaagctagcaccacctccccagacagcacactggctggagaaccacatgcccagcgtgagagccttttgggacatttcacatgcaaaccacaacaggtccaataccttgattgctaagagtgagagaagaaatagcttccaaagaccagggcccctgcatagtgagggagcacaactgtggggttgtggagagctgcagcctcaagggtggccatgggtgttgctattagtgtccctgttcagtatcctagctcctgtccccagctcagtgtcctagctcctgtccccagcttagtgtcctagcgcctgcccccagttcagtgtcctagcgcctgtccccagctattttccagcaggagcaaagaccaagccttgagtcccttcagcttccagtgccaattgctactgctgggaaaagtcagtttctcttctgacaagatttggattcaagaaatagaggaaagcatgtggcccccgggcctttccttctcctctgctagtaggagtgaaacaggaaatccagagcacgtgcttcctctcatactgtgcacgccctgaacactgcacacagtagtctttatcaccctcactctgaacaggagaatggatccttaaggactcctgtgctggagactccacctgctgtggcagtgtcctctcagcaccttctacctggctgtgagatattcttcccttcagcttccgaagcaagagatgacatgcttgaaataacttttaaaaagaattaagacaggcactaaagggggtggggatggagctccctatagagctggtccacactgcacagggttctgagtccagtctccagcatcgccaaaagaaacattattgctcaaataggagtaccgaatgctgaccatcttgctagcctcacctactcagaatgtgacctgccttttattcaaaacagggactcccatagaggaaggggaccccatccccagggaggccgaggtcacttccctacttagaaatgctaactgccttcatagcccaacccaggcttttaccatgttggggttttttttcaatgtctgtggcctctcctgcctgacccaccttccccatcccacttcagatcccaccacctcctgtgtaagcatgtgactccagcttcccaaccctgccagcacgctggaccaccctaaagccgaccactctctgggcaaggtcatttctccagaccacattcatagtgtcctctgtgactcaacttcctcgctcacatagtgttcctgagccaactgcatctaggatgcttggccccaggcaaggatcttactttcccattaacgagccacggctgacatccttctcatgccacttagggaagggccagctccgtgggtccttcagctcctccctcatccatagccgagagtgcatcttgacccagttcttgttccttggacccaacctgattcctctttgttaccttcagccatcagttctccttgcccagcatccagccctgggatgaatgccaagctgaacctcagttaatgtttgttgaatgactgattgggtttttgtggcctctgagaggtaaatgaaaggcagccagagccatgggaataatttccatgcttaaaaggcatacttcttagttccaggccaagacttggatccagctccagctaggttgttttctctgcccctctcctctgccccctccggagctgcatccagaggaggaaccacagtagacacccaggctaatacatttttttccatgcatgcccattgcataacatgctgattcttgtccacaatgaggaagtgctggtgtggcctctttggtgactctttggcataccctttacacgggctgcccaagtaaagcgactgtggagcatgtgcgggcttgagcagagggtagcgggctgcaggacagttgccaggggccttccctagatcattacaatgggtaaatggttaacccaagggaggattctccttggtgcctcctcctctgccagacttcacctttaatcaccggcccttgtgtaaggtgtgaggcccagcaaagcggcgcaccagcacacggtggcttaggtgcccagcttctcagatggcaaggagctgtgggctacaaaacaggtacacccacaggaaagaaaggttagacatggcccttggttacactaaatatgagacattgtggattgcccatagcaaagacagcgatgcgtctccagccttggctgattttgttgctgcttgctcttcctgtacgaccctggccccaggaacttggaggtcccactgcctgagacaacttaagtctgctggctgaatcctccagcagttctcatagctgtctccttcctcatccccacatatgtcctcttattgtagctaagtagctctgtaattaatcaagtttggagagactggccttccaattgcttcattcattcaggacgactttttccattctttcccctcacctcccctgtgcccattatattggcacattccctgtgtctctaggcctccctggccaggaccagcatatcatttccactctgtgtacgactgtgtggtgttggctttagggtggctgggggagtgtgaaccaagcctctggggccacacctccatggagcttggactggtcctcagaagtctaagagcttctttgtttagtcatccacagccactaagaactgatgttagggatatcaggctagctctgagcatatctccacaaagcaaagcagccctgcacattgtcaagcagctttggacttcaggcctggggtctaaatccgtagaaccattaaagaaaatccaaggagctaccccaacatgagcctacatcctcgtccttccctccccacccccaatagcaggcaggaatagaggaactcagtccgtggagactggggaggaagaaggaagagatggtgattgctagctttggctaatgaaaatctagatgtgctggaccttggaacacaccccagaattctcccctacaaatatgagtggtcaaaccagatttgatatctactcagttcgatctcagctattgttggactcttagaaggtccgttgtctgatgctctttaaagaattattttatttccaatgcagacacagcccttgacgtagcagtcaaaaacagcacccccgagagacccatggctgtgaagtgtttgggtatgtaacttcctgtctttgcctacacagaaagaaggcttggtcccactgctcccattcccctcacgtgggtgtcctctgcccccagagctcaggcctcagaaagcacggaaagtcagttaggacaggaggtctcttctgcaggggactggggtggggagtggtggctatctttcacccaacaagagtttctttgagagtgccactccctgccccccactctgaagatgcaagtcaaattttgggactctgctgtgcagagcagagaggtcactgggctctaatgcatttaccattgactgcccctcttgtagtgcgtctattagtgagtaatttgatttgtacctattcatttgcagtccctgcaggagcctggagctggcccctagtataattggtgctgtctctatttttacatcattagattagccccgactcctggccacttgttgtctgcgcttgtctgtccatttatacaacctaatgtaacacaaaattcattactgatcacattactttcaactctgaagccagccttgtgataaacatttggttaaccccttcctacccacaggagggctggcagaacaaatgcacttctgctcgacaggcaaatcaatatcttaatacaccaaagtggaattgcatttctagatttgttatccctcctggaggagcaaatggaaaggctcaaagtccgagccagctgaattgaataatgaatagggcccggcaccagcagcctgtctgtgagatcaacacagaggcagagggagccataccagcccagcctgggctgcagtcagggaagggtggcaccaccgcagttacatgagaccccacccccacccccacccccacccacccccactcaccatggcacaggcgcacaggctctacagtacagcctgagaccctaacagaggccacagaggcctcatcctgatgtgtatcttttgtcagacttagcataggactgcaggacagggaatttggtcagtttccttaaaactttattcatcagtgaaaaggctagcaaacatggggccctaacctaaatgccaccaaaaagttaaatcgactctcacaaaaacattgagattgatgggttcctacccaggtgtttgtgtagccgcccatcctccagggaagtgctgtccagcccactgactgagtggtcctggtcacttgtgagtgcttagtgagacttaaaggacctcgacagagctttgtttttaaatccagagggttctgcatggcccttgtcatcctctcctcaactcctgcttgtctctgggttgcacccacacccacaagtcattaactcacaggacagtttgtttcaaaggggaaacaaaatacctctgcttattaagaaacactcataaagcctgcaccataatgattcgaaatatcggcacggaggaaatagaatggaagccattaccatgaaagccataaatccctgagtaaaaagatgctgtaaaccgaagatgctcgggtgggcagggaggctggggaagtagctatcccaagagccttctgtttggctgtaaggaggtcctgaggggtgcctggaaggaagttgcctgaagctgtggaagggagctgggcagtctcctcaggctctgccgtccctgctgttccacactcttaggctctcctttcaggacatcaccctttgcctcatctgcagatggatgcctctgatgagggcatcgaaagctggagaaggggcactcactcaccaaacagcaatcttgagggacagagtgagggacaggtagtgtactaggaggcagcatgctcaccctgctttgggctctagggccagtcccagggtagggagagtctcttgtctcagcccctccctcagtcactgtcattagtactcccttagcacagtcttataggacacccagtttatcccatggacagagatgggcatcactgaagtaagtcagccttacagagtctgcctcctcaggcccagggaagagcctcacaagaggaatggtgacagtaacctcccccaacccaccagccccagtggacacttgcttggtctcagtctctggtttagtcctctcagataggtagacagcatggttgagggggaggagggtctcctgtaaatcatatacctaatgctgcccccagcctgtccattctacaaaatagaaagagaggccaaacacatacctgtagttcaaactactcaagaagccaaggcaggaggatcccttaaatgtaagggttcaagaccagcctttttaacatagtaagagcctgtgtgccaaaggaaggaaaagagaggagggagggagggagggagggagggagggaggaagggagggagggagggagggagggaaggaaggaaggagacagggagagaaggaagcatagagacaaacagatgagggtggggtaggcctttgccctctctgtttagggcaggatagtggcaggaaagagggtgagtctcttgatagaacaagaactgtgatttcttaggcctcatggaaagggggtaagccacatcttagcaaactcttccgctgcgtcgtagagaatttaattacgcttgaacatctgaatgagaaccagatgtggctctggcccccaccggtcaatagcatctctcctgtggtctgcaggctctgctatctcataaggctggagactaacttgtgatataccctgactggggcttaagataggtcttgcagccctgtgtcttctttaggactgtgtgaaatgggacccacatgcccagctcacaagactcatcccagccccttgttagtgcctacatgaagaggttgtgccatagcaccaggcctggcattctccatctccaaagaggtatctgccatgctgctcaactctgagtcagccttaaacagcaccaggatctagtgttccccctgtgaggtgtctactctaggtccttcagcccactgaagttcccaggcatttaaggggtactctctgatgaaggcccctagcaccctattgcctgacagccttacatagcccatggcatcttccctccctccctcccctcatggtctgctgatgaaaatggcttgcccaggttactgagcactctctgatgtcctagggccagaacaatgaccctcttacaccccttttcctcatggctttctgtatggagctcagtcagggccaactaaaacttagttttagccagtcatcaaacacctcagagaggaagtgtgagccaggtcaactccatgttttctgtcccttcacagattcttgtgactggatggatttggccttggtcaacatttagtgttattttaatatggtgggtgctgagagggtcaccaagtgctgagtgatgtagcatgttgctggttgttttgccttgtccttggaagctaagacttagggaggttctgatgctgtgggtttcctgggaatcagtttctgaaagttcatacttgatagttcaagactatgactgcctgggtgggtaggctccagcccccagcccgaccagcggttctcatgacacgtcaaaagctgtgtagatgtggggccatgctgtaatcagctctgcctggaacttcagagccctgccctcaccacacacatacacacataaggatacacatgtgcatgcacagacacatttagtcagctctagcagagaggctagagaccgagtggccatggcacaggactctgcaagaggtctccttctgtgaactcctccccagcttctttattctcctacctctggtttcccatgcacatgtctcctgtcaccatgtgcctctcacatagacccactagggagggcttaaactgtctggtctgcctcaggccccaagccatggtgttggcaccaccctggcctgctgttgagaaccaagttctcaggggctctacgccaggtgtttgggttgaaggtaaagcccggctctgctgctccacctgtttccctgcgtactgaccaccactctcaaggtctaactgcttatgcaggagcatttaggttcttctaggcctgggtctctcctcactggtagctgaggctcttagtcaccctgcatggccctgtgaccaaggctccctgagctaaaaacacctgagatctgcctttaccactggcagctggcagctagggagtcaagataggccctagaaaaatagcctcattttctcatggtggaccctcattttgtccctttgtgtatctgagtcgggacaaaagctgagcagagagaagggcaagtgtgttgatggggtctggagggctgacctgtccaggaaggaggcttctgttgctccaggcagctgcactctgaaagcactcagggcgccaggcgtgtgtgtagtgtaagacaccagaagactggcgtcagccagccagggatctgggttcagacataggtgttaagccccagagataagagcaggccagagctagccctgcttttcatctccaaaccaggattcctgtgatgtgagtgggtggagccttttcagcctttgccttgcagcttctgagggcaagcctggcaaggtcccagaggccctgctggaggagcaaggtgactaaggtgactcctgtctctgtctccactagctttagcacccagtttttccagacctccccaggataggaagccctttgactactggcatccttacaagcttagaagcctgaggggagggaaggctggagagggcacagagggaaggtctagagagccaggcagccaaccctagagctgagaggtgtgctaaatgccaagggaggccatctctcccaggatgctccctttaactgcaggactttgaacctcctaagaaagggccccagaggctgaggctgcctccagcccagagtatggtggactctgatgatggtcacagtctcagggatctcagccaacaccatccatgtccccatgtccccatgtccccactgaacatgcccctacctcatcaccacactcagggaatggcctcatacaggccctgaccatgtctgccaggcccacccacctcccaggtgacatcagggccagctgcacaggtcttagccccaggaagcactcaagactctcatttatccctgtatctgtctgtgtttgtttctctgtgtttgtctgtctctctgtgtatctggttttccctccttctcccttccccctctcccccccccccattgtcccctcttcctttctgtactgttttgcccctgtgtgtaagcttcttattaataaaatggcttgcttggaccagacctcttctgaaccaatttactgaacttttcactgtcctgtggtcatctggtctcctcattatttttatcccttcaagggaaagtgctggtcaccctgactttttaatgagaggacacccccacccccacccatcacatacctgactccccacccaagaaccttcaagaagaaaggaactgaaaactgttttattctttacaaatctttcctatgttaggcactgggtaagacagggcatttggctggcttctctgtatccattcattgccctgagctcccaccaagccaaccccaagaaaggaggactgggaggtagatgcaggaggagagagaaatcaatgtgtgtcaacagggttggggatttattctccatcttgggagagggtgttttgaaagagggaaggcaggaaatgcaaagctgtgaacgggcatctgccaactgccctgggccatttcttgatttaaaagactctttgcccaggttgcaatggaggcagagctagtaggggcctgggtggcagggccacctgctggggaggaggctgcagagggcccctgaagtcctggagataatcacagtgactaattcgattgcaacaataatagtaactcacatttgctgactggaagctttgagcactctgggacgggctccccatgcattatttaatttcattcctacagccagactatgaaacagacatccttatcctcgtgctcaggaacccaaagcacccaggaagcaggtggccagagcctgtgttcttagcagcttgcctagactgcttgctccatcctacctgtcttctcaggttgaattctgagtcagacatttagggaaggcttaccccctcttcactgcaggaagtggccagagcctcagcaggggcagactccccttcccaccaggtctaatcccaggcctactgggctgcttgggtggttagtttaggagtagggtatgctgctacagccaggacctaataaaaatgctctgctaatccttttaatgagcagcatcttggcactcatgcacacagcaaggttggctggggaaggcagtagatgccgatggattaatggtggcagaagtcccagggctgctccaaaactgagcctgggccccaggtaccctcttccaaacacacacagcattacttttgcaggtccctggggtccttctcgatcctggagacttggggtccccacagtgctgtactgcccaggatccctagactagacagacctgaaaactacccagcccacagcagaattcactttggccttctgctgaagccttcttcctactaagacttgcacagcagtctcaggtctcactaaggcctcgtatcttcagtgtctccctccctcctcagggaatgggaagctagacctcatgatgcatgaagtcattgtacccccctccccaacaccccttcactcatcagctccctcctagagcttccaagggccaggcacagcaattcatgcctggccaaagggctgtgcccactctaggatgaggaacaggggcaactgtacctatctcttcagagattgactgtggctccttttcttgttcctcgcagatgttcccaagtagccagagaccttctgagaggccagccacctctctttgtccctcatatgccttaggagtttgacagacacagtgtagaatgggggtaacatgcagacaaggcctcctctgcttcaggcttatttatttcatgaaagcagaggcctcgcccttctcattgctggctctgctgtccactcctgtcccctgtggcctgcctagtctctgctactggggatcagctgtggtaacaagcctggtttctcgtaagaccaatgtggtgtggggtcatgggcagtagtattagtggcctgccctaagaccagttctccctccggtgagctcagggtcaccaagtccctggagaatatgagggcacagcctgagtctgagaacttgcttgaggctcctccttatgtgctgccctgctgtggggagggctggggataggagaacaagctttcttaaagcatgggccagactccgtgatgcttggagaacctccctagttgactggccctagctggttctgctaggctttatctggcgtctacttacactgcagtaagctgctgggacttagggaaggtggggttggggaggtgggggcagagggagggcaatggtgaactgaaaccaggctactatgttaaaatgtccagggttccctctgaaaacttgtcagcctgcctccttcctcttcctctcccagcaacccacctgcatggggccccgtctgtcactgcatgggccataggtccctgtgtatccccttctagaaaccgtcgttttatgtgttctatgcttactgtgtgactcctcttccctaccccatactgaaagattcacaacacttctgcctctgggcccgcccctccatgaccagtcagcctcctgccgcctcacgtgcatgtcagtgtcctggacagcagagtgtccctgcaagaccgccctttgcccgtgtgtcacccctgcacctccctccacctcctcctcctgcttgtggagatccgtgtacttctggagcattgtccagatctctcaaagaaaacacagaaaaagattcctcaatgcttttctttccaaaagggaaaaaaaaaggaaaaaaaaaacaatgccaacagcccagcgtgcgtgaacagcccaacagtaacaaagcgtgcgttcgagacggaggaaggtaaggccacgcacttccacacggttctactcgccacttgctccagggctggggggtgactcgagtggggatcccgtgtgcatctgccctcctccatgttctcaccccacaccacacactctcactctggtgtctttggaggaatagaaagagattgggtttgatagaagtcgctagtaaagtgccaaagaaaccgtcccagccggaccagctgggcccctgggcctctcactgactgtccgagctggagagaggtcccatgtctcccaccacaccattcattcattccagaaattatttttcagcacaagctacttctcaggcctggggattgtgactggagaagcagggactgaggcacacattcccgaccagggcctgtcttcctgagagctaactaggagtcaaatgaggagttccgagcctaggtgctctgcagtggacaccgtggttcgcaaaagagcagacactcacggaaagctcaggaagagaagcaggcatgttggagctcggcggcctaaagctgtccatagcaagctcctcattcaaataggaaacaccagtgaagtcagacagggcggcaggctgtgaacagccattggtatgccagggaatttatacctggggaccataaggagtgaatggatgcctttagagggataacaagatgaggttcacagtttccggacttggagtgagaatatgatcttgggacccagtggccatttcagactaaccagtgcaatgtttaaagaagacagtcagcaaaatcttaggtaccctgagatgtggggccactaaacactcctgtccggccccatctctcccaggcctaagcaagaaagagaaaaaatgggccaggcagctcagccacacctggcctccatcttgtaaccccttggcaactctccctgcactgtcacttgatggatggggtgtgtccactcagacttatgtggtggggtcaccaggttggctggggatgttgctggggcctgtgcagagggacagtggggtgcagagctgcggcctgggctgtggattccttagctttcttggcagtgtggatatgttgcatttgtatcaagactgctgggactctctctctgctcagcaaagaagcccctcttccctcactgatggcctctcctgctcctttatctggggcggctttccttgggcctgcatccatcctatctgtatcactaagaggcccctgcttttcttgctactgcctgctcctctcctgcccttcctggccctgctgtcagcgccccctagtgctaggatggctgcgcgggagggcatggcctctgcaagcctctcaggtccttccggtctttctgggacactcctgggcttgcttgtggggaaaggaggagagaaaatggactctattggatgttcctcctgggaagcccttctgcttgctgatgcctagggcctccctttgctcgatagccttctccctcctgtccccagatgaaggtgaacctgaaagcaagctggaggaaaagatctgagcagccctcggcctcatctttctgtccatatagagttatctcatggctttcccagagccaaggccccccgcaggaagccagtgtctcttggggatcaggcaccacaaccagtccctcagcctttatccacagtccttctcctcttcctcttcctcctcctcctcctcctcctcacaacagtcccaacctgctaggactgataatgctgtgtacccatctacctgggctaggcccagatatgactggcatggttagcatttccctgacccattccgtggcggctgctgctgcttctgggcagcccaacttgggctacagtgtgaccttcagagggcgggagtggctggatgatgatggccagcctagtgggggccatgaccctcactccctaaccaaagccagctgtgctgcatgtgtttggtggcaggggactggggcaggtacaggctggatactgagctctgaaaccagatgagtgtatcgctgaatataccttgatgttttgagtaacttcttaaggtcctgttttcctgaggtaggcaagcaaaactgtaaaacacagacaggcagactgcagaggaagaagctaagccgtaggtcacatctgagtttggagaagacgccagaaatgtctatgcctgtgcttgcccacgttttagaggcaacagctcaaagcaaagagagagtaggaactgaccttagaaagccagtgaattgatccagcaagtagggtctcctattcccagccctctgcccaccccagttggttgaagagatggtgaatcagttaaggttatcataggtaaatagatctggcttccatatccaaaatagcagtgtggaggtacaagaaccagggcagcaggccttgctactctacagaccaactcagcatataaattctgtgggtccccaggaaacttggctgcggtggggtaaggctaagaggaaagactgacgcaagtaagggcctctctcttcagtggaagagactcccacaaaggatcccgttatacagagaagccatatagtttctacaagctcaagccctgctagcaggtagaacttgtgagagagcaagggaacagtggggctgagctgggacagggctcgagacaagtcagctgggacagcagtcgggacagatcaggcatactgtctcctctcttgtcctggcttgtgcccacctactgatcctggatagtgtgactaagggttgaggcagaatgctggcggagcatgagtgcgtgagcaggagcaccccgtgagaagcagtgtcattgcatagggctttataccgcataatggcctgaagacttccccacagtgaaagaaacacccaggtcaaaagctagaggctgctagccaagggggcttcttctcccaactgagccccttgtgacctgagctgccacttggcccacatggagagcaggtgggaggagcctccctacaaaagcacatggatggacccacaatggggcctcatggtgagaggccaagtccagggtgtgccccatctccagctgactctgaccaggcctggccctctcctctgttctgcagaacttcagcgagagggaagcatcgagactctgagtaacagctccggctccaccagcggcagcatcccaagaaacttcgatggctaccgatctccgctccctaccaacgagagccagccgctcagcctcttccccactggcttcccctaggcaccagccacctgcttctgactggctggcccgctcacccctagagggactgactgggaggggggagtacccccatctccctacaccaccaccaccacccctgtcccgcacgcctctgttcccacccttttcagtctcctcaaccccaccttccctaagcttagtggcaacagctgttcatcccaaactggacgagaagagaccttcagaacacctcggtacaccctgacctcccccactcctgtcagtgggggctgtggcccaaagagactgcagaaactcagtcccttctctctttgcacacaacgtcccgcactggatccgcttttgtattttctaactactcacaggggactggaacaggggccagatcttagggcctctggtaggggagagttgaaagatccagccaggcattttggtggacatcagccctagcccagttcaggctgggatgcacattgcccccaggtacccctgctcagttctaaaacaggagtgaactgagacctagagcgatagagaggaagaaggaaagaggcctccccttgcccttgcttccctgttggctcatggagagatttgtctgtcttatctttaagcccttgtcccctggtcctgtactgttccatgaagggaagtgcagttaccgaggccgtgtcaaaagtgcacgtcttgtccaataaatctcgctgcaattggtgttcattcctgagttgctggggtcagggtcctatccaaacacggagcaaagtcctgtaggtctgaccgtggcactggctcccaacacccacaccctcactatacacaagtgtccagggagcctgtcttgggaagaaaaggggaggaaaaccttcccactggaatttaggtgtggcctcactgaagtccagtctctaagattcttgcctgttaccagagcctctgacttctggaggagccaagcttggacctccttccaagtcctgcccctactatgtggtgggttgctcaaggaagagagcttgcccttgcctgtggccttgtcttagagcacttgagaacctctctctcactccgagaagatggagagcctgttgactaaagttgggtatcctctgaaagttggaacacctctgatagcaagttcttgggttttgttgttttgttttgcttctgagcccaggtttcaggtaactcaggctaacctcaggtagctctgtgcagccaagtataaccctgaactgatcttgctacctcctgtgctggcacccctcaagggctgagatttgaggcatgagccaccatatgcctaaattcttgcttctgtttcctccctcctattgtggacctgagtggcgacagagagacagctgtccacagacaagcatggtgatcaggaaagagactgatgcagttctggcccctcttccttcacctgcacctcccagagaccccagagaagtcctggaaggacggaaagaaacccactgagccaggtgtgccttaaggtggagtttttaatggaacggttaagttcacagacaagcagcctcccagtcagagctgggccagcatctgggcccctgtcctttccatagcccacattcaacccctagtacctgaagagaaaatttaatatttaggctctttcaccagatctgaaatcacactttgctcctacctgggctcctgggagctgagaaaccctgtgtcagaagaaagcttgggagaaagacaggagtgacaacccaagacctaggcccagcaagctgggactccccagaggagcagcttttcccgtttggggagcattcaacatagatatgtctggcacaacccctgtccccagctggagcagcactttagtcaatagaggacagaggagggtgccatgggctgctctttgcacagagctggtggcttggctgatcagggatggtagagaagctctgcatagcatgacccctgcacccacccttctgctacacaaagatgggacctttctcagccccgcaggggacctacggaccctggcccagccctttacagtgggcaaaaaaacagatgtggcctcctccagtcagggaaagcagtgggtgtagcgctggacgtgctggctgagcttgcaggacaatctggttattcatctgcttgcagtcagggcaagtctaagtaaatgggggaagggtgaggatcagagagcttagataagccggccccatagcggctgcgggttgcagttcaggttatctgaaaggccctgggcctggcctccagctaattgggaaggttagggacccagccacagcctgtaatcagctgaaggtgagagctagaccggggaccttactgccactaaccctagaggggccagcttcttatcctctacagataacatccgaaacaacctcaacctctccccccccccccttaacccctagaccgcatgataccatcactcagaaagccatcagaacatgaatctaattgtgactgggccaggtgaccttgaggaaggcaagtgacctcctacttctcacagcactacctacttacggggctccctttcaatctgggaggaagaggctgctgggaactggccactcataaggtatggcactgtctgggagtgaatcagtaaaaagcccaatggtccaagagcaaaaatcacacaaaacacagacacaagggccgactctgccaggagcatgcagaagacagccactgggctgtaactgaggataatttcctagtgatcggttctaaatgttaaagatcggagactaacccccactcattccaccctccttttattgatgacaagcctgagcccccaagaagggcagggactttgccaaggtcatggagtcacagctagtcagctgacccctgtctgcaccttgctaccctgtgagctgtgtcttgttcctgttcagccacctgaagcccagctgatctctctctctctctctctctctctctctctctctctctctctctctccctccctccctctctctctctctctctctctctctctctctctctctctctctctctctctctctctcgtgcccccaggacattcccagacttcacacacacacacacacacacacacacacacacacacacacacacctgcagaccctcccgcagacctggtctgtaaagccagaaccagtggagtttctgggatgccagtgtggctttgctctctgagcaggacagcaataccacctttctaaggagtggatgtgggattccattctggcttttccacctggagccatgtgaccttaggcaaattagcctctaggtaggcttctgattctcatctgtaaggagagggactgtgaagagcagcagagactggcatggcagacgaaaagggaccgctgtgggtcagaaaggtgcttagaggctactgccccgtagctctttggtaggggtgggactgcggggacacccacagattgtgaccgcgctgtaccccaggtactcttgagaaccagcctgcagtgcccacagaccagccccgccccactgttgtcggtaggcctatattggggacccttctcaagtcggttcgctcttgtgagatcccaaacacgcaccacgtccaggctcaagttcaagactggcacctcacttttgccacccagtgtgtaccaagagcgacagctgcacctcctgggaccaaggctcagggtagcaagtatttagcagttttttaggagttatacgattcctaaagctcccccaaatcgactataacctatcttcctaaccgcgtgatctctcactatgcaaagaaatgcccgcccaccggagcaagtgtgtccctgacagagacagtttggttgggcctcgcctttgcattaacctggaaggcagtggccatacaggaggtaactgttccaatacttcccataacctgatgaggaagtggtcccgcggctggtcctggcaccagactaggggcacagcgtcaccagaaagaaggtcgggcagcccactcttcccgcgccgcctgccgcaccccagcctgttggccagaccctgcgctgggtaattgggacgaagagagccggccggcgagcggctccagggagactgcaagcctgtcagccacaatttgtttaagtggacgggacaggctgggccgccgggggctggggtcaccgaggccgcggcccccagcctggccagacccaggaccgcgggggagcccagccctactgcttaaccgggctagctggcgccaaggctctggaaggcgcgggtccggtggagaagccatggatgggaacaacgaatgcacctagtgtcttctaccgaccacttttcctaagcatagggccacacatgtcaccccagcttttcccgggcacatttataagtcaaggcgcgcttagtacccagttattggtgctcacgtgccctcactcaactctgccacaggactacacattccccagccttcccgcatccattctatgagggctcaggcaaatcttcacgcatgcagacatccgcagggacctatgctatttagagatcaactcttgagagaggacttagccttatctcttgaccattctcgatgtaactcggccaaaagacggacccggcagccctgccaggcttgggagggcagtcccctccggcccaggctactggtgctggatttgattgttgcgggaagctaagactacagaccacgtgaaaggggcctgggaccacgaagccagcgcctgcccgacgcccccgcccagaactgcctgggagagggaggggcggctgagcgcgcgtcccccacccgtctgcgggtcccggccgatgcgaagtgacaggggccggagctttgttgtggagcctcggccgcctggcgccaggcgccctcgtccgtgccctccccctccagccccgggcggcccgcgaggcgccccccggggcctcttaaagagacacgcacactctgcccaggggactcccccaggggcgcctgttcctgggaaggggagatgagtgggggtagacccaggcgggggtagggcgaagcaggagttgcgagccgcaaggcgccgctcgagaggctgcttaggccgccccagcaccagttttcgatgctacaaggatattctaagaaaattttgttggggatgggtcgataaagaatcttaagagcggctaaagcaggtcatccaggtgactacgtgatgggggtgggggtgggggggtggctggagctgttggtggaaacccaacctgccctgaaaacgtctctgaccagtcgcaggtccttagctctataggtgggattcagatcccctaatgtagccactgggcgacagctgtccgatttcgtggaccaataactcagaccttcatgttttaactctcaggcctaaacgggtagaccagctactgtatgctacccaggaaaatgaccaaaatacatacttcgatacatacacatttttacaaggtactaaagtgcctgtccccatacacacaacttagcaaatgtcctgccaactcggaaagctgaactgactacttcttgttcacctcactaactgtccaagtgtgttcagacacatctctcctggaggagccacatcctgtctgaattggaagcagtgcaaagctgcaatggatctctcaccggctgcgaacaccgcgaagctagagctgaaggttcactgtgggcagagaaaagagtgagaaaagcgacctaggagtaaggtcctgaagaaaaacccagtggggcaggcgcgcacagggttatgaagaattacaagcgcctggtgttggctcagatgtataggaaaaaaggtcgtggaggccaaacgactcctgctggtctcaaccccgtactgccgggggcaactagcttttaaacgcctttctgggcggtcagctaccaagtgcctgaagacctggtgtatgcagcggaggggcaagctgcctgggccacttacgtggtaggtgcctaccacggggacatagggctggagcggcagaattcgcttatactggttgggagggtgggagtatccactgtggctagttcacaccctgcttcccctccccaacaagcacaagggtgtgagcctcaaccctaaacaggcaagtgtatgatcgttttactctgggcacacctgattatggttttacacacacacacacacagagagagagagagagagagagaaagagagagagagagagagagagagagagagagagagagagagagagagagagagagagagagaggaagatgcattggggctgttgccagagagataacgaagactgatcgtcgaagggggtgttcacacttgctggcaaacacctcgattcccatccgcattactcagctttcctgaactagggagccttgagcttccaagggacggaaacaatctctagagaagtgactgagaagaaaagatgccagagtttaggaagagatagatgggcttgcatctccagtaccggatgcggcgaaaattccttctggcgcgtgtggagaatctgagttctaggatcaactagcgcggcaccgccttgggctctgtagaaggtgcgctcacctacctggtcccaaggatccattttcctactcgccagaaggttttggcttagtgacctgacacagaccttctttaggctaaatgcccggcccttctggaaccccaggttcctgagtctacgaggggaggagcaggtgggggtggggacccttcgtttccccagcgcaaggcggcgtcccgttcccgcccgtgccggccccatcagggttctgccatggctccccactcaccggctccggacacctgattcggctccgggacctcggccgcccgagcctcctgattt

SEQ ID NO: 220 - DNA, 811 bp, Mus musculus
aggtccacagggctctcgccgcgcgccacacccgcctgcgtccccagctccccacccccaccccgccaccccacccccgcctcagcccaccgaagagcataccctagattctcctagattctcgatttccggactggtagcaagcagagaagagatgaggaggccccaaccgcgcccgaggccttaaatacttatggggggcggagagtcgggaggagtctgaaggccagggtgcggccgctcccgagtaggaaaaggaagagagtaagtaaggccaggtgagtgcctgcggacccacaatctagcctatcctctggctcttggccactttgcctcagattgggcagctgatctttctggtactttctggatgctttggctacctccacttagcgatgccagaagtgtgccagcacttagtggatggacatacttgtgacaaagcagatcataagtttaaagtgagaaaggaagaaaagacttttaactactggggctggaggtagagatcttattcagcaggcacagaaaaataaagaaaggtggtcagtgcctgtgtcccagtgtagccttctcagctttgggtaagcctttcccagccatgaaaaggatgagcagtattcccagccttcagcaggctaaacagaccttatcaacctggacacagacatctgtcttggctgcaattgcaggtacccatgggaactttaaggtttttgcgctgaccttgctgctacaacatactcaagctgaagaagtggatggattttgtgggttttttttttcctttataaacacaaagcttattatc

SEQ ID NO: 221 - DNA, 6943 bp, Mus musculus
ctcaagatgctctgagtgagcttaagagaaagcattctgcagtcctctctgtagtacccagaatgcctatgggggattccacaagctcagtgaaaggtagtaacaacaggtagttgaaaaaattgaccactagcagggcggtggtggcacatgcctttaatctcaggcaaaagcaggccttctctgagttcgaggccagtctgttctatagaccagacagggctatatagagaaaccccatcttgaaaaccaaaaagcaagcaagcaaacaaatcaaaaatttttaccattggttccaaacattaagattcagagacagcacattctagtccatctgaactaaagtgacagatttctgatgacgtatgtaatcctaggtccaattagtgtttcaggtgcctccattttaatggcatcctctgtcaagacagactatcacacgtgtcatataggaacagccagtgcttaatactgaattaaagcagacatctacaatgggtatttttggcacaagtttaatttaagttgaacaagaacttggttttaatcaaggccaatgtgtggtaacctttaaaagaagccaaggacaggtatgagaggcacacacctgggtaagcctttgcccagctcttgctttttcttggttacttgctgaatgacctgttcccagttgacatttctccttgatgcatttagaatctgtcgtagggttggcttaagcccagattccttttctgtttcattctttctatggccactaacattgcgaattcgtcgagcgctattgaggtttggctctgggagatgtgttcctgttttggacttcaaactgatgtgtcggcttagatctctctggagcgaggcgggaaaaccaagtttacttagttcgggaagaagcgtgcctgggggctgattattgagatcaggtttttgaagctctgcatccaggctagtgtcctcaaagctctcagtttcaaaaggtccatcagatttaacaaggttgttgtcctgcgcatcttctagagaggtcttcaagtttagcagtaagccagagtgtggactggtcgctgctgacacttgtacctcagcctctttctggagaactgtggaattacatggggaggcggagaggttctcgggtgttcctgggatctggctcccttgttccttatccacggtgtgagtgctgcaggacacaacctctgtggtcagtgaagccacaccttcactttttatgccatggttttctgcatcagatgtcatggcactgtttccagctgagtgtggctgagactcgatgctcagagagtctttggcagactcttctacactactttcttttgcatcgttctccgtccttttgggtgtggtagggagtggattctgcagtgttttgggacactgtagcactgtgtcttgggctttctgtgatgtgctatttaacttctcgtcaggttctttttgagtgcctgatacagttttattctcctttaaaacacgaggacataaaccgcgtgatttggatgtgtaggaagaaccatggctaccttctaaagtagaagtgttcaggagatgtgagtgatctccagaaggaaaggactttgtctccttattttttgagcggttctttaaattttgcttatgaggacctgatttaggggttggaagtggaaggagtggggatttcagtaatggaatcttatttgacttctgatgtggctcagattgctcggtaatggggcaagctcttggcacctcacagaaagcagtgccatcagaaatggctttgtgactgggagatccaggaggtcctgctttttgtgtttttatcactggaggattacttgttttatcaactggtttgcgcagtcctgcagttattaagctaaaattaaagagaggcttctctagtgtgtctgacttgctgccaatgacttctttcagggctgactgtaaatctagagtcttctgggaagggtaaggtgtccagcggcggaacttgtcccttgctttggtgccattttttccattaatttttgaggctgccgtgtctgtttgtttagtggtttgactttctcgctgttcaaaattgaactcaagtaagccttctgaaggaaacgtatcgcttgcgtatccctcaggaggactcctgtacttggcagctttgtccctgtcttgcctctgccacttgcatctctcctgactgtacttgcttggcttattagatttcttgttccacatcttggtcatgtcttccatttgatagttaggatttctgtttctgccttgttgaaatttgtctccagggccattgtaattccagctattcgtactacgtacactggatttccagtttccgttactgttgttcatgtgccagctgggaaagccacctgttccttcagaatgccaactggaattccttcctgtaccattataattccaatctaccatcccattgtttgaatgccagcctcctccagaattgctatgattaaggaaccaagttgaagagcctcttgtagcacctttatgccagacagaacttcctcttggtccaccactattcctcaaagaatgtggaaagctgttttttctagtactattaaagccatccttttcccatttccagtctctctgtgggggtccacgatggtgtcttggtggctgactatagctctctctgtcttggtaagggattcggtcttctcgtctccactggggctgcctgtcatctgagtttacttcttggctgttactgggaggttcatcttgtctgaaagaaaaaacagtttgtcattatggatttaatgaaattcttacttgtgcttctttcttctagtgtttgtttttacatctggaatgtagcagactatctttcccttcatcctagacacatttaaactatcctcccaatttggggggggggggggtaaaaggggttactggtctagaattttgtttctattatctgagcatttttacattatccagctcttttcaaaataagggtggttatattttgtggttaggattattatttacttttttttttttttggtttttcgagacaaggtttctctgtgtagccctggctgtcctggaactcactttgtagaccaggctgtcctcgaactcaaaaacccgcctgcctctgcctcccaagtgatgggattaaaggcgtgctccaccaccgcccaggattattgttaatgtaactccatgttcagtcagtggccatatctgatttcttcagatgcaggttcttactgaaaaaaaatctattttctaacccacttccatacagtttctatttaaaataggcttagaactgtgctgatgcagtaagttaggtcccaaactcagtaaaacagcacaagccaaataagggatctcacaagaagctaaagagagcttctgagctgcaggctctttacagagaagctacagctacttaagctatctatgttacataggtgtccacaaaagggaataacttacttatcacagcaatgtgtgaaaccatttttctttacaaattacttatggtgtgtctaacattccagcaagtaataggtgctcaaaacaccaggtaataaagtggcctaaaatctgcttcatttctgctaaagactagattaattaattcattaatgctttttaaaagattatctcattccatttgtacaatccagaaagatattattactttttaaatggggaggctcaagtttagagaagctaagtaatgtgaatggagtcatataaatgcaaaggggtcaagcaaaggtccgaaccttgcagacttatactacccactcaggccccacacagtaaaaatgtcacagcaacagtttctgcaattgaatttctttctctaaacttgacttagagctggagagatggctcagcatttaaaagcattggctcttccaagtgacctggggttcaattcccagcacatactcatcaccatctggaactcctgttccaggggacctgacacctcttctggcctccatggacagcaggcatgagtgtggtgcatagacacacatacacctacacacatacaaagcaacaccttaggctggcgtggtgataacacacctcttacagcactgagaggcagaagtaggagcatctcagagtttgaggtcagcctggtctatgctgtgagcaccaggccagccaaggtttcatagcaagacactgcttcaacaaacaaaacacattgactaccatcttaaaaactgaccttaattaattagcctttaaaagaaaactgattgtgtgtgcacatgtgcatgccatagtgtatgtgtgcaatcaagagagcagagtactgggctggtgagatggctcagtgggtaagagcacccgactgctcttccgaaggtccagagttcaaatcccagcaaccacatggtggctcacaaccatctgtaacaagatctgactccctcttctggagtgtctgaagacagctacagtgtatttacatataataaataaataaatctttaaaaaaaaaaaaaaaaaagagagcagagtacttggctgcatttcctctacccacagaaccatcttgatggctcttaaatggccttatgcctgtagtattctggacataaattagctcctttttcacaatatagaattaaaaattcggggctggtgagatggctcagtggataagagcacccgactgctcttccgaaggtccgcagttcaaatcccagcaaccacatggtggctcacaaccatctgtaacaagatctgacgccctcttctggagtgtctgaagacagctacagtgtacttacatataataaataaataaatctttaaaaaaaaaaaaaaaaaaagaattaaaaattcatctctctggcatggtaacacttgcctgtaagctcagtacttgcaacagggctaagaagaatgtgagttgactatctaaagagaccctgcagcagtcagtcaatcaatcaataaaagtaagtgggtgatttcatataattatgtcattacaggggcatataagactcaaagaataagcatatcagtgtctaatcatagcctttgataatggttgatcatttacatagcttagctataatagttttgttgtgtatgaaagaaacaaaaattagtgtcctacccatttaacttcctaaaacagaagcgcaggctccaccagctgcactgaggtcatgagaatagtatctgaaggaccgcacagcccaaggggtcaacaatcatggtgctatgggcatcttaagactaagaaagtctttttcaaggacttacttttaaaatgttaatatctagggtaaaactacatatttcctacctatatttaaatctctaacaaaaagcaggtcagagtatgtataaataatattcaagaagaatcattaaaatttagagttggaagtttcctcatcacatagaaggactttaacacttgtggacttcattaattgttctctcctattctctgtcacattaataaataagtcgtagcacacacctataatcccaccacctagggagacagacacagaaattcagaatcatctttcgctatgagcaaactgaaaacttgctatggctacatgactgcctggctcaattaaaaacaaacaaacaaaaaacttcaggctataaaatcaggtaagtaaaaccataaatgcctaacacataaatacataaacacagatatacaaaattaggaaaaacaattagggaacatatattgttcaaatagtcttgctattgtcaaacttaaaatattaatgttttaatataatgtaatattaatattacatctagagtgaaccaggcactgtatagttgttaggatgccaaaggtaaaattcagatttaagaaaagcaccatgctaatttataagaggtcatcctttcccctaagagatattatttgggcaacaaaaaatataataatacaaatgataaaagatgaaatgtctattcattttacttatactctacggctttctcatagaaaaattggataataagaacagttcaagacacagtaaccaagaccatagttttcaggactaaaaacaagactgagtttaaagacagataatataacagttcaaaaaagcacttcatagtccttagtcctcagatagcaaactcaaacaaaacttaatatttaaaataagattaagctttaagggtcttaaagtcaggcttacttatctttcaatgtcaaatcacaaggctgagtgtagcttaggcttacttagtagagtgtactctttgctgcacaaagctctagaggctcatcctcaggacagagaagttgtctacatctaattctatctcaaaaagcaaaactaaaaacaaaccaacttaccgactttgttcttttctttcttgtattaactgaacaagttccttatcaaaatactcttcctcttcctcttcctttccatcatcttctctttcctgggcatcaacattatctttgtgcaactggccagaaatgtgctttgcatatgcagagagacccacttctgtgacccggcacactcggcactcatgactaatgtccctagggaaagagggagatgaaggacattcaatgctccccactggcatggcacactcaccagattgctagttgcctctgaaagactctgtatgcagatggccacagtggaaggttagagggaatcaagtcggtgctcctctcaccactgttagtatatttgcttataaattactttggaataaatttaagattcttttccagcaatcaagaggtaaaacacttcaaattaataggctttaggagaaatcttcttgaattgctgtacttaaaatcttgccgaaggaaacatggtgaaaggggaggcagggcagggggctcagagcaaagacaagctgctctggggcacacccatga

SEQ ID NO: 222 - DNA, 44738 bp, Mus musculus
catgtatagccttacacattttaatatgtatttatgaaacaaaaattaatgcataaatgaaactataactttgtaaagattatctataattgtataatatttatgtgtatgttatctatatgatgcatacatctatgcatgcgctctgtgtgtgtttacacgtgtacatatacacacatgcacactcgtcaattgacaataaatcctaaaacacaagtgagggagggagggcagttgggtaggctgcattagtcagggttctctaggtcacagtgcttagggaatgtctctctatatgaaggggatgtattgtgaggacttacagtctgtagtcccacaatgctcagctgtgaatgggaagtccaagaatcttgtagttctcagtcccaccagctagttgtttcagctggtcatctgtagaagaaggttccaacagatgtgctggcagctaagtgcaaagaagagggaatcttcctccttccaatgtctttatgtaggcctccagcagaaggtgtggcccagattaaaggtgtgttaccaccatgcctggatctgggacttgcttttgtcccaggctgaccttaaactcagagatctccttgtctcaagtctcctgagattaaagacatatacaaccttgcctggacctaagcttttcatggccactgtgcctcaagatctccatgctaagattgaggtcagaaacttgtgtcttccagcctcaagatctggatcacaggtgagccctccaattctggattgtaggtcattccagatagagtcaagttgacaaacaggaatagccattacataggtctttctgagaacatgaccttgaggtgtcgaccggggctgggctgtgtgtctctgggagagaagagggttacaggagaagttcgaacctctggggactatcagagagagccagcctgctgtgcttgggactggcaggggagatggtgtgtctgaagtggttgatccagggttaaagtagggcgaggaagagtccagaagagcagagtgaccagggcagggagtcgtaaatgacagtggtagacggtctcaatggagtagaacctctccttccatgtattaacagaatcttcccgacgcccacattacaagaggagcctccctttaagcgctgtccagacagtaagacagaagcagcgtgggccaagatggtggcttcagaatatggagggaaatggtttggagaggagcagtcacagagacctggcacagcagggaacacatgttatcccaacacttgagagactgatggctaattcaagaccaacctgagctacatgcagagtctagtgctggcatgcttccttagtaagacttagtatgtaacatgcccaagggtgaaggtgacacacatagactctctcagagctcagagaagagacaacccaacccggaagggcgtcttccatccctgcactcctagaacatacctggaatgctcatttgtacatgcgtgaacttctttaggtcactgttttcttctgctctaccgtgctcttcttactcaagtgcctatgagccatttgtcctaaacagacaaattttgtcccaaacagccttggctcctggtggactagggtagcccagtcttgtttcatcagcgtctcattacacctgattcggtttctgctgtctctagttcaccaaccccacaacttctaaaggcaggtatgttctaactgtgcctctgctctttcccccacaggtcactacgtccatggcatttgtatctatggaaacggagacttgcagtggctgattaattcgcaaagcctgtttgctaacaaatttgaactcaacacataccctcttaccgtggaatgcctggaactgaggcttcgagaaagaacactcaaccagagtgagatcgccatacagccgagctggtatttctgacccgcagcagctcgggcctaaatggaaattgaagacgtaaagaagagctttcttttccaagagactctggtcttggctatgctgaagacttttttaaaaaatggttttcagggaaccgtgaggatctggcaacatggctctgcttgcaatatccactgagcactgtaatacatttgacaggatggctgcatgaaactgtccagcatttttctgtcgtttcccccccaccccaaatcctttttttctcttcttttttaaaagataggtagggtcttgctagatatctctagcaagcctgtttcttgtcaggtagcccaggatggccttgaactcttaatcctccgccttggccctctaagggctgctagtccgagtgtggacaaccacacctggctctggcgtctggcggtcacttgacgctcatctgcgtctccgtctgctaggtggtcggtgataaattcaaatgtatcagatctctgtgccagatactcatattagtataccctgttcaaaggagaatggtggataatactgtctgaggaaatcagaacttatttgagaaggaagctctcgttccacattcctagcaactatattctcaggcacacataggcgcacagagacagcttcctagtaactcacatcaatttcgtttaatacaaactgatcctgaagagctgaggaactatgtaagttcagtgtccaagcatttgactgacatttgtgcagagttaggttccatctccagcatcacgcacgggtcttgtgaacaccgacatcttcagtttacttgtgtctgcagttctgtggacagaacaaagccattcacaagtgaccgacagcacgtgccgtgagacgggaggtggctgcaggaagaggatgcctcagggatgccggacatttccgtgttctattccagagtgttctcttctcccagagaacactggaacgtcctcacagggatgaaggaattctttctttcccacaggaaaggtgctactgtgtgggtctggaacctgtgaatgaatcactcctggggtttcgtttctatgtgagagacggggacccggttctgttgtgtgcagctttagcggcatcaggacagcttccagcttgcaatgattgctgctgacaggaacacctggatctcaagagctttttatgacaggtggacatctgtgtcatttttccttgttccctcatccatccatccatccatccatccatccatccatccatccatccattcgtcagcctacattcaacaaacgcctcttgaatgtctatgattcccccagacacatgctgacagacacgagggaagcaagacagattctttctccactgttaaactctggggagtggtatcagcttttgaaaccctgctctagactcttacaaaatggctacacttagcacatactctgccctggctatatattatattgggccatagagatcagcaatgtatcaattaatagattaatccagagacaggaaggaggaaacgaaagctagagcctctttgtgactccaccaactccttcttgtctccttttattgaagagtccgcacacatactcacccctctggtgggccacatgaggacctgcatcttgcagatgatgtagcaagccttaggatggttcatgatcagtaggaagcaaattctaagacctcagggtgtctttctgagtctctcatttctttagggatgtggagagaagatgaagtatagccgtgtgtagtgtcgccagagaaggtggagtttaagaatggtctcagtgttattaatgagaaaaagttctgtcattcaggaaaaaaaagcaaaaaacgtgaggttgggactcagtaggtgagggtgcttgcagccaaacctgatgacctgcattcaattcctgggtcccacgggacagagggagagagtccactactgaaaggaacgctcaaacctcctcacacaggtccttgtgcctgggcactcccccgccccatatgcatacacacatacatgcttttgtgattttttttattagtgcttttacatttagaaatatttatttattctagcagggaaaaaaccccacatgctttaaatgatgtcactttccacaacttcattcttgtgctgtcattggactgaatgttatgcatctttaaagggaatcacttcgtgtaaaactctcttgtctcttctgctgaaaagtaaaatgggttgtgtcgggtaataaagggtcgaggggtaggaagcacttggtcaaggcgaagtctaaaaccggtctcttttttatttgttacttggatgagagcacctgaagactaatgttttacactggattgagatctcatggaaaatgaaacattctttttctggagaagtttacatgcccattgttggtcacctctttactgtaaatactattgaaaaaaggagcgtagcatttgcatagcagggattgtgcctgtatctactgtgtccattttgttttttcggatgttttctggttttgtttccttggaaataaattaatatattgttttccaccttcaggaatagtggatatttatttgatacctggttaatatgcactgggtcccccagcttttgaaaaggacaaaagaaacacatttatacatgtatagctgtcttaaaattatctctccactaaaaaacataattgacctttccatttgtggactaagggacactttgcactgcacttgggccatcttcaggtgaacacagagactggctgggcattgggtttgctttcatcattttagtttctagtcttggtaaaattccagtcagccacagacttcttgcagcagagctggccctagagcttgggcagggaagacccaaaatgagactggaacgtactgttataatgtgtggtacaagaatcccaaaagggtgacaatcgtgtcacaggttcaggggttgccttgaactctcctactgcatcagaaataggacaataataaattgtggcccaataactaaaataagaatccaagcatgcacaatacatgcatatacatatatgtaaatgcatgtataaaatatacacattattaaaatgtataagaggcaagaattagcttgaagggagttcctgctcttgggtccagtgatcacccaacaaatctatcatgattctctcacccagggctgagcacactgattctgtgatgggtgagagagtaaatatctggggctttgtcagtcacatggtttctgtcgcgattattcacttctgctgtgaatacatagatgatatataagcatgggctgtgtgttctttgccgtggttgcagactataagttcctgatctacccaatccctctctaatgcatgtcagacccaaagaaggcaaaggaccatcctcttggatgtggattacctcctgatgggaacacttgagtgcccaacacctcccccaccccagtccccagccaggaggggagagtgagaaacgagcacacagaaggaagaccggtggcatttctactttggctaagtctctgtctaaggcacgagtaaacaggcgtgtgctttctccaaatgggcaaggagagctgggtaagaaagcttacagtctgctctggctgttgttggagagtccaaacaacacatcagggcaccaagactgcaagacggggaagccttactatttatgtttgaagctcctgggacagtaagcgcacgtggtagctgctgcccagtctgagagctactttgcactgcacctttgctatcatcaggtgaacacagagactggctgggcattgggtttgttttcatcattctagtctctagtcttggtaaaatcccagtcagccacagacttcttggaatggctggttccagagcttgggcagggaagacccaaaatgagactggaacgtactgttataatgtgtggtacaagaatcccaaaagggtgacaatcgtgtcacaggttcaggggttgccttgaactctcctactgcatcagaaataggacaataataaattgtggcccaataactaaaataagaatccaagcatgcacaatacatgcatatacatatatgtaaatgcatgtataaaatatacacattattaaaatgtataagaggcaagaattagcttgaagggagttcctgctcttgggtccagtgatcacccaacaaatctatcatgattctctcacccagggctgagcacactgattctgtgatgggtgagagagtaaatatctggggctttgtcagtcacatggtttctgtcgcgattattcacttctgctgtgaatacatagatgatatataagcatgggctgtgtgttctttgccgtggttgcagactataagttcctgatctacccaatccctctctaatgcatgtcagacccaaagaaggcaaaggaccatcctcttggatgtggattacctcctgatgggaacacttgagtgcccaacacctcccccaccccagtccccagccaggaggggagagtgagaaacgagcacacagaaggaagaccggtggcatttctactttggctaagtctctgtctaaggcacgagtaaacaggcgtgtgctttctccaaatgggcaaggagagctgggtaagaaagcttacagtctgctctggctgttgttggagagtccaaacaacacatcagggcaccaagactgcaagacggggaagccttactatttatgtttgaagctcctgggacagtaagcgcacgtggtagctgctgcccagtctgagagctactttgcactgcacctttgctatcatcaggtgaacacagagactggctgggcattgggtttgttttcatcattctagtctctagtcttggtaaaatcccagtcagccacagacttcttggaatggctggttccagagcttgggcagggaagacccaaaatgagactggaacgtactgttataatgtgtggtacaagaatcccaaaagggtgacaatcgtgtcacaggttcaggggttgccttgaactctcctactgcatcagaaataggacaataataaattgtggcccaataactaaaataagaatccaagcatgcacaatacatgcatatacatatatgtaaatgcatgtataaaatatacacattattaaaatgtataagaggcaagaattagcttgaagggagttcctgctcttgggtccagtgatcacccaacaaatctatcatgattctctcacccagggctgagcacactgattctgtgatgggtgagagagtaaatatctggggctttgtcagtcacatggtttctgtcgcgattattcacttctgctgtgaatacatagatgatatataagcatgggctgtgtgttctttgccgtggttgcagactataagttcctgatctacccaatccctctctaatgcatgtcagacccaaagaaggcaaaggaccatcctcttggatgtggattacctcctgatgggaacacttgagtgcccaacacctcccccaccccagtccccagccaggaggggagagtgagaaacgagcacacagaaggaagaccggtggcatttctactttggctaagtctctgtctaaggcacgagtaaacaggcgtgtgctttctccaaatgggcaaggagagctgggtaagaaagcttacagtctgctctggctgttgttggagagtccaaacaacacatcagggcaccaagactgcaagacggggaagccttactatttatgtttgaagctcctgggacagtaagcgcacgtggtagctgctgcccagtctgagagctactttgcactgcacctttgctatcatcaggtgaacacagagactggctgggcattgggtttgttttcatcattctagtctctagtcttggtaaaatcccagtcagccacagacttcttggaatggctggttccagagcttgggcagggaagacccaaaatgagactggaacgtactgttataatgtgtggtacaagaatcccaaaagggtgacaatcgtgtcacaggttcaggggttgccttgaactctcctactgcatcagaaataggacaataataaattgtggcccaataactaaaataagaatccaagcatgcacaatacatgcatatacatatatgtaaatgcatgtataaaatatacacattattaaaatgtataagaggcaagaattagcttgaagggagttcctgctcttgggtccagtgatcacccaacaaatctatcatgattctctcacccagggctgagcacactgattctgtgatgggtgagagagtaaatatctggggctttgtcagtcacatggtttctgtcgcgattattcacttctgctgtgaatacatagatgatatataagcatgggctgtgtgttctttgccgtggttgcagactataagttcctgatctacccaatccctctctaatgcatgtcagacccaaagaaggcaaaggaccatcctcttggatgtggattacctcctgatgggaacacttgagtgcccaacacctcccccaccccagtccccagccaggaggggagagtgagaaacgagcacacagaaggaagaccggtggcatttctactttggctaagtctctgtctaaggcacgagtaaacaggcgtgtgctttctccaaatgggcaaggagagctgggtaagaaagcttacagtctgctctggctgttgttggagagtccaaacaacacatcagggcaccaagactgcaagacggggaagccttactatttatgtttgaagctcctgggacagtaagcgcacgtggtagctgctgcccagtctgagagctactttgcactgcacctttgctatcatcaggtgaacacagagactggctgggcattgggtttgttttcatcattctagtctctagtcttggtaaaatcccagtcagccacagacttcttggaatggctggttccagagcttgggcagggaaggcggggcactttgggctgtacgtgcagagtcaatgaaacctacacatcgggccaggcatggaggtgcgcagtgctggtattcacaggctgcaaaattgagtcctgtctaggctgcagagtaggagcctgtcaaaaaataaagtaaaagaaaaaaagagggtgaaacagagaggtttattcaaacagagtagggggaaggggaatgtgctgaagagacagatgtctcagccagtaaagtgcttgtcattcaagcattagaggctgagtatgggctgaaatttgctacaataagagaaagatagagtaagccagagagccaaatgtctaagagattgtgactaaattgacattccttctgcacgccagggggtcatctagagccagttgttcttagggtagcttgttaaaggccccaggccaagacttaagaagagctacttacaaaggggagttggtccctgcagatgtgcattctagccatccagaggttcttaatatgtgtggggaacccatcatgacagtcctccctaagctacccacagtatgtgaagagtccatcttccaaatgtacagcaagtgacagggaaatctatgtcatccaaagtactggggaccactaaaaactccgtgaatgtctcaggagtgaacagtgccattcaggtattcattacaagaacatgctaagaatctaaggtgccagaggtttagaggtcaactcagtgggttttattctatctttacattggttccacagataaatctccccccccctcgcacccccccccccagacagggtttctctgtgtaaccttggctgtcctggaactcactctgtagaccagggtagcctcgaactcagaaatccaccagcctctgcctcccaagtgctgggattaaaggtgtgcgccaccatgcccagctccacggataaatcttagatctccaggtttgcatggtgtcttagggtttctattcctgtacaaacatcatgacaaagaagcaagttggggaggaaagggtttattcagcttacacttccacattgttcttgatcactaaaggaagtcaggactggaactcaagaaggtcaaaaagcaggagctgatgcagaggccatggagggatgttctttactggcttgcttcccctggcttgctcagcttgctttcttatagaaccaagactattagctcagagatggcaccacccacaaggggacctccctcttgatcactaattgagaaaatgccttgcagctgggtcccgaggcatttccccaactgaagctcctttctctgtgataactacagcctgtgtcaagttgacacaaaactagccagtacccatggtaaatgcctttacccactgagccatctgactaggtccaagaattttaactcttataggatcctaccccatacatcccactttatgtgccttatttcagttgttgcttgggtgttttggtgttttgaatatgtttggcccatgggaaatggtactattaggagatatggcctcattggaggaagtacgtcactgtggaggtggtgctttgaggcccggtgctcaagctctgcccagtgtggaagagaccctcctcctggcagcctgcagaacaatctcttcctggttgccttcggatcaagatgcagaactctcagctccttctccaacatcgtatttgcctacacagtgccatgcttcccgtcatgatgataatggactgaagctcagaacctgtaaaccagcctcaatgaaatattttccgaagagttgccttggtcatggtgtctcttcacagcaatggaaatcctaagacaggcattctgatccttttggtggcctgttgctttgttctgccagccacataaagcaagatcttcagttttctttctcgttttaagttttgaccaaccgaggatggatgctgctgaggacgcagagacattagttagcgtcccatgtgtcccatccttcccgaactgtgttctactagactgcatgacttcagccccagacttggccttatttggcactgacgtcacttgacagtcattagaatttgcttgttatgttccatttgcaaatgaattaaggtgcagtaaattaacagaaacccacctacattgtgaacagagaaattttaatggtgtattttttgtttgtttgttttgtttgtttgttctgctttgtccagacaaagtgtcttggggttttattgctgtgaagagacaccatgaccgtggcaactcttataaagtgagatatatttcattgaggctggcctacagttcagaggtttagttcattaatgtcacgacgagaagcatggcagcgtgcgggcagatatgacgcgggagaagctgagagttctacatcttaatcaagcaggaagtaagttggtttgaatttctgagaccttagagcccaccctctagtcacacaccatctccaacaaagccacgcctgctccaaggccacacctcctaatagtgcctaatatgggcctgtggtggctgttttctttcaaacaccgaatttctcagtgtagctgtgtaccctcgactatcctggaactgctctgtagaacagcctggtcttgaactcacagagatccacctacctctgtctctcgagtgctgggattaaaggtgtgcaccactgccatcaggctgtttgtttgtttatttatttatttttatttagttagctagctagttgttgtttgaggtagggtcccattgtgttaccctgcctggtcttgaactcacagagatgcatctactgcctcctcccaagtgctggaattaagggtaagtgccactacacccagttaataaagtattactaatgggaaaatgactaattgtagtggtaatggacacagggagcgcctaccctctctaaggtccaggcacagtggttagggaagagcaagctttaaaagacttctgagctagtctggggctcagaactcactaagggggcatagccaaggccccctcgatggttaagaagcatgctaaggtgtcacacgatgaggctacaaatgtgaacctacccactggcgtgccagcaagattcagtcaccttctgggacacctgcagagtttgctgagatggcatgtgccaggctccctatgtaaaagcccttcagcccggtagcatgatcccctctgtgacatagcaactagcatctagccaacattctctctgaatgttgggatggccacacaacttgccaaaggtgagcagtaccccttcagcctcacttgagtgcccacccagtgacactcaccagaagtgacctgcaggacatttactgaaactccctgggaatccaccttcccacctcctgacagctgagaagaagatcagctcagcactaagctaccagactcagaaagccaatgcctacagtgaccaagaaggaggccacttcctcttgcagaaacccttttctgacattgctgatgaaataccgtgtgaactggcaaaggagaagtaggtcaagggcccagcttcgtctcagaactaaaagggaagaaacttcccggcactgcccacccatccctctgctccccactcccacccccttgaccctcgtgctcttgtatttccagttctgtctgcgcattcctgtcactgtccccagaacaccacagtgctgtctccacctaccatgtcctcttaagtgaaaacacttcccttaaactggaagatgggttgccctacagtcagcagatgacccctcactgtgccacaattccctccacgctgaaacatccttggaaggagagatgatcccaggactctggaggccatagacactttgcatgctctggtggagtaagttacaagacccagatccctttccatgctcatatgggcagaaagcaattgctgagggaaaagacactctgcagtgaggctgcctgcaagttgagcaggaagctctggggctgcggcctttttgagattttgcagttcttacgttgtaactgcctttaggtgcctaccccacacactcctgtaaataacctgaatgcactcattggctcaccaggccagaagcatagaatggtttcttttgtgtgtcatcaataccatgtttgggatgaatacatgttagttcacgtctccccaggactcaagcaatagtctgaccacacaaccccaactcaatggaatgttctgttacattgtcgaacaaatctaaagttagtctcctataactgatatagaaagtcacagagagaagagagattagaaatggttaccggtggacagaagttcacacaaacaaatagaaagcatacaaagccactaaattctcgccatgataatccatcagaaggctgtaggcgatctctgtgaagttcttccaccaaccattcatgttctcttgcctttaagctggtctcagccagctacatttttttttccccaggtggagtgactgaaagcttttctgaggtatatgactctctatagttttgtctcctttgggctactgtagttttcaattcacctttgtgattgggcctggaagtcctaagaggaaccctatatgcattcaggtgtttgatttgttcctctctcccagtgggtgtgcagtttccttcatgaagaataggatcagtcactttcaccagcagttttggctgagtggcattagcaattcagaataatcaagcagcgaccttgtctttggaacccagggatctatcgttgtgttctaatgaccacattgaagaaccagcctgcctccattttaggcttaaaagccatcttacagtaaagacaaactaggtgcattctcgtttatgattaaatctctgtttttcaaggattggactctgccccacctgtaaccttaactacaaatggttctgtactgcctcttccagagttctacgtcttcatccaaaggctactagtggaagactgacttccaggcaactagggtgaggatcttatgcccacacccacagtgacacacctactccaaccaggtcacacctattccaacaaggccacacctacctatatattcttggaccagggagtggtgccgcagatggtcaaggctacacaaagaaaccctgtctcaaaaaccactacaaccaccaccaataacaaaaagaagctgacataagaggattgctaaaggttcaaggccagcctgagctacagagtggggctttttatcttaaaaacaacataacagtttgacagtgggctaaacacagtgcctctagaaggttataatgaagttgaaaggtccttactgcctaacgacatcaacagccagcctagcacctcagatttgggcattgtagcctgtgctccaaccaaaattcagccaccatacttaatgagccaattttaaaaatccaattaatagtggaaaacagcaaaaggagatttactcagtgtagccatattgaaaaggacaaagggagccagggaatctccctcaagtccgtctttggggtcttgaagtgagattaaagtttaaatacaggacgttggatatccatccacatctaagtagactccaccaaactgtgtctggggctttcggtccccttctgtaaggtggactggcaggctgtaagaactctaggaaatctctctctgggagacaagttcctgtctgtctggcaccctctccttcccccagagtgagaatctgatgattggggattctcattgctctcctgtttcaatagtctggtagtcagatggagagacagagtgtctctttagaatagattcattttcaccagatctgttacatcagcccaaagcatttcgctcgtgttgtggcaatgagacacaaacacacctcctaccttgtagacaacgacagcacacacaaagatggacatacaccataatctacaacttgtttgtatatttacaatggtgtcttttgtgttgttagtttaaagcataaatcttctagcctacggaggtgggggagcagctataacaagtcatatacatatctcgtgattaccacatcttaatggtgtcaagaggccaggaatagtgattgacctgtctgagttacacaagtctctctgtggtgtttgctcaaagatgaaactgcttggtgacacatttcttacaacacacccctggatgggaaatgccacatgacttctcgctgtgctctagggcaaatgggagctgggccagataaagcaagacgtggggatgttctaagacacactgagaacagatatgtaaagggctctgatgtccaaccgctaaccacatttatttttgccttatattcttggtagcaaagaatttggaccagactggatgttcatcaacagacgaatggctaatgaaaatgtggtatagatacaaaatggaatttatttcgtcataaagcaaacatcatttgcaggaaaatgaatggttctggatactcttatatgaagtgataagaaacgtgcatactgtatgatatctctcctatgtggatcctagcttctaacttatgtatataaatatatatgtgagcctgtaagtctggataggtggactgtaactagaaaggggagcacagagaaaataagagggtttgagtcaggggctggggcataatagaacacctgtaccaggaacgctgaaagggggctcttagggcagaaggcacaaggcagggggaggggcgtgaaccagtgacctagtttggtttctgttgctgtggtaaccatggccaaatcaactttgggggaggaaagggtttctttcagcccacaggttttgcaaaggatgtattatgtatgtcagggcaggaggttatatgcagcctatccctgtgtcaaggcaggagctgaaggcaggaaccatttctctgtacagccctggctgtcctggaacttactctgtagaccaggctggcctcgaactcagaaatccgcctgcctctgcctcctgagtgctgagattaaaggcgtgggccaccacgcccggattcactattggcttcttttcatgacttgcccagcttgctttcttacacagtccagaattacttgctaggggcagtacggcccacagtgagccagcccctcccatatcactcataaacccagagggtaccaatacccccccccccacatgtccacaagctaatttgataaagatgggccctcaactgagattccttctcaggtggctctagtttatgccaagctgaccattgcaaggggaaaaatcaaagtacgaaagtgatatagtagggccagtgacatggctcagggaggaggggctcttgctaccaagagtgatgtcttgagtccagttcctggaacttacacgataggatagaagtgactccctaagcagtcctctgaccttcaaatgtatactacagcacatgtgcctaacttccaaataaataaataaattaattaattaattaaaatgaaagaaaatgctacaagaaagtttattactttgtgtgctaattaaaaaaaaaaaacaaacaacagtagcaaactgtaggctagaacaagcaacttcttcacagctgcaacccatacacagcaattccctaccttttaaaagagagtctaaagttacttacagtgtgagtgtgtatgggcacctgcatgccattgtatgaaggtcaaaggacagtttgtgagagctggttctcttctcacagcatgtaggctccaggaatggcactcgggcggtcaggcttgtcagcaagcaccgttgttactcagtgagccatctcttcaatgtggtaatcccccgattcaaacctgccaacatttatctcccctcccaatgtgtgtggctaacttgttcagcatctctcctcagaagaactgggtgtggtaagcatgcctatagtcccagcagaggcaaatgggtctttgtgagttcaaggccagctggtctacagggctacgcagtagagacatctgtctcaataaaaacaaacaagcaaacaccatctcctcttgggtgtctcattgggaccttaaagtccacatatcccaagatagctcaagactcctctctcaccgcagaagccaggtcaactaccaggcctgcggagtcttcatctgcttcactcctgatagcactctcttcaaaaccactctgcaaataacatttggcctctgcaaaacattttctaaatgggttcctacaacctccttaacattcctggctatccatttcacaagcagcgggatactgtgaaaccacaaatctgatgagatgttttctagcctcaagaactttggcctttttctaaaagtcaggaactcggattaaagcctgtagcctgggcaggatctgcagcaccttctctcttcacctctggtgctaacctcctctgttctccttctccagcgatagtggtctgtgattcattagacagtatgtgggcatcctatccacatcctattcctggaaaggtattacaggttctctaaggtctgaaaaaaaaattaagaaaaaactggcagggctgaagtgatggctcagcggttaagagcactggctgctctttcagaggtcctgagttcaattcccagcaaccacatggtggctcacaaccatctgtaatggggtctggtgccctcttctggtgtgtctgaggggagcaatggtggtgttactcatattcataagtcaaaaaaaaaaaagactggcgtcatttctacatacttcaggaagatgtctctaaggtgaacggacaccggaaatgtaccaaaaatccacacctctcgccatgacatcagcaggatcagccaatcagaatgaccaggaactttgttccaaacaagcaaaggaagaagagactattcatgagacaattcacacaaaactcagttccaaccactcaccaaaaccctaccaccaacatgctagtcttaaaagtgagactccagaaagtgaagatgaagatatctattatcagactgagagaagcatggaaatgctattgtagctaacttaatagacgaaaaatgttctggggagatgttgagagtgtttgccctgtcatcgtgaggacagacattcagatcgccagcacccacttaaccagctgggcatcctgtgaaccgatgtaaccccagctccaaggaggggaatgggaatctctagggtttactgcttcccagcatggctgacccccaagtacagggagagattctagaccaaagaatcaagtggagagtgacagagaaggccccggtgctttcttctcggctgtgtgcataggctcaggtgtctgaggatgctcacacacatgtacacactcaaacatgtacgcatgtacaggattaaaaaactcacatctttaaaagaatcagaaataaggaacctttatttctcatgtattttttaaaaagatttatttattattataaataaatacactgctgctgtcttcagacacaccagaagagggtgtcagatctctcattactggtggttgtgagccaccatgtggttgctgggatttgaactcaggaccttcggaaaagcagtcagtgcccttacccgctgagccacctcgccagccctctcatgtatttttgaattgtatgtttatggatgttctacatgcatgtaatgtctgtgcagctggcatgcatgcctgttgcccactgaggccagcaggagatgttggatcccctgaaattgaagttacaggcaataagacttcacgtgggtgctgggactcaaagccgagtcctctgaggtagcagccagtgctcttaacacctgagccagctctccagctcctcatatgtagaatttaaagcaagaagggaaactttattatatttactcaacttgtgcctggacttttagggaccatttttttttcccttattaccagaaatatcaaagtagtgccattagtactacttagtgcttttacattatttatttgctataattttgttagattccatttctcttttccttggattaatattttatatggttggagcacatctttgagtaatcacttcataaatgttctggaaatggtacaaactgctcatggttttcattttccttcttgaattataaatacgacgttaaagtaatttccatggcatctttgaggctttggtgagtaccgtgcccctaatgaggcatttggcacccaggaagttttctcctttccgagtaatgcaatccattctctctctttgggatcttatgcagttttcttgttgtctttgaaaacgtagaatttcactaggaaatatataatgtatgagtttttaaggagttgatattcttgacactcacaggtgcatttccagtaagaagattctaattgtcctcagtccttgaaaatgcctttctaaattgctttgaaagttctcagcattcagttggcccctgggtctttctttttgggaaaggaagttcacaagtcatggtggcagggaccagagctcagttgctatacgtcagtgtctgctttatagccttcatgactctttcttcgagcttctcggccctcagtttgcccctatttgggtctcagaaagtgacaatattaaattctggctcccagccagggcatttctgcacagggccttaaacaaccagatgtagctttcttggcaacatctatagcatcacacctgaccccacaggtcctaaggttctcctagcccacttgaaatcagtatgtcttagtcatcagaatgcgacagttcagaagtggtttctgtaccttctgaccataatgccggatcccccacctcaggccccaaagctaaaatactatgagaaaaaacagacagaaaaactgtccttgtatggcagcgtccgtactagcttcttgtcatgtagtttcttgttgtgtttgtatgtttgtttgtttgtttaaacacactacccaaaacacaaatgcatcatcttacagtttaacagcccggcatcaggcccagtcagtctcacagagccagtcttgatgctggcttggctgaattcctaactcgagggtctctgctcccttgtactgcagcctgaatagcttcatcctgaaaacctaagtggggcatcaatggaacaaggaaaaacaagcagatagaaaacccgacacgaaacacaatacggtaaagctggggtcaggtgggctgtgcctgctcggatggactgcatctctgtgtttattgtgtataacacaggagaaagagtcagctacactgggtaggcgtctgagggccagtagcctccagctgtaaccctctgggagcaggaagctgcagtgactagtttttacacacactggtcaaaccttggtaaacagccgcacttgcacacactgtcaacattttcattcagagcagaggaggccttggccaatgctgagcctgagccatatggggaaggctttgccattctgtgactgaacacagaagtgctctggtatggtcttcctttgggtccttagcactagcaaacatggagatacacgaaaatttccttttcttatcctggtgtctgaagttgaactcatggccttgtatatgccaagcacaagctacactacccggttgcaaccctagccagaggatttagatgtaaaatttcccttcttctatgcctttctttcctacaaagtccattgactagtctttgttgaagccagaaacttgtggggcaatggtctatgcacagacagcctggtctccagtctagcttaggtcttaaaccccagtgggacctggtaggtggtaatttccacctacaatgggatggaatggttatgtctcaaagctggatagagacaactagacactctctaacacatatctagaactcaagaaattgtttcttctcctttttaagtgacttcccaaaaggagtacatctaactaggctaacttaatcactttagatataatcagattgtttatgaagttggttaaataaaaagtaaactgtgagaaatttcctagctttcttatactaattatcaagaaacagaatggaaccgggtgtgatggctcacgcctttaatcccagcacttgggaggcagaggcagacagatttctgagttcgaggtcagcctggtctacaaagtgagttccaggacagtcagggctacacagagaaaccctgtctcgaaaaacaaaaaacaaacaaacaaaaaaagaaacagaatggggaaagatcaaaaattgcacaattgctgtccagagacacctcaggaaggaagagatgatagagcggaacccaccgccttctatgctttttgtagagatggagggttcttgttaagactattgtcaatcagctgactgggttcggtttgctgtacccaactggaaactgtgggccagcaaggagaagaggtccaagtggtggtatgtgtacaatttttgggtcctttggcctttggaagcagtgaggttagcagaaggtaggggaagggacgcaactgcaggtagcgccctctagtgttgcaattctcgcattggccgcaggttaagaggaagccagggaagaaagacaaagcggccaattggagagtcattgctgcccagcccaccatatatatggaaatgagcattgggagggatgtttacaagaaaatctaagttattgtgacgtttgtaggaatttaaagagattcttaacagtgagtaatgctgacacctacccattgcccagggagaggtgggtccctccatctcagcccacctgggcatcttttgcaaacattcaaccgcatactatgtgactgtcggccagagacatttcttgttctctgacaggtcccatggtgttcaacatgattctgggacttgtggtaaatgcaaattctggagcttttctaagagtcagaacccctggagtggagagatgaggaaagttcctctagctgtgtgggggtggttctgatgtagcctcaccttccctaatccctattagaaatttagctaattaatctatctttagaaatgtagaccagtagtttgtatgcaatcttttttttttttttttttttttttttttttggtttttcgagacagggtttctctgcgtagtcttggctgtcctggaactcactctgtagaccaggctggcctcgaactcagaaatccacctgcctctgcctcccaagtgctgggattaaaggtgtgtgccaccatgcccggctttgtatgcaatcttattatgaatatgaaatgacttgggtctagtagcataggcttgtaatccctggtgtttggaaggctgaggcaggaggattggtacagtgagaccaagagtagactgactggtcaactgaataagaccctgttcccaaactctttttaaaaaatcttcaaaagggcttgggatacgtctcagtggtaaagtgctttttccattgtacacgggccatcagtacaatctttagaactcaaaaaaaaaaaaagggaaatagaataaaggccagccctgacaatgctttagatctgcagtttccacactgtagagtcagccagctacacagacaggaaacattcaagaaaaaaaattttttttttgtctggattgatcatgtgcagacttctggtcattgttccccgagccagacagggtggcgactatttacactgcattctaagtgacttcaaaatgattaaagtgtacaggtaacagtacttgtaagtggaaacagaaagatgcccagctagaggctagcttggactatagagcaagcccctgtctccacactgaagaggatatacaggtgaatactagaactgctctatcttagtgcacagatgggtctacttgctctgagcttttcagagagcagtgtgtgaacaaatctgcactttctccttcctctgtgccagcccaagaactcattctttgctagcagcgttttccacagcgtggtaggtcgggagcctgggcctaagatgtttttacgggtgtatcagtggttttttttgtttgtttgtttgtttttgttgcagtgagtaaataccagacaagaggtcatttaaagggggaagggcttagtgtggcttagtgtttgacaagagagtcaaggtaggcaaggtatgtagcaggatcaggaggcagctggtcccgctggctcttcagtcaggaaactatctgctaacctcaagccaactcactcccagggatccattcttctaacaatgattgacttcctaaaggttccagaacgttctgaaatagtgccaccaactggactgggatcaaatgttcaagcaaatgagctggccaggggacatttaacattcaaagtgcaacctaaaccttttgtcaaatgagtcaaggttttaataaaatgttatttctgaggtgtgaaggatttatattgttaggaagctaagtctttctctccttctgctttggtgctggggaatgtacaactttggggagtcgattctccccctctaccctgtgacgtctagggatcaactcaggttgtcaggtttggtgcaagtttatttgcctgctgaggcatcttgccaactccatacattctttttaaatattatttgcttgatactggggatcagactcagggccttgacagcatgctaagtacccagtctaccactggtacaccctcagccagcctaaatcccattgtattttttttttattaaaatgtcatattgaaatgataggaacagagagtgtaagttttaactaaaggaaaaaaaaaaaccaaacaaataaacccccaagttggctattacatactacatactgcatgctaatgattgctttcatttacactctctgaccatgaaactcaaatgtctaggtacgtatctctctaggctacttttctttcaatcaatgatgaagacctgaagttttctctgcatacagttttgggattgtgctgtttcagaacatattgaagtgcactacttgaaaccacagtgctgtttggacgctgtgaccctgccacattgctagagggatttctactatagccttatttctagatgcatcttaatgtcatgtcagcacagtcaacagcccacccctctgcagaacacgtcttcagtgcaaggtgagacaggtaaaggggcttacatgatggtctgatccatttgggaaacacttataaatgatacattgccagagtttttcatcagaaaatccagagaaagaaaacacacagcctatcttggatgaatttaaatacagagccacggtctctattttgatctcttcatctctatagaactcatgtgttccataggccacagttttggggaatcctggtctaaaacacaatatctacttggtccctggacacagttcataccttccccctcaacagtttgtttccaatgaggtctcagcttccccaaaatggactgtaactccggtttcagctgacaactccctaggctgatcctgcctactgctcagcttcagccatcagcaggtactgtgtttgcagtttagactgtagtaacccacccctaaaaggctgtcctctgatcgccacacaaacactatggcggtaataactatttagttatagaaaaatcagtaattttgtcctttgagtttttgtgttccaggttaaccttaagttcttaatatttgttacataatatatctttaacaataatatccttagtgctgggatcacagggttatgtgttatcatgcccagctaaactttttgtggcagtaatatatatatagtaaactttaccatgttaaccattttaagatacatttagatcgttttaatacacatgttattgtgtaatttccaccaccctccatatccagaaccttcctaaatttgcctcatcagatactcaggattctatcctatcatcttggtgatttcctctctcttgtttttgtttttgttttgttttgttttttcgagacagggtttctctgcatagctttggctgtcctggaactcactttgtagaccaggctggcctcgaactcagaaatccgcctgcctctgcttcccaagtgctgggatcaaaggcgtgcgccaccacgcctggcgatttcctctctcttaatgaagaaaaaaaaatacatccatgctaaaaaagagcagccttccaggccatggtcatcaaccatgttgggtaagacagtttctgttttttctctccactcacacaaaaacataacagacagaacaatggcatccacagctggtaatctatgacctaccctgcttccaaggtaggagtttgtcaccaaaaattaggtaggtccctgttaacttgcaacagaaggactccctgtaaggcccaaggacttggtagacctaacaagccaagacccataatgtggtcagtcagatctcagagccctctcctttctccatactggtggtatttacaatatcaatgctatgagatacttggcttttgtttttctctgcagctacagtatgtttgcattgacagacaccattacttcccgtagtctgttgctactgtctggttgctgccttccgagggagcctctctgcccacggatgctttttgtcttttgagctaagtctgacctgcttatataagtgaagttttactagaacacaacctggcttcatcaagtctctgcgttctcaatcgtttgttctttaagagcaaagccgaatccgtggtagaaagacagcaaggcttagagaggaaagagcctttatctggtccaggtgtgtggcttcatacccataatcccaagcaacactttggggggatgaagatgcttccagcgccaggacagcctgagctacatagtgagttccaggacagcttgggctacaacgtgagactcaaaaaaccaagagggaaaaaaagttacctcccggtctagtttcattttgccacacttaaaaagttctaccttccaagcacttgggagaccaaggcaaaaagatcatgagattgaagccagcttgagctatctagtgagaccatgtctcaaaaacccaaaccaacctaagcagcagcaaccaagagtctgttgtcttatctcctccccatcagcagtgctgggatggaaatacgtgcctccgtctccaccgtgcagagtgctgaggatcaaggcctgatttacacgtgctgggttaagtctttttctgactgagctacatcctggccctcctttcttacttatgtacgaaattgatgtaaatgaggttaaattggttgttcctttaaaacaaatatgcaaacagtatggatttgtggtcatttctttaacaaagaattacttgactgaatttaaatttttctttctctcttttctttctttctctcttttcttttcttttcttttcttttcttttcttttcttttcttttcttttcttttcttttcttttcttttcttttcttttcttttctttttctccctgctgatttgtgtctgtgacttttcattttactgccaaatcctaaagcaagctttctgctttggtctaaacacaccttcctggagcctgataatcagtgttctattccagtcatgttaaatgagggcacaatttacccctgggggacatttggctatgtctgggaacattttagtcatactatgacacaacagtgctgtgggcaccttatggccgaaggtcagaaaaatgttcaagataatccttctgggaagaaaagtctgggctcaaatggcaaatgatgactcagtgggtctgggaagccccacccctgccttggtttgtaagcagctagagcccatcagcagctaaagtctttcaaaggcctgagtggtatgaggcttagcatgagctaagtacctttgaaaaggaggcaatgtccaatccctttgcttacagtctggtcaactctcctaaacatatgcttttcatatgcttttagcccacggatgcagtccagggcctctcttaagtgtctatttgaggcaaagcaatactccaaagcacaaccccaataacacttatttaagtttctataccttattattttatgtatatgtatgtgctcctgcatgtagcgacacacatatacctagtacccatagaagtcaaaggagggcttcagatccctgggcactggagttacattataaatggctgtgagttgtcaggtgggtgctggaaattgaacccagagtctctagaagagtagccattgttcttaaccactgagccacctctccagctacctcacttcccacttcatacatacactgaagcttcatgactgggttgtataaagtcccgactccttgatcttagaaaaaccatcaggctttgtggatgaggtaaacttggtccattcttaggaatctttttgttcagctaagaggctctctgccgacttctactcttaaaccagctcttaacagagcctgagatcagtggagattgggcatctagttctaaatagcatttgccagacaagataccactgagaaattttacaccctgcgtgtgtctgattctttccacgagggtttactgttacaggaagtgtgcaagacaccgaagctaaggccaccaacccttgagctcacatccatctctgtaaaatctatctcccaatgtcatcttgtaacttctgccttcagtcatgtggactcttctggaactgacttaagagaacacacttcctgggttggctgtgctatagtagtctttatttatatcatagtccaccatgccaatgtcattgaagtcccagaagtttagatttacaaacagcttctgagggctgggacataattcagttatagagtgcttatctaacattacaaggccttgggcttcatctcccagtaccagggatgggggcaggggtagggggggcgaagagggggagaattaattatacattcagaatctaacacatttctggaatttttttctcctaaactccaaagcaagatagaacgaatcttcactttctgccacaaactctttgtttgattcttcaatattcagatgaaggttttgtggcctgccgaagccaatgacaagcatgagaaaaatagttgcaccaatacctactaccggaaatggctgaaagctagctactgtaacaagcatcagtggtatgtatgcatgcattacagagttacagctaaaatgtttaatttgggggaacatgttcagtatatacaatatatactcataggaacatgtacaatgggtatacacacaagaaattaaaagatatttggaggaaattgtttccttccaccaagacttgaagccagcaattcaaactgtcagagtgacatcatcgggccaggcgggtgtctagatgattgaaagagatggaggaaaccagaaagccaaaggtgtttggggatgagttccatttaggggaaagagaagagtcaaggctgagacccaagcggctagcctgagaacacaggtggacaccctgtaaacagtgagccgagaaggggctccggggacagagctctgaaaaaaaaaaaaaaaaggccattgctttggctgcttaccaaacctggcctcttctttctgaagcctagaacccgagacaaggaagtgacatcatcatcacggagtcgtatgtgggttttcctcccaagtcggcaggcttcctgggagtcccaaagcgccaaggtcacggttttatttttttgtttttaatgctagtccatcttttcctcattgaaccaaatgtaactaaagatgcctgtggctctcctctataatttttgcaagtctaaatgtatccaagactataatttgcctcccatgggctcctattccttggtaacgctgtctgggactgaatgctgtgtccctcccggagtttcatatactgaagtcttagcactcactctgatagtctttggagctgggcctctagggacgtctcagtgttggaggggatcaaagggcgggatcccagtctgagggcattggtgcccttaagtgagaagacagctgagcttacatcctcattcttagtatcaacaccgagaggagatcctgtgagggcatagggaagagcatcatctacatgccaggaagagagctgagcatggaacttccagtctctacagctgtgtggccagggggttgacacatcaggggagggggagggaaggatgggggtggagagcagcagcagcttctgtgaaaccacccagtctacagcgttttattacagcagtcctagcagactaatactaattactttgaattcaattgcattggtggtgtatagtctgagtcttagtgttttatgctagatttcttttgagaacttaatggctataaagatcacatcttccaatctgggtgaggtagcaaaggccttttagtcccagcacttacgaagtagaggcaggggcatctttggaagtttgaggccatcctgatctacatacataatgagttctagaccagtcaaggctatgtaaaaaaaaaaacaacaaaacaaaacaaacaaacaaacaaaaaaaccaaaccaacaacaactacaacaaccaccctgtctaagtttgtatctttctaccttttccccctgaactttcttaaattcagtttcaggtatctttcctgtgcagctaaggacagttctgggggtgttgctttgctttgtttacatgctgtggttgagggagaaatgatacaatggcacacttaagtatgaacattcctgctccctcctgtaacctgtggtcaagagtctgatgagtaagcctattaaatgcgtggcaggtatattcacaggagacaaggtggacggctatatccatgcacactgggactatcacacggaaaacagagaatacccaagtacccagcctctttcattattctctttagtttgcctactagaaatttaactcattttctccagtggctggtactttgtattgcatttgtagtgagtcacacttctctggatctatgactagctaccctcctatgtgcttattgcgtgccaggcgctgttaggacatgagggagccctttggatgttacattcacatagcctctgagctagatatgacagtttgctttagagaagggaaactagatattaatctgtctgggacagtagagatagtaggtaggacttgaatcctgatcatccgtgttgcaaaactagatatttggagggtataattgttgttttggttctgggaacagagtattcctatgtagcccaggctggcctcaaacacatgatttttctgcctcacaagtgaggggataatatacatgatcacacctagcttgctgcatattctcattgtctgcatgtctcatgaaggcaggaagagcaggatcacttttttttttttttttttttctgagacagggtttctctgtgtagccctggctgtcctggaactcactttgtagatcagactggcctcgaactcagaaatccacctgactctgcctcccaagtgctgggattaaagacgtgcaccagcatcacccggctttttttttttttttttttttttggatcactgaatattctatttttaaaaatgtgtttagacttattttatgtgtatgagtgttttgcctgcatgtatctctgtacatgcctgtcatccataaagatgagaagatgccctgtaactggagctgtggatgtttgtgagccacttgtgggggctgggaacggaacccaggtcctctataaggacaacaagtgctctaagccactaagccatctctccagcccctctttctaccttattttttcaagtgaagtcccttactgaatctggaacttaccgattcttctagaatggcaggctagcatgccccagaaagcatcctgtctctgcctccacagatgctggagtcacgggtgtgcaccaccatgcccatcttcttatgcgggcgctgggcatctgaatttaagtcttcttgctagcctgctgagtgttttattcagggtgtagggtgcgtggcgtctacagctttagatgctttcctccttgactatgtatagctgtttcaagggaccaagtggttgagaaaggctactttagcttgtagcaccactgaacttaaacttctcttgataataagtagataatattggaaaagaaagacatattatctaccaatagtctcctcttcactcagaaacatgtcctggtttgaaaaatagataattcagtaacaaatgtaatcacaccaactcttccttcctctctctctttttctttgtgtttctctttttctctctctagctttctcttttactctctctttcccctctcttctctctcttttctctttcttttctcctttctttctttctttctttctttctttctttctttctttctttctttctttctttctctctttcttcctttcagatttatttattatatgtaactacactgtagctgtcttcagacactccagaagaggacatccaatctcattacagatggttgtgagccaccatgtggtcgctgggataagaactcgggactcagcagtctccctgatatagctctcgtgaggctatgccagtgcctggcaaatacagaagtggatgctcacagttatctattggatggaacacagggccctaaagaaggagctagagaaaatatccaaggagctaacagggttggcaaccctataggaggatcaacaatatgaactaaccagtaccccccagaactgtgtctctagttgcatatgaagcagaggatggcgtagccagccatcaatgggaggagaggcccttggtcatgagaagataatatgccccagtacaggggagtgccagggccaggaagcaggagtgggtgggtgggggagcagggtgggggagggtataagaggctttggggatagcatttgaaatgtaaatgaagaaaatatctaattaaaacaaacaaacaaacaaacaacaacaacaaaaaaccctcaggactccagatgagcagtcagggctcttaactgctgagccatctctccagcccctctctctcctgctgtctctctgtgtgtgtctctttctttgattagaaatggaggtggcaccagaatcggagcttaaacagcgacttttctttaagggatctcacattttatccttttctatctcactctcataaatatgaattctacagagtttgggaagcagaaactcctgcagagagagcatctctgtgacttgatggtccctggccaggagccacccccagtagtccttaaagagagggtttaatctccagcatccacacggcagctcacagccatctgtaaatcttgacccaggagattttacaccctcttctgacctccacgggtatctggcacacacatgatgcacaggcattcatccaagcaaaatactcatacactagaagaaaaaaaaatagacctaaaaaccagaaatagctgggtgtgatggctcaggactttaatcccagcactcaggaggcagaggcaggcagagctgagtttcaggccaacctggtctacagagtgagttccaggatggtcagggctacacaagaacatcctgacttgaacactaacaataaatgaaaataaattgttagaagagaaggcagggttaataagtagagaaagaatctgttattattttaatgttctcatgagtggaaagaaaaggtaattcctgaagttaatatacaaatacctacatctgtctccttaaagataaccaagccgtcagcaaactgggaggaggtgggcaaaacgtgaattcagacctcagagggcagtgttttacaaggatattaagatactgtctgagaaaaggaaaacccagacaggcaggggtaggaaacaagttattttatataaaaggcacactggaaagacattaacaaatgaagataaaaattttggatggaaaattaagttatcgagatgcaatatgcatggacaaaatattaaaatatattttttaagtttcagaaacaaaggcctaggtattgacttcaattttgatgttaagaacgggtcctcatcagctgggcggtggtagcacacgcctttaatctcagcacttgggagacagagacaggcagatttctgagttcaaggccagcctggtctacaacgtgagttccaggacagccagggctatacagagaaaccctgtttttaaaaaaaaaaaaaaagaaaagaaaagaaaagaaggggtcctcatcactgtgcacgtgtgtgtgtgtgtgtgtgtgtgtgggggggtaatgattcaagggaacacccaagccttatcactccaaagctcccactttcctcaccacctgaccacttttgtggttaaaccaagaagacaccaccacaaaggagaaagttgaccaaggacagccacacgggacacaggcacaatgaacatttagttagttagtcatttagacaaaggtctcctacgtagtccatgctagccccaactcctgtccctccagcctcggcctcccaaagtgctaggatgacaggtgtgtgccgccactcctgattctcagtgaccatttagaagctgtttgtccttgatgattagtgaacacatgctttctttcacacagagaagaacccagcgaggtcggcaatcccaccacagccaggaatgaaaagtcagctcacacaggctcatggggagtgacctgctgctttacattaaaatgtttttttttttttatattttttgagattaggatataattatgtcattcccccttccccttctccctccaaatcctaccatatacccctataccatatactccttgctctctttcaaatcaagacatcttttttcattaattgttattacatacatatgtgtatatacatatatcatatagcatatgcagaaaagcacacaaatatcttcttgctgaagataccgtatactttagacacaggacccagaagcccctgagctggaactgacatgaggacagctctcatggtactagaagacaaaggaagacatgaggactgctctcatggttctagaagacaagggacaaacttgcaaaggagggaagcaagcaacagtcctatccagctgtgatgcttaggaatcacagcaatgaccagcatggcacaataaccttaagggtgcagtaggcacccaaggtaccaactctctaattggatctatgatctactcagtaagagggaaaccactagaactcctctaaatagggttggttgaactgtttgaggcagggtctctctctggagccctggttggcttagaactcagtgagtctactccctctgcctaccaagattttaaggatatttaagatgcttgtttgatcggtttggtttgagtgctgggcttgtgaaactcagtatcagctctaccactgagctacagcccctaggtcctagaggggtaagttttaaagaaggttgtctttaaataacctgtaagtgcaagcaagtaattaagaagaaggagaggaggaggagggggaggaggaggaggaggaggaggaggagggggaggaggaggagaaggaggaggaggaggagggagaggaggaggagggaggaagaggagaagaggaggggaggaggagggagggaaggaaaagaagaagaggaggaggaaaagaagaagagaaggagaggacgagaaaaaggaggaggggagaggaggagaagaagaggaagaagaaagaaagaaaagaaataggagagagagagagagagagagagagagagagagagaagggttactgggttacttctggtccagctatcggttcaggattctcagactcacacagaggactgggcccatatccatacactgtggagccgtagctgtagcaggagagatgggaaaagctgtgtagctgttcaaaatggttgtcacagcggcactccaggctgtagtgaaacctcggctgctccctaatggcagatggaagaggacaagaagtaacagggctagcaccacacactcactcttttccagaattttcaagtgcagacaattctccttcagccatttaaaatgaaaactcctatgctctcagcaacaggccggcacttggcaaaaagcttgtattgaattaacactgatgctttcagtcaaagtatataagaaataaaacctcactcaccattgacagatgaagtaatagttattttgttgggaggtgccagagtctacaacatcccacatctgctcatttctacagacaccgaggcaaacaactcgaccactttatttcagctgcatccacccttacaaagacctcttataagcagccatgaaatttgtgcaattacatttagtggcaattcctgctaggcaattgtttcctgacaaggaggaaaggtgagcgatggcagagatgcatctgtgatcacttggggaaacctgtgcaaacatctctggcttccggttgccagtacctcccagagttgccaggattgcggaaatttgcagaattctctgtgtgcttgtgggtgatacttcgaagacatgatacttctccactgcctgcttcccttgcccttactaggtaagaatgtcattttcagtatctaaaacctaagcaaataccacaatctgacaggcctgctcctcagtgatcggctacaaataactaatggagccagcacctcatggctccctctctgagatttatttattttatgtacatgagtacactgttgctgtcttcagacacaccagaagagggcatcggatcccattacagatggttgtgagccaccatgtggttgctgggaattgaactcaggacctctggaagagcagtcagtgcttctaaccactgagccatctctccagccctcatggttctctctttagatatttaaatacgaaaccattttctcaaccagctgcagactcatcaacagagagctgcataccacatacatactttacataatgcaggtctgagctatggctttgtattgttaagatcgattctctgtatgggaggatggcctcaaactcaaggtcttctgtctcagaggtcctgagtgctcccgccacgactttataaggttgtaattttttttaaaaaattaaaaaaatttagaaccaaaagggtaataaagcaagagtatgcacgctttaacatgcatatatatcctctggtgttttcttagtgattaaaaaatattttagtttgtgtgtgtgagcccatgtgtttctctgctccatccacatgcatgcaggagcctgtgggggtcaagaagtgagccttggacccctggagttcaaggtggttgtgaggttctgtgctggagctgagacactgtcttagtcagggtttctattcttgaacaaaacatcatgaccacgaagcaggttggggaggaaagggtttattcagcttacatttccacactgctgttcatcaccaaaggaagtcaggactggaactcaaactggtcagatagcaggaggccatggagggatgttacttactggcttgcttcctctgacttgctcagcttgctttcttatagaaccaagactaccagcccagaaatggcaccacccacaaggggacctcccctcttgatcactaattgagaaaatgccttacagctggatcttgtggaggcatttctccaaatgaagctcctttctctgtgataactccagcctgtgtcaagttgacacaaaactagccagtacagacactgaacctgggtcctctgcaaaaaacagcaaacattctcaagccatttcgtcagccccctcttcctgatttcctaaggatctcacaagtcctcacttgctaaggccataaaaattattgcatccactctcccctgttggtaggctcagactcagtggtctctatgccacttacccgataacagttgcgtttccccactttgacgagtgtcggtgaataactttttctctaacattatgaaggcctggtctgagtgtctgtggactccttcctgtgctaaactgccctgctgccagggtcacttaactgaacagaggtctatgtaagccactgttgcttccgttgtttcattgaattcaacacaagtcctgactccttagactccaacaaacattagggaatttttttatattttaaaaaagggggggggaggaggaggaggaggaaaaagagaaagaggactggagagagatggctcagaggttaagcactctggctgctttcctaaagagccccggttcgattcccagaacccacacggcagctcacaactgtctatagctccaatttcaagggatctgacatcctgacatagacataaatgcaggcaaaagttcccgaaaataaatataaaataaaaagaagaaaaacttagctgggcgtggtggcacacgaatttaatcccagcacttgggaggcagaggtaggtgaatttctgagttcaaggccagcctggtctacagagtgagttccaggacagccagggctacccagagaaaccctgtctcaaaagaaaaacaacaacaacaacaaaaaaaaacccaaaaagaagaagacgaggaagaggaagaggaggaagaggaggaggaagaggaggaggaggaagaggaagaggaagaggaagaggaagaggaagaggaagaggaagaggaagaggaagaagaagaagaagaagaagaagaagaagaagaagaagaagaagaagaagaagaacttattcccttatcactttagaaccttttaaaccaagaaaaccagagccagggctataaataaacgatttgaggctgaaatcaggaatgtgcagcctgaacatcatgaaggttgtcaggaggctgaggaagggagtggccagcgggacaaaaggctttgagcagggatcctggagaaaatggggtattttgaggtcttggagtttaagatgacaagggtggcctttaatcccagcagttgtgagggagaggcaggcagatttctgagttccaggacagcctggtctacagagtgagttccaggaccgccagggctacacagagaaaccttgtgtcaaaaaaaaaaaaaaaaaaaagacaagggtgggctcaaaaatattgcttcgctcttttcccaaatgcaaaactaaccaagatcagctggctcgatcgagtacacaaagcaagctctttgtgtgtgttagcgaccagagaagacgtccacaatctgcttgctttaacccagaaatgcaaagggtctgaacatctctgggaatacagctatctctactcaacccccacagtgctagagcctaatggagttgccaccttccatgtggaagaaggaaggtgaatgactggtactattacacttatctgagttttctgaattgggctaacttcctccgttttatcttaccactgctattgaaagaggaacagctgttgttcaaaaaggaatgcagtcatctctctctctctctctctctctctctctctctctctctctctctctctctctctctctcggcaaatcaaacaaagccaggtcctcaataaatatttgctggacgcataaatgaatgaaggtctggctcaagtgcaaagagctttgcaatcaatcattttaaagcacaacaaaaaaccctgccggtgtgttactgatctcccaacagttggtttgctccttgaatacttcaattctcacactgggattaagtggccatttacagcctgttttgaggaaacaggaggtcttaggagaagtatgtcctgtttggatctagtggaacgggtatattatttctcagtggtttgcttcagacaatgagtcctgcaacctgagctagttaagaccgtgctgatctggcagggagtgaaatgaaaagctgcagctttgttctccgtgaatgagaaagttcaaggtcaagagtgtgtaagacacaggatctgcaattggctgccccttagttgtgtggctttgagacatcacgttcctgggtgtgtttcagcatttataacctaagaccaaattagggtattgtgcttaggactttattctattttagtcttaactctatcatgcattttcctttttctttctttcctttttttctttctttctctttattttgagacaggtttctctgtgtagccctggccttctggaacttgctctctagacgaggctggcttcaaactcggagattcacctgcctcccaagtgctgggattagaggtgtggaccatcactaccttgcaggatttttcattttttgacggcacgttagtacataaaaatatatttaaaggtgtaaaatccaattttacttcattgaagcagtaatcccattaaaaagatcaattaaatttttatcagtgttctccaaaaatttagatccacaaaattccataaaattttaaggaattaaatcccttgacatttaccaatgcacccacacctaccctcttatttaacttttggctcacatattctttttttttgttttgtttttttttgttttttttgttttttcgagacagggtttctctgtgtagcctgggctgtcctggaactcactttgtagaccaggctggcctcgaactcagaaatccacctgcctctgcctcccgagtgctgggattaaaggcgtgcgccaccacgcccggcggctcacatattcttaaatcttctgagctctgtggttggatgaatttctaaggcagtttttgtttccttttgttaaaagcactgtgacacctccacttaatgacttatctcctagagccaaccatgttctttgatgattcctggttggagcagaagactttgtcaaatcacaaaactctcctctaaaacgtaagcaggcccatgtgtgatattctggcactaacagattccagtctaggattaaatttgcaggagctttgcatcttgactaggtgcccacacgaagcccatcatatcaagccagtatagactttcttcacaggaacctagcctcagttgcttgttagatgccttatagccaattaaacgacaaccaacaggttacttaaagaactatagaactatgctgtagctaattacatcactcctctttttttttcttttttcttccttttttaaacaaagaccacttgatcacatatcctggaattcccagaacctgatttgactttggaagctgctcaacttgcaaattatggcattatgttgttgttgcactgtgtgtgtgtgtgtgtgtgtgtgtgtgtgtgtgtgtgtgtgtgtgtgtgttgggggaggaggagtattaagacagaatctcattccaaagctggccctgacttccttgttctcttgcctctacatcccaagtgctgagattacaggtgtttttgtttgtttgttttgtttgttttgttgaagggtcgaaggctgagacaggatctccaggagcctgggcttttctggaactgtgtcccacccacctctgcctcctttgtactgggtaccctgctttatttcactgaccgcaataatcacttattgcttgttaaaattttaaaatggagaacttgccaaacaaaacaaccacacagcgaaattatccagatccaaagtctatgcattccagtgaacttttatagttagaatagctgctttggccgggtggtggtggctcacgcctttaatcccagcacttggaaggcagaggcaggcagatttctgagttcgaggccagcctggtctacaaagtgagttccaggacagccagggctacacagagaaaccctgtctcaaaaaaaaaaaaaaaaagctgttttgaagttatggaacttcacactggattttacactttcaaatacaattttatgcatttacatgtctccaaacccagaaaattcatgatagttaaaattagaaagacaattctctttatttcttgttgtgatttagatgttcattattagtatttagtttttcctcattacctaatgtttttttcctttctacacggtacagtacacccgtatgtacatttgtataaatagatacatatacacatatatgctatgatacacatgagaacatgagttttcccctaagattgtgtctttgtttaatattatatattctaagcccatctcttttcttgcaatattttatttcatttttttcatagagccaaatagtgttccattctatatatgtgccatatttttactatctattgtttgttaataaacaacgtggcttccttgtaatagaaaataaagtaccaaataaacatgtgggttcaaatgtttctgtggtagggtatggggggcccctggtgtattcccaggatcgaaattgtgggtccatatggtaattatattttaattttttgaagactctccacatcgatttccataatggttgtattgatttgcaccaaacagcccgtgggtgaagtgctcctctcctcatcctctcaacctttgtcatcagattcttgatgacacgtatccgaccgggaggacgcagtatctctaacttcagttgcttttctctaatgttgaacacttttaaaaagttagtggtcatttttttttctcttgaaaactgtccagttaatttgctgctctgttgtttggcagttctatttccttggtacttaatttcagaggtttgtaacttctgggtattggcctcctgtctggagtgtgacttctgggtattggcctcctgtctggagtgtgacttctgggtattggcctcctgtctgtctggagtgtgacttctgggtattggcctcctgtctgtctggagtgtgactggtagatttctctcccattctgtgtgctgttcgctctgagagcttcctttgttgtgcagaaacttttgatttcatgtgtcctgttaatagttcctgggatactggtgttctattcagaaagttctggactacactaaaagtacttgaaaagtattctggctgggcagtggtggcgcacgcctttaatcccagcacttgggaggcaaaggcaggcagatttctgagttcaagggcagcctggtctacaaagtgagttccaggacagctagggctacacagagaaaccctgtctcgaaaaaaacattaaaaaaaaaaaagtattgtttttttccagatgtatcatcactttttgttgtgaattctttgatctgttttgaattgctttttgtacaatgtgaaaagtatgaatgaatctagtttcacccttttttttctttttctttttaagatttatttattatatgtaagtacactgtagctgtcttcagacacaccagaagagggtgtcagatcttgttacagatggttgtgagccaccatgtggttgctgggatttgaactccggacctttggaagagcagtcgggtgctcttacccactgagccatctcaccagcccatctagtttcattcttatgcaagcagatctccagtttgctagtaccgattaatgaatgttatctttttcccccaaagcatatttgttggttcccttgaaaaatcaagtgggcgtttcctcaccatttcatttccaggtcctccattcctttagtctgactgtttttacaccagtaccaggctgtcgttatcactaataaagtataatttgaggtcaggtgttataattctccttgctgtgttcttatttctcaggattgctttggctatttgtgatagcccctcatttctggttccaaatgaatttggaattcatttggcatttttctaaattctttctaaattctaaattctaaatttctaaatttctaaatttctaaattctaaattttctaaattcttgaactatgatatcaaaattcatattataatagaagattataatatgtagattaattgcagtaggacagccattttcacaatactaattctaccaagccaccaggagcatgggagatctttaggtaactttctccaagaaagataagggaaattaacaaaatggagatgaagaacttttagcaatcacacttcctctgttgtaattttaaaaatacctgcacttgccaggcatggtggtgcacgcctttaatcccagcacttgggaggcagaggcaggtggatttcttgagttcaaggccagcctggtctacaaagtgagttccaggacagccagggctatacagagaaacactgtctcaaaaacaaaaccataaaacaaaaaacacaaaacaaaacaaatacccgcacttatatttctccaacagcagctggtatttccctggtggtaataagggggcgaggcgcttccaggaacaatagggtaaataaaccacagggttctgaagcagttttactcatcccccacccccattttttttgatatgattactattgcattaaaatgagtatgacccaatgtaaactgtaacacaccatgtatggacaagatgagacttttcactttgttccaagctaaggagacatgttccaactttagtggttctctggtgaaaatgattaacatgctcaggacaacttagcaatacctggagataaattaagtaacacaagggttgcaagtggaatagcccaaactggaagagcctttacacaattgaaaaatcatcaaaacacccaaagtcaaattaattacttccccctatactcaagcaaaagaggctgtgtcgacaatttgcagccttagagaacaagtgtttggaaacaatgtctaagcacttaagaactccattaattcacaggcctgtgtgaagatctgacataagcaccaacccacccgctttgacatatgcactcatccctgaccccgcctaaagagaaaggaaaaaaggatattattgctttcattaacctctgcacctcccccccttaaagatttatttatttatctttatgcataggagtacaccaccattgcttccttcagacacaccagaagagggcactagaccccatcacagatgtttgtgagccaccatgtggttgctgggaaatgaactcaggacctctggaagagcagacagtgctctcaaccgcctagctatctctccagccctgcactttgtcccttaactcgggtagagatgtagccactgtcctcctccctcaagacaaatcttttttcctgtaccataggtcagcacatggccagtctgattagatacaagaagccagtaggcaagaaaagctgaggagatggacggcttgcctgcaggcgggacacggactggcaggcccgggctcgcaatccagcgaggggacactgccaactccgggtcccgcgagccctgaccgtccccgggccgaccctaatctgctctctctcggcacgaaaacaaaaccctttgcttgtgatccgagccatggggaagctgcaggaggaaaacgggtgcaaggaggcgccaggctgggcgacgaagtgagactggctgcaaataagaaaatcatagttaatcccagcacccgggaggcagaggcaggcggagctctgagttcgaggccagcctggtctacagagtgagttccaggactgtcagggctacacagtgaaagcctgtcttcaaaacaaaacaaaacaaaacaagaaaagaaaatcataaatggaggaaatgcattccggatccccaaatcacagcaaccctccaggaactacaagggttgtctagacaaccgctggccaccggagccggaagtgggcccgccccttccttaggcgcgccggaagttggggcttccggggagaagttccctcccatttcccaaggccggcggagcccacggcttcccaggacttgcctgcttgacacaacttttctttctctctgctctgagagcctcctcccgcggcttccttccttaagctcgtcgcagaagggtcacgt

SEQ ID NO: 223 - DNA, 86910 bp, Mus musculus
gaccgcgccctccgctcgccactgcgaggccacctgctgcgccgcccgccgcttccggctcccaggccgcccggaggctgcgcccaccgctgcccgcactcctcacctggcggcggccctctccgccggacgcgctgccgccgccgcctctcgccgccgctgagagtgaggacaggtgaggccgccaaacccccactcgctcccggcccgccgccgccggccctccgtccgctgtttattaaacttttctgtttggctgctcggcctgtgacgcggcctcaagggagcgcccgcgattggctctcaacgcgcgctgacgcggcagtcccagcccgctgcctaattatgaccggcccgggcggggccgcgggccggaggcggcgtgggggcggggccggatctcggagagtgctattattggtcaaggcatttgaggggcgtggcacagaggcgctgcttttctctcggccacgcccctgcctcggccaggtcagcgggctaggttagctttttgatgttgcctcaggagcaagagggctctggtgcagacttgggggacggcgaggggatggggtgtctgatgacgtagctccgggctctgcatcctcccagggatagactacccttgtctagagctggtgttccacctgcgtagtttgagagacgacatagattgagattctgttgcccaggcccctagaagaccaggagggccagcccaaagtgccaggtctgaactctgccctgtcctgaaccacgatttacagagagcgagacctgaggcgtgtgtgctcgcttgtgtaatacacacctacacgcctggactcgggaagccccctggaccttctcgcggaagcggtagattctagtccagcagccctgcacaggttgtgcgggagaagtgggggacagctctcctgagatttccccagcccaaacaggattgcctagagtcctgtctttatttgaaattatgttattttgttagtcttggggttgtgccttttggtgttttacaatgtttatctttgtcactgtgctctctttacctatttccctgaaatttctgccctatttttacagtaataggggctcatggtcacaaggttgagatacggctaaccatgtgtggtttgggctgctttctgtaatcctgtagaataaggaggagacagaatagaggacatggtggaggtcaggtagaattctttgaagaaaaggtggcatttgaaaaattcttatgacttcatggaaaacgaaaggaagtgttcctgaagagggcttgggagaaacacacaatgctcttgtgaggtgacagacaagtttctggggcaggatattctaaaataaatcaccaaagctaagcctggccagccaccgtggcccaggcctttatactttcagcatggagaggcaaagaaaaatatacctctgtgagtactaggtcagcctggtggatatagcaagttccagggtgaccagagctaagtagtgaaacccagggccaaataaaataaagctaagcctgctgttcgaaaccagagcagaacagaaggtccctacccagggcctaagggtgtttttgaggcacattcaacccattcaaaatttatatttaaggttggagtaatgattcagcagttaagagcacttactgctcttgtagtggtcttaggttgggttcccagcatctgcgtggtggctcacaactgtcaaaacactcatacacttgaaaataaatctttaaagccaggtgtggagactcacacctttaaactcaatactagggaggcagaggcaggttgatctctgtgagttcaaggcccatctgatctacatagtgagtttccagacaggcaaggctatgtacaaaaccaaaaccaaaacaacaacaacaacaacaacaacaacacacacacacacacacacacacacttagaaacatgggctaaaacatcgagaggattttgcccaagaagatgatctgtaataggggagacaaggctatagatagactgggaacggtttgaggttcaattatggcaggcctaaaaggtcaaagcgagtagttattttatttagtaacatataagaacttcttagacatgaggagggaaggaaaaggaagggtggatggatcctgacagctaaaagatgctgcaagtgtcaggaatcattttccagcctggaattcttttagggttcactagtttctggccgttgggaaggaaaattatatgagaagaatgtagaatttcgtctagggtttaaattgttgctcaggcactttttgacttactacattgagccatctctaatctttctatgtcctaagtttagtgagtgatgaaaagatttttccacctctagagaggtaattctaatggagggcatgcaaataaacctaatagcaaacatctgtatgctgtgaattataaggtgatatgtgacctagatggagaaggtaactatataaacagatgcttgaaggctgttggaccagggacagtagtcaggataggccccatggggaagagtaggtttaaataaaataagtggttagagtatcttggtggagattccagtgtgagggattaataaggaccattctcaagccagaaacatagaaaaggcttaagttagtggatcctgtgacctgggaagatgaagttgtgaatcaggtggacctgtgaggtaatataaaactcttactataaattaaatggaccagcacagggttttaaacagaaaacatgaaacaccataaattttaaaggataattctatgttgaaagtagtctcaagaacaccagtgttagcagcaagaccccatatggaaggttctgtgtgactccatgtaagtgataatggtgccttgcacccaggtggcaacaagggtggccacaggaagagatcaaatttgggacacattttaatggtagagccaactgtgtttcctgataggatggtacattttcactctatgtggaatgaaagagagatcaatcgggtgaaactgggttttggcttgtgcaactcagaggtagaccaagacagaggttttcttttttgtagacattgcattgggcattgccacacatccaaatagaaaggtaagtgttgtagttggatatttgacactagggttcacagacgagtcaaatccctaagtcattagaacatagtagctaaactatgaaagtgatatggaaaaatgactgtgaagaaaagcaagggatgagccctaggcatgggtttgagagttcacagacaagagcagaaagaaggcaaacacaaagggttaacagaaatgtgaaagaactagtgatttaaaagccaagtaagagaggatcagaggtgaggaagacacaacatctggcccaacactgaaagtaaatgtgcccagcatgatctaggcacccaggaactcccccgaccactggcacaggttccttccagtctgagcctgtgccctgaatagaccttgggtgccaactctacagccagtccctcaacacccagaagaagctccactcccaggcagtctaacatgctcagcaccataggattccaagatctcaggatcccaggagcttggtcacaccaggattacagggtcccagaggcccttgactcccagaagctctgacacactcaggatctcaggatcacaggatcacgcagagagatgaactctgaggagttctgacgcaaccaggatcacaggaaagacagaccccagtcagatatagcaaaggcaggtagcactagagctaaccagatgacgggaggcaagcataagaacataagcaacagaaattaaggttacttggcatcatcagaacccaattctcccaatatagcaagtcctggatcacatcatcacaactgaaaagcaagattcagatctagaatcacttcttatgttggtgatagggaacttttaagaaggtcataaatatctcccttaaagaaatacaggagaacacaggtaaacagctagaagcccttaaagaggaaatacaaaaatccctcaaagacttacaggaaaacacaatcaaacaggtgaatgaaatgaacaaaactattcaatattttaaaatggaaatagaaacaataaagaaatcacaaaaggagacatccttggagttagaaaacctaggaaagagagatcaggagtcatagatgaaagcatcagcaacagaatatgagagataaaagagagcatctcaggtgcagaagataccatagaaaacgtggacacaacagtcatagaaaatgcaaaatgtaaaaagcccctaacccaaagcatccaggaaatccaggaaacaatgagaagaccaaatctaaggataatagatatagaatagattgaagattcccaaattcaaaggccagtaaaaatcttcaacaaaattatagaagaaaacttccctaacataaagagatgcccatgaacatacaagaaacctacaaaactccaaataaattgaaccagaaaagaaattcttcctgtcacataatagtcaaaacaccaagtgcattaaacaaagaatattaaaagcagtaagaaaaaaaggtcaagtaacatataaaggcagacctatcagaattacaccagacttctcaccagactatggaagctagaagatcctgggcagatatcatacagaccctaagagaacataaatgccaacccagactactatacccagcaaaactctcaattaccatagacagagaaaccaaggtattacatgacaaaaccaaatttacacaatagatttccacaaatccagccctacaaaggataatacatggaaaacaccaccacaaggagggaaactataccctagaaaaagcaagaaagcaaactttcaacaaacctaaaagaaaatagccacctctaacaacaaaaataacaggaagtaacaatcacttttccttaatatctcttgagatcactggactcaattccccaataaaaagacctagactaacagaatggatatgtaaacaggacccaacattttgctgcatacaggaaacgcacctcagtgttgaagacagacactacctcagagcaaaaggctggaaaacaactttccaagtaaatggtcccaagaaacaagctggagtagccattataatttagaataaaaccaactttcaaccaaaagttatcgaaaaggataagtaaggacacttcatactggtcaaaggaaaaacctaccaagatgaactctcaattctgaacatctatactccaaatacaagggcacaaagtttcattaaagaaactttactaaagctcaaagcacacatcgcactccacacagtactatttcgagacttcaacaccgactctcagcaatggacagatcatggaaacagaaactaaacaggacagtgaaactaacagaagttatcaatcaaatggacctaacagatatttatagaacttttcatcccaaagcaaaaaaatataccttcttttcagcacctcatggcaccctctccaaaattgaccatataattggtcacaaagcctgccttaacagatacaaaaagactgaaataatcccatgcatcctatcagatcaccacgaactaaggctggtcgtaaattccaacaaaaacaagggaagacacacatacacatgaaaactgaacaacacaggaagaaataaagaaactaaagactttttataatataatgaaaatgaagacacatcatactaaaacctatgggacaaaatgaaagtagtggtaagaggaaaactcatagatctgagtgcctccaaaaataaactggagagagcttacactagcagcttgatagcacacctgaaagctctagaacaaaaagaagcaaatgctcccaagaggagtagatggcaggaaataaactcagggctgaaatcaaccaaatagaaacaaaaagaactatacaaagaatcaacaaaccttggagctggttctttgagaaaatcaacaagatagataaaactcattgccagactaaccagagggcacagagacagtctccaaattaataaaatcagaaatgaaaagggagatgtaacaaaggaaaccatggaatacaaaaaagtcatcagatactactacaaaagtttatactcaactaaattggaaaatctgtatgaaatggacaattttttagacacataccaggtgccaaagttaaaacaggatcaataaaacatctaaacagccccataacccctaaagaaatagaagcaatcattaatagtctcccaacccaaaaagcccaggaccagataggtttagtgcagagttctatcagaccttcaaagaagacctagttcaaatactcctcaagctattccacaaaatagaaacagaaggtactctacccaattcattctatgaagccacaattactctgatacctaaaccacacaaagacccaacaaaaaaagagaacttcagaccaatttcccttatgaatatggatgcaaaaatcctcaataaaattctcacaaaccaaatccaagaacacatcaaaatgatcattcaccatgatcaagtaggcttcatcccagggatgcagggatagttcaatatatgaaaatccatcaacataattcactacataaacaaactcaaagaaaaaaaccacatgatcatttcattagatgctgaaaaagcatttaacaaaattcagcatcccttcatgttaaaagtcttgaaaagatcaggaattcaaggcccatacctaaacatagtaaaagcaatatacagcaaaccagtagccaacatcaaactgaatagagagaaacttaaagcaatcctgctaaaatcagggactagacaaagctgcctactctctccctgtctatttaacatagtacttaaagttctatgtaaggcaattcgacaacaaaaggaggtgacagggatacaaattggaaaggaagaagccaaaatatcactatttggagatgataggatcatatacttaagtgaccctaaaaattccactagaaaactaaagctaaacaacctcagcaaagtggctggatataaaattaacccaaacaaatcagtggccttcctatactcaaaggataaacaggctgagaaagaaattagggaaacaacacccttcacaatagtcacatataatattgcacagcttgatatgactctaaccaagcaagtgaaagatctgtatgataagagcatcaagtctctgaagaaagaaattgaagatttcaaaagatggaaataacttccatgctcatagattggcaggattaatatagtaaaaatggccatcctgctgaaagcaatctacagattcaatgcaatccccatcaaaattccaaaacaattcttcatagagttagaaagagcaacttgaaaatccatttggaataagaaaaatcccaggaatagtgaaaactgttctcaatgataaaagaacttctgggggaatcacctgatctcaagctgtactacagagcaatagtgataaaaactgtatggtattggtacagagacaggatggaagattagtggaatagaattgaagacccaaaaatgaacccacacacctatggtcacttgatagttgacaaaagagctaaaaccatccagtggaaaaaagatagcatttttaaaaattggtgctggttcaactggcagtcagcatgaagaacaatgcaaatctactcatttatatctctttgtaataaagctcaattccaagtggatcaaggacctccatataaaaccagatacactgaaacgtatagagaagaaagtggggaagagcctcaaacacatgggcacggggggggggggggcgattcctgaacagaataccaatggcttatactctaagatcaacaatagacaaatgggacctcataaaattgcaaagcttctgaaaggcaaaggacactgtcaataagataagaaggcaactaacagattgcgaaaagatctttatcaatcctacatctgatagatggttaatatccaatatatacaaagaattcaagaagttagactccagaaaatcaagtaaccctattaaaaatggggtacagagataaagaattcttaactgaggaatacggaatggctgagaagcacctaaaaaatgttcaacatccttagtcatcagggaaatccaaatcaaaacagccctgagagtctacctcacaccagtcagaatggctaaagtaaaaaactcaggtgacagcagatgctggtgaggatgtggagaaagagtagcacacctccattgctggtgggattacaagctggtacaactactctggtaatcagtttggtggttcctcagacatgaagacccagctataccactcctgggcatatacccagaagatgctccaacatgtaataaggacacatgctccactatgttcatagcagcctcatttataatagccaggagctggaaagaagccagatgtccttcaacgggtgaatggatacagaaaatatggtacctttacaaaatggagtacttctcaactgttaaaaatgatgaatttatgaaattcttaggccaatggctagaactagaaaatatcaccctgagtgaggtaacccaattgcaaaagaacactcatggtatgcactcactgataagtggatattagtccaaaagcttcaaataactaagatacaattcacacaccacatgaagctcaagaagaaggaagaccaaagtgtgggtgctttggtccttctttgaaggagtacgaaatacaggagcaaatatggagataaagtgtagagcagagactgaaggaaaggccatccagagactgtcccacctggggattcatcccatatacaactaccaaacccagacactattgtggatgccaagaagtgcatgctgaaaggagcctgatttggctgtctcctgagaggccctaccagagccttaccaatacagagacggatgctcgtagctaaccattggactgagcactgcgtccccaatagaggagttagagaaagaaccgaaggagttgaaggaaaattaacagtatcgaccaaccagtccgccaagagctcccagggtctaagccatcaacaaagaagaacacatggctccagctgcatatgttgcagaggatgatggccttatcttcatcaaagggaggagaggcccttggtcctatgaaggctgtatagatgccccagtgtaggagaactgagggcaaggaggtgggagtgggtgggtggttggaggaacaccctcgtagaaacagtgggagggaggatgggatagggagtttggggggcgggaccgggaaaggggataacatttgaaatgtaaataaagaagatatccaataaaaaaaaaacaaagtatataataaaattagataaacactaacaaattgctattgagcaaaacaaacaaccagaaggaaaatagtccaagaaaaggtacaagaatcagagacctactcattggcacactcagggatcccatagacacactaaactagaagccctactatatatgcagagggcccagtgttgacctatgcggatgctgtgcatgcagctcagtctctgcgagttcaaatgagctttgattgtgctgatttcaaggatcttttttttttcttggtgtcttccatcccctctggctcttatattctttctgtctcctcttccacactgttccctgagatctgaagggaggaatttggagagacattggcatcccatgttgactgagtgttctcattctctgcaagttctctcattctctgcataatgtctgtctgtgggtctctgtatttgctgcaggaggaatcttctctgctggtggtgatctgtgaatatagcagaatgtcattatcagtcattttattcctactttgttgttgctgtttgtttgaatggtagtatttggttttgctaggtctgtgggctatctagtcataggttcatggtcaaataagcaatgtcagttatggattcagtcttgtggagtgggactttagttaaatcaaatattggttggttattgtggtggtttgaataaaaatggcccccatagactcatatttgaatgcttggtcacctaagagtagcactattgggaggtgtggtcttgttggaggaagtgtgtcattgtggggtaggctttggagtttcaaatgctcaagtcaagcacagtctctgtttctctttctgctgcctaccaatccagatgtagaactctcagctcctactctaccttgtaccatgtctgcttgcttaccaccatgcttcctcccatgatgataatggactaacactctgaacctgttagccagtcccaattaaatattttctttataagagctgtcattatggtcatggtatcttgcatagcaatagaaaccctaactaagacagttattcccacaaactttgttccaccattgccctagcatatcttgcaggcaagacagcactgtagatcagaggtttgtggctgacttggtatttacatttctcttttagtagtgtgcatagtacctttctataccaaaccttcattttagctccccatattccctctcttgtcccacttttccctcccctcttgatcctcacattccatccccctatccatatcttgtctatcttcctttgttgatgacatcaatctatttccctagccccctattctttacctaatctctttggttctatacattatggcttgattatctttgacttaacagctaatgtctacatataagtgaacaaatgtcacatttgtcccacttgggatgattttttttctactttcatccatttacatgcagattttatgttgtcatttttttgtaaaggctaaataatacttcattgtgcaaatgtaccacattttctttacccactcatatgttgaaggagatcgaggttgtttcaaatttctggttaatatgaatagagcagcaatgaatatggatgagaaattatctctgtaggaggatgtaacatcttttgggtatatacataagagtggtatcattgaatcttgagggtgattattttcatctcttttaggaaagtccacaggttcctaccaagtccttaccagcacgagctgtcacttgctttattaatctttgctagtctgacaagtgtaatatggaatatcaaagaagttttgatttgtgtttccataatggctaaggaagttgaacattactttaagtgtttctcagccatttgagtttcctcttttgagaattctgttaggatctgtactccagatttcattgagttatttattttcttgatatttagtttcttgagttgtttatatattggatagtagcactctatcagatatggattgataaaaaaacatttcccattctcaaggttactgccttccccaattgatggtatcctttgcctatagatgcttttcagtttcatgaggtctcattcattaaggattgatcttagtgcttgtgctaatggtgttctgttcagaaagtcatttcctgcactcatgtgttcaaagctattccccactttctcttccttcaggttcagtctatctgaatttatgttcctgtctttgatccttttggagttgaattttgttcagaatgataagtatggaactatttagaatcttttacctacagtcatccagtttgaccactaattgttgaagctgtttcttttctcattatgtatttctgggttctttatcaaaaatcaggtgttcataagcatatggatttatgtctgtgtcttcaatttgattctgcttatcagtgtgtctgtttttgtgccaagacaatgctggtttttattactacagttatgtagtacaaattgaaatcagagatactgttgacctgtggtttcttaattgtccaggattattttacctatcttgggtttcttgtgtttgaagctgaaaattgtccttttgagatgtgtgaagaattgagctgaaattttgatggggattacattgaatatgtagattgcatttagaaggatggctattatttatatataatttgatttttcaagacagggtttctctgtgtagccttggttgtcatggaacctgctctatagaccagaccaggtcatttagctatattaatactactgatccgtgaacatgaaagaaatctttccgttttctgaaattttcctcaatgtcttaaagttttcatcacacaagactttcacttgattggttagagttacccccaagatattttgtattatttaaatctgttatgaaaggtgttggttccctgatttctttcttagtttgtttgtcatttgtttatcggaggactactggggttttaagatccttttgtgttatctccaaatttttaacctagaattgctcctgtctaaaggaaatatggagacaaagtgtggagcagagactaagggaaaagccatccagagactgtcccacctggggattcatcctacatacagctactaaacccagacactattgtgaatgccaggaagtgcttgctgacagatctgatatagctgtctgctgagaggctctgccagagtctgacaaatacagaggcagatgctcacagccaaccattggactgagcacagggtcatcaatggaggaattagagaaaggactgaaggagctgaatgtgtttgtaatcccataggaagaacaacagtatcaaccaaccagactccccaaccccccacaagctcccagggactaaaccaccaaccaaagggtacacatggagctggagagacccatggccccagctgcatatgtagtagaggatggccttgtcagatatcaatgaaaggagaggcccttggtcctttgaaggcttgatgccccagtgtaggggaatgccagggtggggaggcaggagtgagtgggtgggggaacaccctcatagaagcagggatggggggatatgatagggggcttctggaggggaaactgggaaagggaatagcatttgaaatgtaaataaataaaatatccaataaaaacaatgataattttgtgtgctgccactttgtttacagtatttcttagctgtaggagctccccagtggaatttttagggtcacttaggtatacacatcatggcatctgcaagtaaagatggtttatcttctttctttccaatttgtatcccttggatctccctgagttatcttattgctatagctaagacttcaaggacgatactggataggtgtggagagagttgacaaacttgttttattcctgatataagtggaattgttttgagtttctttccatttaagttgatggtggctatggttgtggtgtactttgcctttattatttgagggatgtcccttgtctccctagtttctccaggacttttatcatgaaaccgtgttgggttttgtcaaaggccttttctgcatataatgagctgctcatgtggtttttgtctgtcagtttgattatagagtagattacatttaacaacttccatatcttcaaccatctctgcatctctgggatgaagcttacttcatcatggtagatgatctttttgatgtgttcttagattcagtttggaactttttagtgagaatttttgtatgtatattcataagggaagttggcctgtaattttttttttgagtctatttatagttaggtcagagtgactgtggcatcttaaaatgaatttgggaatgttccttctgtttctatttttcagaataatttaagaaatattgccgggcccccaatggaggagctagagaaagtatccaaggagctaaagggatctgcaaccctataggtggaacaacattatgaactaaccagtaccccggagctcgtgtctctagctgcatatgtatcaaaagatggcctagtcggccatcactggaaagagaggcccattggacttgcaaactttatatgccctagtacaggggaacgccagggccaaaaagtgggagtgggtgggtaggggagtgggggggagggtatggggaacttttgggatagcattggaaatgtaattgaggaaaacacctaattaaaaatatttaaaaaaaaaagaaagaaatattgccattagctcttttttgaaagtccgatagaactcggtacaaaaatcatctggcccagggattccctttgcttgggaggcttttgattattactgctttgtcactagggttatagatttgttttaattgcttacctgctctgaatttaactttggttagtgctatatatctagaaaattatccatttcttttagatttcccaatttgctggagtacaggttttcaaagtatgtcctatgattttcaggatttcctcagtgtgttgttatgtcctccttctcatttctgattttgttcatttggatgttctctctctaccttgtagttaatttagataaggatttgccatcttgctgaatttcttaaagaaccaactcttagtttccttgactttttggggtattgttttgttgtttgttactattttattgatttcagctctgagtttgattatttcttgccatctacttttaggggtgatttttttttctttttcttggagagatttctggtgggctgctacattactagtgtgaggtctctccagggtttttttttttttttgtttgttttgttttgtttttaatgtaggcacttagtgctataaacttgcttgcttgcttgcttgcttgcttgcttgattgattgatttatttatttataaatttacttgtctgtttgttttttttacatcccagatgctgccccctcctgatccccacctcaaagaacttgtttttaatagagtcccataagtttgggtgttctgtgcagttaactacctgtttctctggctggacttgcctgagggtccccttggagttgggagctggaatacagcaatgagtcaaggaaagaacacttggagggaaagatcccctggaggagtgtggggtatagcatgtggtctgctgcagtacgggggatgaggctgggggattggattagaggaagctgaggggaggtaaagatctgcagttagcctacctgcttttttattttttgtaagattgtttttgaccatttaagaactaccaggatgatttccataaggaccagactattataagtcaggcacactctgcagcctgctttttagtaactcattgggcttatgtcatttcccacctccccaagatgtgacacattgccactgtccttaggagttatgaagcaacaagtgtgctcttaaaaggtcctgacaaccccagatgattctctctgtcttgttcattctctctttcttcctgtctttctgtctctgtctctgtctctctcatgtctccatctgagatggccttttgaactcccctctcccccaataaacttcatgtgttagatttgttgtatgactaccttttagaagcacaccttggcctccacccatcaaggacactgccttagtttgggttttactgctgtgaacagataccatgaccaaggcaactcttataaaggacaacatttaattggggctgacatataggtttggagtttcaatccattatcgtcatggcaggaagcacagcagcgtctaggcaggcatggtgctggaggaacggagggttctacatcttcattcaaaggaagccaggaacagactgtcctcaggcagctaggagaagggtctcaaagcccacccccacagtgacacacttcctctaacaaggccaaacctctttatagtgccactccctgggcaaagcatatttaaacctccataggtcccatcttcttggtttatcctcactcacacaaacccctttttcactttctatcagcaaaacaatttcagcttctccacatactcaccaacactttctgtaatcttttctagccttcgtggttggacgaagtggtaccatattattgtagctttgctttgcctttctctagtgaatgatgatgctcagtatcttttcacctatagattatttgttaactccttcgaagaaatgtgttttcagatcttgctcctttttaagttagattatgtccggctgttttgttttgagacaaggcatcttgtattccaagctggaatgtagccaaagatgaccttgaatttctgatcctgatcctgggattataagccttggtactaatgcccaatttatatgatgctggtggtcaaacccagggttttgtacatgctaggtaagtgctttaccagtggagttagagccccagtcttcaaggttatgtttgttgttgtgtaaaggtctgagaatttgctgaaagaagaccccagactcaaatagtatgcaaagacaaagagtgtttattctgcagaagcagccagcaggtggggagcaaccatccaagcaaagtggcaaccataagagaagctcacaggccactcttaaagccaattaggggttttccagttgctgtgggtcatcttcatcaggattggctgagcttatatttttatatttttgtatctagtgtcagcccctggccatatgttgggtagttgctgattggctatggtttttctgagaagcctgggctgttctgggaaattgtcctttctaggaaaaagcctaagttggctgcttctaaaatggagtgagttaggtcctctcatatcccccttgagtaagggtccatctcaaatccttgagtagagtttaagggctggtattgggaccttaggactatgagttgaacaatggaaacttgttccttaacaaatcttactaggacattaataacacagagcccacatatcagagtaagtatgcataggaccaagggtctgactaaagtagaaacaagtgttgtgagccatggaaaccaattgaaaaaggacttataccagctctgggcctgttgtctttctatctcgtaaccttttatgaaccaaaggtattgattctcttatgaccactgagcgattggcatagaaacaccattgttctcccaatgtcagacatagcccactgctctatgaatgggggtccagtcctcaatgattttatgaagccacttcagctaaggaagttaaagagcttctaggtgggatatagacttttctaattcaggtgagccaacatctatggcagaatcatgagactgacccagattcaagacacagggagatgaagccctccttttgaagccaggagtttgcagagttgtgcgcatgttaatgtattctgcttatcttccagttcagcctagtttaagggcatgccacttctaatgtaaatgaggctggacagggaggtggccagagcatagtttcagcctgtgctgtcctttagaaaagctttttcgtgacctaccttgcaatctcacttcctcaaatgctttctgccacaggtctaaaactttcctctctcagaatcccctcacattcctaaaaattattgagaactgaaaagcaacaacaaccctgctttattaaatggatattaatcagttctacttcaaatattaattagtttaaaagtaacgatagtctatttacatgttcacataaggaacattgttcaatgaaaagtgaccatgactttctagactatgtttagaaagaatgccattgtgttggagcatctctgcctctctctcatattctatttaacataagacagcttggcttttatattattaattaactaattaactttgagctaccatctctatgtgctgcccaggctggtctggaattcctgggttctagtgaccatcctgcttctctccagtcaacaatttctggtatacttctcttatggtatcacatactatgtagcctctgatcatcactattgaatagctggagatgaaaagaacaaaaagatgacttgacattataatgaaaataactgtgaactttttttttaaaaataagtgctctggagttaaggagaggctccaccattaagatcacttgttgcgcttgcagaggaccctggttttattcccagtagtggctcacaactgtccataactacaggtctaggggatctgatgctctgctaggacctatgatggtatcaggcattcatgtggtacatagtcatacatgggagcaaaatacttacataaaataaatcttaaaaagaaaatactatagatttcagcctcagttaacctttaacagccaattttcatgcctctaagcatgagccaccttatccagctaacttggatctttcaaaggcacctccccccaccccctggtatatatggctcacactttgagggccactggtttaaattgcccccatgttggcatactgctttgaaatagtcaaatggcaatatatgtaaataaggtgctcactcatacttaccctttgccactcaccagactctagatgttgctcttttttatgactttactgctttgcatctacttattcccactatgtttccttctaaacccagtgtaaacacatgcttcttgatgaagatttccttgacttctataggttcttcacctgttttcacactttattttctgtttgttcttggtgttttaatcatcacatatcagttgtagatgataaagggtttcactgtgacatttgcatatatgtgtttaatgtattgctgtcatctccaccctctcccattaccctttgccctccccccattcttattgatttccttctttccttccccaactaacccccttccactttcaggtgagtttttgtttgtctttgtaatctgatcagtttcattagggttagttataggagtgtattagtcagggttctctagtcacagaacttatggaatgtctctctatattgagggaatttattgtgatgacttacagtctacaatccaattaacctaacaataggctgctgtgaatgggaagtccaagaatctagtagttgtttcagctgaccttccatagaagtaggttctaacaaatgtgcaggcaaataagtgcaaacagttgaagaagagtgagtcttccttcttccaatatccttatgtaggcctccagcagaaactggggcccatgattaaaggtgtgtatcactaagcctagatctggggcttgttttttcgcaggctgtccttgaactcagagatctccttgcctcagtctcctggaattaaaggcatgcactactttgcctgggcctaagcttttcatggctattatgcctcaagatctccatgccaagatccaggtcaaaaattcatgtcttccagactcaagatctgggtcacaggtgagccctctgattctggattgtagttcattctagatagagtcaagttgacaaccaggaatagccgttacaagaagcatgagcaccttatggtatgccattgaagaaagtgtttcttcaagccccagggtcagtgaaatacctcagtcagccagtgcttcttactacataagcctgaggacatgagttctatccctagagcccacttaaggtgaaagaagagagccaattccacaaaggtgtccactgatcttcatgtgtgcacagtggcacacatgtgttcacaccaatcttgtacctgcacccaaacacaataataataaaatttcaaatgaaagtctttccctctaccatcaattattaatgatgtataaaccctcaggtagggctgtagccccaggactcctcacacacttcatgacaggatgttgacaggccaactcttgtccaggtgatcacaatgtagtgagtttaagagcacaacagccacattgcatggaaaattcagccttccacccttcttctccttttcctacagctcttaccttcattcaccagtcctttcaagctattctctgacccttggtggggtgtatatttattacttttctgttgatatctggtgacaaaagactatgtccaaaggcacttggtatttcttctacgctgtgccctacctggcaacagccaggtgtacctgactcacaataaaagggctgcttgccctctcacgactctcttgctcctcttgctctcttaccctctttcccctgtctcccattccctcccccctctcctcttctctcccccttttatctcccctcccctcctctcccctctccccctcccctcttctctcctcctcctctctctccccccttttccttcctctctcctcctcccctctcttcccccttttccctcccctcctctcctctcctctcccctcccctcttctctcccccttttccttcccctcccctcctctcccctctccccctcccctcttctctcctcctcccctctctccccccttttccttcccctatcctcctcccctctctcccccctttccctcccctcctctcctctcccctctctcccccctcccctctctcccccttctcctctcccctcccctcccctctctccctcctcccttaccctcccctccccctccctttctctgtctctactaccttctcaactcccatccccatgccctgaataaattctattctatattgttgtgtggctcatccctcagggggaagggatgtctcagcatgggcctgaggaggcacctcttttcctcacaccttgcctcacatattccctctctctttatcttttataaacttaacagtacttatgaaagaaagagtttatttcagcttacatttctagaaagaaggtccataagatcaggggaggcatggcagcaagcagctgacatgacagtaggcacaggaagctaagagatcacattgtcaacagaaaccaaaacagggagatggaacaggaaatggggtgaagctaaaatctcttaaagcccatcaccagtaactcccccaaccagggaatacatgttcaagtatcagagcctttacagcacatttctcattaaaatcattatagggtgatagagatatcccacttaggattgagttttcaacagccacttattatcatcactttgaccacttatgtgtctctgcagttaccactgatactgctaaatgaagcttctctgaccaaagccaatggcagcactaatctatatgaccacacatagttatctagaaggcaagctgatagtcacatcatgtccatttaacaaaacaacagcagtaacttcctcacaaagacttatgacttccccttccataaggttttcagtactagatatggattccttccagtggagtggtcatcaaacacaaggagtacttgtctgtccactttggacccctatctttggactctataactaagtacagtggctcctagccttgtcgtacactttgtttctgagataaggtgttcatgtatagcccaggttgactttgaaattgtagcaattttctctagagcagtggttctcaactttccccatttggtgaccctttaatatagtcttatgttgtggtgaccctcaaccaaaaaattattttcattgccacatcattactgtaacttcgctattgttatgaaattatgatgtaaatatctgtgttttccaatgatcttaggtgatccctatgaaagggtcattccaccctcaaagggctttcgacccataggttgagaaccactgctccagactgtggtgattataagcatgcaccactaagcttaatatatccttttttaatacaacagtatatctgaagatagcatgtgtcaattggaaagaagggatagttgtagccaattcagtattatctcagggtgagcagagtcagtgctgataatagatacatgcactagactttctagctagtatgttttccccatttcaattttctaaggctcttttggttattacgtgcctaatttatttaacagacttttgttgctgagttaatatgattggccctgttttcgtcttagttatatttctcatttataaattggaacttagatttataaatcagtttaatgaacttggcttaaaggagcctgctgatgagaaatggatctaataataaggacaatagtctgatgtatttatataaaggcaggaaatgatgctccatggagcctctctactcaccagccaggcccagcctggggtcatgttagtcatcctcaatactacatggtcctactctgcccatacagggccgtgcttctttctagttgtgatcattaccagttttaatcagggtttagagattccctgtttctgttatcttattgtgtctatttatttcttttacttttctatgacttccaattgatttttgtactacttaattttactttcttcctaaagttttcaccagaacatattcccccattccccacttttggaggacaggatctcactatattggctggctgtctagaccaagatggtcttgaactcatagagatctgcctgccttggccttcctagtactaggattaaaggtgtacccactgatcacttctcttgagatgatgaagtaaaagttttttcttacagtctcatctataaagtcatttagactgtgaatgtgtctcttctgtgtgaaaaccccatgatcatctttgactttcatgttggcttttttccctcctttaccaacttcctgtcatctgtattttcagagttgtatttcttttagtatgtaccttcctgaatcaaatctcactggacaaaaaccttcaaaatacctagcattgtatacctcataaacttagttggcaaccatatgtaacagatgtgcagcttgaactttatgtggatccccctaacaactagagtgtgggctgtccttcaatctgttacctgtctgtggatcccattctcctaactgggctgttttgtctggctcaatagaagagggtgtgcctagtactgcagtgacttgatgtgccagggtggggtgatacaggggaggtctttatgttttcagaggaaaaagaaggggtaagggaggggctgtgtatgtggggggggggactgggaggagtgggagggatgtgatagggatgtaaagtgaataaataaataagttgctggggaaaaaaagatagttgcagatactaggattgacctgagatattgtcatctctgtagcactcaactgtatgacaaacagaaacaccacttggcttgtctaacttccagacaattctagatctcatcaagctgaccattacaaataaacatcatactaagtgcatgtgcgtgtatgtgtgtgtgtgtgtgtgtgtgtgtgtgtgtggtatgtgcatgcaagtatgaatgtacatacgttctcataagtatgtggctgccagaggtttacatgaggcttctccataattgctctcaacttacctttgagaaactgaacccttaagtcaccagttagctgcacttgatggacaataagctccagggaatctgcctgtcaccactccaagcttgggggttacagatatgtatgtctatctttggtggtctgaactccagcatagcatacaccttaactgatttagacatctctataggttagctcttgattttttatttttttttatttttttttttgttttctaaatttactttttttttttccattttttattaggtatttagctcatttacatttccaatgctataccaaaagtcccccttactcacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacgtctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcctagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacaccgagatattttatattatttgtggctattgagaagggtgttgtttccctaatttctttctcagcctgtttattctttgtgtagagaaaggccattgacttgtttgagttaattttatatccagctacttcaccgaagctatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaagaatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccattttgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcatccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggtgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgactgctgctgctgtggcttaggccgcctccccagccgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtctcggaccaagatggcgaccgctgctgctgtggcttaggccgcctccccagccgggtgggcacctgtcctctggtccggaaggtggccggctgtccccggcccacaaagggtgctgcctcagcgcctctgtgcttccgcctgttccagaagctgtcaggttctctggagcaccctctcacctgttcagactaatttcctaagttcggcgggtcccggaccaagatggcgaccgctgctgctgtggcttaggtcgcctccccagccgggcgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcgtcaggtcccggaccaagatggcgaccgctgctgctgtggcttaggccgcctcccctgccgggtgggcacctgtcctccggtccggaaggtggccggctgtccccggcccacacagggtgctgcctcagcgcctctgtgcttctgcctgttccagaggctgtcaggttctctggcgcaccctctcacctgttcagactaatttcctaagttcggcgggtcccggaccaagatggcgaccgctgctgctgtggcttaggccgcctccccagccgggcaggcacctgtcctccggtccagacggtggctggctgtccccggcccacaaagggtgctgcctcagtgcctctgtgcttccgcctgttccagaagctgtcaggttctctggcgcaccctctcacctgttcagactaatttcctaagttcggcgggtcccggaccaagatggcgaccgctgctgctgtggcttaggccgcctccccagctgggtgggcacctgtcctctggtccggaaggtggccggctgtccccggcccacacagggtgctgcctcagcgcctctgtgcttccgcctgttccagaagctgtcaggttctctggagcaccctctcacctgttcagactaatttcctaagttccctaaatttactttttatatatgtgtatcagctcttgattttttaattaactaattatttactttatataccaatatcaatccccctctcttcccagtaccccctcacacagattcttcccctattttccccaacccagtattccctccccagaactccactcattaagtcactgcaggactagttgcttcctctcccactgaggccagataaagcagcccagataggggaaaggaatccataggcagattcagagacagctcctactccaattgttgggcaaccagcatgaagaccaggtttcacttcagctacatatgtgtgggattctaggtccagcccatccttgctctttgattggtggttcagtctctgggagctccaaaggtctaagttagttgactcagttggtcctattgtggagttcctgtcctcttagccttcacctttctacaaatagttttatagcatgtccaaaatgggatctggccaaatatcacccatatgtatcatggtttattttattattctattgtaatttgaaaacactgccaaagagataggactcattgagtagtaaaatccaacactatactaattggttagtctaaatcaagccctaaacctgatgtattcttgtgtttatattataaatatttttattatattcattatattctttgataaagcaatctcaatgcccacacaattataatcaactatttttgccagatgtgcaaaagtaattaagtgtaggtagaagagtttttcaacagatgttggtggaataatggagaatctgccagggaaatggacctaggtacatatcaggtgcccttcacaaactttgcttataatggatcatagacctatatgtaaaacccattacataaaacttctaggagaaaaataatgttcactagcatacacatattttcttgctctcttacctgaaaagacctaaaagtcatgacaccctgataaccactagatcttagtttttagtgcttttcccaagaaaggaagcaagagaataggaaatagggctctttaaagcttgaggccagaagtatacagagtacttgtagattactttgaattatcagaaagtaaagtacttttaaaaatccccatcttagtggagtattaaaggaacacagggctaactgaaagagttatcagcagccaagaaaagaacaattcaagtaacaaagtgaatgatatagaattgaattagaaccaaagtagaagatattcacaagtccacactaataaaaataaatgattaaataaacaaatgatagaaaatggacaaatctcccatgcaaacattccaaaccagttatagagatatttgactattaggatcatcaagtgggattcctatgttctcatatgtgctatgtcacacagcatatgagtcttggggaaatcacaatgggcagccttgagtcaaacccatggaccaaggtctatcaggaaagtcacatttggtagtctgtcctctgagaaggcttcatacccatagctttcctcttctaatcactagaaaacaataaaatcaatcccaacaaaagatgttctactatatttctgactgatattgacaactgttaaggtcatctaagacaagagaagaaagaatctttaccctctgggagaccctgatgttgcactgatggagaaatatagcttggtgtcctggggtagacactgaagaacagatgagtgatgttacatagacactgaggaaatctaaatgatgtgtaactccagttaataatgtgccaatgctggttcattagttgtgacaaatgtacaacaagatactaataataggttaaatgtgaatgctatataatcatttttttctataaatttagaactacaaaataaatttcaatatataagctactctaaaataaaattttcacttaagaatgcatttatttcactcatttacgggacacctcaaacaccattaacacatttttgtctcctacagatgtgtagtctcaagctaatgaatgctgctttacatttaaaaagacacatagatacccagccagtgctgtgaacctagtgctcatgtgcaaaagacagcattttctgtcgttttctgatcatctctttaggtaacttttccatgcccttttccccaaaaacttctctgagaggctgaaccacgtggagttcttcagtgaacactcatgacctttgccctccagttctggtctacagaaaagactcgtgtgtgtgtgtgtgtgtgtgtgtgtgtgtgtgtgtgtgtgtgtgtaaagttggcttgtttattctcacatctaactctgctaactcacaggaggttgcggacattctcctacgaaagccacagcatgtatcagcagtcctctccattcatctactgcttccatgatccactaggcgctcactcccctagtatggtggcccttatcagtcttagcacagctcctgctcagcaccgtggcgagagtttatcactgtctccctagcaacctcaccattaccctggccacgaggcagataggtgcttgcccccatgggccttcaatatttgctaaatgaatgtgtcagccaatgaacttcagagaattcaaattagaagacccttgtaacactgttactaagtggttagagtagtggactgccagggctaggctcacagtgtgggtctttcaacttcccaggtgaattctctaagacttagttccttaaatttaaagtgcagatagggatatcttcttcccttggttgattaaatgtgaacaatctctaccaagtgcttagcactggcgggaccacagaacagtgcttatcagttttatacagctcagtcatagctaaaatttgcttgtcttttaaatagatagttgatgagcaaccaaaacagttggtttagtatatgtgaggcatgggtcccaaaagaaaaaagttggcaaaacaaattgtaaatttattcaaccttgctgattagtcaagaaagtggaactagaagaacagtattcatgtctctcctccaaaactagaagactgtcctgatagtatttaaagctgctataacactgctcttctttttttatgaagccaacttggaatttatcaagcaaagaccaaggaatagtttttaacatgggcattattagtgtgagtgagacttgcttaagaaaagaatagcacatacctcagtctagttgtgagcttctcaaggggcagctaccagcaatacttttttttttttaatgtatataattttatttgtttgtatgtctgtgtatatacatgtgtgttacatgtgagtatatacaagtgtacatacctatgcatgcacatgtggaagccaaatacaagctttctttctctaatgttctctactttatcaccttaagtcaggagctcttatagaactggaagcctactgtttgggttatgttggctagccagagcacttttagggttcaagttcttctaccctccagtgctggggttagaagtacatgaagtcacactgagcctttgttttgttttgttttgttttgttttgttttgttttgttttgtttgagacaggacttgggtccttccctgtagccctggctatcctggaactagaggaggctagcctcaaattgatagagatccatgtacctctcccttctaagtacggggattaaaggtgtgtgtcaccattccagacatgtccagcttttttttaatctgagtgctggagatagcacatcaggctctgatgcttgcagagcaagtactccatgcactgagccatctcctcagttcctcaatgtctttttttaaagaaagaaaaattttcagtagctaagcgtgtagatcaatagtagctcatatgcttagtgtgcatgaagccctgtgttcagttcctagtatgtgtaaacacacacacacacaccttttacacaaacaaacaaacaaataaacaaccttaagctttagtattgtgctcctgaaatctcagggcggggaggtggagcgtccctggtctttttagctagccaatctagtagaatcaggaagctgccagttcttgaaaaacactatctcaaaacaattgaaaaattggggaagatacccagcatcaacctctggccttcacacacacacacacacacacacacacacacacacatgcctaccataaaaatcttgataaaagcttactttgctttattctcatgtaagttttgttgttagacttttaaataaaaagcatgagtttaaataccacaacatagtaataataatagtagtaataatttaataacaataataataaagccacaaaagacataataaattagggatgacctttgaggttcaaaataatagaatgtgaaattatatttcctcatgcccatgcttttagtagtagctgaatgaatctggcctgtggactgttgcatgtcagctctgctctaggtagtggggactaccagtgtcagcattaagctagacctttggaggagggaaaccagaattagagggcgacaagaagtattgtgggagattcatgaaatcaagtcgagtccctcagcaaaagccttggattgaaccaagtcccagagtaaggttgtttgccacatcccagaaggttgttcatggcagtgatgctctggtcttgttgagcagaagcctggaaagaactctaaagctctttctgtgcatcccacctggggttcagtgatgtggaagaggatagtgggtgccttgccacccacttctgggcttcttcctttcattttttcccttcccactgtctttgctgatcatagcattgtacttgagaatcttagtcatcagtgggcaagcagaatgtttatttcatgtgaaaagcaactatggtccaagattgttgtccagctctctctgtgctgtcatggagacaggaaggaaggctgtaaggaggatatcagtggataccaaaggagaagagttcctgcaagggactactatcaaaggtttgttagctatagcttagcctagtatcctacactggttgcattccactcccttaaagctccaagaggtttggagtctatctaattggagaactgctatgttaaagccttgctgcttgtatggcttatggccaggaagcatcagtaccatcagggagtttgtcccagtctaccaggacctgctggatcagtactgtcattttaacaagacccctaggggatttttatgtaccttctactttgagacatgtggggcttgagttgctgattagacagtgtatagacttctattgttgttgttgttgctcttgttttgtttttatttatattttttttcttttttaacatatatgagaaataaatgtaataaaccaaatacatttacaaaaaaatataagaatcatatgatcatctcaatggaagcacagaaaaagaaaaagtctttgataagactgaacatgcattcttaataaaagccctagaacaagtaggattttaagaaacatattccaacataataaaggttgtgtctgaaatactcatagccagtatcatcctaaatgaataaaaccattattaaaccccattaaaataaggaatgggagagggctgcccactgtccctactgctcatccataatgtgattgaagcattagttggagcaataaagcaagagaagggatacaaatgggaaaatattaagtcaaattattttcaattgaagattatattatcttatatccaatgttcccaaaatttgactagaaaaattgtagaaattatcaataatttcagcaaagtgttatgatacataattgacttacaaaattcaccagtcttaacacatatatgtaacaagcatgctgagaaagatcatggacacgctcctctccccagttattcaaataaaataaaatatacataacaaaagaggtaaaaatcctctacaatgaaaactttaaatgtgtgaagaaagagattaagaaacatactagaatttgaagacctcccaagcatatagcttggtagaattaactttgtgaaaaaagacattcttaccaaaacagtttactgattcaaggaaaacaaaaatcaatatcctcatctcattcttcacataagtagaaagaaaatcctcaatttgatatggaacaacaaaaggcccagaacagctaattagtcctagatacgtgtttgtttctatgcattctgctgattttaagtgctaagtgcatctgtcaatgaccccaacttttatatatctgtttctattgagtcgattttgtttgatattagaattgttactccagcttgtttcttggaaccatttgcttggaaaattgttttccaacctttttctctgaggtagtgtctgttcttgttactgaggtgcgtttcctgtatgcagcaaaatgctgggtcctgactacggatccagtctgttagtctatgtctttttattggagagttgagtccattggtgttaagagatattaaggaaaagtgattgttactccctgttatttttgttgttagaggtggaattatgtttgtgtggctatctttctttgggtttgttgaaagattactttcttgctttttctagggtgtagtttccctccttgtgttggtgttttccatctattatcctttgtagggctggatttgtggaaagatattgtgtaaatttggttttactgtggaatatcttgttttctctatctatggtaattgagagttttgctatgtgtagtagtctgggctggcatttatattctcttagggtctgcatgacatctgcccaggacttctagctttcacagtctcttgggagaagtctggtgtaattctgataggtcttcctttatatattacttgacctttttcccttactgcttttaatattctttctttctttctttaatgtatttagtgttttgattattatatgatgggaggaaattcttttctggtccagtccctttggatttctgtaggcttcttgtatgttcatgggcatctctttctttaggttaggaaggtttttttctataattttgttgaagatatttactggccctttaggttggggccctttggtcttctcattttgtcctagatttcctggatgttttgggttaggagctttttgccttttgcattttctctgactgtggtgtccatgttttctatggtatcttctgcatctgagtttctcacttctactcttgtattttgttggtgatgcttgcatctctgactcctgatctgtttcctaggttttcttaccccagggctgtctccctttgtgatttctttattgtttctatttccttttttttagatcttggatggttttgttcctttcttttgcctgtttgattgtgttttcctgtaattctttaagggatttttgtgtttcttctttaagggcttctagctgtttacctgtgttctcctgttatttctttaagggggttatttatgtccttcttaaagtcctctatcatcattgtgagaagtgattttagatctgaatctagcttttcaattgtgattgtgtatccaggacttgctattttgggagcattgggttctgatgatgccaagtaaccttggtttctgttgcttatgttcttatgcttgcctcctgtcatttggttctcgctagtgctacctgccctggctatatctgactgtagcctgtccttcctgtgatcctggttgtgtcaaaactcctccgagtccagatgtctctgtgatcctgtgattttgggaacctgtgattctgtgatcctgtgatcctgtgttcctgagatactgggtgtgtcagagctcctgggagaaaagctgcctttgggactcttgggattctggtgtgaccaagcccctggaatcctgggtgtgttagaacatctgggagtggagcttcctctgggtgttgtggggctagctgtagagtttgggcccaaggtctgctcagggctctagcccagaccagaaggaacctgtgccattggtcaggcagggttcctgtttccctgaatctgctgctcccagatattcccagtggtgttgggacagatgttgtgtcctcacctctgatactatgatcctgggcatgttagagagcctgggagtggagctgtctctgggtgttgtgggactggctgcagagtttgggctcaagcttgtcttgtttttcaagacaggatttctctgcatagccctgaaactctctctgtagatcagactagccttgaactcagggatctgcctcccaagtaccgtgtatagaccccttcaacaaggctccaggctcaaagaaacttcagcagctcagagtcatcatctactctgacatgggcgagaccagtaaaacaggttctttctgtgaggaaatgggtcctcagcctgaggcagctaagaaatcctggagagtgacacagacagaccacagctgaaggccatcagccctgggcactcttctcaaaggcagggacctttctgtgccctccttccagacttcctgccctagccaggcacattgggaattaattaaagctcacaattctcttgcttttccccactcagcttttagagctaatgccaaaaattcaatctccctgccccatagcccctggagcacagcccctggtgtacagttggtttagaaaaactctaccagaaaggccttccttccctgctaagatccaccatagcattgtcttctgactctgggtggtgggactggtggagagagagtatatttgaaagcccttggaatgtactactagcccatctccagcgctctaacccactttctaggctttgtaaccagcctcctctagtttcatacctaaggagtactgctacttcaggaaggtagctgagctttcattatagtcttctctcaacagtattcattttgaaaataaatctacctgtggtggtttggatgagaatgtccatataagctcatatatttaactgtttggtttccagtggtggactgtttaggaaggattaggaggtatgggcttgttggaggtgtgttgtgcgggtggagttttaagaagcctaaactaggccaaaccttcccccctccacttttctgtcaagtggttgtggatcagatgtaagctctcagctatgcctctagcaccatgcctgcaaccatctttgcagctatgatcatggactcactctttaaaactataagcaagactttaattaaatgtgttcctttctaagatcctttggttatggtgtctcttcatagtaatagaactgtaataagaccctacctcacattgtcttatcttgagtgagccatgttgggaccctgattcatatagctggagatggttgtatcatgggagagagatgtcaccctatctctcaatggtatcaatagggcaaggcatatctgaatcaagcattggatcacacagcacataccacaaagagctgtctccttcaaagagatgaatatgggatgttggaggtttccccaaatatcagctagccatgggaaaagaaaggaacattcctccaagcagaggtgagcaaaagctgaagccctttggtgtgtgcatagtacagaatagcaaaattcctatacaactgagaagcagatcagtgacccacccagttccttccagctttgaagctgtgaggctgcaaacagctccggctatttagtaagtatttagtaagagtccctagtgtgtcttgggtactaagttactatacagggttttattatttgtctgaatggaagcatccagacaagtcacaaccatctgtagtacttggtgttgctatctttcccagcaaggttcacttgtctggggaagggggggggtctccatctaggtggacaggctactgctccagggctcaggcttctctagtacatacttgctcacttctcagtcacctggctgggcagtagcagcacaggtcaataggatctagacattttgcaccctctgaaagtgagagaagggaagggagagagggagagggatgagggagagggatgaaggatgagggagagagagagagattgattgattgattgattgattgtgtggggtggagcagctagctggtggtaaatgtattaattaggaagaggaaatattggcccttcctttggggcctcattttcaccacttgacttggctaactgtgactgaccctgtggatgtagctgggtgggggttgggatagaatctacaaatgatgacagctcagagattcagaaaagtcaacatgtagatttcctaggcatgcatagcctagaagcagatcctgaagccaagagtgaggaaggcgaccacccactagaggtctgacaaggatgtaaaaataccagccctgggtcacaggaagtttggctgacacagagcaaatcacttcatgggtaaaaggcaatgggatattgttggatactggctgaaagggcctgggtagagccttaaggagtccctatgacaattatggtggcctgggttttaggcaacaaggaattcctaggctgacccttgaggtagggatggaagaggattgtcatgaggcttaatgataggaaaggagaattgaggagagtgacatgtgaggctatggttcaaggatttactctaagcctctcactagaaagagactagggtcattgcctgctcgattgctggtctctgctacagtgaggcactcagcaataaaccagagtagccggtctgtctccactctccagagcttgaagctgcctttcctgttgctggctgaatgactgacttggcagcccaggtgtggctgagtcagcaggtcccaaggtgtgagtgtcctggcctggatataggggtggactgagtgcctgattgacgagccagttcctttgagcagcagacactgtctctccctctctgacaggtccaaactgcctattgaacatgttgcaacaaagaaggtaaaataatatttgttaaacttatccccatcaaactttaaataaatgagacccaaactataaaatttcagctttgcataattactcggggattaccccttatcaaaatctcttaatgctagtctatctactggctcaactctgctcttcatatacttgctgtttgaaatcctctgggttatttctgctgcagcagtctggtgtcctcgggaggcatatcattctggcacgtactgttagtccatgatgactcctggagaccttctgttctcccatcttcttctctgtactccttttccttcctcacctcctcctcagtgcctacctacgactcccaactggataactcgaactccacctctctgtagtccccacagttattgtatgccaccagttttatttaaccaatggttttaaattggggagcaaggtttacatagtatcacttggtgtagtatatgaggatctgctcatctggggacaaccagatcttgggagccacattatttagcatttaaatagaagcaacaccagaagaaccccttagaaagaacacagacttgaatttgaccaactgtctcagtttacctgggactggcctggtttttatcactatccctagaaacctctgtagaataaaatgatgcggttcaaggattgagatccttgacaagagtaaagagtggccaagtgtaaagtgatctattcatggtgccaagttgaagccctagggcttcatcatccatgcaaatgaggccaagctggtgtttgtgtctagctcctctgaaggaccacatggctgggcatttcagaagcaattaattagcagcatctctgacctaaatacctccaattctggttcattagtcattttcatctatgaggaaatccatggaaggaaaacattaagatgaaatagtacaggcagagtagagtagatcatatctgtaaactcagcctcaagggaggctgaggcagacagattgtgaggttcaagccagtctgggctcagtagtgagacccataatacaaacaaacaaaaccctatatggtgacttagtacctaagacatactcgggactcctactaaatacttattaaatagcacatgaagagtcagggtagtctttgcagaaacaaggagccaaaagggcagcatgaaataggtgggactggtaattttgaaagccattaattcaaaacaagagggccacaataggcagcatagggaatctggtttccagcaacccaacaggaagcatccagacaagtcacaaccatctgcagaacttggtgttgctatctttcccagcaaggttcaatttgtttggggaagggggtctctatctaggtggacaggccactgctccatggctcaaggttctatagtacatacttgctcactcctccaataggccagtcacctggctgggcagtagcagcacaggtcaagaagatctggacactcatacatgagcgtgaggggagtttggtctgcacatagatgtgtgtacacacgcaatctcttccatccccctctgtctgtgcagaaggttaaatgtcaatgctgaggcctcctgaaggctgtggtataacctgaaagctataaaccaggtactgtagagcagcaagaaggatgccataacctggatggcatggatccaccctgtggctcctccttgagtcctgtgcacctgcttccttgctcacctgcaggctctgggcctgtctccagacacgaatgctggatgctgctggcatgtgtgtgctccacttggctttcagcctctcctgtgctggcactgactcttcttactcactctcaactccaccctctcctgccctcctgactttgatgcctaccaactcattaaatgtttatattgcaatacttcctctgtgcaggcaatgggctaggtgctgggcttcttggtaaacaagacaaaggcctataaacactcattatggaggaagaggagacaataaccagtcaattatgtacaatgtgataagtgcctgtgtggcataagtggctgtaaggttaggtagagattaaaggtggcagatgaacaggagagctgcagttttgcttctcagctgtaggttgtgccatgaattacagctttatccccttgaccatatagttttaccatccatccacctatcagtccattttctccttcagtaactattgggaccctcactgaatgccaggcatgctgtactggcattatgtcctggaattatgatacaaagaataggctcctctcttctaccaaacttttggtttcccaaatgtattctgcttcttcctatctgacaacatccatactcactggttcctttggttagcttagccctatccacctaggttaggttatttccttcattctttaaccctcctcaaaggtcatctctttaaggacagcttccctggcctcttcaccaatgctgggccccattgtgatgctttcatagcaccctgtaattttctttcatagcatctttgattttgtatttataagaggaactattttactagtgtccatcatgtctgccagggactcatttattatagtatttatgctgtctagcacagagcaatgcattcagtaacataagttgaagtagtagatgaatgggtaggcagtgttgctgggtgggtgggtggtttgctgactagatagctggttgtgtgggtagatgaatgggtggatgcatgagtgtcgagatgaaggatgtttgcactagagcaaaggcagaatgaaggccagttaaaagactgatctagtatcaagttagagctagttgaggattaggaaataggccccagtggaaaagaagcaaagccaaggaaggtttagcaggagatggtctgcccgatttggtctgtggttgcaggatgtggcctgcttcaggagtgaaagagaggaaggaatgagtgacaggtgttagtcacggttctcactgatggctggaagactgaaaataagagagagtagtctgaaggtatagaataaaaaagatgaccctgtgaatcggaagtctctgttggagcaaagaagtgaaattttaagttgtttttttctgtttgtttgctttattttctcttttcttttggtggaccacaccatggtctaattgtaagtgtttggaattagcacagcaatatctgacatggtgacttaatggtccctgattcctcgcatctgttattattactgtagcccaaaattgtgtcgtgtttaatccctatcctaaactgatgtgacatcgtttatatcttaccataaggctaaacattcaaggctcacacattttccaaacttcaaggcttgggtgcctggctacacctgtgtcatttagttgcttttctttctgactttggtttggaaacaaatgacataaagaatcaataggctctgagaatccagtcagcagagggaggcagtggcaatgtcctccacagccagtagaggttagagtgacagctgaataggctgtagcatatcttacccatggtatcaatagccccattctacccttttgtccactggttccagctctgtggagtgctctttcacattgttctttgctgttcttgatggtttctcatattctgtgaactacttaatatataacaatcaagaagagaatagccttttttttttttcctgcacaaactcatcagtgatgtcttctgttgcttttagctaggcacttggtcctatataaacctccaagtatagatcagattccacctggactgacaggagcaggacttaggagatctaggccacagagatcatggaggaggctaacatcaggggagtatattgtgctgcaagtttttattttgcaatgcaggaggcaagacatatagacaggaactctgcacaaggagcgagagtagtagacctctagttccagccagtggaggtccctgccttgtctagagtttgctgtttaggaaactaactcctagtccaacaagtaagtccattgcgtcttcaagccccattcttcttgggctgctgccctgttgcttcttaaatgcactggccttgtcttcttctttttttttttttcctttttttttaattaggtattttcctcatttacatttccaatgctatcccaaaagtcccccataccctccccaccactcccctacccacccactcccactttttggccctggcgttcccctgtactggggcatataaagtttgcaagtccaatgggcctctctttccagtgatggccgactaggccatcttttgatacatatgcagctagagtcaagagctccggggtactggttagttcataatgttgatccacctatagggttgcagatccctttagctccttgggtactttctctagctcctccattgggggccctgtgatccatccaatagctgactgtgagcatccacttctgtgtttgctaggccccggcatagtctcacaagagacagctctatttggctcctttaagcaaaatggccttgtcttcttaaggctgctgcagatgacatctgacattatcatgacaattacaacacctacctgttcagaagagtaatgtcaagtatgtgccatcagtggcaccctccttactaatcaatgcccttctgatgtgatcagcctttcatagtttgcaacaggcatttccaccaaacaattgttttttttctcagtgaactcagaatccttctcaacccagtttgcaaacagtcctggataatttcatcacaattaactcatgagatgctgttctagtcttgatagatcatgagttagctcatgaagtgtatcttgctaactagctctggccaatggttttaggttcacccaactttttatttttgtgcttgtgatctcaaagattcaactcaaggtcttacagattctaacaagcatctatcattgacctacatctccagattccgttctgctttttataaaattaaataatatttttaaaaattaaaatataattacatcattatctccttttttccttttttttttttttttttttttttgagacagggtttctctgtgtgtaggtatggctgtcttggaactcactttgtagatgaggctggccttgaactcagaaatctgcctgcctctgcctcccaagtgctgggattaaaggcgtgtgccaccactgcccggctttgcttcttaatttgatcaaacttttactcagatactctccttggccttgaactcacttagtactgcgtaacttgtgtcctggttttctttctttcttcttcttcttttttttttttttttttttctgtgattaataccatgaccaagaataacttcgggaggtgttggagggtttatttcatattgcagattacaatccatcactgaagaaagtcagactgggaaagaaagccagaagtgcaggaactggaaacagagaccacaagggaacactgctcactggcttgctctgaggcttatgttcacttactttccctatttatcttatcttagcctaggcctacccatctgtggatggtaatgcccacagtggactgggctctactgtatcaatttgcaatcaagaaaatgtcgcatggatatgcctacaggccagtctgatggagacagttcttcaactgaagttcctttttccaaggtatgtcaagtagacaaccaagattagctatcacaatttagaatcctcctagaacagcttacttggtagctagaactccaggcttgtgctacaggtccagcttatacaatatttcagtgtatgttgcctttacttttcttgctagttttgtgtaatttagtctttcttcagtatccttagagcttgggtttgggatttctaaaattggccagatctgtagatgttcagtcccttatataaaactgcattgtctttgcatttggcttaagcacatcctcctatattctgttattacaagttatctctagattactcttaatactatacatgatgtaatggcaaggtaagaaacctgtacatgtttgctacttttatttattttagtttttggagatatgaccttgctatgtaaccaatttggccactcacagtaatcctcttgccctatccttctcagtgctgggattataggcatgtatcaccatatcagacttatacatttttttctaatattttaagtctgtggttaattaaatcagtaaatgtggaatgcacagacatggagggttgactgactcatttgatagcaggattgctttagcagtgagaaaactagtatctcaaggagttaagtgaattagttgatcaaaattacctatataaattaccaaggttagaacttgaacttaggtctcttggttataaatccaaactctttatctctgtcaataatatattattcacccatgtatcatatagattataagaagtgcttaatgaatttcaaggaacagaaaaagtcagagtagttgctaaatctcctgagctggcctgcttgagaataatggttgttgtaagtgggaactgtggtgctctaggtaaaatgggtacatcttgaaatctctgttgaagttaggacaaagattttgtgctatagtctaagaagccatgagtatcggcccatagcgaagtaagcaagtaatctttcactttccctacagagggtcttgagcctctgaaaaattgtatcatagcaagcagtgccatggtgttttgttttattttattattttatttttagtcaaggacaattttattagagtttaaaagaaaaatcccagggcaagcaagctgtagatcacatcagctgctcagaggaggaaaatggacactaggagaaaaaaaaaaaagtcattcttgggctcagctacaaatgggacatttatgccaactctcactctcccaccaaggctcagggactatcttataggagggaacaaaaagatataacatccagaggtcagggaggatcagagtgaaacagtatctttgaacacgtcaggacttctgcacttataaaaccatagcaggtgctttgcctgcacaagtccattttagatcatggtcccagacccctagctatcaactatcaatagttctgtcagcgtgtggtcattgtggttaatcatcctccagtggatagcctcacactcatgatgactatatgggcaacaaaaattgaactagggtacttgaatagccagaacttgtgtggcatttcctgagcaggccttgaacttgttgagccagtccatcagcagggtgcctgctggtgggagacaaaagcctacaaagcctttgttataagctgtccagctttgttgcaagtcagtagggtgaggaagaagctagacatcttggcacattgccatctttattacctagccataggcccaattccctatctgtctgcttaccatggaatctgtctaacttctagcctctcagtgggaaggtgggaagatggtctacaattcctgtttggagaagttgagggaagagttggaggtgaatatgattaaaataccttgtatgaaactctccaaaaattaataaaatattatattaaggaaggcaagcaaaagaagaaataatgctgagttaaagcacatgatagataaactttacagggtagatagggggcttcagagagacagtaagttagccccaaataccagagaaagcattcttagaacagagatggaagaaaaagaactattataattttctgagtaatacagataagtagacatacttatgaagcctatgggatggggcactgtaagccattgctatagacacaaagttttataaacaaaaatttcagcaactcacaatgttttaaaaacaatcaaaacaaacaaacaaacaaaaaacaagtggtagtggcagtggcggaggcagcagcagcagcagcagcatatacctttaataccagctcttaggaggcagagggagatggatctctgagtttgaggccagatggtctcagataaagttacaagacagcaagactccatagagatactctgtcttgaaaaaccaaaaatgttaataataaataaataaacaaataaataaataaacaaaaaactagcataaatagtaaaggtgtggtggtgtatgcttttagttacagcacttgggaggcagaggctggcagaactctgtgagtttcaggccagccaggcctatgtagtgaggccctgtctccaaacacaaaaacaaaaatcataaacatgttctggttgttgagggaccagtaaaaatagaggacctatagattggtatgtttgccttctattctaagaattgagagttacaaatgctatttttttcagattcctgtattgctagagaagatgtgaattattttccataaattgtgtgtgtgtgtgtatgtgtgcttattttgcatgtagtagtgaattttgtagagcaaaagatagtagggttgtataaaattggaggttgccaatggcttcctgatttaagagatggcttccagtaggtgacaggggtggcttcttcctgcttctgaagcttcctgatcacatagaagcaggagatgactctaatacacaggtctctgttgtggttttgagagtccttctgggaggcttctgctagtgtttgcttcctttgtgccttcaatgattctgtcatctgtctttaacccttaataggcacctttctgtttatactagctggggtagatcctgtggtctatagctgagaaatctgactaatatctcgtgtctgtagctgggctcttcccagtcactcatatcatagtagaagttggcttgctgccctctactgggatcgggatatacaactattttggtgccagaacaatactcactattttttgacagatgaagaagtccagctgctgagagctagctggatcttataggtggatgctgttcctaataaccctgggagaaaggaaaaaggagagagctgtctactctgctcctggaaagtagagggttgggtttgagcgtctttttcattattgttgacccaatggccattttctctgattccaagttctttagaatacactgtgtgtgtgtgtgtctgtgtgtctgtgtgtgtgtctgtgtgcgcacaaacaattatactcttggggaatgttacagcttaaacactgagcctcaccccttgtttttagtcatgttcttttgatttctgcattctgatagacatcttgaagcttttctgggtctagagctactgtcctctcagagttatataaatacaagctatcccatctagatcttcaattctcttcttttctggcctcttctatttattgccacaatcactccaagaccaggtacttatcatatgattcaatacaaaagtaggaatattagaaccacaattgaagaattactgtagactccgagtaggcaggtctgatgactaacattgttagattcagtcacagggaatccccatccccctagatgtttatccaacttgattaaaaactgtgtcatcacaaaactcttcacaattgggctggggtgtagtaggttgcttgcctaccatttgtgagggtgtgactttgattcccagcatcaggaaaaagaagacaaatccccaaataacaaatcacaaaaatctgcacatgaatatttgcagccttattcatatggccatagctttgagaaaagccaagatacctttgaataaaagtgatagtccattgtcattttctgtttggtgggagtgagaatcatctaggagacataccactgagcattctaagaaggtgcttaattaaggaagggatacccactctgaatatggagagtaccttttcatgggctcagtttccagaccaagttaaggggagaaaatgctaggaggtctacattcctatctctttgcttccatactgcagacaatgaaaccagctccctagtactcccaccatcaggtctttcccacctccatgcactttattcatgagaagagagccaacataagccctcctttaagttgcttttgtgggatattttgtcacagcagcaaaaataagacgtaggtgaatgcaatagtaaatggataaatgataactgtagcacatctagataagttgacacttcatcgattaaaaaaagaggttctaccagctgatgaaaagatgaggcaccttaactgtgactaattgaaagaatccattttgcatactctgcaggttgtgcaatttcaactccatgaactttgataagggaaatcacgcatcaatgactgcagtggggggagggggggtttaaggtgtaaatagagatggataagagaatgaagtacagaggtattttagagcagtgaaaacactctgagtgatgtcctaatggtctaggtacatgtcactgtgtatctgtacaaacccataaagtgtccagtaccaggacttgatgtgaacttcaggtgacagtgatatttccattctgattcatgagttttcacaagtggaatgtgtcatgatgggtgctgatggggtggggatactgcctgtttgtgggggacagagactaaattggaaatatctgcagattcaggctttttatatgctacccaaatactctatgtctgctacacccaaccccttcctctccgttaccaagttatcccattctcaaaatgcaaatacatatttttttttctattgcaaggcaaaggggatagttgttttaaaaaattttattgggataaagtttgcacccattttaaatgcaccatctgatgaggtgtttttgggttgttttcagtttgatgagatttttgcagttgaaatccccatctctaaccacaagccggcaggttgaagataaaggatattcttgccccctgaacactcccctcccactctgtcagggcagcactttacagattgcagccctggaagccactgattcctttttcctgcccttctaagactggctttgcctgcacaagaatttcacataatcaggttatgaggcacagactgtttttgtgtctggcttcttttacttggtgtaatgttttacagtttcccatgctgtttcctatctcagtaattccttccttatagattagggttccacttgtggatatttgggtatttatccatcattcccctctgaaaggcatttgggttctttctagctttgagttattgtgagtgaacctgctatgaagtttgaatatacttccttagaaagacatatttaccttgactacagtgctaattctagaattgtgaactatatggggagttttatatttatattgatgagaaaccctggattcttaaaaagtgaccatgccactctactttctgccactacagttgacagttccagttgctccattttctttgcacttgatggtgtctgcgtatttagattctgccaccaggtagcctttccatgcgtttttaataaatgtttccctgtatgttcatgatagtaagctttgtaaattgacttatttcatgacaggatttaaaatggcattgaaattctttgtccatttgtaggagttggtttatgttgttactgaattttaagagtacataccagacactattgcatatgccagcaagattttgctgacaggaccttgatatagctttctcttgtgaggctatgccagtacctggaaaatacagaagtagatgctcacagtcatctattggatggaacacagggcctctaatgaaggcgctagacaaagtacccaaggagctaaagggaccggtctgcagccctacaggaggaacaacaatatgaactaaccagtacccccagagctcatgtctctagctgcatatgtagcagaggatggcctagttggccatcaatgggaggagaggaccttggtcttgcgaagattatatatgccccagtacaggggaatgccagggccaggaagcaggagtgggtgggttgaggacagggcggggagagggtataggggactttaggagtggaaactaggaaaggggatagtaaatgtaaatgaagaaaatatctaataaaaaatttaaaaaagagtacattatacattccaggctcagctccttcgtcttgtgtgccatgattttctgttctcacagccatatctcatttatggtttcttttctttttctttctttttgataggttcctgtgaatatttaaatttttatgaaccccaatttttcttttgttttcatttacagattatgaaatgagctgactttgttgctgttgttaaagtgaacacattctttcttttatgaactccaaggcccttgaaagataaaaaaaaaaaaatgagaatttggatatctgttctccagaaataaagaattctggataggaatattcctattcctgctaggtccctcccttagtcctggacatagcacccctgtgtcttctgcctcctgctccatgcatgccctgcccttaaatgacattttgtccccttgtctttgttttgtcctccagtcttgggatacctccttggaacctttcaactcattactcactacctgagactgaaagctgggagaagcaagtggatgtcagatagattttgcatttccatttcaataggttaagttgcttttttttcccttccagacagagtttctccgtgtagtcctggctgtcctggaactcactctgtagaccaggctggcctcgaactcagaaatccgcctgcctctgcctgccgagtgctgggattaaaggcctttgaaaccaacgcccagctaagttgcttgtttttaaagctttttttttttttttttttttttttttgagattgggtctcttatagccccaggttggcctcaaaatcaacaggtagccaagaatgaaccagtttttaatgaagttggaaataaaactcaggagttagttcttgttaggtaagtgctgtacctaatgagctaagtttccagcctctctttacaaaagctgaaaacatggggcctggtgaacatatttcaaaagatcactggaggaaagaaaactttttatcttgttttgagtgtgccaaggcctcagggcctcatggggtttaagcaaacaccagtgatctacacccccaactctgttacctcttaacttataagaaaaatgggtaccttttgagcttagtcatcttcagagtgtcaaatgggatctgactgcttcttcatcgcagaacaggcatgtctaaaggtttgcagccatactgctgatgataacagagagactagacccttaggaactggaaactgattgcatatcattagtaagttcgcgtcaaagatctaaggttaaaaaatactttgactgggctgaaatctcaaggactcaaaatgagaacaacgagccacggaaaacattactaagtcaaagagttgacacaacttggttgaacttttagtggaagtcagtttgatgtggtttaagcaagactcccaaagccatcctaactcatatgtttttaagatttatcttaaatggaagatccttaacttttaagtgtggtcaataattaaaaatttaatagttttgaattatattctttttgctgattatattcaactgagtttcattttgaaccacctaggagccatttgtgcccagtgttattcaaaatgcattagtgcatcaaattaggaagggtacagtaaataccaccttgggttttcttgtgacatgattgagtagggagcaattaactccaactaagtggagcaggtcagaagcacagagagtctgcaattagataggcttactggacaccaggctgagaaacttgagagggtgtttcctagtgtatatccatgggtagcttcagatgagtggtgggcctctgggatgagtggaatgacagcgacaggcttcacatatccagatccatatagtaacatggctttctcaatatttcagattagtttatccattccacaccaatagcctgatttctagaacagggatggagtgtattggcaaagaatgtggttagacataaatatgataggatatgatatctcaacatgcagctggatagtggtattaactacagtgaaaatgacccattttttgtttttcattagtgtatgtgtgtgtgtatatttgtactatgccattcatgtggcgcctagagtacaacttgccaaagttgattctccctttccactgtatggggtcttgggcttttgcacctgttaacagtcaccaagcacctttacctgctggtcactgtaacagttccaaatttctgtttaaattcagtcagggtgaaaactgaaagcagagataagttctggacatcatagtttgccaaagaaagcctataagaaacagaaagaattctgtaccagtgaagcacaccagcatgggaagatcagactagctctaccctgaaatccaggcaggccatcaggacagaggagcagacacaaagggatccacgcctctgtaacccagggaccaacaaccaaggagccttattacagaggtcctgttttcagtggttccttgcctgtctcttgtcttggagcatagtatagagaaaagcctgcatactgaagccggagaaccattctcataccaaaggagtattgggaaggaggagcactgtggcttatgtacccaaaagacaaatggtcactgagatagaacttcctgcttcctgttacatgttcctgcattagctcacctgtcagcatgttcgagggatatttgttttcctttctttgtttttattacatcttcttactgaataggaggaggtttcccaagattgctagctagtccaagcacttagttataaagagttaggtgtggagagggaggagggatgaaaaaaagccacctggactgccaaaggcatttgtcatcttgtttgacactgccatcacaaagctaggggaaacctctgtaaacaatctgacatttctatattttgaagcagctggaacctgtcttacctgtgagattgcctcatcttgataatgaccataattgttgggtcctttgccagccatgacccagccttggtaatggtgctgaaaacaagcctggagccaggcagtctgcactgtgtaaggagccctctcaggcacactgtacaccaggcagttggaaggatggcagatatgtcagagaggttctgtgtcttccttccagtgcatcctagtttgtgttagagggaagcactgcacacacccacggacgaagtctggtttggggagggatgcctggtacatgttattgtttagcagtgaccccagaaaaaaggctcatatctctatagtagtacagaaaaaacaaacaaacaaacaaacaaaccatacaaagtacagggggaaaaaaacgatgctgactgagaatgtagaagtcagaaagatacacccaccagtctcaaagccccagatgtggtccccaggacttcatgaaactggtagtacattcctgtaagtttagaactcaggaagtagaggtgatggcaggatcagttcaaggtcattctcagggatacagcaagtagccaggctgggctactcaagaccctgtcttaaaaagcccataagaagatgcattgtttctaagacatgggtctttctacaacagtggcggtgacttagcaaagtgattatttgacagaggcaaaagccagatggacaaacactaatttataatgaatttataaaggaagtaaaacttttaaatgatcaaaactaatcttgtgctgtgtatgtcatccctggggaagccggggcagcagaagtttaaggatattgtcagttgcatagtcagtgcaaggctaggctaggctataggagatgatgtttcaagagaccaaaaaaccagacaaaaagtactcttgagagtagatgttgccaactaattagacaaagcctaacttcttattttctaagacccacagtcctgaacacaccaaggcttccccattattaccacaatactatatgtgaaactcaaccatagtaatatcccagcagagggtaggttggttgctatacagaacccatggatagtcctggttctagatctcgcctagtgttgtagattagggagccccaccccaccccacccaagccaaacagcgactgaactaagggctcatctattacctgtggagagtgaatagtatgaaaagtgaagtaaaaaggctaaggatgagaagccgagggcaggaagaggaactggaaaaagtcagaagcccatactctcaactgtcaggccatgaagagtcaaaatgaagacaacaatctgtttagggtagtagtcctgtcctcaataatgtggaggcataaggagaaagaggcaatccatcctggggggcgagaacaccatagctcctgtcctgtgcctggggctgactcactgatgctctgagcctctgctctctgtcctgaggcaggcaggttggggtggaacagggaagttgggaaaacctgctgtatgcagactgtctgccttaagataactgattcagttcagggatcacgctgcttctgtccagtgtaaacaagcagctggcttctcagaactctggcactgcttcccttgccatcttcccctgaccagtcacaccaagtctgagtcaccctgaggtttggtctgacactctgaggatgtgggctcacaagtaaatccttgaaatacctggcatctatctgcatttcctacaataactcactaaggtaaacatttctttgggggccagaacaaaggctcagcaggtaaaacctcttgcagtataagcctgatgatctgagctctgttctcagaattcacataaaggtggaaggagagaactaactcccacagtttataccctcacctccatgtgtgcactgtggtactcatatgtgtacacttgtacacacacacacacacacacacaatcacaataaaaaatttttgattcattacaattattcttagcatatctctactataaaatgcatatttattggaaatacatctctgaatgagataggtggaacagtaaacattattaatattttatttacttatatgtccatgggtaaagtttttaatttttttgctagggtttagcataaattctcattctgttttttatgatcagcagtgagatttttttaaaaaactaaataaggaaacaagaatggaagttttgttatatttaattgataatctgtcaaaaaccaaaaaccctgaaaacttcccataatgacaaaattgcttttgatgattatccacttattatttgactggttcctagtgtcatcctggtgtgtgctcaaacagggaactctcttttgctttggcatccagaaagttccaggcctctaagggaagatatcaagatgttcagatgtggagtagaacacgggaaaagaaaactactattcagctttttatacactggctcattcacaggcatgacaaaacaagttgcgtggggaccctctagggtttagtggaatgtcttagtacccttacaagcttgggttatatctgcacctggcttttataagaagtccttggcacttcttcatggtattgcagggtccactgttagaagcttaaagtcaaaatctaggatttgggttaggactgtccaatgcccatctacttactatcttttacccccacccttcaggactgagttcaacctcttccaagactgcagggccataaaaagattcatgactccctacctccagcccacaccttgccaatgttccggccctactgccttggctccctggaaagaatgcatctcaagccgcaggatccttggctatctggcatttaacatgtctctctagtgtttcttaccagagccattgtgtctctcacctacttacttctgaggttccccattcacggaccactggttactgcgggcagacagattcttttcatgttcatttcccattctccctccctctctcactcttccccactcccatcctctctgtctcccattcccgtctttccacttttttttttcccagtaggaaaaaggatagtttattaaggaaacagaaacaaatgagcttggaaatatgccagaggtgagctgagcgagtccaggcggctctttctaaagaatagacttgccttgcctcaagccccagggctcacaggctggggtttactgagcctttgaatgaccctcagtgacctgtcctgccagtcttccacccgctccctttctgcctgcttgttgattacattctactcaatttgaaacagggcgtttttttttccccccagattctgtttgctttcctccctcatccgtatgcctggatcatttatccatgcccgcttccagcctggcaaactcctacacaagctgaagcgtcagctccctgtaatctcctccgagaagctttccaactcgcccaaggtgttcctggctatcagctaacttggcacacgcggataggattttcaggcattttcctgtctccttcactagagggagtaattcaagggctgtaccgtccctccccaaattccagtgaaagagctctttgtgacggaggacgtttgttgcagacacagccctcactggcctgcaggtgtttccagagaagagttgtcttctctggatttttgttcccgaccaagcatttggtgttgacctgaagcatttcccagtccggcgttcaggaattcttactgaaaaggaccctgatctgaaaaggttgcgctcttctaatgcacttccacttgagaacacgagatggcacccgtgaagaggaagagctgttaggctggccctggacagtttctttctttctttctttctttctttctttctttctttctttctttctttctttctttctttctttctttctttctttctttctttctttctttctttctttctttctttctttctttctttctttctttctttctttccttccttccttccttccttccttctttctttctttctttctttctttctttctttctttctttctctctctctttctctcgttctctctctcgttctttctgtctttctttttctttcttatctctttctttctctcttcctttctctttctttctttctttctctctctttccctttctttctttctttctctctctctttctctctctctcgttctttctttctgtctttcttttctctctctttctttctcccttcctcctttctttctctttctttctttctttctctctttctctctctctcgttctttctttctgtctttcttttctctctctttctttctcccttcctcctttctttctttctttctttctttctttctttctttctttctttctttctttctttcttttttccttttctggattagtctatatgcaactaatttgagatgatgaaccacaatttattctgacaccttcccttctctctccctaaactcactttctatcctcttcctgtacaaaagaaaacctgagctatctagctctaaagagttatttttgcttaaaagctaaaattaaaactctgtgctgtgaaactttgctctctaagcatggtgtagtggctattcctggttgtcaacttgacaatatttggaatgaactacaatccggaattggaaggctcaccagtgacccttatctggaggcttggagatccttatctggatcttggtttgaagatcttgagccatagtggctatggattccagaagattgaatctccgagtttaaggaacacacccttaatctgggctacgcctttcatctgggattaaaggtgtggtggaacacacctttaatctgggctccaccttctgctggagacaatataaggacattggaagaagggagtctagctcttgctcttgctccttcgcctgcttgctgcgtgagactgagtaactgctagatccttggacttccattcacagctgcgactgaatcattgttgggaattgggctgccgactgtaagtcatcaataaattcctttactatttagaaattatccataagttctgtgactctagagaaccctgactaatacacatgggtattggagtcttgctgtcagagcacctgtgattatctacaccaaacattgggcccactaacccttttttatgaggacaaggaggtcttaacaggaccctgcctttccctgaggatgtataaactggtatagccgtagataagttgttggattccctgtagatcagtggttcttagccttccttacgctgtgaaccttcctcacattgtggtgagcccatccataaaatcactttcattgctacttcatagcttgctactgttacgaattgtaatgtaaatatcgaatatccaagatatctgatgtgtatcctctgcctccagagtgtcaagactcacaggttgagaaccactactgtagataattccatcaccctgtaagtaaacccaattagctcattgtctcacccatctaggcttgaatggaataatttttttggtctgttgttggtgccgtttggaatgagtaggtatttgttcattcttccctccaaagagttaatgctatttaataaaaaaaaatattcttcacaaaaaagagggggaaaaaccccacctagaatgttggttcatgactttagtcacagcactcagaaggcagaggcaggtgaatctctgaatcccatgccagtctggtctacagagagttccaggacagccagtgctacatggagaaaccttgtctcaaaaaaaacaaccaaacaccactccctcaaaagagcctgaagtgactctgtttagcttttcttctcagtgttaaaggctgattgaggaaggaaaagtttattttgctcagagagtacagttcactaagacagggatgtcacgtcagcagggacgaaaggtcatgcaggaccctcagtcagaaatcagagacaattgctgctacttaccaggagatttgcttagggtcttaagtgtggactgtgcccagggggctgctcttggaatacaaggacctgccggtgctttgcaaacctggagcccttcattttggcttcatcttgggccccttcacttctgcctgagatcccacatatgacagcataatcctcctgatggaatgagagaatctgggatgtggactagttcatagtgtgcttgcctggtatatcagaagccctgaatttgatatccagcacgatgtaaatcaactatggtagcacatgcaatatcatcattcgggaggcagaggcagaggatcagaggtttgtctgaggtcattttcagctataaaggcagtttaaggacagctagagatacactataccctatttgaaaattaagaaggaggaggggaggggatgagagaagaggttgcaggacaggagaaagaagatcagcctttgaccttcaactcctctgcattaaggtggtaagggtgactcctgcagggttccacagatggggcttggctcactgtgagaagcctttcatggttgccagcaaggcaactgatggaactctgagtgttgtcactcaatagctggagtctgagaatgaaaggtaggttctaaaagaagcttctaaaacctaaggttttagaatagagtgggtgttgaaagtgtatatgaggatggagcagggacatcaacgatcacaaagagaggggctttcccttgaaagtgacaagttactagacagatggaagcttcccagtggcactggaaaacagactctaaaggtatttgaattcatagaagatattgtatctttggggaatttctttttaaaaaagacttatggagaaattgtaacatactcaaaatagaattgtatcagctcctggccaactcacctccttcatcaattgccaacatgttgacccattattttgttctctcccaccttctacatattattttctagatcataagcaactcttaacatgacttagaaggctgcaaagcccttacggaaatctaaagttagcatcaaagaagtaatgctgggacagaatttggagttcctccatgcctgtattctcaggttactgcactggggctagacagagccaccagctccatgcttctggccttctcttgcccaaggcatctcctgccaaggccaagctacatgggatccagtatcctcttctggcctcttgaagtacccatacacatgtggtacacatgcacacatacacataaattgaggggggggctttattaaatgatgtactgaagactttaaagtcagctttgtagaaatgaaattgacatcttctaatttgattttttttaaatctacctagtagtgaccaagtgtttattccttactttgaggccagattaaactagctgtggacctcccctccccttgagtagtcaagattgatgtcagcaaagttgcaagtagtcattatcaggcagactgcctgcgaagatgaaggaactgggccaccacattgattcccaaagatgcacagaaacataacaagccagtaaagtacatttcccctattacactctcaggtcaaggtctacctcttattatgtttaaggtaaacccttctctctgacttcctcactatgagatatcagcaaagttgcaaatagtctctatgacagagagaagaaaagagagagtgggtgagttcatgtagtgctgggcttcctgtataccagcaagcacttctttcagcacatcaacgctggctgtttttatacatagggcacttcagaaatgcaatgggtataatccaatttatttttcatacatcattgctacacccactcgagtagtgacttgtgtgacaggtttaaaagcctggaagcagtcacgaggcaaagagtttcaaggaaacttagcctcctggaaccttggcattcccatagctagaatgccccagatttgtccctgcgatattgtggagggtcttgcatgctttcttacagtattttactggataagagttagaaatctcaaggcaagcttagcaaagtatacttagaatcttcactacagtcaggtatggcagactacattgcatattagaagaaagttggtgaattcttctgacaaatggagactccccacagatacttaaaagaacagccaagttactctcatatgcaagaatttaccaaggcctaggaaatagatgggttgtggtattgcattatttatgataaggtctgctagagcagaacccctggtgctagttttcacaaggctcaaaggagtagcataaattgtgactagtgtgtgaaattcttacctgacattagctgatcctaggcagggctgttttatctttactgtaaacattacctgtttcctgtcagtcctttgtaggtattcctctgttttgtgtcagatactttaatgtaccttgcctactgtgacaccttactcctttgttttctgtattacataagactggtgttccctttgtgaaaaattacattcagattcactactcccttgtgtccgtttatcaattcttgctaactccatgcccacctgtcggaatccctaattcccacagctgactgagcctggtctgtggcacctaaggtttgcatagcaagtgttcaaacattagtaaggtagagtctcaatataatctttgccttccagtaatgccaatgacaaatgtgatcccaggcagaaatccttattccttgatgtagaatgttagtacaaaactgtggaagagcgctttctctatgtgatagagagtcagagagaaagacacagagagacagcacaggcagaagaactcactaaagcatactgccctcctttaaaaggttagtcttcatatgcagctagagactctgggggtactggttagttcctagtgttgttcctcctatagggctgcagatcccttcagctccttgggtgctttctctagctccttcattgggaccctgtgttccatccaagagatgactgtgagcatccacttctatatttgccaggcactggaatagcctcacaggagacaggcccttggtcttgcgaagattctatgccccagtataggagaatgctagggccaggaagtgggagtgggtgggttgggggagggcataggggattttcggagaggaaactaggaaaggggatagcatttgaaatgtaaatgaagaaaacatctaaaaaaaaaagttagtctcctcttccagtgaaatgtcctctataaattaaaatgggtatgatcccgtaattcagttgctagataattgctcaaaggagtcaaaagctgcatatgaaatagatagaggcctgggctcacacttaccaatgaaaatggaggcagagatgtgcccagtgcttgcccataacaacctgagcagaggcaactcaagtacacataagaagacactaggtgacagaaactggaacatccctgtatcaggactcaactaggcttaaaatgacatgccacaacttgcacagacctggaggacatttggtaggtgaaatacaccaaacagagaagcaagtacttttatgattctatgtataggaagtatctgaaatagtagaacccagagacactaaacaaaacaaaatcatggttacaaaggaccaatgtaagcagtatgtggatttttatgtaagaggcacagaatttcagtctagcatgacagcatgttccaggaagagatggtaatgattgttgcacaacaatgtgtgtgtttacttaatgctatggggtttcctgaaaatggctgcagtggtatagcacggggggttggggaatcaatcctgggagctcacacatgacaggtaaacactccatcactgaattacatggctaaccctctaaattttgtattttgtatattttgccacaaacgtcaaatagctcttctgcttgaaaagctttgctgacagccagtcctagcatgtctgtttgacatgtaatacctcaaggtgtgcatcatgccactaacctcaaggcaagcttctgtagagagctcctcttagcctaaagtacatatatcgtgtttacttttcacacctttggtgtacatgacaggtgttcaaatattagtcaggcagtatttcaatgtaagccacatgtctgccggtacttgcataaccttatagtcagatgttctgtgcattttggccagttgaggcttttctgtaatagtttttccatctactgctaaaagaagcttctttgatgaggagtgagagctctattgttggaattagtgaatgggagttttgtcataaaaacacaagtgctgtgtctaaattaagggaaagagcagagaagacaaacagtacatatgctaacaatagccagacagggaagacccattctttatttaccaagggaaggactttcttggtggctatcataataatttgggttattcaacaaaaatacactcctcttttgcctagttttatccggtgactgcttcatacaaggtggatattaatgggtgggattcagttggagacctgagtgagattctgtcattgggcttttgatcttctatctttgatgtctccatgaaagaaacatgtccgtagtgggatgctagtgccacaggagtgagatacatgtggaacatagcaaggcaaggtgacccacagctctggagcttgaagcactactgttacacttgatctgcaaactggtaggtgtgacactgaagcattggtgttgggttctgaggaaaccatcaggcagtatcattgtagtatagttgctatagtttgtatgtaaaacctgtcccacaaaccatgcattggaatacctagtccctagctgtagagctgttttgtgagttgtggaacctttgggaggaaaagcctagtggagaaaagtggatctctaggggtcttaaaggttgtatagactggccctgcttttcatctggtctttgtttcctggtactctgagctatgggcaagaatctgtctcatgttcctgccaccacggagcttctggtgccatgccttcctgccttcactggatcatgctttctgaaacaatgagaataaaagaagaaagcctcttctgtaatgtgtttcttgtcaggtatttatatacacagcacctaaatacccattttgtggacaaccccagtcttatcaatgggagaatgaataagtaaactatggaagagccatacaataatagataccactcagttacaaagtaagcagaggcatggatgaatcttgaaatctatgttaaacaaaagttagacagaagaggtcatactgctgggtttcctttacattgaattctagtatgggaaacttctgatccttggcagatcagaagttgcttatggtcaggggatgggaaagagtgactataaagggatataagagaacttttttggggggtggtagaaataatttgtattttggtgaggatgtttaaatatgtttttacatttgtcaaagcctcttgtatggtacccttcattagattttagctttggaaattatatcccaataatatatattaaaaagttgttaatcctgattccagttcccctagtgttgtggtgtctcccataggcttgtgattttgaaaacttcgtcccctagctgatggctctgtttggaaagattgtggaacctttaggaagtggggccatactggagtaagtgtgtcactgctgggtagcacctgaggtttcctctgccatgtcttgttcacttgcttgctgattatagatgcaatgtgactagctagcctcctgttccagcagccaggactttgatggagtatgtctccctgagtaagcccaaatcaacattttctccccaaattgcttcctgtcacttatttggtcacagcaacaagaaatgcaatccactccaagttgtgtacaacccatcctttgttaaatgcagattttgccttagaattttccagctttaaaccctcagatgctttcatcatttgtttagtcagttttaagcttcaaagctatacttaaacctgcttcagtctgaattctgttttgtccttgaaatgcatcaacactggagtccacgcttgagctcctcagtcagtcccaagcttctgtgtcagtactcagggttgctgtgacctgaagctgctcagttcatttccacctggaggccacattttggctcaccaaaagcatgcttcttgacacacacctgtgcattcaacagctgctctttgtccagggtgacatctgcctcctctgagctattactcatatcatttgtagtagagaaattaatgtcctgcagttgaactttccattggtttccagtggagcattctattggtgaaacagtaccctggtctacagactcatgaagcccggctcaatctatgccctgatgtgggaagcattcagtcgagttgactgagcagttgactgaatgagtatctgtcagtcctctgatgtgttctgaggccttgacttttgctgagaattgcacttgaggggcgagatttcatttgctctcactgagtacttttgcttcttcaatattcagggcaccagaaagttcaatttcctgtggcccaatcatttaaagattgtggtcctagtcagacagatttccctcctgtatgctcccggatatgacattttgggaaagatggaaatctcgtttttgctttgttaagtaaaacttaacagaaaagctaacatagttttggccacagtatcaaccccattatgaagcaagaagtaaaatagtatgactggcaacaatcatgatgacatctaaggcagcattatcttgcctttgcttgaccagtctgtgtggaccttctggaggagtcaaaggtcagcaagatagttcctcctaggataaagcataaaggctttagtgaaggacacttttaagtgacactttctgccctgtttatactcgtctagtacagaggaagtgaacgttcctttttggcaggaacagggacagcagtgcttgactaggaactaagagcagagatttgaaaataccgaaacaaaagagaaagctttagtagaaaacaggaagaatgaatgacagtggaattcatctggcagtgtctaggaggacactgctgggaagtggatggaactgagcttaggcatacctgaaggagtagggactgagtcagagcctgaagagcctttaatgagcctggactccccttctcagaaaccgaggcctttagaggctcttgagctgggagcagaatgcgtgatgataacatgatgaaaaagaaagatggcttcctgttgggagctattaagacaacacaattgtcctgatctctgaattgggcctcctcccacccccgagaagaaaagggaacaaccacagattgttccagccctaagtcagcgccggatgtcctcaccacaagatgtaccctgataccaccaagttcctgcttccctgtgtagtcgccaaaagaaaaatttcttctgccccatccttcctgctgagaagtacttcctcctttgcttgtgcatttccactgccccattcctcctgctgagaagtgcttccccttttgcttgtgcatttaagccttgagccttcctgaatatagtgagaccttgatgctaatcagactgcttccgtgtgtcgttcattgcacttggttctcgtctctccttccccccatttggttcttaggagaaggtcccctcgagaccctcgaataactggacctgctggacgggtcagcttccatctcagcttcctccagtgcccctctgctcacatgggtcacaactagttcctctttccttaaacctcttaaagtaataacaataaaatatcaattattatatttatatattaatgaataatagtaattatattatgtgtttacatgtgtttttgcaggcatgtctgtgaattacttgcatgcctagtgcccccagggtgtagaagagggcattagatcctgggatctaatgtctgaacctttgggcagttgtgaactaccctataggtgttagaaaatgaacattagtcctctagaaaagcagccaagtaccccagagccatctttccagccctgccagtaccccacctccctttttatttttctagacaggatttctctgtatagtcccagctggcctcaaactcagagatttgccttcttctgcttcccagtgctggattaaaggtgtgtgacaacagcctaccagcttgctagtactctcttaagctctgcttttgatcacagcaggacagcaggaagactccactttgcttgtgacacacacaatatattttggagattagtctctttaggtagaaatcaagctcctataaggagctttgtagtactggaccactagcttcttttttagttagttttcttgacagtcttggccccacaggactaagggagattatgggagtactcaggtggtttctgacctatagagagagacctgctcagatgacagctagtaggaaagttcacaattgcccttgaattctgaggaggtactttgttacaatcaatggataaatggaacgtgtgtatagaggtggccatttatgcaagaatggtgattgcatatatgacatcagtgttgacaggaaagtacaaagtatttcacaagtggaagaagtttctcactcatatttttcacaaggatgatgcatgatgttctcatgatgtcatgatgttctcatgacagatactagatattccttcagtcctattgtggcttcatgcttctgtatagatacttcaggatgatgtagcatggagaaatcattggtcaggttactgttcctccatcccccccccccccaatagagctagagatagaacccagggtattctaagcaagggttatatcactaaacttatcccacccccatctaccgtaggaacttgataattatgaagagatatggtgactcattcctgttatcacccctttctcaatcagcttgtccttcagctatataggtcagggtcacacatgtgtatttcctagagcctcaaaattattgcatgaccttagcttgtgatccagcgattatctctttgtttgagagagcctcactatgttgacttggctggcctggaactcactatgtagatcacactggccttgaatttatagagatctgcctgcctctctttatccattaagcaggtgttccactcaacctgtgacaatggtatttctgctttccttaactatttacctatttttaaaaaaatatccttctaaagacaattcacagaggacatattgatgtctgtgatccatgctgccaatattgttatccatggtccatgtgccaccacagtgtctgtgatttattccatagctggagactatggtgatgttcatgattgaggctgccaacaggggcatgttaatatttgtgatctgtgctgctagcagggaccaggttgatgtccatgatctgtgctgctgttggaaaccgtatgcattggaggtcaatgttgctacagataagcaagcttcttttataatggtattaatgactaaagactcataactgagaatgggagagattgaaggcttccttggtcacctccctttctaccctcaaaagaaacaatccagataggaagttattaaagagagtcctaaaacattgtgataaagatactgaagtgtagcttttcacagttgatggcttctggtatggagtgggtggggcaggtctcaagttttcttttagcggctagccactgggaatttgaccatgctccaatgagtggattggcaacacaaattgtactttggaaggtggggagtacaagggtgggagggtagtcataggacgaatgggaactgtgactgaggtgagttgtatgaagttcctaagtaattaataaaattattgtgttggaaaaagattaatttaatgtggatgagtattttgtctgcatatatgctcacagtgtgtgcagtgcctacagaagcctgatggaagtggtggattccctgggactggagttacagacagttgtgaactgaactgggaattgaactcaagtcccctggaagagtagccagtgatcttaactgctgcgctatgtcttctgtccccaaattcatctgttttcttatttttatataaaaaacatatatgactttcagttttctttcactcagcatattgttccaggttcgtctgcactgtggttatgtcaggccttcactctttttatggtagaatggtattccctaaataacctgtgtatttatctgttgaggaacattgcaggtgtttacaaccattggctattataatattgccacaaacactcctgtatgtctttgaatacctgttttcagttatttgggcataagctgtaagaaaaacagatacaccttttattctctctttgttgcttatttgtgtcccttactgaatctaggatcctaaacagtacaggagccattttacaagagaaaataataaaggttattattaaatttctgtgtatatgggaatcattacaagtaaagtttgaggaaatgtctgaagcataatggttttgtattttttttagacaaataacaatttatacatgcagggctgatagcacactaaagtctccatactggagtggaaattgtaaatattaacgaagagactggaggtggtgagatggtgtaaaagctggcagatgaccaggatacttcagaatatgttaggcccatggcatcccatgcccggctctggtaaccaaaaatgtcatgatgccctggtatgtgaaggatattcatccccaaagagtgattgcagtctaaagaagaacaagtttatgatatttgcaggaaaatgtatagaactaaagactaccaagttaagcaaaaggagccagacttagaaagacaagtgtcatttattttcactcatatgtggaattgaggcaagggggtcagggagggagaagagaagtagaagggaaacagggaaatgaggaatgcaagaatattgaggtggactatagttgacacacactatatgcatatatgagattatcagagtgaaaccccactatgtgttcaattaatagacactaataaaaaccacaggaaaaagagagacttgtttggctctgtgcatgtaggaaggcaggccaagtggctcttggttagttcttcctgtgattgctgctcaagataagtttttacaacagtgagatatgtcttgggatgtatgtcttttctttctctgacacctctgagtggttctgtgtgttctgggaattctatacttaaccttttgaggaattgccaaggtttttttcatgggaaatacaccagtttatgttcctacctgtaacacacagagactctcatctctccacctccttacactctgaattaatcataggatggatggccatgtccccataaacccatttatttgaatgcttggtccctagttggtagaactgtttgtcaaggatcacaaattgtgtccttgttggaagaggtatgtcactcgaggtaggttctgaggtttcaaaatcttatgccattcctaatggattgagatgtacgttttcagctactgctccagcatcatgcctgcctgcatgcctgctgccatgctccccgctgtaatggtcatggattctaatcctctggagccatgagtgctaaatgaaatgttttcttttataatttgccctggttatggtgttttattacagcaataaaaacataactaagatgaggatgaagaagagacagagtgtgaagaagatatgtgagggattagagagaagggagaggagaaaagaggccaattttccacgttgattactgattttgccataaaagtgttgacctagtcctgtgggctatgcattatatataattctctcttaagtcttgccttccagtattatcaaagggaactgaaaatgtgtgatttgtgaagatgggcagactacagaagtacagtgtactgcttatgctatatgctttcatgaaaccacagtatctcaacaaactgccattcatctccaaaagaagcaggcctgggcttctgtgttcactactgcatgactgacaggatgatgaatcctatttgtatatttatttttatataatgctccttaaacgcaaatagcatgattaaaaatattttgcaaggaatgtatttgaaaaatgctgagaaggaaaaaaaatcactcatttccgcagacgaagacattatatgcagttataattagggtgtatgcaatagctttttcattgttatatcttcagtgtttcctcctatggtccaggttgacatttctaatgcctatagcattagtctaatgtagcataatttacctagccagttctcagctgttgacactggatctgtttcttctttttccctattagaacagttttttgatgaaacagaacacgtgagtaacagtatgtttgtttctctccacccccattcccttctctctcctttcctctatcttccctccctccctttttttctactggttctggggattgtgtttcatgtgggtttacaagataggagaaaatttgcactgctcatatgcattagaatgcactgcttacaggaaaaggttgtattgatgagatgatgtcacagccttagcatcccagtactaactaaatataacttttagtgtttaataaacttaacacgacaagggcgattaaaagcagtgatttcctgaaatgtgtttaattgctcgtgataagccttccccacttacctgctggtgactatgtttttctttttagtggccttccctcttcattttggaggactgtttcatggtaagttgctttcttagtctacggttcttttagtttttgataattcttttttaaaaaaagaaccccatattcatatagctttttctgaggtccattttttaaaaaaatattatattctattttttgcagaatgcctgttgttatgtggatgatgggacctgagctctgatcctcataattgcatagcaaatcattcttaattgattctatctctccatatctttattttagttttttttcttttgagtcacagcttagtctagcctcaaatttatgttaaccctcttgccttagactcccaagttttggacttatagtcatgaatcactatgctcacctttggaagcaatgtccagcagagacattttatagtaattaatgggaaattaattatcgtataatgcttcttgttatttattattactattcttacagcactggggaccaatcccatgaccttgcatacactaggcaagtacatgcacctgtctaggttatcactttataaaactatatctagtctttaaaacaatgaattataataggaacaaaccttttctttttctgtttttttccataggccctaatacaatggcttcatttggactttcactgagtcctcataattcttgataccttatcatataaatatatattttcatttttagaaaaaaatttagatatgttgccttctaagttttgcttgcagttcaatgggcggttatttgtaggcaccaaacaactgaattaagatggaagtgttcaatactcattgggttttaaagatctggtatacagaaagaattgaatatgtcactgctgattttatactgtttatactgttttatactgtaataatttggatatatcagagatgcattgagttcgatataaaaataatttttgccttaaacaaacataatgatgctaagaagttaaaactttatgtgtgcggggcgtggtggcacacacctttaatcccagcactcaggaggcagaggcaggcggatttctgagttcaaggccagcctggtctacagagtgagttccaggacagccaaggctatacagagaaaccctgtctcaaaaacaaaaaacaaaaaacaaacaaacaaaaaaacccaaaaaacaaaaatactttgtgtgtacctcaaactaagtatttttcatgcaattttgccccaaatgagtctagaataatcatgaagacaatctgaacagaaaaaaaaaagggaaaacagagactgtcttgtgacttacatctctacttattcagggaaaattctattctagactgttttttaaatatgttaaatgcatcctgtcatagaaaaatattagcccaaaagctcagaataaccatgatacaactcacagaccatgtgaagcttaacaagaaggaaggccaaaatgtggatgcttcaattccacttagaagggggaacaaaatgatcagggtagacagaaagggagggaggggactggatgggatatggaatggggagggaaagggggtttgggatcaggtatggaaagagacaggagagaagtccagagggccaggagaaatacgtagcagtggggagagggcaatgtgggaaccactagaaagtcctagacaccagggattcaagaggctgtcaggatccaatgaggatgacattaactgaaatatccaacagtagggagataaaacctgaagagaccagtagatagacatggcccccagttgagatatgggaccacccacccatctcaaaaattttaacccagaattttccttctaaaggaaatgcagggacaaaaatggaaaagagactgagagaaaggccacccagagactgccccaccatgggatccatcccatttagacattaaacctcaacaatattactggtgccaagatgtgcttgcagacaggagcctggtatggctgtcctctgagaggctctgccagcatctgactaagacagatgtagatactcagagccaaccattggactaagcccggggaccccaatgaaagagttaggggaaagactgaaggagctgggcataggaagaacaacagtatcgactaactggacccttcagagctcctaggtactaaaccaccaaccaaagaacatacatgggctagtccatggcttccactacatatatatgtagcaaaggactgtcttatgtggcatcagtggggggagctgcttggtcctgtggaggcttgatgacccagcgaagggggatgctagagaggtgaggcagagtgggtaggtgggggagcaccctcttagaggcaaaggggaggggaatggggtaggggacaacatttgaaatgcaaacaaataaaataattaacagaaatttaataaaaaaaatgaatttggaaagaagtctgagcttaagttggctggctgactttgttggaagtcacaggacagatctggaaatgccttcatccttaagcaatactactgaccaaaaggacctgctcccatgagaactattgcgatatacatttcttctaattttaagaaacttcgatgaactttttttttttaacaggtttatgcatcaagcaagagttaatctgttttgttattgtggttagtgtagaccacgcagggaccaaggtctatcactctactgaggtctatgtttgttgtattcccagtgtcttggatgcttatagttttctaccctccccaactcatttcttggccttctatacagctcagaaaatgatactccagagtgaagccctcattagcagtctgtgtctgacaaaggtatctcctatagctcacccttcacttaaaccttagattatagataatagagttcattttctccaaggtttagaaaacaggatcttctttgcccagattcagctattaaaccccattctatctttcctctgttttatttttaagagatattcatgaattctgagactaacctcatttgattgtgagtcacaggactccaattcaagaagattctgttgtgtacctggaaggacgttaagctgcagagtggccaagaaaaagtctagagtctaacactccccctccatgtgttacaattagatcacattcttttcaatggctgtgcattcttggttgaacccaagtatcaaaacaaatagttcactctgggtcctgtgttttcaacttgaatgttactgtgtcatgtaaaaactatgatcaaatctatcttgtttctgtggttgttctgacttttgttatagtggtgcctaatacaatcctttgtgataggcagtaaaggatttcttcctttctgttccagcagccagaagctctaggtactttggatgttaatatgtaaatgatccaatgctgagccactcttaagcttgtaagcttgatttttttattttttatttttttaatttttaatttttatttttttttgcaatgtgaggcttgatgaaacagaataccatgttttcagtaagaaaatggatgagagtgtcatattatgggttgtttcttgtgtgttaggtatctttttttttaagttagaatagagtttatttagggtatggggaggggaattaaagggatagggagagagagagagagagaggagttagagaagtagagatcagccatgagcatatgcagagagatgggggaggggatgtggagagaagagtgtaaaatggtaagagagcaagagagtaagagaggaatcttttaactctattattttattttggactctaggccttacacatactcagagtttaagatacataatctttcctctcatcctcattatagccaactgaagtgggtactattaccatgttgctgttgaagacacaggcttatagtcaataagaacctgactgtagtaagagttgggtgaggggtcagaggtagccttgagcctctctgagcccaggctggtccttgctctagaggttttctcccacagcactgtgtctcttcctacctccttgctgtggccatagcccaaggggacttctgccagaaacttctagagctgcaggctcagagatgaggctggatgtgggaacaatttctattcctcttctagggccaagatcgggcatggatggggccattcttaccagaatttttactccctctgggtcaaaattgatttgggctcccattttgatgagaatatctcttccaagcagggagtatggacatccaggggtgacaacaaatgagtgggttatctgtcccattctgaaggtcacctttattcaggtagtccatggatagggcttggtgcccattgttccttgcacccatgttttctgctctgacagtgctcctgatggttgttttaaagcagagtgttgtgaacctatgtccactagaaagtctatgggcttcctcttcatggttactatttcccagatgtcttagggtttcttttttcttttttttttttttctttttttaaaattaggtattttcttcatttacatttccaatgctatctcaaaagtcccccatgccccccctccccccattcccacttcttggccctggctttcccctgtactgaggcatacaaagtttgcaaaaccaatgggccactctttccactgatggcctactagcccatcttctgatacatatgtagctagagtcaagagctctggggtactggttagttcataatgttgttccatctatagggttgcaggtccctttagctccttgggtactttctctagctcctccattgggggccctgtgatccatccaatagctgactgtgagcatccacttctgtgcttgccaggccccggcatagcctcacaagagacagctatatcagggtcctttcagcaaaatcttgctagtgtatgcaatggtgtcagcgtttggaggctgattatgggatggctcccagggtatggcagtctctagatggtccatcctttcatctcagctccaaactttgtctatgtaactccttccatgggtgttttgttcccaattctaagaaggggcgcagtgtctacactttggtctttgttattcttgagtttcatgtgttttgcaaattgtatcttgtatcttgggtattctaagtttctgtgctaatatacacttatcagtgagtacatattgtgtgagttcttttgtgattgggttacctccctcagaatgatgccctccaggtccatccatttgcctaggaatttcataaatttattctttttaatagctgagtagtattccattgtgtaaatgtaccacattctctgtatccattcctctgctgaggggcatctggctattataaataaggctgctatgaacatagtggagcatgtgtccttcttaccagttggaacatcttctggatatatgcccaggagaggtattgcgggatcctccggtagtactatgtccaattttctgaggaaccaccagactgatttccagagtggttgtacaagcttgcaatcccaccaacaatagaggagtgttcctctttcttctctttctttttctttttctttttttttttttttttttttttgctataaaatcatttataagatccaaacctggaaaatggtgtttaaaagttttaagagtgttcctctttcatccacatccttgccagcatctgctgtcacctgaattttttttttttttttctagacagggtttctctttatagctctggctgtcctggagctcactttgtggaccaggctggcctcgaactcagaaatctgcctgcctctgcctctcgaatgcttggattaaaggcgtgcgccaccacgcccggcttgtcacctgaatttttaatcttagccattctgactggtgtgaggtggaatctcagggttgttttgatttgcatttccctgataattaaggatgctgagcattttttttcaggtgcttctcagccattcggtattcctcaggtgagaattctttgtttagctctgagccccattttttaatagggttatttggttttctggagtccaccttcttgagttctttatatatattggatattattcccctatctgatttaggataggtaaagatcttttccaaatctgttggtggcctttttgtcttattgacggtgtcttttgccttgcagaagctttgcaattttatgaggttccatttgtcgattcttgatcttactgcacaagccattgctgttctatgtcttagggtttctattcttgcacaaaacatcatgaccaagaagcaagttggggaggaaagggtttattcagcttatacttctacactgctgttcatcaccaaaggaagtcaggactggaactcaagcaggtcaggaagtaggacctgatgcagaggccatggagggatgttacttactggcttatttccactggcttgctcagcctgctctcttatagagcccaagactaccagcccagtgatggtaccacccacaaggggcctccccatttgatcactaattgagaaaatgccttacagctggatctcatggaggcacttctccaactgaagctcctttctctgataactccagcctgtgtcatgttggaaaaaaaaatctagtacatcagggctcatggagtgggggttgagcctgattccctcagttatctagttcttccaattccagatgttctgggccctctcttggatttttcttaggtcactcatttttccaaaggcctttttatttgtaatagacacattggtcctgctgtaactgagggtggatttctctttttgtggggactggattacctctgccccttctgtgaaccagggttttcagttttctttcattgggacagccacagttcacagcagcaagcagcacctttgccagtcctctggtttgtcagtcctcaggagtctctagattgttggaaactttctcagctatagctactaattcagtcagttgcttacccacaaagccatctaggcattaaagtttctgacagatgtcctagggcaacttggttaacaaaagccatgttcacagctgattgcttctctctgacctctgagtcaaaaggagataggttctatagggctttaaaaagcctctctagatattctctgagtgttttcatgaacagaaaagaaaccaataggactcacttgtcatccaactgcagttcaaatccaattaaggtctggggcaaccctagtttgaatccggctttatccaatgcccagagaagccacaatgagcatcacctcacatatcaacgagttccgggaagcagggattcggattccttgccaattggcatgtaacacctttctctttccagttaagaaacctcattcctgtgactattgacttgtgcaggatttgagggacgtaaacacgtgggtagaggacatccaccctacagtttcacatctctacaccttggtgaaaagccttcttcccaaacatactgtttacactgtgttcgacctgaagaatgctttcttcattttgcatctgtcatccaaaagccaatacctatttgccttcaaatggaaagatttggagagagacttcaatggacaactgactttgacacatctgtcttaaagattcaagaatccacccacagtcgttgacaaggcactgcatgaggacttgggtgaggaccagtgggaccaccctcaaacacctttactctagtacatagatggcttcctgattgtggccactgacctggagacatgccaggaggccacacaagacctacttgctacaagacctaggtgtctgctaagaaggcccaactttgccaacttgaagttatttatctggggtacatactcaaggtggggggtaggagagcaaatgcatgctgttgggcacccagaagcaacctatcctcagcatcccagttctatcaatccagaggcaaatatgagaatttctgggatccactaggtattgtagtctctgggtgccagggttcactgagatagcaaagccagtatatgaggctaccaagggccaaggagataaaatagaatcgacccctgagctgcacatggctttcaagaccctaagaaaaacctttgatggtgccagccctggccttcctggaccttcacaaacctttctacctatatgtggatgaaagagagggaatagaaaaagaagtgctcacccaaacattgggcccatggaaaagaccgatggcctatttacctaaaaagctgaatctggtgccccagggatggcctgcctgtctctggatcatatctgctattgccctgctggtcaaggatgcaaacaaaataaccatggggcaggaacttgtcacaactccccatgctatagaggtaaccctgaagaattcacccagcctttggccacccagtgctagactggtgcacttccaggctctgcttttgaatacccctcatattagatataacccttcatctgccctaaatgcagccaccctgctactggacccatcctcagatacagcaatgattgatctatagttttgaggcatgttccaaacattaggccagatgtaactgacatactgtggccagatgctgagtgcatctacctcatggatggaagcagcttcagccagaacagacccaagtatgctggggtggctatggtagacttggactctgtcatttgtgcaattgctttgctgccaggaacttcagcacagtaagctaaactaatggttctgacccaggttttcaaactggtgaaggggatcatagccaacatttacattggtagcagatataactttgctacagctcatgtgcatgggtccatatactaagagaggggactgctgactgcttaaggaaaaaaaataaggatgaaatacatgctttactagagacattatggttccaaatcaagatggccataatttattccccctggcatcaaaaagggacatcagaaatagcctgagaaaagcgactaggtgataaagctgcaagggaggccacccaggcttccactgctcacatcctggtcaccctgcgacccacctcctcctgcatgtctggccagtcccagagtatgctgctgaagacaaacaagatcaggccaaatgcaagggaatctacagaagagatggatgatttcatacttctgaaggctgtacaatcctacctaaggagtttgctaggcaactcatccattaaatccatcaggactcacaatgaggtcaccaaaaattaaaggaaatgttttgaggggtaaagtgcaaaacattttacttgggagccttggttgatcaggtaattttgcattgtcgaacctgccagctgcgaacccaccgcaggccccagtcaaggaacaccaggaatcagaattagaggccaaaagccaggggccgattgggagatagtttacacagaagtaaagccaggaatgtatggataaaaatacctgctagttttatagataccttttcaggatgggtggaagcatcccctacaaaggagactgccagtgcagtggcaaaaaagattctgaaagatatcatacccaggtatggactacctaccctgcttgggtctaacaatggactagcaatggactagcattcatttctcaggtaagtcagtctttagtacgtgtcttaggcacccattgcaaactgcactgtgcatacagactccagagttcaggacaggtagagagaataaattgaaccctgaatgaggccttaaccaaattaacccttgaaactgacagtaatgggttatctctcctactttatgtcttatatatgggcaggaacacccctatcatggtagaatactggttgcccccagtatctaaagtgggcttgtacttcaagggctcaacctatgcatactaccctggtcctaaatctgactcaagttttttgtgttctggtacagcttgtctttcaggtgttctcatcccactttgatatcctatatggcaggctctctcctatgctgcttaacttccaaactgatattctagctgaatatgaccaacacatgttcttggagtctttgaaggtcctccaaagattccagaagtaactccagcctgccatctgctaggtttatcaatctgcaactccctttaatcctcattactttgaaccaggtgacaatgtttggattaatagacatacacacaagactctggaactctgctggaaagaacctcatacgatgatcctgaccatgtaaatggctgtataggtggatgggatctggacgtggatacactactcccatgttaagcctgacagaagagagacaacacagcagtggagatctggcagggagagacttccagatgttccaccaagagcaatggaagcatacccacatcttgttgatccaatagggctgcaactttggcactcctgatcatgcatgcctgctgcacccttcaccaacccttcagtctaacctggatgcttatagatgttggaagaggtgaaatacttcaccaagtctccaaacaagtgctagaaaggatcttgagctatggttggatgatttctctgggtttgaggtcttggaattgtaccattggaccaaaaatggccaattctatgtttgcccaggccactgctgcatcaaggctcagagagataagtgtggagggtcctctgattacttttgggttgtttggggatacgaattcatctgctatatatggtgacttgtggtgcatgcattattaatactttagtcaggtttgttaaggaacggatttccactgatgattgagaatccaactggtgattcacaagcagcaataccagcccatcttaaggtttcaggttaggccattattcaaggagggaatgagcgccaagctgactccatgagaggctgcaagatgccagttcaggagactaggcctaagtttctgtttcccagaactgagcagaccagttcttggaaaaaccacagcccatgaacagccaatcagaagctgccctgccaaggttagtcagcaagggttcttgtaaagtccccaggcccccagtgatgagtttggaaagcccacagaactctagccaatcccagagttacccatacccctagagttagagccaaccatttgggtcacctacctcttcttggaattccccctaataacctttaaattgagcctacagagctcaccttgaggttaccatttttatgaattgtagacccttgcatgctggatttctgcagaataaatgctctttccttttgtatacc

SEQ ID NO: 224 - DNA, 172848 bp, Mus musculus
atgcacagcgcgctctgggatccctgactgagggatagaccacaggctgcttgttgttcgggtttcacaagtttgccctctggttttactgttaaagagagggtgagtgttcaagaaaaggtttagtgaattcgtaggactaacgaaacaacaatacgtgttttctgccctgtaaaggaattctagccgcatgaatatgtcttgttagtactctgaaataaggaagtaaccgtgggagagggtagctgagggaagccatctgtttgggaatgtttcaaacctggggccttccaacatttctgcagcagaaaatccccgttatcattttccaaatgtgcctaatgacatttgctaattttttaaaactaacggggaaaataagcacatttaatcagaaagtttggaaaatattgaatcatttgtggtgcaaatcaggtttagaaaatatggtttcagccctatacacagatcttttccgattcgaattcttgtctttttcagaatgttcactctccacagcctcccaatattttaagatgccaagtttagtactcaaaaccattataagtattattcacatgcatctgtaagcattaactttgaaaagttcttgaagtcttgttacctgggatatccatactaaatgttccttctggcccgagcactttcatacttactgacaatttgtcatcttctcattgtaagttactcacggtgctgagttagaggtgcccggacttgtcctgataaaaatcatgcgaatactgtgggcacactcagttgagtgtctataatcagcttgtattcttgtgttgttggttctccttttaaacacagttgtatctctctgacggtaatgatttatacttctgcttcccaaaagacgtttggcaggaacttcagcgacattagctaggaacaataatttgatgaaataaatgtgccaagattttacaggagcttcacagaggtggtgaacacattaaagcaagttgtgtctgatagattgacagtgttgtttttctaaagttaattattttaacaaattcactctaattgcacttgtcttatgttgcttttggctttgtatctttcctatcaattagttttggaataggacctcttgcttttatgacttccaaaatatcctcctacattccagtgttttcatttgggaggttttatttttccttatgtatttgtttcagctagtggaagtctgcagactaaagttagtgcttgtacacttttctgttcctgagtctgtaaagtgtcttgcttaagctttaagtttgcagagtctatgcatggtaaaaatgttcatcttttcaattattgtagttagaaattaactaatgacttggtctatctgtaaaaccgtggtacaaattggtgtagggatattttgggctcaaatatagttttaaactgaaatctgttgcattttgctaattaggttctctccgtattggaaatccaaggaaatgcttttacaacagcacttttaggttagaggctattataattctattttttcctcattctattctaactagtctgtttttcttttaatagtaatttattcctttactttaaaacaacggttccaccatactagacaaactttcaggttacttgtcaagatgcaaatctcagaactactctccttacctctgagggggttccaccactcacatactctttccattccatgcacatttaatgctcgactgtttaatacaaaagctaatttgttttcctctattgacattttgctcttgctgttttctctgccagtaatactttccgacagatttgtcatagttattcttagcatcatccagggtttagagctttgttcaagcttccctttccatcttagttaaaacaaaaacacaaaattaacacactctactattatattatgtagataaacacattcaagtagaaattctatgtgaggtagaaatattttcatctcgttcatggttgatttttcacctagtagaacagtaccctgtatgctagatacttagtagatatcttgtaaatgaatgaataagggtagtacaatacaggatggtattactgttgttactttttctgttcatagtacaaagtatcttacaagcaagaagtttgcttttggacaaatttatgaagatgcttaatatgttattttgaatcttcattcaaagttgattatcaaaaatttttcctataataaaatataaaaatctttcttattaataataagacttctgtgagagtataagatgcaattgaatctaaaacaagatcctaaatataatgctttatacttattttctctgcccagatttgtaaaatatattcattgaggccacctagatgactacactaaacattttgagatacagaatccagaatttagtttctcaattcagaaatctaagttaatggcatttccactaaaataaagactcctgttagccagtgatagggacaaagaatactgtggaagccactgatctcagcagttgaaagtaaatttcccaatcagccattactaagaaacaatattaaagaaagaagaagtggtttgtgctgattttataaccattagaaatgagtcaccaatgggcccggaagggaaggcacctctgggatctatcagaggaggcacaatgtgcctacaggagaattttgcagtgaatcgtgggtgtcagggaattcataaaacccagacttcctcattagcagttgagccaaaccaagtgagtggaaatatgttagttaaatttcacaattaaaaaggactaacccagagctagtcagtatttctcatcaataatggatatttgacagtgagaacattgtgttaggataattaatcattagagtaaccagataggatgttacattttctacaactatgcagttggtcaaaatagaacaaatgaacaaacttcagtacctgctgaccctaaattcctcttgtagtattattttatagaggatatgaaagctaaatagtcattgatgttgaactctcagctcctcttgcaccatgcctgcctggatgctgccttgctcctttattgatgataatggactgaacttctgaacctgtaagcctgccccaatttaatgtccttataagagttgctttggtcatgttgtttgatcacagcagtaaaaaccttactaagacagtcattttgtatgtagatccaggtgtcatctagattcctggaggatgtggtcctatctcatcaatgaattatggtaaggtgggaatcaagttggcaacatgatgcaatcaacattcacctggcaagggattctcagtgagaggttgtccaaattaggttgtctgtgggcatgcctctgagagatattcttaacttggttagaaatgagaatttttgctctaaatgtgtgctcccactattttatggtatgggcttgaagtgaatgataagaagaaagcaagtttagcattgacaagcacccattcattcacacactctccttcctcttgaacgtgaatttgagtagctgcttcaggttcttactagcttgatttccctgaacaatgaactataacctggaagtgtgagctgaaataaactcctttgatcccaagttgcttttgagtaattatgagcattttatcatagcaacaggaagtgaaactaggatacagttacatttataaccttatgttgtcaaggaagagagggcatctccatcaataacagtggcagacttaaattttatttaaattcatgggttcctaattcagaacgcctatgtgagagaaactgatagtttcttgaggtgagagattatatagcattttatctacaataatgaactgatagactttgaagaccatcactacttgtcacaaaactcacctctctcatttatctagaaacacaaattatctagcttcttactatgatttaaatttttattgatacatatttatatatacacctaatgagggcacattatatatatatatatatatatatatatatatatatatatatatatatatatatatataaaaatatatgaatggtagtgcttttatttattttgactatgaactcattagttcgattgttgagctacatgatagttttgttttcaagttttaaagtccccccatactgttttccataatggctatactaattcacctcattaacagagtataggagctcccctgttgtgtttcctcacaagcattttcattttgtggtcttcttgataactatttgaatagcagtgacacaaaacttcaatattgaactctcttattgataatgaggatataaccaattcatcggaatggcaatgcagcttaaatgaggtgacatatgaaatgcctgagtatagtcagttttaaagtattattattaacaacaataaggatgttagaggttttattagcagaatggtttcatcttctataggatatgtcagtcagcttttagtttctataatgaaatacttaaggcagctaactttataaaaagaaaagcttgcttgagtcacaattttgtaggcttacaacttatagccttaaacttttttttttgagtcaactccttttatttaattttttaaaatatttttattaagtattttcctcatttacatttccaatgctatcccaaaagtcccccatacccacccccacaatcccctacccatccactccccctttttggccctggcatttccctgtactggggcatataaagtttgtaagtccaatgggcctctctttccagtgatggccgactaggccatcttttgatacaaatgcagctagagtcaagagcttcagggtactggttagttcataatgttgttccacctatagggttgcagatccctttagctccttgggtactttctctagctcctccattgggggccctgtgatccatccaagagctgactgtgagcatccacttctgtgtttgctaggccccggaatagtctcacaagagagagctctatctgggtcctttcagcaaaatcttgctagtgtgtgcaatggtgtcagcgtttggaagctgattatgggatggatcctcgaatatggtagtctctagatggtccatcctttcgtcacagctccaaactttgtctctgtaactagccttaaactttaaggacatagagctggaatctgctcagttcttatgaaggccctctctcttggctgagtcacatgacagcagaagagaacaactgtggctgagcttgtattgttcaatgggaagtccgaggaagagactggagtcccacattcccttcatagtgctggataaatttatgtcagcttgacacaagctaaagtcataaagaggagagcctcaactgagaagatgcctccataagaacctagctgtaagcaagcctacagggtcttttattgatcagtaattgatgtgggaggacctagcccattgtggcaggtgccatccctgggctgatagtcctgagcaagtcatgaggagcaagccattaatgagcactcctccatggcttctgcatcagctcctgccttcaggtccctgtcctgtgtgaatccctaccctcactgctattgatggtgaactgtatagtagaactgtgagtgaaatagatcctttcctcctcgattttcttttggctatagaatttcatcacagcaatagtaaccctaattaagacatattctaatgatatatctctgttgacccccccccccccaccaaatccccaaaagttttgcctcccaaaagttctggcaccacaagaacacagtctagacacagctcttttatttaaaatgttcctctataggcataaactgtttttaaaatgtagcatgatgtaagattgtttgacatttatccttaagaaacttttgaaatggtgactaatatataccaatatgatctaagcttttctttacatgaaacttactctataccagcctgaccttgaactcagagatctgcttgcctctatatcctggggttaaaggtgagtctgtatttcatcgagatcacactagaaggtgatctagaaggtctttggatgtgatcttttgctacagcagccatattgctagattaaaattcctctacaccttttccctttttatttatggtaaaaaattgtagactgtataacttttataatggaaacaattatcaattccatagtagtctgaacgtctttacgaagatctgttgatgctgtgattcttcatcactgcttgttctgatcatctgcctttcaccagttgtcgatttcaccatccaaggctttacagtctgccagtctgatgaacgctctgttcttttccattcagtttaccgagctatctctctgccatatttcagcatctcttcattccttcagttttgcctttcatgtggaagcatctcctattcagatcagatctttgtcaattttagtggaacccatagtctctcttcacctgtggaaatttagacaaaaccctttccccaccaacataacacattccctgactcccattctgatgttaaaacatctttaaagtatacaggtctatctaattaagccggtttttttttcctccagctaatcttatttccgatttttatttatcaaggcacaattagatgtttagatcaatcccccataaactagacacttgatatttgaatactgtgcccagatccacactagcagtctgggattctcacctgtttaaacagaaacaatcaaaccacattccataaaatatcaacatgcagtgtcagctaaaataggtctctattgcctgagattggaggaatattaatctgtgttcctcattgttatagtagaccaattccccatgggtttatgggcatatctgctacataggttttaatcttcctatttgacctttgatctcacacatttaattttgcttacattttgttttattgggataatgttccaattccaataaactgcgtgtataccttcagaaggggcctaggtggattccatgagtcttgtgagattacagttacattagctcctgtgtccattaaaccttcaatttcaatactatttaactttaattttgatctctgctcattgttaatacttaagaaaaaaaaaaccctttcttctggtacctccaaattttcctgttctttcaactggggctgctttgcctttgccttacaaaattggaagaaggtaagaaatcctgtctcctgctttaagcttcatatttattctttacataaaccataatttcaatttctcccttgaactcttgatctataattcctggatgcactgaatccttgagaggtaaggctaattcttttagaaaccagttccattgtctttggtgatattcactccaatggttattttatagcatggaattttaattgatagtgtgatatttttacttctggataagtctagggtaccaattctttctgtaactcatactagatctccaatacatagtttagttttctctagttgctctgtcaattgctgacaggaaatggctgggtcatgttgtttgttgcaccagtaaaagctaacccccttttggagtttccagggttatctcatagtgagttttccaataacatgggattatctcttgcagatctgcattcattagtccaatgcctacccttaccacacctacaaatactggaaggatgaggtcttctagagaagtctctaggagcaccttgcctacaactgcttttcaaaacacctcatctcccactgtgtcttagttaggtttttactgctgtgaacagacaccatgatcaaggcaacccttttaatgacaacatttaattggggctgtcttacaggttccctgttagcagcttttatcatcaagggggagcatggcagtgatggcacaggcatggtgcaggaggagctgagagttctgcacctttgtctgaaggctgctagaagactgacttccaggcagctaggatgagggtagtaaaaaccacattgtcatacttcctctaacaaggccacaattcgtaatagtgccactttctgggccaagcatattcaaactataacattctactccctggccctgataggcttattcaagcacatgagtctattgaggccacacctagccatagcataatgcaaatacatttggtccaacttcaaaagctcccagtctataaaagtctcaacaatgttaaaagtccaaagttcgaaatcttttctgagattcaatcacttcactataacccctgtaaactcaaaatcaaaaagcagatcacttaccttaaacaccatggaatatgcactaccattccataatgacatagtgaacattctagaacagacaagacccaaaaccagctgggcaaactctaaactctgcatctcaatgtctgttaccaaagtgctcttcagatctccaatcctctcatctttgttaactgcagtacaattctccttggctggttccactccatgttagcagctttcctcagcagatattccatggctctgggatctcaaacatcaagggggctctaaggctgcttcaacattatagcttcttgttcagatgtctgggatccacacatagtattacgttttgcttggaagaagaatgaccagatgtacagttgttcactgactcatgggctgtagcctatggattgcctggatggtcaggtattggaaagatcatgattggaaaattggtgaataagacatccggggaagacgtgtatggatagatttctccaaatgggcaaaggacgtgaagatatttgtgtcccatgtaaatgctcacgaaaaggtaactgcagcggaggagttcaataatcatatggataaaatgacccatttagtggacagtcagtctctttcctcagccatccctgtccttgctcaattaagtggtcatggtggccgagatggaggttatgcttgggctcaacaacgtggatttctactcaccaaggctgagctggttatagctgctgctgaatgctagatctatcaacagcagagactaacactcagccccagatacggcaccattcctcaaggtgatccaccagcaggttggtggcaggttgactacagtggagtacttcctccttgggtaggacaatgttttgttcttatagaagtagacgcttattctggttatggatttggctttcctgcatgtaatgcttttgccaaaaccagcacacagtagacaacagacattttgatatctaggattattgacaattagttgtccagttgcgtagtcattagggtcaatatcaggagttctaatccattcatccatgggtgctaattgaacttttaaatgtctaggaacttttacactttgtatttgcatttcaaaagctaaagtctcacatctgggtctgatattgccctgtttagagaggacactaatgcatgtcagcaaacatctctctggggatttccataatttttgtgaatgataaaggtctttttttctgtgttcctccaccttatcccaggctctttaagatgctatagtatctttaataataataacaagactgtataacagtacagtcatcaaattgcacctgctgtcttaaatcaaccaaactgacctttacctatcaactggtctttcatgatattaacacctttagacccattataactttccataattgcaactttttctcattatcttgccagccattgtaactgagaactagcttcgaatacagctgctgctacatctttccaggcttatgagataatcctgtttttggtagccaggtatttaacatctgtctttcaacgggtaagtgcattccacaagttactaatgattttctaaaaaattatttaagatcttgtatttttaatagaattcttgattagttgttcattttgtgagttttcacccttttctggcatttgttcctgggtaactgagaaagctagtgggggtggccaccttcctcaagttcaatgtttatcttgatccttaatttcattaggtaccataggttcacaattaagcagtttctgttctcttagttcctatgtctcttgtctctcaagcctttgtattaccacagctattttttcttgttgttcatttagagtttttttttcaacctttttgagaggaaatatataaagactacaattgaaagtagggaggggtttactcctgtgtacacagttgtaataacaacaatatgaactagccagttcccccaggagctcgtgtctctagctacatatgcatcagaagatgacctagtcggccatcagtggaaagagacattcattggtcttgcaaactttatatgcctcagtgcaggggaacgccagtgccaagaagtgggagtgcgtgggtaggggagtggaggaagggtatgggggacttctgggatagcattggaaatgtaaatgaagaaaatacctaattaagaaaaaaagaactgcattgcttttttcaagtaatgtttctatcccctcaatggtggcattggtcttaagtttaccattttttagtgcaggaaaagcctgtctatataattaaaatagtttttcaggctggcttactgtctcaaaggctcttgtgttggtccttgctcttggctcccaatgttctggagtttcttgagtctttctgggtgtccagcctaactcaaagaactgatgctccttcttgagacaattctaggcacatttctcccctgtagctttctgtcagacatctcttgtcctctgagatatttctgtcagatgtcctttgctttctccaatgttggtgtgcttttttcttctccaataacactgggcaccgcatgtaatagtaatttttatttgcctgatttcattgtcatctcagaagcttactgacgaataaggttatcttttctagtcctttctgaactctggctggctggttcaactcagcacttctggctcaaattcctctccaagctgactgattcagtctgtctcctctatattttcactgaattgttctacttggcctcagactaactcttgcagtttgttctaattgagctccttcttatactctggcttcaactgcctctgctgacttcacagaacttcaagaattcatgaaggaactcaactccaatgcactgtgctcactgcattaactcccaactgactctctgtccctgagctgttcttgaacagcttctctttcctgggctgttctcgtgagacttgggcatatcctatcttggattccttctgtcaaatgttagtctgatgttgctggattaaaattcctctacataattttttacacacacagacacacatcttttaaaagaaatgtctattgtagtaggtttccatacaactcaagtagcccttagttttatgggttcctcctcatgttctcttctttatacattcattgtctacatgctattacttgaaaaaaaaatgttcatagaatcaagtaacattttaattttctttgaaataaaatgttctaagtttcttttggaagctagatcatagggggtgactcattgaagtatcatctagtttggtgagtgagtcaacattagtattcacctaatttattgtgagtaaaattcaacaaatatgcataaaatgctttaaaaattaaatatgtctaaattgcatatgaaaatatacaatgaaaatggattctgatatgtttccaatttttaagcaccataaaatttgccacatttatatattacacagaattcatacagacataaagaccctttggagtactttactggagggctggagctatagtggctgcaaaaataggaaggatgtgagaaatttagtgtatgtagttcataaggaaatattaattcttcagtaaagaccaggtgctcattatgattaagagctagttaccatggctacagacagcatgaaatttgtaaaattaaaacacacaagatagaaaatgcagatagcacaggagagtgaatcatgaccaaatggtcttagcttcgtttccatagatccaaaaatgtgtacaatttctgattggccattttgtgggtaaaattactttggttatatatctcatattacttacttgatagatgttttatctggacccaatttaaatatgatggaatgcattatgataattaacttaactgtagatgagctaaggtcgggttatgtgaatttaaaatgctcatgagtagtaatagttacaattaaaaagtcatactttatggaaaaccctattcctcctcctcctcttcttcttttttttttttttttttaaacagggtttctcagtgttagtcttgatcatcctggaacttacactatagaccaggctggcctcgaattcaaagatctgcctgcttctgcctcctgagtgcagaaaacaatttctctctctctctctctctctctctctctctctctctctctctctctctctctctctctccccgtgtgtgtgagtgtgtgtgtgcacatatgatctttgtaggctcaaggaggtctctaccctctcaaatttctatattttaaaggtggactactaaatattgtctataaaaatgatggcatttgatgctcatgaggagacagtcctgtgcagcactattcagtttcattggttggtaatttggattcatcttaaaaagcatgttaagctcaaacttctaaagagagacaaaataagtagttgccgtccatctaaaagtctacctttgtgatcctaggttaacagtagagagtgtaaagagaatgtactgtgcttgccaacaacagggtctaggttttttgttttgttttgttttgatctactcattaataccattggtaagatattctgtctttattatcagacattaaataaatgtaataaagatagcattggacacaggaaggatgacagagtctatccaaggatgacaaattctatccacaattggtatgctctgaattcacttgcatcttacttataagtggagcttattattattattattattattattattattattatagaactttatcacagattctccaaggactttttacatttatctaatatttggacttttatcattggggaaacccatttaccccagggagattatttaggaggtagatatctggaaacaactgaataatgttgaatagattaattaactataatgttgaatagcttaattaactgtacatttttgataaggcccaagttgactttagtcatgaagcagtaaatacaagtgttttatagtatttgtataggtatcaaatggcatttttctgtgctttttaattattatatctttctctataatgcttgctttttataagtctgaagccattctgactttccatctctaaagatgtagcaacagctgattatttagtgaaaccaaaacgttagcactgaaatggactgtgaacaaatgggcaacatcttcagctgtcagaagcaacagtgacttcctaggtgaggtagctcagggctgtaaccctagcacttaggaaactgagatcagccttggcaacatagtaagaccttatcgcacaaaaaaagataaaaagaaagtagcagtattgttttaagttttgtatggttatttctcattacattatcagatcagggtccataaactacaactcggtagagttaatggagaggtgtcatattgtggcatccaaataaacatctttcttgggagagttttacccaaagtctgaatttagaagcccttggacttagcttcagtcaacatttccctctcagtaggattttggaaagagctggataacctggagtgttggcattctaaattactggctgaaggcccatccatatgctttggaactgagatcagcaagtagcaagatagttatcctattatgaaaatcaagtagctctaacaagtgttcttgtcacacagctagtggcagacaaagtagtgcttgggcccatacatgcttaaaaaatagttgttgaataattttaacttctaagacattaaagttttagacactatgaagctcagtttgaattaacgtgggtaatatttctgtccatagtaataatgattccaaaggagaagaattgaatttgttctagattattttactcactggtacaaatagtatgtgttttaattccacataaagagaagtaatttcaacagttctaagatacaattgttggtcatgatcacagtgaattgatcaatcagaagtttagattggtgaacatatggctgagatgtgaagagattcagaccttaaaatgatatttgaaatgtatgttcttgttgactctgttaggctgctcatcccctgtacaaactggaaaaccccatctgccctcctgcctgcataaagaccgacatcacctccccactccccacctccactgccgccctcttggagaaaactctgtgctaacatgtcatcactccttgattctgtgttttccccagcccactcaagagcgctggcctaggaactcagtttttgagctgcatgggaataaacctgcctttatctacttttaatctggtctaatctggcctatatctgtatcactaagggagagaaaaagccaatcagattcctctaaatcagatgttgcctgattatattatcagggcctctcaaccatcctcaagtcctgagttagttgtctgatgtttattacaaaaacttgcttctgtttggtatggtgatgcatgtttattaatccagaagtggagaggctaagtcaggaactctttttttctctaatgttgagtatggaacccaaagccttaaacatggtaagttttacccttaatatagctatatacactttagctataccactgaacttccctcagctggatctttctttatttcaaattataacaaagatgggactttctctctctctctctctctctttttaaattgacttccgatccctaataaaattgatcactctgttaagttttattagaaagttgacacaatcatctgaacagagagtgtaagtgagagactctcttgaccaggtggacctatgatggtgtctgtagggtctatagagtgggaagactcagcctgaaagtagacatcttcccctagaaggtatacttaacagtaggcatgtactgtatctctatgttcttgacacagatgttgtgtgactagtgattttttttcagttattaacacattgactttcacactatgatggacagtaggaggtgtgagctgaattaaatccacttctcccttaagttgctcttttaaagggttttttttttttaaggtaactttttttattagatattttttaattttttaaaattttattttaattaggtattttcttcatttacatttccaatgctaccccaaaagtctcccataccccccaccactcccctacccacccactaccactttttggccctggcgttcccctgtactggggcatataaagtttgcacaaccagtgggcctttcttgccactgatggccgactaggctgtcttctgatacatatgcagctagagacacgagctccggggttagttcatattgttgttccacttataggcttgcacatcccttcagctccttggttactttctctagctcctccattgggggccctgtgatccatccaatagctgactgtgaacatccacttctgtgtttgctaggccccagcatagtctcacaagagacagctatatcaaggtcctttcagcaaaatcttgctagtgtatgcaatggtgtcagcgtttggaggctgattatgggatggatccctggatatggcagtctctagatggtccatccttttatctcagctccaaactttgtctctgtaactccttccatgggtgattgttcccaattctaagaaggggcaaagtgtccacactttagtcttcgttcttcttgagtttcatgtgttttgcaaattgtatcttgtatcttgggtattctaagtttctgtgctaatatctacttatcagtgagtacataccatgtgagttcttttgtgattggtttacctcactcagaatgatgccctccaggtccatccatttgcctaggaatttcataaattcattctttttaatagctgagtagtactccattgtgtaaatgtaccacattttctgtatccattcctctgttgaggggcatctgggttctttctagcttctggctattgcaaataagcctgctatgaacatgtgtccttcttaccaattggaacatcttctggatatatgcccaggagaggtattgcgggatcctcaggtagtactatgcccaattttctgaagaaccaccaatctgatttccagagtggttgtacaagcttgcaattccaccagcaatggaggagtgttcctctttctccacatcctagccaacatctgctgtcacctgaatttttaatcttagccattctggctgttgtgaggtggaatctcagggttgttttgatttgcatttccccaatgattaaggatgctgaacattttttcaggtgcttctcagccattcgatattcctcaggtgagaattcttttttagctctgagccccattttttaatggggttatttgattttctggagtccacctgcttgagttctttatatatattggatattagtcccctatctgatttaggataggtaaagatcctttcccaatctgttggtggcctttttgtcttattgacagtgtcttttgccttacagaagcgttacaattttatgaggtcccatttgtcagttctccatcttatagcacacgccattgctgttctattcaggaatttttcccctgtgcccatatcttcgaggattttccccactttctcctctataagtttcagtgtctctggttttatgtggagttccttgatccacttagatttgaccttagtacaaggagataggaatggatcaattctcattcttctacatgataaccaccagttgtgccagcaccatttgttgaaaatgctgtcttttttccactggatggttttagctcccttgtcaaagatcaagtgatcataggtgtgtggattcatttctgggtctttagtcctattccattggtctacttgtctgtcgatataccagtaccatgcagtttttatcaaaattgctctctagtacagctttagatttgacatggcgattccaccagaggtccttttatccttgagaagagtttttgctatcctaggttttttgttattccagatgaatttacagattgctctttctaattcgttgaagaattgagttggaattttgatggggattgcattgaaactgtagattgcttttggcaagatagccatttttactatattgatcctgcccatccatgagcatgggagatctttccatcttttgagatcttcttaaatttctttcttcagagacttgaagttcttagcatacagatctttcacttccttagttagaatcacgccaaggtattttctattatttgtgactattgagaatggtgttgtttccctaatttctctgtcagcctgtttgtccttagtgtagagaaaggccagtgacttgtttcagttaattttatatccagctacgtcaccaaagctgtttatcaggtttaggcattctctggttgaatttttagggtcttttataaatactatcatatcatctgtaaaaagtgatattttgacttctttcttgccaatttgtaaccctttatctccttttgttgtcgaattgctctggctaggactacaagtacaatgttgaataggtagggagaaagtgggcagccttgtctagtccctgattttagtgggattactttcagtttctcaccatttcctttgattttcactactggtttgctgtagattgcttttatcatgtttaggcatgggccttgaattcctgatctttccaagacttttatcatgaatgggtgttggatcttgtcaaatgctttttctgcatctaacgagatgatcatgtggtttttgtctttgagtttgtttatataatggattacgttgatggatttccatatattaaaccatccctgcacccctggaatgaaacctacttggtaaggatggatgattgttttgatgtgttcttggattcagttagcgagaattttattgagggtttttgcatcgatattcataagggaaattggtctgaagttctctatctttgttgggtctttttgtggtttaggtatcagagtaattatggcttcatagaatgaattggttagggtacctgctacttctattttgtggaatagtttgtgcagaattgaaattatatcttctttgaaggtctggtagaattttgcactaaacccatctggtcctgggctttttttggttgggagactactaatgactgcttttatttctttaggggatataggactgtttagatcgttaacttaatattgatttaactctgttacctggtacctgtctaaaatttgtccatttcatccaggttttccagttttgttgagtatagccttttgtagaaggatctgatggtgttttggatttcttcaggatctgttgttatgtctcccttttcatttctgattttgataattagggtgctgtccctgtgccctctagtgagtctggctaagggtttatctatcttgttgattttctcaaagaaccagctccttgtttgattgattctttgaatagttcttcttgtttccacttggttgatttcacccctgagtttgattatttcctgccttctactccgcttgggtgaatttgcttcctttttttctagagcttttaggtgtgttgtcaagatgctaatgtgtgatctctctagtttctttttgggggcactcagagctatgagttttcctcttagaaatgctttcattgtgtcccataagttagggtatgttgtggcttcattttcattaaactctaaaaagcctttaattccttactttatttcttccttgactatggtatcatttagaagagtgttgttctgtttacaggtgaatgttggcttcctattatttatgttgttattgaagatcagcctgagtccatggtgatctgataggattcatgggacaatttcaatatttttgtatctgttaaggcctgttttgtgaccagttatatggtcaattttggagaaggtaccatgaggtgctgagaagaaggtatatcctcttattttaggataaaatattgtgtagtatcttttaaatctatttgtttcataacttctgttagtttcactgtgtccctgtttagtttctgtttccatgatctgtccattgatgaaagtggtgtgttgaagtctcccactattattgtgtgcggtgcaatgtgtgctttgagctttactaaagtgtctttaatgaatgtggctgcccttgcatttggagcatagatattcagaatttcgagttcctcttggcagacttacctttgatgaatatgaagtgtccctccttgtcttttttgataactttgggttggaattcaattttatttgatattagaatggctactctagcttgttttttcagaccatttgcttggaaaattgttttccagccttttactctgaggtagtgtctgtctttatccctgaggtgggtttcctgtaagcagtaaaatgtcgggttctgttcgtgtggtcagtctgttagtctatctttttattgggcaaattgagtccattgatgttaagagaaatcaaagaaaagtaattgttgcttcctgtcatttttgttgttaaaggtgggaatctgttcttgtggctgtcttcttttaggtttgttaaaggattactttcttgctttttccagggtgtaatttccatctttgtgttggtattttccctttagtatcatttgaagggctggattcgtgaaaagatattttgtgaatttggttttgtcatggaatactttggtttctccatctatggtaattgaaagtttggctgggtatagtagcctggactggcatttttgttctcttagtgtctgtataacatctgtctaggatcttctggctttcatagtctctggtgaaaattctggtgtaattctggtaggcctgcctttatatgttatttgaccttttttcccttactgcttttaatattctatctttatttagtgcatttgttgttctgattattatgtgtcaggaggaatttcttttctggtccagtctatttggagttctgtaggcttcttgtatgttcatgggcatctctttctttaggtttgggaagttttcttctataatttttttgaagatatttcctggccctttaacttgaaaatcttcattctcatctactcctattatctgtaggtttggtattttcattttgtcctggatttcctgcatgttttgagttaagatctttttgcattttgaattttctttgactgttgtgcagatgttctctatggaatcttctgcacctcagatcctctcttctgtctcttgtattctgttgctgatgttcccatctattgttccagatttctttcctagggtttctattttcagcgttgccttactttgggttttctttattgtatctacttccctttttaggtctagtattgttttgttcatttccatcacctgtttaaatgtgttttcttgttttttttttttaagtacttgtaagtctttagcagtgttctcctgtatttctttaagtgagttattaaagtccttcttgatgtccttgatcatcatcatgagatatgcctttaaatccaggtctagcttttcaggtgtgttggggtgcccaggactggctgaggtgggaatgctgggttctgatgatggtgagtagtcttggcttctgttagtaagattcttatgtttgtctttagtcatctggtaatttctggagttagttgttatagttgtctctggatggagcttgttcctcctgtgattccatcagcctctatctgcagacctggataactagctctctcctgagtttcagtggttataacactttgcaggcaagctctcctcttgcagggaaggtctatagatatctggcgttcagacctgcctcctggcagaagatgaaggcccgaaacagggcttgtcccacaatctgtgtagcttctgcagttcacactttcacctgcgcagactagtccaggtggagtcccggaatcaagatggctcccccagatgctgtggtaaagccctctttttttctctttttgaagagaaaatttaaaactatttttatgtatgtaagcatatatttttaataccgttcatatttatcagaagcctatatgattgcatttctttcataaattatcatggagactaagattaataaatgaataaataaatcctgtgtgttttgtttagactgctgaaaatcttataatctgaggaacaaaatataagcttctttatgctttggaatatggaaagtccgaagaaatgattttggaatatatttattttatgtgtatgtatgtgagtgtgtgtgggtgggtgagggtgtatatatgctccagttgctatgtaggagctctcaagtcacaagagggtttctcatctactataactggagttacagatggttgtgagctgttaggtgggtgctaagaatctaacacaagcttcttttctataagagtaacatgttctcttaggtgttgagacatatctccaggccctaaaaatagatttcttataaatacctatattttatgttcaacaagtaaaaaatgaataaagtagacttgtaaacatctagccatgtatagatagtgaagtcttagatcattgtagattttcatgttaagattgtgtttttttaggaagtgaagtgctttgatttagtttccaaatatttaggttacttctaccctgaagtaagctcgcgctttgaacataggagtatcaaaaatacttgttgtgcttttcatacagtgcagagcttgcttaggcactccaggaatcaaaacttaagggaacacaaggctgcagacaattggataactgttgaattttataaaatgcttgttattttgtaaaggaaatacccattaccagttgataggaaagataaaaatgtacacaaaatttagaagacaataaatagaatatacttaccatgctaagtctatggtgacctctcactaaccttcagaggagcttttaaaagattaggaacataaaacacagatgccattgtattcatgatttttttttgacagaaaaggccttactagatcttttaaacaaaatacatttcccatatctctgagtcatggcgatctattgtagacaaattgcttttattatctttttacttttatgctctttgaaatagaattttgtctagaacttctaattacttctcttataatgggtaattaaaatgcatttaacaaatttttcttttcttttcttttcttttcttttcttttctttctttctttttttttctttttctttttttttggttaggcactcaaagttgatcaggataaattatagacattaaatataacttaattctaatctattagttcctaaaatttgttagagttaaatggagttggagccagttagagatggattatactgtgtcatcctcattaaatagtttcatacctctgaagtaaaattgaaagctacaccaggagtagtactgagaaagtcatcaaaaaccactataataaaactactataataattctcacagtgggctttagattagaaataaaactctgagatgaagagtttgtaagaagaggttttttacttttatttttatattttattattattattattattattattattattattattattatagaatagctttctataatttacagtgatgagcaaaggtagtttggccagatggaaaagatgattctcaatacaactgtcgtggtttgaataagagtggacttcatactttaacttatctgaatgcatagtcaccagagagtggctctatttgagaaggattagaaggattgggaggtatagccttgttggaggaagtatgtcacttgaaatatgtagagaaggtgaggaagtatttgtgacccccacagctggaaaagtaatgatttatgagaggcaagaagacagtcctattgagtatgagtaagtagctagtcttatagaatagattgatcagaaaaccaagttcttgatcagggcctgtgggaggatctggtatgctcttggccacacagtacagaggtcatgattgttctgtcttctgggtgaacgacaagttattcataccttccttgaagggacaaccctgtgtgtataacatttctggttctcctagtgattatgtgtgaatacaaagaactctctctatgcctagtgcagaagtggacttagaggtatcaaaaaagctaacagctagtgtttctctctgtctgctgaacaggatgtaactctcatctacttctccagaaccaagtctacatgaagccatgtgcctgctgccacgcttcacacctggatgataatggactcacctctggaaacaagcccccaaattatatgctttcttttataagaattgctttggctatggtgttcttcacagcaataaaatagcgatgaagacagtagttgataccaggaaaccgagtattgctgtgacaggcatgaccatgctgtatattggcagaatgtgaactttggactagaaaagtgactgagtggtttaagtcgggattttatgggctatactagtagcaaggacacttgtattggaaaaatgtagacaagtgggagaccagcacaggaagttgcagagggagaaatcatacaaagtgaatacaaagcaacctagtgaccattcttgatgtatttcagcaaagaggtggctgcttttgcccatgtcctgaaaatctgcccgagtttttgattaatgatggcagaggagatgtcaagacagcttagaattgatcatatcatatggttattagtaatcactcttatttaggtcagtaatggaaaagataaagctagacaaaaagaaataccaaatgtacagattgaggggaaaagaaagcactagagagtgtaatggagctaagtccagtgcttctagaagattaaaatttaaagaaaaatttgacactaagtggaatcaaaagagcagtaacctcaggtaagatcccactcagttaaggttccaacttgtaaaagggaattaaagaagtttaagcagtgaaggaaactatcaagaagggaaagctgatgcaaatgtaaatgaatcagagggccaagttcaggccagcaagcagctgaatttggcagctttagccaagtggttctggccttagagtcaaggaaatcaagagagcaagtccttacaatatacaaaggaatggctcttcccccactggctaagaaaaggtgctgagtccaggcaagtgctgtgggtgttgaggaccccctgcaggtgtccatgcagtgatccatgaagaaatgagaatgaaaccttggttcagatagacttcgtcaacctagatcaaacttcggggagtttaatgctaggccatccattgtcagcatattaaaacatagtacaatttgggaaaattactaaatattttccctttaagtaaattattttattcttttttggaagatttacttagttttattttatttggaaagatgaataaatagtagaaaatgtatctaatccattttgtaaggaatattgaaattattcaaaataaaatatctggttgtgtgatttgtattactgttatggatgatagaattaatcacccaacaatgtagtaaatttgttatatatttctgtgaccatttcccacctttttttatttgattgtttgaggtaatggtataaatttgagtttaaaagtaggagaaccatttccaggaagatatctcaagaaactcaaagatctaccatatgaccatctatacaactcctttgtgtattgtaaggacttgctctcttattagagacacttgttcagccatgttcactgcagatctatatatagtagttaggaaatggcaacaacctggataaccttcaactgatgaatagatgatgaaaatcgactatgtttgcacactggaattttattaaactgtaaagaaaaatgaaatcatgtaatttgtagatgaacaaatggaactggaaaatactacattcacgaggtacttcagaccagaaaggcaagtgctgagtattctctattatttatggatactaattccaaattcttgtgtttgaagtaatattagcaggggccagggaagtagaaagtacctgtggtgagggtgaaggagctctagagagggaaatagatataggtgctatgaagggggtatgggtaaaatgggtaagactttatctgtgaaaggatgatggaggttaacacggagagacagaaagatgaaggggagataaataacaccaagaatatttgtaaaattatagggtaatattattttataagcttacttaatgaagtctctactgccatgactgcctgaatgtgagcagagctaggatgataccactagatatacccacctaaatggaagaaaagcccacaagacctcaaccctacacaaagaactacaggcaactgggaagcaggagaaatagccgcgaattcaagagagaatggggaagtcctgagaagagttacaggaggagaggaaagcatgacaattatgtaaaaatagtacttatacagaaaattctcaaaaaaatttaaaaatacctaaacacatgaattattttattaggaataaggcttcatacttaaacaatattgcatgtttggtattggttttgctaatcagaaattgatgctagaatagatactagaaaaaaaacctgcatagacatttattataatgggaatttttattcacaaagagcaatatttgtgactgatgcagtactcctctaatgtaagcactgtaaggtaatttaaaagaccttatcaaggtgtaggaaggctgagttgcggtaaatggcatgagaagccatggccacacagcagtgttaatctgtagcttggttggtagttttgttgtagaacactatcttgcctctcattttcatacttctttgacctaaattttcctcatctacttgggactttagtagggaaagtagcatctatcaaattccccatatacattttgatcctcctcctctgtataagacatcaaagctatctgctttgctctatctctgccagtctgccctgaagagaccctcagaccaagtaatgtagggtacactggacatggtctgcttctttcttcacatttagcatggaagctctcccttttaaacttatctctcgagttaggggaactgtccttgccttggacttttgatgcttatctacatcttttgtaaccacagaatcccctgttctacttgtcaaggtaaatccagactggagaaacttctaggctagaagctgggtgttatttatttatttatttatttatttatttatttatttatttatttgaggtaggctgttttagtgtcattctctcttgctctgaaaaatcttatgactgaaaacaacagtttatagttcatcattttgggaagctaggacaggagctcaaggggaaagttgaatcagaaatgaggaatgctgcttttagactctaacttcctcataggctcatgcttagctagcttgctacttatgtagctcatcattacctttctagggaatgatgccacccacagtgggccaggccctcccacacaattaggactgaagaaattctctacaaacctgtctgccattttaatctgtacagtcccacagtcaagatttctctttcaaatgactaggatgtgtcaagttcacactatactctaactaggatagggtcttatgtattctaggctggacttggatttctgatcctcctgctttcatcttcccagtgcgggagtatgtaggtacgtgccaccatccctggtttgtgtgatggtaggtgttagactcaacactttgtgcctgctaggcaggcgctctatttattgagtcacaccccctgcccttttataaaacattcttttgtaaggttttaatttcattttttatttcatcatttatgtatgggtctctgtgtatatggacatgcatacgtgggtccctgaggacagaagaggacatcaggtcccctgaagacagagtaagaggtgtttgggagcccctcaatgtgggtactgggaaatgagcttttatactctaaaagagcaacaagtgcttttaactgctgagccatctttctagtgcctgatttatttatctttaatgcccctctgcctggcaccatgcccagtcacttccaaaatgacaagttcacatatttatcatatttatgctttcgcttttttcctgaacaagttatttgaaacaggaaatcttgatgggcagaggtagtcaggtccaatttatcactgagttctacctactttttcatctagacatatgttactcccaacctctccatagctctctatgaagtttgtcacagctcttcagatgaaatcccttcccctccagatagctcccataattatctgttagcacgcaaataaaaaaatgctcctacctagtctatgaagcataaatttcaaggtccttagtgtgatgtggaattttaataatatggttcccaattgtctcattttattatcaactatttcctgctccagaaatgcttggcttgtacagtctcatgtggggtaatttctcattttgtgccttgttctgaatgttccaatggcaaaattgtctcatttcatggtgaacttctacacctatgcagcataccaaggagagaaaatatgcttagagctgtgctccccaactcagaaactgttgaagtttggcctctatgctctcatctgtacaataagactatgaacagcatatctccttagaaattatgcatatagaagatgccattgattattttattctttaagattttataaagatacttgacagaatttttttcaggtaagtaaagtttccttctaacatatctcattatgtctattgcagacttgagtcttaggttcactgcattttgtagaattcgtatttctgtatgtattagtcagggttctctagagtcacagaatttatagaatatctctgtattgagagaattcattgttatgacttacagtctgtagtccaactaccacaacaatggtcagctgtgaatgggaagtccaagaatctagtagttactaagtcccatggggctagttgtttcagctggtcttctgtagaagtagtttacaacagaaatgttggctagtaagtgcaagcaggcgaagaagagtgaatcttccttcttccaatgtccttatgtaggcctccagcagaaggtgtggcccacaataaagctgtgtatcaccatacttggatctgggttttgctttgtcccaggctgatcttgaactcagagatctccttgtcttagtctcctgggattaaaggtgtgtactaccttgcctgcgcttaaactttccatggtcacagtgcctcaagatctccatgccaagatccaggtcagaaacttgtgtcttccagcctcaagatctggatcatatgtgagcccttcaattctggattgtagttcattccaggtatatagtcaagttgacaaccaggtatagccattagagtgtagaactgccttctccagggaataagtgtcccatgaagcaagaatgttttctttagttttatatcttctccacaacctttgctcatagtgcacactcaatacatgtctgacgaatcaatagcttgcacagtgggaagggtctatgctttgtcaaaacaaaggtatattcagactgaatgtctgctaattttgtattcactggtaagtaatttttctgaggctctttatgtaccaataaatagaaatattcccctttcacctttgatctagtattgattgcagtgcttgagatatggtttttattattatcttgaaaacaatatattattatatcaaacttaaacattaataaacaagcaccattttccttgttgggaaaaaaactgtaaagaaaataccttacagtgcttctgttttttaaaagttaatctcctgttaaattttcattatattacccatggactcttaaaattttattttgtctgtaacacacatgggaaatagcaccattttttttcttgtagttttacaaaattctttgtgcctgtcttgtatgtacaatcatatacattttgagaacaatcatgtattatttatccgtttgcttttcttttatatttcccatccactgcttctcttccaaatagagactcctagataaaggaataaatcaatacacagcgttggttgataacagccagtacccaagagcaggcagtggcaactggaatgtgctggctttgggaggacccgtctcatttgatgtagaatcctagccagcagataatgacaaaattgcactgagcatgaaggggaataaaaagaaatataagatttggctccttctcaacaggaactgacaatctatttggcaagataaagcacacgcacacagaactgctaaggagcagaaatggacagaatatgattaagtacccactatgttctgaggaagagacactagaaattctcacacgtgagcctgaagtgaggaaattgttgcaaaactcagatgtgacaaagacagaagtccataggtgtttaaaggcttatgatgtgccagccactgtgatacgcaaagcacgtgctctgtatgtttatccatatgcatgcctgtggtgatttttcactctcttctcttctcttctcttctcttctcttctcttctcttctcttctcttctcttctcttctcttctctcctctcctctcctctcctctcctctcctctcctctcctctcctctcctctcctctcctctcctctcctctcctctcctctcctctcctctcctctcctctcctctcctctcctctcctctcctctcctctcctcttctaatcatcaattggactatcatgagatggggccatctgtatagtcacatacagtcttcagctaatgggatttcctttttctctaaagatttatgtaattcatgcatgtgactatactgttgctgtcttcagacacaccagaagagggcattgggtccccattacagatggttgtgcaccaccatgcagttgctgggaattgaactcaggacctctggaagaacagtcagtgctcttaatatctgagccatctcgccagccttgattttcactcttgaaataaaacattatgcttcatttagacagaaaaaacaaaacataaaatatttatcttaaccactttgattcaactcagtggtcacaagtactttcaacattcacatccttaacagaggcttgtcttgtcttcattttatgaaactgaaatgctgcacacattaaacatcaaaatcctcatcatctttctctatgaaagcaatagtgtatcaaaactctacagcaaacttagaggataatattatgtcattttgtgtagaagaaaaacacttgtgtgtatgtgtgtgtgtgtttatgtgtgtgtgttgacgtgcgccaatgcatgtgttcatggggtagtatgccataccatgtatgtggatggatgccagttttcttttcttatcctgtgtgttatgaggatcaaacttaagttgccaggtttggaagaaaatacctttacactgagcaatcttgctggcccttgaatgtcttcatgaattgggagacattacctattgaggtgacaattgcaaggaagggcaaagagatctgtgtaatattttcccatacgttagtatgacagggcatatggaaattgaggtaagattttaaactggaagagatctatgttggctgaagctttataaataaccgtttcttattagatggaatctggtagatgaagacactggtagatgaaggcactgatagacgaaggcactggttggtagatgaaggctctggtagatgaaggcactggtaccttccaaagaaggataaggtgctttatgcacactatgtccaattctcaaaatacccctttgtggtaggcactgttgtttttattttagtgtctcagaaaggaagtctttgccatagattactgggctgatcactaaagtactatctttctgcaccaagacagagtgctgtattttgtcttttaaatcctgaggttgggcatctgcaaactgggcttttgctttctaggattcatttttaaatgcagattagttcctttaggcccccccacaagccacaaaacccagatcgaaatcccatcattcttgtaagcagatatgcatatttatccctcattcagaaacaagaaactcagtctggatctggcaacatctagcgatgatggaaccatcagtaatgtttgtaccatctggccacacgggagtgaccctaattactctgtgatgagcagggttctttaggaacttatcagagatgttctatagcgatcattccacaatgaggaatgtctatgagttttaactacaaaaaacagggagctgatagtgcacttttccttgtagtgctcagatgttatgtgtatgctgcatattataatgctccaaaaaaaaaaaaaaaagacttgaaggaagggaaatcagcaggcttcaggacacagggccatttctccatctggctgtttagataacagcatattgttgagacccagaaatgctcgttcatctcacattctctagagctgtctttccattaaaatggaaggcctgcatagacatcacagagaacaaatgtcccatgaatcccaaatacttaccattttacagaaaagtctgttggcaccaatctcatccactaattcattttacaaacaaaaaactgaatcccaaatggattaaggggctgtacagaggtcacaacactgagacaactaaggttaaagacagtagtatatgctttgaggaagaaaaatcacgatcacaccactgacaagtgcgttctaatagcaaagtgagggtaaaataaatatttcatgagtggatttaacacagaaataaaaccttgtttgactggtttatttctcccactgaataaatcggatgcgtcaagccacagagatgaagctaaaccaagacttccatcagtaacaacataactgtatacagttaagtgactgttttcaaaatgatagcaaaatgtttactggccagtctcttgtgtctcagtattactcaaaagttgaattaaggacaatatgacaaagaagacatttggtaattgctagaatcctgaaggtgttaaaaactgactaactgtcccatgttctgctgtggcacccgttgacactgatgaaatctatagaagtagggcacatttccataacatgaatattcagagtttgtgatgcaagaattattattaaaccactgggaaggaacacattttcattatttgattgaatactaaatgctgtcttttaaaaataatttagtatgactattttgataatgtgtagaagagatgtttggggaaaaaccgatacattttatacattacataatcaggaaattaaattaagctatatacgacatttagaggaactgatttttaatcattaagtgtacttcacgaatctctgtcctgcatattttgaagtataatgtgatagaaatccaactagagcttgactcaagtgttttgtataaaaatatagtatgtagaggtcacttaacccataatggtgcgtgtgacaggtgccctcagtgtcatccctgtgactcacatagtagaacgaaagaatcaactcctggaaatcattttctggcctcaatgtcatagtgtgcacttcccacataacacacacacacacacacacacacacacacacacacacatacatataaacataatagataagtataataaaatattacattactaagcatttgtaagcacacatttgttgtcttggcagtaaataagacactacaataacattgttgtaatattgtacatgtttgccacagttctaagtaaagatagtgtcatttgttttgtttttgttttgtttcgtttttcggttttttgagacagggtgtctctgtgtagccctggctgtcctggaactcactctgtagaccagggtggcctcgaactcagaaatctgcctgcctctgcctcccaagtgctgggatcaaaggcatgcaccaccactgccccagtgatagcggcatttcttattgattgatttgtttatttttattgaaaataatttttacacaataaattttaattatgttttctccttccaaaattcttcccagatcttccccatcctctgtacgaatgttactttgtgttttttctctctttaaaacaaataagaacaaaacacataataataaatcatacaaaacaaaacaatccaagaaacatagacattacatcaagaagcacacacactaacaatgaggaaataagaataaacaagcaaaggatgaaaatgaaaggaagtgcccaaacaaaatgagatgagatttaaaaaaaagtttgcaaaaatacaattgagttctttttgcatggactaactactcctggacatgaggcttgctctggagtgtggttggtatatccaatgggactccagtgaaggaaagtgatttttttcccattgccagcagatctcagctgcacacagcttcttggttagagtggtgagcccatatcctatagatgacacatttaatttctcatttcccatttctcattttctcatttaagaaacctgatccacaatttcccatcatgtgtgaagtatactcagttctccacagcaagatttcacgtagagaatgtaggaaaggaaagaaattaattttgtctatttaactgtcaaaataaattgaaaactgggggtatagctcagtgacaggagtgttgcttaacatctgtgaattgttgtgtttaaacagcaccttcaaaacttcaaaacaacaacactaatatcaaagaatgattagaacttcagctgcatgccaagatatgcattaggctctggtattatacaaataaaaactcatttgtcctacgaaacttatcatctaagtaaaggctatgtacaaagagagtctcaacagaaaaggatttgcgttccataacagtaaactcaggatgctgtgatgggcagtttttatcatttttatctgttgtcttttatcatccattctagagctgtctcttcaattagattaggtgaaattgttcagtttggcaagaatgatcaaggtttctactctatttacttcttcctatggagtgtgttgtttttactaccctgctttaagctccggatggaccacgctaccagccaccgccctggttccctcggatccttggatgacacacacacacacacacacacacacacacacacacacacacacacaagcttatttttaattcaatggttgggcacttctaagcctcccctggctaatgtgcccttaccttcactcccggctcaacccctctaaatcttccctcaattagttacccggttaccttctccttgctcagcaccctaaattttgccctcagcttagttctgtttctaatctcccactggataccccagacccagtcgaggaagaaagccaatggccgctccatctaccagagagatctcacatggctgatggcaatttctcccttcgaagcatggtgaattttctttcctcctcttgtatcttttagcctgcccgtgggaacctggaagccctgcctcttccgaccaatcattagccactagcatctatgtttattgatcgaaccaagtggtgaacaggatcttcagtgttcacatgcagattccagatcaaaacatcagaaccacgccctacattcgtttatcactttcctcctctgcaggtgtcacacgtctgcccctccacgtagcagtaaagctgtctttctcctgactgctcaccttcccttgggcatcctagtttcttgagctttcacctttaaaattttccttttttttttttaaaacttcattaaaactaagaaactcagtctccctttaccagggtttcatctggcacacagcaaatcaaatagggacacagttaagtaatctgttaattttgtgttgttatcagcaagtatatccaggcaccatgtagcaattttattttaatgagaaattttgaggattacaaatcatttatcctgtagagtagaagaagagtgccatctaaagtttcaaatgttgttaaaaagagaaagagaccttttggtcccttagaggacactacctgaacaaaagacaaatgagagtgaaagtcagagagagactggagggctcaaagtgaaacctatagatagtttttcagcttaactgtcaattagcacttaccttttcctttagttctttcttaaaaccacattgtgtctgtgtattgcatcacaacatgatttattggaagggtttgtcctttggtagaatcacagtgctcaaatcacatctcttttttttgttgttgttgttgttgttgcaaaaatgataacgtgtacaaaaatcttacacattacttggtttcacatttgtgatcagaggaacatttttgtgttacattctaacttcactaagagtgattaataagcagaggctgttaggagggtctgagaggtgaagctttgaggatgcatggagaagtatttgggaggcttattcccacaaagttaatatccaggaaatcttcattatttttttattagccttttattcagctacattcctagattcatgaggaagaaacactgggcatccaaacacccaagcctgagcatccttgtctatctccaaggagcgttgtaaagaatctcctccaacgtggagcaaagcctgtcatcagcttctgaggtagctgttgggagctatgacagcagggaggtactattatgggatgcctctttgtgagttgagaaaagtgtatatattcatcaagatgtcaaatggtgtgtggtattagttgtagtcggggggggggagtgtatgttttactgattaaaataaactatcatacaccactccttaattgaacagagcagtggatagaaactaaaataagaaaatgggttgcagttcgcttcttgttgcaatgaaaaactgcctaagggaaaccaacttcacagagaaaaggtttattgtgggccttagtcattgcttggtctggttgctcatggacctgcccggtagaatttcatcatgcacacttcatggtagccaggaagcaaaagaaatgaagacaagagtctgcgtgccttaaggaatgctcccaaggaaatatttcctgcagacaggcttcaactgctaacatttttaatcatctcttaagagcagtgattctcagaatgtggattgtgacccctttgggtgtcaaacagtactttcacaggtgtctcctatcagataactcgaatatcagatagttatattgtgattcacatatttgcaaaatgacaaaatagcaacaaaaataattttatggtgggggggtgttcaacatgacatgaggtactgtctcaaaagggcaaggattaagaagatagagatgcactgtcctaagaggggctttatctgaagaccaagacttcaacaaatgagctgttgggcacctttaatattcaaatcacaaacaaatctaactcctaacaattgtcctttttttgttatccagcagaagagctggggtggaataggacctggggtgagcaagtgctgcctgaggcactgggatgaagaggctatagaatcctattgaccatgacttttaggccaacagagtccctgtgaaaggttaggtgctgagtatttgtgagatgcagaagacactgtcatgtcctttggaaaagaaagtccataaaaaggctatgaagtgagctggagtatgaaatgtccagtaatgtagcccaaatgggaaggcaaataaaagcaggaagaactagggaggccacagctgctggtattagtggccattctgggatggtttcccaaaggccagagatgtgccaacaacagtctgatgataacttttatattatacgaggggagggcaggttgctgcttcccctggtatcctacctcatagctgttgttccaccaaacatcatggcttcttctttggttctggagtttcctgagactgtgctgggagatggagagccctttctctgtaacagctgacttcaccaggacagtgtgggaacggtttcaaaaaatattctatgataaatgtaggccacatttctcatgttcagctccatgcaagcataatttaggatggatttcttcatacttactcaaacacagaaacatttattgaagatgtttccatgcattatgtatgattactgtttccctccactgtctctcagatcctcctaacctcctcagccatccagttctaggacttctctctctctctagaaagcaaattggtcaataattaaattaaaaggctagaaaaaaaacccaaagcaaatagaagatgaaaaaccacaaaggcatgagaaacacacatacatagagacacatccgcaaccacacacacacacacacacacacaccccataaaacacaaaatcagaactcataatagataagcagagctaaggtaaaacaaagcccaaagtattatgagatgaaatgtcaacaaaaaaacaaacaaacaaacctgtgactcattgtgtattagctatctgctattgggcataggaactcccttaaatgtgggttgtataccagtgagacttcattggagaaaactaatttgcctttgggagcagttgtcaattggagatagcttctggatttgggatgagggcttttttttttccagattccttctcagtactggtacctcatttggcatgattctgtgcagacccagtgtgtgctgttagtgtctgtgtgagtttatatgagcaacagccttactgtgtctgggaggcattgtttctgtggttatcttttacccacttttgtagcggtaattttggctataccaacccacacccacgccagttcattcttgacagttctgacatgccatgactagctcaaagtctggtcactcctaaacctttccctgttagcaaacactcctctctggtactccagagactcctaaaccttcccctgctaccccgggcccaattgagtaagtggtagtggccacttaccagaattcttacataactggttggctttcttccctgaagctcttaagtcccattcttctcccagagtcatggcaattttccgtttgctcttcggttccggtatcttagcctgtaccaatctccaggtcacacctcagtctacctgcccagtcattggctgtacgacaattctttattgccaatcatatccagcaggtggtggagaccctcagtgtctgggaattcggcctttggtaagcaaattgaattgagacagcattaaaaccaatccctaacacacactggctcataaattctttccttctctttcacacagtttcctggtccagtggtaaggtgtttgatgaagacattccattaggatgaagtgttacaaggtctcttgattttctgcatattgtgtactcatggatctctgtattagtttacatctactgcaggaagcaacttttcggattatggctgatttcgacactggtctatgggtatagcagaatgcaaaggacagacttcttgattgcaggtttcaatttggttatcattagtgctaagaacgtctctgaaacctattgtagacttaaaaagtgaccattcagagtgtttacttactgtgcttcactgtagatacgacagtgtttccttgttttatagcataattagaagatttctgccttgtacaaaatataaaaaactccaaagtcgtcatgcgcgttcggtttaaatggaatgacatagtttataggactttgtagtattgtctttgaaatgatgccgaacttaaaaataaatcgattttgtaatggaatttctgtgtgctgagtctagcatagaaaccatgtcacgctaatgtagagctggaaaagataagtgatgcatctaagtatattttcctcggtgactactcctttggcagcacgggaaagcatagagaaagttcaggagtgagccaccacaaagaccaaacttctggtttgtgttgctgaggaagtgctgtattttaaaacagacactgagaagaatggcagacatctccatgattagttagtattttccttaagttcagctcaggtcctgctaccagataccattcatctcttgttaagttactcatttgaaatgctcaaactccacctaggaaagtagtagtttaatgtggtggcttttccaggggagttgtacacctgttctgaacagagaggtacgtatcatgcttttgactatattcccagtgctgagggacaagttgtttttcacatgggtcctctgaatgttacaggagatggtgtccagatgaaaaagattattggtactaatgagttcttagttatatgtcttactccataattgcatggttcacactgcagacatttattttcttgtatttggagaaatgggaagtcccaaatcaggatacctctagctttaaattttctgagaatttcatacatctatacaatggaacgtgaccatatctacctatcccaatttaatgcctctttgttgtggttgttgttgttgttgttgttgttgttgttgttgttgttaacccactgctcatataagcatgagttgtacaaggaaaacctagcagtgggcctatacacacagagtggctatcctgcccaagcaactatgcactgtcaataactcacttttctgtagttttagttcctgatttgttaatggccatcttctggtttgtctttacctatatggtcttctccatatgcaaatgttctttgtgtctttacctctcttaataaggacactgattctcttagactaaggtgctatcattaggaggtcatttaccctttattgatttatcaaaagcttattataaaaacaaaagcaaaacaatgaagcaaacaatcagaaaagacaaagcaaaacaaagcaaatcaaatcaaatcaaatcaaatcaaaacaaaacaaaacaaaacaaaacaaaacaagagaaccccaccaaagcaacaaaaaactctgtctaaaaacagttatactgaaagtttggccttcaagtgctgatgctctttttattgttgtctttccctttggctctactttattgacctcagagcccctttggatacaatttttataaaaaaaccacatacacaatagaaactggatccaggcttgctctgcttggctccagaaaaattccaaccaaagtacatggtgcagcttggacacaccttcatgtaagttcaggtgctcaccacattaccatgggtgatcatgatgaatttctggtcacttagctcccacaaaagtgtagtctctagatggtccatccttttgtctcagctctaaactttgtctctgtaacttcttccatgggtgttttgttcccaattctaagaaggggtgaagtgtccacactttggtcttcgttcttcttgagtttcatgtgttttgcaaattgtaacttatatcttgggtattctaagtttctgggctaatatccacttatcagtgagtacatatcatttaagttcttttgtgattaggttacctcactcaggataatgccctccaggtccaactatttgcctaggaatttcataaattcattctttttaatagctgagtagtactccattgtgtaaatgtacctcattttttgtatccattcctctgttgagacaaaagaatggaccatatagagattgccatatccagggatccatcccataatcagcctccaaacgctgacaccattgcatacactagcaagcatttgctaaaaggaccctgatatagctgtctcttgtgagactatgccagggcctagcaaacacagaagtggatgcttacagtcagctattggatggatcacagggcccccaatgaaggagctagagaaaatacccaaggagctaaagggatctgcaaccctataggtggaacaacattatgaactaaccagtaccccggagctcttgacactagctgcatatgtatcaaaagatggcctagtcggccatcactggaaagagaggcccattggacttgcaaactttatatgccccagtacaggggaatgccagggccaaaaagtgggagtgggtgggtaggggagtgtgtgtgtggggggagagtatggggaacttttgggatagcattggaaatgtaaatgaggaaaatacctaattaaaaaaagtgtagtctcctgcctgtctcacctctgtacagagacaagcctacttccatccagggtcatgagcaacttcctgttatatgcagttatctcactaagttcaacccagctcatctccgtgttcttgaatgtgctatttatctttaatatggcagtattcctgtccttaatgattgtggtaggattgtcatgctagccacctacctagtggcaaagctcttatcaagagacttcatgtagtgagcaaaagtcttgctgtccactggtttccaggagctggtaaaggcatctgccatggtgctgtaagagaggagggctgcacgcactatgaatggccataatgattgtgttccacctcaacagttgaaatttaggagatacaattcagtccatgacattcctcccgaaccttttagttaatagaggtcatcaatagaaatgtagcattagagaaaaggaagccaggcatttatttatttatttgcgaatacggtgttgatttttaggattgcttgttagtgcaacagttcagtctttaatggtagcagttatagctataatttttctgaattgagcagtaactcatagatccatttcaagagtcagagaatcattagaagaatctgcattcctgtaaatctccatgcaattgggtatgcaagatctacccagaaacagagtctgagaatggagatgctcagataaaagctacatagtgaaattacaaatgtactttacaagtattcattaaatatccactatgccagtttcaggagtaatattcatattagagtttgtttcactgtagtttagagaagtgctagtaaaatattttttttcttttcagttttggctatagaacatcattttttctctgtgaagtcaattgcatctgaaatttaagtaatagttactacattaagatacacaagaggatagaggataatgccctaggtgttagagggccaggctattaaggttgcagtccacaagactctctttcctctttttttttttttttttttttttaacctaccttaatgggagactctctctaggcacagatgcctgacccctgcacgtgccacatgattcagaatatgagtctttctgcccatatgataattaggaaatgtgttctgtataatcaatcagttcctcctacacatatggtgctgtattacaaccaatcagcccttcctgtccgtattataattaggtgctgtgttatgatcaatcagctcttcatgtacagaaccctaagaaccttgtataccttttccctggaaaaaaaaattaagctgactcccgggagttcttcccgtcatacagcgtgaataagattatttaaaggacaggtagcaagttaggttcattccaagagtggaagcagaaccttataaaaagatagaaagataacctaaaaagcattgctgagaaacaagcagagtgaaaagtatagagtaaggagtgggcacgtccttcaagagttaagggcttgcatttaaaaaatatatacattgaatttaacaacataagaggtgatttgtgacagtgaaaacagttaaggtgtcaccaggacagtgacatgaggcatgaatgggagcgaaggaggcagttctggggttgtgtaaatccattttcaaatctatggctgtgaggaggaacagaaagggggatatttaagaataaatagaaatggtaaggctcaagtgaggcttatgtctggaacaggggttgctcacatggttctgacaagcaagggtaggagagcactagcacaagttgagaacatctaggatgttggatgactcaggaaagaatggaacagaggagaagaccattcttaggcagtggaaaggacatctcatctctcactgcagtagggaaaaatggcaaggtggcagaggctggaggactagaacattatgtgattttttttcttttgcttatgacttagtattcattagctctgtttattattaactgttgacttcagggcattttgagtttttatttctttgtcttcatagatagatttgtttcagtctgtaagtgggaacaaagttcaaatttacagagacatcttagttttctctttctcagagtgattagtagtactctgaagtgtttctactttattagccagtatgtggacagagcagaaccaggtgatctggagagtgaaggagaagtcggctttgaagttttttctgagccattaagtgaaattattatttatttggaagtcactccagcttgtcaattacacccagcaatattgtataattggttgaaataagaaatgagtgaaatgttacttttagtttttcttcacacaggagcttcaacagctcacagttaaaagagtagtaaataactttcttgaaatatggatcctagatatatgtggttgagtatttttaaagtaaagtaaagtaaaaatatttcattggccaagagaatcttgattgttaacaatataattgagaatattccccttctaaattagcgtggatcccaaagataatgttataattcagagatatgagtagatttgtggtctcccagacacatcaagaagagttacttttctactcaaacgaagcaatgggcagacacctgagtacagggagggaaaaggttccatactagatttagattaatgataaacatgtaaagtctgtgtgtcttcaaaacttttaaagagataatattgctaaaacaaattcagtcaatagtgacattaatacataaaagactaaacataagccttatcacacaacttgctaatcagaggctctttaatatgttcagttgctctgcttgtttgctctgtgggtgtgcaagtatacattttatgtttgtgtgtatcttagtcagtgttctatgactgggaagagacaccatgaccaaggtaactcttacaaagaaaagcattcaagtgggacttgcttatagttacaggggattagtccatcatcagccttacaggaagcatggcagcatgcaggcagctatgttcttcatgaagagtagagagttctacatatagatccacaagcagcaggaagtgatagagaccactggacccggcttgtgcttcttgaaccatgaagcactccccggcctcattccagtgacacacttcccccagcaaggctacacctaatgacaaaactttcaaatatatgaacatatgttgaaatattgatactcctgttcaaatcaccatagtgtgtgacagtggatgtacaagtgtgagcacacacacccagaagacaaaagttgacactgtgtgtcattatctccattaattttgtttgagataaaggcatatatgggacttggagctcattgatgtatttaggctggctggttcatgaatttcggtgatctacatacctttgtactttatctttttacagggattctggaatatgagctcaggtccttaagtttgtccagcaaacagtgtactgaccaagtcatcctctgactccagatttttttcctagaaggaaagaactcaagttacctactttgcttttctactcttacttcagattgaattctagcaaagatacttctgtattctaaaatatctcagttctttcatgttaattaggctagctctagagtatctgattgaatgtggacttcttaataatagtcacaaagaatatgaaaaggtaaacaaatgctttaatttacacttgttattttggccttgaccaggtgaagaaatttaatttatcataattaatttgaaataacttacatagtgattgtgtaaaaatgtctatgtccttaatggaaacagaaatgctggggcatgctacttttatttaaagggaatattgatatttgactcaacttgttttatttgaggaaggcttaaggttattaaaagtaggaataaagcaaattaaatcacaatagattagctaacaattgacagacaagtcagctcagactgtcttcaatggccctgaaaattttggctctcatctggaggtcctgaagtaccgtgcacctgacagtgacttcaacccatcctcacctcattctacttttttctgagtttggttcagttttgaaccatgagcacaatggggtccacagttccaagttttacaattcccaataagtaagagaagatgaacactctccttggcattaggacataaatagcagaagctaacaaagcagaatggtctattttgtttaaacctacagaatggcatcttggggtctggtgctgttctctgtaaagtgttaccttacagaagagagagagaatgaaagtaattaggttgtatttaggcaacagcaatatctgtagcggggatttgtatgaatagtagtttttattaactctctctgcttgaagatgctccaacttataataaggacacatgctccactatgttcatagcagccttatttataatagccagaagttggaaagaccccagatgtccctcaacagaggaatggataaaaaaaacgtggtacatttatacaatggagtactactcagctattaaaaacaatgaattcacaaaattcttagagaaatggatggatctggaagatatcatcctaaatgaggcaatccaatcacaaatgaacacacatgatatgtactcactgataagtggatatcagcccagaagctcagaatacccaagatacaatttgcaaacacatgaaaatcaagaggaaggaagaccaaagtgtggatacttcaatccttcttagaagggggaacaaaatacccatgaagcagttacagagacaaagtgtggagcagagactaaaggaatgaccatccagagactgtaccacctgaggatccatttcatatacaaccaccaaacccagatactattgcagatgccaacaagagcttgctgacaggagtctgatatagctgtctcctgaaaggctctgccagtgcctgactaatacagaagtggatgctcacagtcatccattagatggaacatagagtccccaatgaaggagctagagaaagtacccaaggagctgaaggggtttgcagccccataagatgaacaacaatatgaactaagcagtaaccccagagctccctgcgaagaaaccaccaatcaaagaaaacacatggtgggactcatggcttcagcttcatatgtagccgaggatggcctagttggtcatcaatgggaggagaggatcttggtcctgtgaaggttctatgccccagtatagagaaatccctgggccaggaagcaggagtgggtaggttgaggagcagtgggaagggggagtatagggtatattcagaagggaaactgggaaagaggataacatttgaaatgtaaataaagaaaatatctaataaaaaaagataaaagaaaagaaagttctctataagaaaatttaggtgctattacagcagctctaccctggcagagtcaagtctgtgatataactggggtcatatagagacactaatgtatatgaatgtgcttaatttgaacccaagaagcacctttcttagtcaccatccttcctctaaaagaggttacaaagtgctccaagttatttgtagcagagaagtttctcatgtagtcagtgagtcttcccagcctgtactgtggagtatttgattaatagaaagcctccacattaattccccactttctctaaccctgtcgcagaaggcatcttctctctccggtcagtttgtctccacagatgatgatcttgaaccatttgcttacaaacctgctagtgtctcagtataagcaggaggggcacccaagaatccatccttcccatattagttacttttcttggtgctatgaatatattcatatacttaaggaagaatggcttatttgtttcatagtgtatcatatttggagaggcatatggtgttatcatgaggctattgagaacactgcatccaatcaggaagcagagagatgaatactgatgctatgcttgatttcttggttttacagtttgagatcatagaatagtgcaatgtacattcagggtaaatcttccttccttagataaacttccctgaaaatgacttcacatacacacaagattatgtctcaggtaattctatgtagtcaaggtgacaatgagaataattaccatatttctccaaagctgtttcccccaaatctcataactttcttcttaccgaatcaatgaatactacaaaccaaatgctttctgttttatttgaggcatagctattgtcttattttattttctccattgttcactaaggttcccatcatcacagcagatgggacttgaggtagacatccatgccatgtagtgtacagtgttcttggaatggtcgggaagttcataagattcagacctatgatttttgcttcatgtctccctaccccccttctagccagtcacagacagtcctgggctggctgtcagtgtgctgacacagccttgtgtcttcagtatcaatatggcatcattttctctatgactcagagcatctctggattcatgatgtggatccctggggatgcccttgtcatttccatgccaggaagagaactaatgttccagataagcagtgttgagattcattctaaataattcctttaagatcctgacagaaactagcatctgttgtctgtcgtgctgatcatctcaataaagcagtctttaaaagaaggttttagaaaattgaaacataaagtgcagaaaagctcatcaatattaaatgtagatcttatgaaattttgtatgtgcatatatacctatgtggccccccctccaagatcaaaacatagaagattttgagcacctcagaatactcatttctgatcactctgctatttaagagaaatagcttcaaactgtacatgtcacttgaggctggattccttgcactcagcgttacaatggagagcttatgcagatttttccaaatgtcattcatggctccttttttctcactatgtgtggtattctaggttcagtcatttacaaagtattttcatattgggcttcctagttttctcttttactgcctcaggttttttatcctttactcacacccaaaactcattacctgcatccatttcttctttggctctctacctcccgctcaggatctcaaagcaccaatgctattgtttaacaataggagtttgttcattctcattgcccatttcttgatatgtgcccattgaaagcagcttcctcgtggaggggtttatgtcttctcaaaataaagcttgagaaattctgaatagtgttcttgtttttaactctgtaagttatgtaatcactttaagagagattttcttgggaagataatgctcaacatacagaaataaatggtagacttcatgcatgagacgctctaggtgagacatcatagctttgtgtgagggatgacatcatgttctgagtcttcactgcttgagcagctgtgtagctgctgggttttcttgaaccaagacagactcttctgatacaaaggagtagccaggttaagaaattgataccttcatgtaaagaggtagctagaaagaggcaaggacttagaatagaatagaaggcagtatgtggtgtatggatgtatgggtctgtatctatcattttccttcagggcaactgcactttaatttctaagatattttctgtgtctaacatgggacaagtattatgagggtatctgttgatggacatcgtcagctatggtgggggaagacactcttgaaggcgtgatgcacatactttcagtctataatatttatttcacactatgtcagtgaaacctcttctaagtaactactataaattgcacagccattatagtaattgatttaatatttcacttgcggatgtcactaagatttgccctcattcaatgaccttgtttccatggtaactagtgcgttttaaatgataagaaacgtgaagagaagaaaggatcaattagtaatatataactccaatgaaataaaatttagattttacccagtgaagcaaatctttcaaaactgaacacgacagtctaacaatatgattgtgctttggcaaatgatgcatatgctaattttaaataaatctgcatgctattgtgcatagagtctgactacttcagacttaaggcttttatgcaaatgtgaaaataggaagagctaatcatgcaatcagtccttacttaattatctattgtctagattccgcctgctactttctcttatttgccatcctttcatcctttattggcatttttaacataaggaagaggagggaaattaaaatgattttattttgcttctcaagagctctgcccgtgagaacacattaattacttcatttatcaagggtatattgagcacattccaaacactgatgcttgttgctattcctcaacaagccctttttctgctaagatgtcatgtattcagtgttgtctttgcctaggaagctctcctctaatctacgactgggtcactctctgtttcttttacctctctgctcttctgtcagcttcaaagtgcaaccttactgccatccttcatgaaacagaaactttaacccccacagaaatcctatacatcatctgccttggatactttgcattccatatttcttataatgtcacctaacattcattcactgactccctcactctatatatcctcactaatataaaatgtatggggcataaacacaggtttctctgttgttttccttttactgttatgtgcccagattagagtagttgcatgtagtatttagtgggagcatcatctctgtttttagtgacatctttatttaaagatgaaagacacagtgtttctcctttattcctaaaacatttgtatttactaaagaaatttataagcaagattatagtggaagattatgttagatgattttttcctttattaaaaatagatttttttcatataatgtattctgtttatagttcccttcattctgctttctccttctccttgctagttcccttcctgtctggatccaggctctttctgtttctcatgagaaaacacgacaggcatctaaggaagaatgctaaaataaaatatattgaagacatcccataatatggaaaacaagcaatcaaggcaaagaggcaatgaaaagtcacaagaaacacatacagctggagagacacatgcacttacatactcaggaatcccacaaaagaagccatattatataaggacttgcaaggctgaaaaaaaaaacccataacaaatgctctgacttaacattatgagacaagggccatccaaaaatgccattgaatttgctttgtgttggccatctactgatagtcatggtgcctacccatggtttgttttcccagtgtaacaaccttagagaaaactaatttttcctttgtgagaagttatgagattggagatagctcctgggttaggactgtgggcttttgtccacatttattctcaaatctgggatgccatcaggtccaggcctataaatgtcctgtgcacactgatagcttctgtgagtttatatgtgtgccagcactgttgtgtccagaagaccttgattccttggtatcctccatcctctctggctcttaaaatttttctaccttctattctgcagtattccttcacccctgagggaagggattggatggagaaatctcatttaatgctgagtattccatgtctctgcatctggtttgcttgtatgtttttatttgcttgaggggaatatttctgtgatgacaactgaacaagtcattgatataaaagtatagcaaaaatattgttaggagtcattttattgctatgttcttttagaacagtagtattggttttcttctaggtccttggcctatatagtctcaggttcttgaccacccaacaacattgagttccatctcttggaattgcacttaattcaaatcagatattggttagttacttccacaatctttgtgctcctattgcaccaatgtattattctggcactagttaccattgtataacaaagggttgtagttgggttggtatttaccattctcctttggtaccatgcagggtacagttcagtaccatgaatactagtcatcattggtgagaggtctagataggcacaaactcaactccctcatattcaataagcaggatggctgctgtattcggtaatagggacttccctacagttagtgaagagacaccaatagccttgacaatagcctggtttgttttgacattctcatgagacccctttggccaagaattcaattatatataacttattcctggtactagatgcttcctttggtgacgagatatgcttaattgcagctttgtctcccccattctttgacaattttatttaggtcaccttcatatatgtgtatattataggatgcttctaccatattaggtttgtatacaacccctcaaatggcccttagttttagctgtctctcctagtattccctctcatactcttttctctatctctactcctttctcatacttctattcaagttctcttcacatctatccataactaccaattctatttccccttcctaaggaaatccctccctccagccttagtcctttgatctctacttaaccatatgtttttattacaatagcttcacagtactatttgagaccctagctggtggataccttcaggagttttttaagttaatcagaatattagtaattaataccattatattatattttaattttatttttagcattcaagaatgtttttactatcctgcttttttctgtgttcaatatgaagctgaaaactatccttttaaggtctgtaaagaattggattggaatttttatgggggttgaattgaatatattttggtagaatgaccattttttctatacgaatcctacagatctatgagcatgggggatctttccatcttctgatatattttttaaatttttttcttcaacatctacacgttttttataatacaagtgtttcacttgcttattagagttactccaagatactttatatttttgagtctcttgtgcaaagtgttgtttccctaatttcttcctcagtccatttgtcatgtgtatataggaaagatactgattttcttgagttaattttgtatcctgctacgttgcagaaagtgtttattagctgtaggagtttcccagcagcatttttagtgtcaccacgtacactaccataccagcttcagataaagatactttgacttctcttccaatgtgtatacccttgagctgccttattgctctagctctgtactataatgaaatagatatggagatagtagacaacattgtcttgttcctgattttagcgaacatgcgttgaattgatgtttctatgtgctttctgtaaactgccattaatatgtcaaggtattttccttgtattcctagtctttccaggactttaacatgaaggagtattagataatgtcacaggcatttcctaactttaataagatgatcatgtgttttttgtcatttgatctgttcatatggtggattatattcattgatttatggatattgaaccatccctacacctctgggatgatgcctactggaaaatggagactgacatttttgatgtgttcatggatttggtttgcaactattttattgagaagttttgcacctgtgttcataagggaaattggtctttaattctctttctttgttgggtctttacatggtttaggtatcagggtaactgtgactgtatataaaagaaaagaactggacagtgttccttctatttatgttctgtgaaataatttgaggagtattgaccttaacgcttctttggaagtcttgactaaagccatctggccctggattgtttgtttagttttttttgggggggagatttttaattacttcttatatttgaagaacagttagagttctgttgaaattgattacatgatcttgctttaactttggtaggtggtatatgttggaaaactatccatttcttttacattttccaatttgagtacaggttcctaaaggatgtgtttgtatttcttttgtgtctgctgttctccccctttgtcactaattatgttaatttggatattctttctctgcattttgttttatttgctcattgattgtcaatcttactggttttcaaaaaggaccaacttgtcatttcattaattttttaatatttttgttgttgtttgtttctactatattgatttcagccctgattatgattatttcttggcatctattcctattcagtgttaatttcttcttcttattctgacactttcaagcatgttcttaagttggtaattgtgagatctctttaaaaattttttttttatgtaggcactattttagtactatgaacttgccttttagaataaagtttattgaatcccatacatttaaataaaatatccaataaaaaataaaaaggagaaaaaaaagaaactgtcaaatataaaaaaaattgtctttaccagcttgattcttaagttcatttgctgagatatctattttcatcttcttactctgaggtgctgtgctacccttgatgctttttaaaaaattaattaattaaatgaataattaaatgtacattttgtgtttggtctagatgtatgtctgtatgaaagtgtcagagcctctggaactggagttataggcaactgtgagttgacatgtgggtgctgggaattgaaaccaggtcctctataagagcagccaatggccctaactgctaagccatctctctagcccctacccttgatgttaatgtgtgtttcttgtatatagcagaaggagggcctatttttaatgcatcctgttagtatgtatcttttattgcagaattgagattactgatgttcaaaattatcagtgagtaatgtttgccattttcatttctttgtcgttgtgatgtgggcttttcctttttttttttcttttaaaaaattttatttattttttactggatattttaaatttaaatttcaaatgttatcccctttctaggtctcccctccagaacctctctactctatcccctttttcctgcctctgtgatggtgctctcccacacatatgcccactgctgccttcaaaccctggcattcctctatactggggcatcaaaacccctcaggcccaaggactattcctctcactaacgtccaacaaggccattctctgccacatatgcagccagtgttatgattccctccatgtgtactctttggttggttgtccagtccctgggagctcagggggatctggttaattgacactgttgctcctttccccttgggcctgcaaaccccctcagcttcttcagtcccctctccaactctttcatcagggacccctgcgctcagtctaatgattggctgtgaccatctgcttctgtatttgtcaggctcctctaagcaagcatgtcccatccctgcatttgaaatagtgtctgggtttggtgactgtacttgggatggattccccaggtaggaagtgaagcagtctctggatgagctttccttaagtctctgctccacaatttgtctccatatttcctcctgtgagtattttcttcccccttctaagatgcactgaagcatccacactttgttctccttcttcatatggtctgtaaattgtatcttgggtattcaaagcttctgggctaatatccacttatcagtgagtgcacaccatgtgtgttcttttgagactgggttacttcactcaggatgatatattcaagttccattcatttgccttcgaatttcatgaaatcattgtttttaatagctgaataaataaataaatatttctaaaaaattacaaatgtaaattaccacattttctgtatccattcctctgtcgagagacatctgggttgtttccatcttctggctattataaatatggctgctatgaacatagtggagcatgtgtccttcttaccagttgggacatcttctggcaatacagaagatgcattgcatcacagaagaaggtatatgcccaggagtggtataactgggttctcaggtagtactatgcctaattttctgaagaactgccagactgatttccagagtggttgtaccagcttggaatcccaccagcaatggaagagtgttcctctttctccacatccttgccaaagtctgctgtcacatgaatttttttgatcttagccattctgactggcatgagatggaatctcagagttgttttgatttgcattgaacatttctttaggtgctcctcagccactcaagttttctcagttgagaattctctgtttagctctgttccccactttttaatagggttatttggttctctggagtctaactttattgagatctttgcatatattggatattagcctgtcattggatataggatttgtagagctcttttcccaatctgtgggtgccattttgtcctattgacagtgtcctttgccttacagaagctttgcagttttataaggtcccatttgttaatttttgatcttacagcacaagccattggtgttctgttcaggaattttccccttgtgcccatatcttgaaggcgtttccccactttctcccctttaagtttcagtgtctctggttttatgttgaggtccttgatcgacttggacttgagttttgtacagggagataagaatggattaatttgaatccttctacatgttgactaccagttgaacaagcaccattttattgaaaattctgtctatttttccactggatggttttagctcctttgtcaaaatcaagtgactataggtgtggtgattcatttctgggtctttagttctaatccactgaactacctaactatttctgtaccaataccatgaaatttttatcacaattgctctgtagtacatcttaacatcagggatgacgattacccccaaagttcttttattgttgagaattgttttcactatcctggggtttttgttattccaaatgaatttgagaattgctctttctaactctataaagaattaatttggaattttgatgggtattgcattgaatctgtagattgctttcagcaatacatttttactatattaatccttccaatcagtgagcatgggagatctttccatcttctgagatcttcttcgatttctttcttcagagacttgaagttcttgtcatacagatatttcatttacctggttagagaaataccaagttactttatattgtttgtgactggtgtgaagggtgtcatttccttaatttctttctcaaccatttgtcctttgagtataggaaggctactgatttttttgagttgattttacatccagccactttgctgaagttgtctatgagctgtagacactctctggtggaatttttggggtcacttaagtatactatcttgttatctgcaaataatgatattttgacttcttcctttccaacttctattcctttgatctccttttgttgaattgctccagctagaacttcaagtactatattgaatagatagggagagagtggtcagccttgattttagcttaaagtttctctccatttagtttgatgttggctactggtttgctttatattgcttttactatgtttaggtatgggccttgaattcctgacctttccaagacttgtaacataaaaggatgttgtattttgtcaaatgcttgtgtatactctctccagtttctttttggaggcactcagaactgtgagttttcctcttaacactgctttcattgtgtcccataagtttgggtatgttgtttgttcattttcattcaattctaaagtctctaatttctttctttcttcctttcttccttccttccttccttccttccttccttccttccttccttccttccttccttccttccttccttccttcctctctctctctctctctctctctctctctctctctctctctctctctttctttctttctttctttctttcttcctttctttcttccttgaccaagttatcattgagtagggcattgttcagtttccatgtgtctaggtatgggccttgaattcctgatctttctaagattttaacataaagtgatgttgtttgtcaaatgctttctcagcatctaatgaaatgattatgtggctttttaatttgagtttatttatttagtggattgcactgatggattgccatatattaaaacaccccttcatccctggtatgaaacctgcttgatcgtggtgaatgaccattttgatatgttcttggatttggtttgtgagaattttattgagtatttttgcatcaatattcataagggaaattggcctgaaatgctctttctctgttgggtatgtgtgtggttttggtatcagagtaactgtggcttcatagaacaaattgggtagtgtttcttctgtgttcctatttttcggaaaagtttgaagagtattggtatttgggtttcctctaagttctggtagaattttgcactaaacccatctggtgctgggattttttttagttgtgagagttttaatgacttcttctatttctttagaggctatggtactatttagatggactatctgattccgatttaactttggtatttgatatctctctagaaagttgttcatttcatcgacattttcatgaaatagacatttcattgactatagtctccagtggtaggatttattgaatttcctcagtttctgtttttatatctctcttttcacttctgattttgttcatttggatactgtctctgtgccctctggttaatctggctaagggtttatctattttgttgattttctcaaagaaccagctcctggctgattctttgtatagttctttttgttttcacttggttgatttcagccctgagtttgattattttctgccttctactcctcttggatgtatttgcttctttttgttctagagctttcaagtgtgttgttaagctgctagtgtatactctctccagtttcttcttggaggcactcagagctgtgcatttgcttcttagcactgctttcattgtgtcccgtaaggttgggtatgttgtttgtcattttcattaaattctcatgtttctaatttctttcttaatttcttccttgaccaagttgtcattgagtagggcatgtgtatgtggagtgtgtgtgtgtgtgtgtgtgtgtgtttattgaagaacagccttagtccagggtgatctcataggatgcatgggattatttcagtcttcttgtatctgtagaggcctattttgtgtcagattatatggccaattttggagaaggtaccatgaggtgctgagaagtaggtatattcttttgtttcaggataaaatgttctataaatttctgttaaatccatttggttcataacttctgttagtttcactgtgtctctttttagttactatttccatgatctgtccattaatgagagtggggtgttaaagtctcccacaatattgtgtgaggtatgatgtgtgctttgagcttaagtaaaatttcttttaagaatgtgggtgccctggcctttggatcatagttattcagaattgagagtttttcatggtatattttttctttgatgagtatgaagtgttcttccttatcatttttgataacttttggttgaaagtccatttaattggatattagaatggctactccagcttgtttcttcagaccatttgcttagagaattgtttttcagccttttactttgaggtagtgtctgtctttgtcattgaagtaggtttcctatatgcagaaaatgctgggttctgtttaggtatctagtctgttagtctatgtctttttattagggaattgaatacatttatgttaagagatattaaggaaaagtgattggtggctcctgtttttttttttttttttttttttaaattagaggtagaattatatttctgtggctgtcttcctttgggtctgttgaaagattacttcttgctttttctagggtgtagtttccctccttgtgttgacgttttccatctactatctatgtagtgctcaacttgtagaaagatattgtgtaaatttgattttgccatggaatatcttggtttctttatttatggcaattgggagtttgctgggtatagtagcctgggctggcattttgtgttctcttagggtttatatgatgtcttcccaggatcttctagatttcatagtctctggtgagaagtctggtgtaattctggtaggtctgccttttatgctacttgacatttttctcttactgcttttaatgctctttctttgtttagtgtatttgttgttctgattattatgtgtcgggaggaatttcttttctggtcccatgtatttggagttctgtaggcttcttgtatgttcatgggcatctctttctttaggttagggaagttttcttctctaattttgttgaagatacttgctggccctttaagttgggaacatttgcccttttctatatccattttccttagggttggtcttctcattctgtgctggatttcctggatattttgggttaggatatttttgcattttgcattttctttgactgttgtggcaatgttttctatggtatgtcctgaacctaagattctctcttctatctcttgtattctgttcatgatgcttgcatctaagactcctgatctctttcctaggttttctatctccagtgttgtctccctctgttatttctttctttctttctttctttctttttttctatttccatttttagatcctgtaaggttttattcaattcctttacctgtttggttgtgttttcctgtaatcctttaagggatttttatgtttcctctttaagtgcttctacctgtttacctgtgttcacctatatattttttaagggaattatttatgtccttcttaaagtcctctaacatcatcatgagatgtgattttaaatcagagccttgcttgttgggttatccaggtcttcctatagtgggagacctgggttctgatgatgccaagtaaccttggtttctgttgtttatgttcttgctcttgcctcttgctttttgtttatctctcatgttagttggtcttgctgtctctgactgtggtttgtcccttttgcaagcctgtgtgtcagcccttttggaaaaccagatctctccaggaggaagtcgtggcacagggttagctctgggatgcagatggaaaccagaaggattctgtcccagactgctctttggtttctgtgtcctgagagcactgggcaggcctctctgagcagaagtggtattccctgtgctcacacatgtgtcggcactcctggaagaccatatgtctcctggtggtatttgggtattgagagctgtggcacaggattacttcttcaagcagactttacctttcttttttttttttaattatttttatttttattttattttattttattttatttgctgccctggggttatttttttcttgtgttttcttgggtgtgtttaccttcttcaagtaaaaatttttgtccctgtgtcttctggagatcaggatttgtagatagatattgattaaattaggatttagcatgtaatgtcttattttccgtatcattgtacttaaaggttttgttggatatagtagttgactgacatctgtactctcttaaagtttgttgaacatctgtttagtccccttttgagtttagaatctacattgaaaagtcatgttactcttagtgttttgaatattatatgttgtgtggaattttttttctggtttagtgtatttggtgcattgtatgtttcttgtaccttaattggtatctctttctttaggtcaggattttttttttgtatgattttgtgaaaaatatttcctatatttttgagttaagattttattccttcctctgttactattattcgtagatgttgcctttccttattttgcccaggatttatttcctggattatttttttttaaagatttaacatttatttatttatttatttatttatttatttatttatttatttattagatttaacatttatgtaactgaggtatctgccttttctatctgtactggctagttttgtgtcaacttgacacagctgaagttatcacagagaaaggaacttcaattgagaaaatgcctccatgagattcaactgtaaggcattttctcaattagtgatcaaggggaagtccccttgtcggtgggaccatctctgggctgatagtcttggttctataagagagcaagctgagcaagccagggaaagcaagccagtaaagaacatctctccatggcctctgtatcagctcctacttcctgacctgcttgagttccagtcctgacttcttggtgatgaacagcagtatggaagtgtaagccaaataaaccctttcctcctcaacttgcttcttggtcatgatgtttgtgcaggaatagaaacccctgactaagacactatcttgtcaccaaagaactagattctgtcttccatctcttgtattctgtcagtgaggcttgactatgggttgacattttgagttcctcaacttttcatttctagattgccctccctttggatgtcctttattgtttcaatttgtacttgaaagtcttgaactatgttcctcatttcattctactctttatttgtagtttcacagatttctctaatggattaattcattgtctctttaagaatttctaacgtattcataaggactactttgaagtccttttcttgcacatttgctatcctacctctctcagggcatgctgtggtaagtttgctgggcttaatggacacatattgtcatggttgttattgatttgattttttttttttacaaaggaatctgtagttgggtgaattatatttctaggtgcagatatctagttttgtttttgttgggtgggtgttctgttcctgatatatatatatatatatatatgtatatatatatatatatatatatatattttttttttttttttttttttttttactggtgcttaggagcgtatggtggtttagttgcctggtaggtaatgtttctgagagcatgtgaagtgtggtcactggaggttttggttagatgtgtttctcagtatttggagttgatgcttagggatgaagatgggttagaacagagacttgaggtctataaccacccattcttgtttgctgggccaagtttacctgatagcaaccataaggcttaatttaatttaattcattggctgtgaggaattaaatcaggccagttggattgggcacaactcatctgatgctctgacaattttattgagaacaattagactttttatacctctatcagaaacagaatataaaggcaattaccaggattcatttagttgtacttgccaggatacaaagaactttgcctgccatacatggcacacaaattaatgtctaagaccgattatcctgtcaagcttccatgcttccttgactactaagggaacatacatagaaacacaaagtggcctgaacacttgactatctgagggagtgcattagtctctcaggaactagaaggcgcattgtgccccaggagccatgggttctaacctataaaacctatggtgctttcccccaagcagctagatcaggccaactccatgattccctgtgggggtccacagaaggaagaaaatcaggtgtaacaccagcatctggttattttcctaggcatggggaggccatatgcagtggtctttatgtagctgcatacaagatttgatgattggattttgagtagtggaaagagaatgaagatctgatgatcactacctgcttccatggcagacttagccttaaatgaagtatatatatacatacagatatacatatacatatatacatacacacatgtatatatatataatcattagcataccacatcataagagttaactaactcaggcttctggttatcaggaagattgtctgggaagctggtattaagctgaagttaaagagaaagtagacatatgacagcgtgtacccagaagttggctaaattggcacaattattctgatgtgacagagtatgtttttcactaacacaatgttaaaaataaactgaattatgtgcttgttagtgcaatgtattcttacagtcatctccaggttccctgactcttgattttagtatatggcttaagtttccatatttaatgtacctgactgggtgttatgtgggctaacaatgtttattataatgtgatggcctgattattttttctgcagggttataagtagtgaatgctgagactaaggccgctcatttgaactaatcaatcttaagaacctatttcaggctatcaaaacactttagataaagtatcttttacttttagtaaaattttataaacatctctgataactatgctgctcagtgtcaaaaatatgttttatgagccgtatagaatccagaaaatctgagatttgaaataggcatatttgacatggacttttagctctacaaatagctctttgtatggacccccaaaacatgggattgacattttttgtgcatatattgggtcatatgcctagggattgattccctgattctacaaatactgatctcttcgggtgttccttcttgtaaagtggggctatgatagtggtttgttatgacttattcaatttatgtaaagcaagtagaactatatttggggcatccagtaatttcataataaaagataagactaccactgttatcatcaatatggtagaataaacaagaaaatcttgaaaaaatttaaacattcctagatatggtatttaacaggtactcatgttaccattaagaagagggtaaatgtagaacaataatcataaaaattctgtagtctctctctctctctctctctctctctgtgtgtgtgtgtacatgtaccatgttgtccatatagagattagaggacacctttctggagttatttctctctgtacacattctggtttctgggaattaaactcaggtcatcaggtttggtggcaatgcctttatctgctgagccatcttgctggtgcagaacaataatatgattgataaataagaatgatgtttaggtggatgtcatttcacttaagaaaatccccatcaatttacagaatttgacaaaagatattcttaactttaaaatttgtgctgaaagaagaacttttgcactgtttacctgggttaacattttacaactaacaattctggatttaaaaaagactctaacagcctagacaattaaacatagaaatgattttgctataatttaaaagaagaatcacagagttcaaatattgtatttgtgtatagtgctcatgactacaacacaattttagtaattttaaattttacttttagaaagaacccagatgcccctcaacagaggaatggatacataaaatgtggtacatttacacaatggagtatttctcagctattaaaaaaaatgaatttatgaaatacctaggcaaatggatggacctagagggcatcatcctgagtgaggtaacccaatcaaaaaagaactcacacaacatgtattcaatgataagtggatattagcccaaaaacttagaatacccaagatacaagatacaatttgctaaacacatgaaactcaagaagaacgaaaaccaaagtgtggacactttgccccttcttagaattgggaacaaaacacccatggaaggagttacagagacaaagtttggagctgagacaaaaggatggaccatatagagactgccatatttggggatccatcccatagtcagcctccaaacactgacaccattgcatacattagcaagattttgctgaaaggacccagatatagctgtcgcttgtgagactatgctggggcctagcaaacacagaagtggatgctcacagtcagctattggatggatcacagtgcccccaatggaggagctaaagaaagtaaccaaggagctaaagggatctgcaaccctaaaggtggaacaacaatatgaactacccaatacgccctggagctcgtgtctctagctgcattgtatcagaagatggcctagttggccatcagtggaaagagaggcccattggtcatgcaaactttatctgcctcagtacaggggaacgccagggccaaagaagtgggagtgggtgggggacttttgggatagcattggaaatgtaaatgaaataaatacctaatttttttttttttttttttttttttacttttagaagcaaagcttgaatgagcagctttcttttgtcaggggggctattacttctcttaagaatagatttctaggggttaaactattggctgaaagatacaggaactatcttttcctgaagattttggaagaaaggaaatccagcctctgaggtaagatttagctctagaatcattgccaattcgtaggtaaacaattgtttgagaagaaccagggagaatgtatgctggcagacaacttggcactagcaagcacagatctctaagcaggcaaagagctggcatgcaaattctgtgactttaaattctgaggtgagcaaagcatgtttcagggctggacctcagtggacagtttactataagggtgttggaaaagaaagatagtggaaagagtccagcctgttcctagtcccaatattatcaaggctcatagtcttacacagcagaaaactgcacaagcaactgagacatacagattatttctcagtggagagcctgcagcatgttcgtctcttgaattcctctcaccattccaaccctgtgctccttcctctgtgttattcacatatttcacctggagggaggatttctgtcagcctggtgtcatagtctgtgcattttaatctgaacacatggaatgtagaaaaaggagttcaaaagtcatcacatagcaagttcaaggtgagcatgggctacaagaggctctttctcaacaaaacaaacacaaaagtcaacatggaggcttgtcccatgtagactgcatatcctggagctagacagaggggcatttcagacaactagaaacagcacggaagacatggtggattctcaggtttctccttcccagaataacaaagcttgggcctagactagaaagctctattagcttttgtcctcttcttccctctttcaaaggcttggacctaactgccagctcctctgcccactgctgtcccactgttgcttggcagacacggagagagacttttgtgttgactggaattttctgtctctgtctagggagatgtaggtccagctaaggtgaacagtttaaagtcctcaggacagagtgagtgaggagggggtgcttagagcagcacccccttattccctgccttcttcacttggtctgagtctagaacttcatctcactagctacgctagcatttctttctcagagatatggtcacaagaggctcccagccaataataagactcaggtatttctgaggccttaagtctacacatcatgtttccacttctctaacacacctttagtatttgaaacaggacacaagatgggctgtggccactggaaacaaacaagctgttacaaagcagttaaggtatggctttgtgctgctgagtattatgtcaaggtgacataaagtcatttgcgaggagagaagtcagctgagaaaatgccttcataacatcaggctgtgggcaagcttttgggggcatttttgcaatcagtgattgttgggggaggtcccaacatattgtggatggtacaatccctgggctggtagcccttttctggcttccacaagaaatcaggctgagcaagccatgagaaacaagtcagtaagcagatctcctccatggcatctgcatcggctcctgcgtccaggttcctgctttgagtcctcgtcctgacttacttcagtgatggactacaatgtcaaatatgagccaaataaatccccttcttcccaattttcttttagtgtctgtgtgtgtgtttttttaaatcatgtttttcttgcagcaataaaatccctaactaatcagggttgaggttttgtacaccttagaaaacaaatcacaaaccaattaaaatgaatttttaaccccccaaactgacagtagttgacagaagacagttctcagggagcccatcaatggtacatccgattgagagtggtatagaagcatgttggctttcttctgctaaggagcaaagcccatttaacaggatcagtgcaactgctactccagatcagcaccagtttctacactgtttaacgtgtctacagtttgctccacttgctagttgtatcaaaataatttatcgtgtcctgacagtactctttgtttttaacttttcagacaccatatttttctctcttctttgataaccttttcttttcatcgttgttataggtttttcctttttttttttttaaatctgacttttaagtcacaagtgttttaagtctatccatattttcattatcaaaacctttttctatatgcaagctgtctattcagatgacattaattgtgcctatacttctcttataactaagtatatgttaggatttaactacagtattttaaaaatatatttaacactaaatgccttggctaccttgctaattattgttttgatacttaaagactttcgacctaacctgtctggcctgggctacttctttaagcctattatatgcataatttacacctttatctctgtcatctctctactcagctgacaccttctctgagaagccaaccctaaccattttttctttttaaatataaaatactactcattgtcactccatgccctccactttttttgtacacttagttttattcataacagtgaataaaaaatagaacttggaatattatgaaaatcttgaggttatttagaaagtgcacaataagcacattttcacaaaaatgttcataaactaaagaataacccatgtatatatatatatatattcatttactttcaaatctaatgtagtgggcccaagggtctgagaaacaatggactgtgaaataagaagttaagatgttggcctaggatgcacaatatccaccttacaggtctcccagttgtttaaccaagtcacctactctctctggtcctgagttttctttttgataagtacaattatataattacttcataagatgttctgagggataaattacttcattcatgcaaaatacagtacctttttatgtagtaaaagtgtttgataattagatgttttcattatcattatagtatttaaccacataagtgatatgctgggttaccacaaagtcacttaagatcagcaagtccaaaaagcacgccatgaacttttcctcctgagtttgtctagcatcttcatctctggctcacaaagctagaaagaacatttcaatctttttttttttttttttttttaatttaccagtaagtttgtgaagattctaccttcaaaatgtatctaggtttctacaactctcctgcaattaccttctccacaagacaggaccgctctgtttgacatgttcatacttaccttgaaaagtgtcactttctcttctgcttcttaatccattctcacacagaagccacaactgtttaaaaagcccatactaatcacattttccagtaaccttccatttcatatagagtagaattcagattctgcatcatggcccacaagaccttgtaaactctcagacattcctcctcctgctctgacatgtcttaccttcctgtgtgtcagcaatgttcagccccccatgcctttatcctttcgtccccgagacaggccatctatctttcttaactcacactgcctgctctggtagttccttctgtctggcatgctgttccctcaggtctgtaaataggtggttgcttttcgttttccagatcttagctaataagcttgggagaccttttagcaatacccttgttaacatttagaaattatgtatgcataattatatgttttacttgaataatttgaagtctttagtgaaactgaattgttcagtgaaacaatccttcctatcagtgacactgaagctatgttttctctggacagcttttctaccaataaccgagaaagtttcaccccagaatgtaaaaatgatcactgagggctgctgtgtttgagtggaatgaggtgaggactgagtacctacactcccatctcatgccttttcttcactccccaagtgtgaaaaccagcagtgctgataatctacaaatacactaaatgaattttgaatgaggaagttgcccatggatacacatgtgacataatgatgcagtcttgggaaatctttaaaacgagagatattcattgccttttcttataatttcactgccttgtgtttatgattgcatcccccacatccctgtgagtcgataaataggcacttttgggcttctagcacctagcacttggccttccacagataaaagaccctgtacatgacttctgactaaactaatttcagaaaggcagccaagtgtttacctttgctttctgctcttcggtggcctttgtaaaagcttcatataataacctcatttttagttttgtacaagtcaaccactgatgcatggtatcgttatggtatgtctgctgaacagcaggaaataccaggtgccaccctatgtgatgggtgctatatttaatccctggggggggggcaaagagaagcgaaggttgtagtctcctcacacttatttatgtacaaggggagtatagaccagaaatgttaattagtaccttgttctgggaaaagagcgtctagttttctttctgttgtgtgacaaatattctgacagaaagcaacctagaaagaaggtgtttactttagcccacacatccctgattacagtccatcacctcagggaaggcccagcagcagaagcccaagacagagtatcatcttatctgtgcagccaagagcagagagttaatgctgtgtgcatgctacgtgcttgccttttaactttttaaacctttacacttgtttcaaacctatcctagggaatcctatcatccacaatggattggattttcccagtgaataaccaatcaaggtagtcctccatatataaaacctgatctagataattcatcagtactctctttctggattttttttggtggtgacaaattgacagttaaaactctctagcatagtacaattaagaacatggtgatttgaatctcaaattcccattttctttcaattagtataatgaaaaaacttacaaaaaggcagtttatggctagtattgatgaatgtccaaagaatcatcaaaagcttatctatatatttgctgtattatatttttaaaatatgagttgtcgtaattaataaggaaatgctaaagtttacttcattctacctttaggctttgatggaacttgatcaagagtgttcctctagaatctgaagtttataaactttgttaatactgagaaatgtctccatcctaggtaagtcagcaaccttaggcttctaagcacagaaatgcctaatttggatactgctgaatattgaaactgaggaagagccatgccaaggcatagtcagaatgaagtgcatggtgtgaaatgtatgaagcctaaaccattgattctacttccctgtattacacacccaatttattcattgtgtgattctgagatgaaaaaggtatttttatttctttaaaacagtaatctagcagataatcactgggaaaatattaaaatgctagtcatcaaacaggtatatggcaaagaacatcattttgataaagaaaaatacaaaaaagtttacgaagtggcatgctacttctgatctttttctattaatatatatggtttaaaatcatatttggtatattgcataaatatttattgaaagtgaacagagtcatgaatgagccaggaaatattgcagcagataccaaagaaatctaggatattaaataggaatagtttgaaaactgtactctagtatgttgtaaaatctaaaagaaatgcataaatttctatattctctcaaagtactacagttaaatgaagatgaaatcaataacctaaacaaaccctgtggttacttgaataagaatggccccagtgggctcaatgtttgaatatttgatcctcaattggtaaaacaatttggaaagaattaggagttatggcattgttggaagaactacgtcactggtagtgagttttatattccactcaaaggctcagtatattcctagttagctcttactgtcttatgtttgaggatcaagatgaagccttcagctctggtctaatggcatgcttacctgcctgatggcatgctttctatcttgatgctcatggattctgactctctacaattgtaggccacaattacatgctttcttttataacttgccttggtcatagtgttttattatagtagaaaagtaactcagacagaactgtagcaaataaagagagaaaatagtaataaaataccgtttgactaaagaacaaaaaagaaatgaaagatcagacctagatagagtcatatacttttaaacaatacttgcaaccaaccaatccttctaaattatccaattatctagaaacattaggagctcttctaaattctttctatgaagccagttttactctactgcccaacctgtgaaagacacaacaaattaagaaaactaaaagctaaggttacttatgaacacagttgtaaaaaatcctcaataaaacacttgcataccaaaatgcaggcatatatcaaaaagattatccaccatgataatgccagctttgtctcagagattcaggtatgaagaagtatacatgaatcaataactaataactcatggaaatggacgtaaagcccacatcatcatctcaatagatacagaaaagtcttgacaaaatacagcagtcactgctgatgaattactagacagaatagtagtagaactagaacgagtctctatatatctgtagaacataacagagcctacatatatatatatatatataaaactcatagccattgtcatcctaaatggagaaaatcttaaagcatctttttaaaattaggaacactcctccattgttggtgggattgcaagcttgtacaaccactctggaaatccgtctgcggttcctcagaaaattggacatagtactactggaggatgctgcaatacctcttctgggcatatatccagaagatgttccaactggtaagaaggacacatgctccactatgttcatagcagccttatttataatagccagaagctggaaagaaccaagatgcccctcaacagaggaatggatacagaaaatgtggtacatttacacaatggagtactactcagctattaaaaggaatgaatttatgaaattcctaggcaaatggttggacctggagggcatcatcctgagtgaggtaacccaatcacaaaagaactcacatgatatgtactcaccgataagtggatattagcccagaaacttagtatacccgagatataagatacaatttgcaaaacacatgaaactcaagaagaacaaagaccaaagtgtggacactttgccccttcttagaattgggaacaatcacccatggaaggagttacagagacaaagtttggagctgagacaaaaggatggaccatctagagaatgccatatccagggatccatcccataatcagcctctaaacgatgacaccattgcatacactagcaagattttgctgaaaggaccctgatatagctgtctcttgtgagactaggcaggggcctagcaatcacagacgtggatgctcacagtcagctattggatggatcacagggcccacaatggaggagctagagaaagtacccaaggagctaaagaaatctgcaactctgtaggtgcaacaacattacgaactaaccagtacccagagctcttgactctagctgcatatgcatcaaaagatgacctagttggccatcaatggaaagagaggcccattggacatgcaaactttatatgccacagtacaggggaacaccagggccaaaaagtgggaatgggtgggtaggggagtgggtgggagggtatgggggacttttgggataacattggaaatgtaattgaggaaaatacgtaataaaaaaaccccatttaaattaaaaaaaataaaattaggaacaatattgggctgtctagtcttccttacttcttttcaatataccactagctagaacaataagacaacaaagggatttaactaaaatcagaagagaagtccaattcttcctctttgcagatgacatgaaattatacacaaacaacccccaaatcccaccagaatacttctagaaataatgaatgctttgagcaaagtggcaggatagaaactcaatttatattcccaatgttggaaagcaagtctctactgcaaaaatcagtagctttttttttttttacatactttaacaatacagtaagaaatagatcattggcactctcacattcacaacagacttaaagttttctatgactaaatccaaccaaacttgacaaagaacgtcaaagatctgtacaaaaaaacctttaaatctcttaagaaagagataaagatatttaaaactggaaagaccattcatacttgtggataggtagaagtaatgttatgaaaatgaccattctactcgatataaaagacagattcaatgtaattttagtcaacatgtctataacattcttcacagaaatagaaaaaaaataattccatgtggaaccagaaagccaaaggataaaaaaagcaatcctgagcaagaagaaaaatgttggtgtggttattaattcaaagataaacttccatatatgttttctaatctcaagtggtcatctatgaacatgcacacgtatgaacaaagctaaaattcacagagtaggtaatatgtatatttgattatatatattatatatatgtatgtatatatgtatcaataactattattaaagagatcatcaatctgggagaagagtgggaaaagttagaaaagggagagtgtagggtatgagttatgtagatacagtactcacatatgaaattttcaaaaaactcttatcaaaacattgaaaaggaaagcatagaataatattggtacattcatagaactgaatggcttgaaataaaaatagtataagtgagttctatatcaattatgattgagtagtatgtatatctagggttatattatctacatcaatagatctatgaaaaatattctatttattattattattattatttgtttttttttaaagagaaaacaggatttctttttgtggcctgggctgtagacaggctgttagtgaaaatttataaatgttgcagtattctcttaatccagctggctcccaaattattgagaaggattatgttatttatatagcagttctaaagcacaactgagcaatattaatctatgttaacctctaagtaatatggctatctctcagtcaaaatccctgagatccttgtattttgtggctttctctggtccagctctcatcttatgatgttccctggaccctcttctagcggctggatctccacttcctctctctcccttcctgttcactggttatgaggaagtcctgctctattcattcccctgatctgtctttggctggctgatcagctcttcattgattaattcaggaatatatggggagcaatgtttacacaacattgagacagaagattctcagacttgcaaccaaatatgatggcacagaaatcaacatttgaataaaacaaggataatatttacacaatacattactccagaatggccttgaacttatccagacacactgcttctgcctcctgagtgctgggataaaaggcacgtaggaacaccacccagtatattccctcttctaagacagttaaattgtgcttccctcgatctttttaaaacctaggattgcctgattaggagtcatgtatcccccttacttgactgttatgtagcatcaaaatagaaccaactattagtcagtgcggtttcataaaaaaaaaaaaaaaaaaaaaaaaaaaagcagctatctacttacatatgtgcaaaccaacctacaatttttaaccaaattgacaatgaagttaattttaagtatgtttctcctttttgtgcatttgtttcgaatttatgagaacagttaaactggaagcttaggatacaagagtaaatcagctcaccggaacgagggtgcctccttcatttatcctttctcttgagtccttcatcctccctctgctaggtgagcttaagatgtgttctccacaatgttggcttagaacttgttggaactagaagttcctcctgttctttcaaccggcctaaaggcttgtggttgctttcatgtccatgtatcttgtatctaccttctacccaatattaagataaattgaaacttagaaagaaagaaacaaaagaaacttgattatgaaggggaccatgtgctcacaaagaatactaccaggggtgggagacaggaaagaaaaaagccaggagtacagttttgaggctccaagtgcagataatcagggcaaaaattactatcaaaagggaatttggagtttggcatcaccttggaaaggcaggcaataagattagtttaaactcacagactctgatggaaaagggagacattcaaatggcaacatgcatttggaagcatgggatttaatggggcatgagtgagagaaaggaaatctcatggagaaattatattgaaaatgctagaagcaaaagtctgagggatgaattttaaagaaaatcttagaggaagaaaggcagaaggaggaccaagaaatagataaagaaagtatttgtaatacatcaacattggaacataaaacagtttttgagcactgattaacagggctgtcacatgggagaagagaaaatttcacagaggaattggcaaaacacagagcaaccaaagtaagtgaacaatagtccagaagttagaacttagtgggaacacattaagttatatgtggagcctgaaaaatgtatcccatcccctgggagttgaatgactatagttttaccaggcttggtttacttttgttttgttttgtttttttaatgatcacttaataccaatttattgagattactattggaatcataggtaatgtaacagatctgcatacatgtttatatataatgatgatagacaatatattttgactaatagaaaagcttgtagaatgtttaagatagcccacaggaaaagtgtgataactactcttcattgtcagtcttaggggaaacaattgtcaatgcatatctgtgaagaagcaatcttaattgaagaattgtccctgtttaatttgcctatgggaaatttcttgattgctaagtgatgtaagagaacctgttgggaactaaaggtggccctggggaagggggggggggtagacccacaccctgccagagttttacctgccagagactcaaagcaggagtttgaagcagaaaccattgaacactctatagaattgctctatagtttctctggtctgtcaggagtgggagagctgccgtacactttctactcagccctgggtgggcattcaagcctctgacccactcttcatggggtggccaaggggcagccttacctgggaaccctggagctactttgctaaagccaccagggttataggagagaggaataagggaagagggaagaggttcccaacactgaccataatgagtgtagtggatcttgatgaactctctatggttttagagctttattgtagaaaggcatggggaaagagagaagggagagagagagagagagagagagagagagagagagagagagagagagagagagagagagacagagagagacagagacagagagagacagagacagagagagacagagagagagacagagagagagagacagagagagacagagagagagacagagagacagagagacagagaaagagagagacagagagagacagagagagagacagagagacagagaaagagagagacagagagagacagagagagagacagagagagagacagagagagagacagagacagagagacagagagacagagaaagagagagacagagagacagagagagagacagagagagagacagagacagagagacagagagacagagaaagagagagacagagagacagagagagagagagacagagagacagagagagacagagagagacagagagagacagagagaaaaggctagagagaaagagagtaagaaggagagaggagaggagaagacagagaggagagaggggtaagaggtaagagaataagaagtaagaggtaaaaggacagcagtgagaagtaagagcaggcaggggctaaacagccctttttatggtctttactgttgctaggtaactggggaggagtttagcttgaaggtcagaagcttggaccattgcctactgacaactgaccatgctgtgagtggccgtggggggcggtaacttaggcaggagccagagttccaggagcatgagggaccgcctaccatatcatgtaggtgaattatcaccatcggggttcagacttcagtgcaactggagaccagactgtctgtgtatagcccagtgccccacaagaaccaacctactgtgaaaggtaccactcctaaacaggtcggcctgttctgtataagaagcctgggagcaattctatagagtgttcattggtttctgcttcaagctcctgctttgagtctctgcctttgtttccaataatgatggattttatctagtaaaataaaatcaaccctttcttttcaaacccaatccacttttggacatactgttttattacagcaacaaaaacacaaaagagggttaaatttttatttttttgaaaatacagtttaacagatggtaaagccctcatgctttgaagagaaatagtctggattttattaggagaggactctatcttcctctttactatctcctctctctctctctctctctctctctctctctatatatatatatatatatatatatatatatatatatatatgtatacacacacacacacagtttgtagagagcaatgtaaagtctaggaagcagtatgagttgttggagtttctcatggactcctttggccaaaaacttaattacatgtaacccaattttagtctgcaagcttcacttggtggcaagaaacaacctgtggtggctctctgtcttggcagtttatttttgatcatcttcatattttatgaatctttgataattggtatctgtctagaatatcaaccacttcattttgattttccaattttgtggagtacagacttttgaaataagacctaatcattctttgaatttcctcagtgtctgctgttacgtctccgttttcattcatgattttgtttatttggatattgtctctctgtctttggctaggttggctaagggtttgtctatcttgttgattttctcaaagaagcagctcttgattttgctgattctttgtcttgtcttctttgattctacccgattgatttcagccaagattttgattttttcctgccttctcctagtcttttatgtgcttgcttcttgtttttttttttgtttgtttgtttgtttgttttttcttacaggtgtacttttaatttgctgatatgataactttttaatttctttatggaagcttaaggtatgatgttgtaccttcattttcactgaattggagaaagcctttaatttctttctttcttttttttcctgacccagagttcactgagtagagagttgttcaatttccatgagtttgtagactttccagtgtttatgttgttgttgaagtccaactttaattcatagtggtctgataagataccacgaattatttcaattttcttgtatctgttgaggatagctttatgacctaagatatggtcagttttgagaagggtccatgaagtgctgaaaagaaggtattttgtgtgtgtgtgtttggataaactattctttagatgtctgctatgtttaattgattcataatgtctgttaatttcattatttctctgcttagtttttgtttggatgacctgtctaatagtgagaatggggtgttaaagtctcccactagtaatgtgtggggtttgatgtgtgatttaagcttcagcaatatttatttcacaaatgtgcatgcccttgtgtttggaacatagatgttcagaattgagatatcttggtagatttttttcctttgcttagtataaactgtctttgtctttattttctgattaattttggttgaaaatctactttattatgtattagaatggctactccagcttccttctggggttaatttgcttgcaaaactttttccatcccttcaggaaatgtctatatttattgctgaggtatgtgtcttgtatggagcagaatgatggatcctatttttgcatccattctgttagcccatgtctttttactggagaactgagtgcattgatattgacagatattaatggccaatgattgttatttcctgttactttgatgttggtggtgtgtgtagtgtgtgtgtgtgtgcgcgcgcgcgcgcgcgcatgtgtgtgtgtgtgcactttccttgtttttgctagtatggaattgcttatttcctatattttcttggatggagttatccttgtgttggagttttccttctaatattttctgtagggctagatttggatctgtggatagatattgtctcaatttggattttcttgaaagagcttgttatctacatctatggcaattgtgagttttgttgactatagttgtctaggttgtcacctatttattttagaggttgtaagataactgcccaggcccttgtagcttcttcttttttttagaagttgggtgtaactccgatcaatctgtctgtcagttacctggcctttttcccttgatgcttttaatattctctctttgttctgtaaattgtatttttgattattacttggcagtgggtactcttttctggtccagtataatgggtgttctataagctacttgtatattcataggcatctctttctttaggctggttatctttgggctgtatcattctagaccagcaggtctgtatggttctggacctgccggtctggatggttgaggatcctcaagtccaatgacgagggtgggggtggggagatcccgctgggctagcaggctgctcacagaaccttggcttgacccagaggactcagatcagggaagatgtgtgaggaaaggaaaccttatctctatggttcaggatccacagctctgataaaggtggtggagaggcggcatgagaataaactgaattcaggttttcatgcttgtgtgacaaacactttaccagtaagccacctccctaaccctttcattaactttcactagttctttcatatttttatacaggttttaccttgctctgatctctcagtgtgatccaaaatactcttgtatgcaaaaagagccacttgcctgatctctctcttttcactactaactgtgtttaacctagaatccagaggatgattttttgggggggaggtatccttattttttatttttatattttgactttttatttaattaagtattttcttcacttacttttcaaatgctatcccaaaagtcccccatacctccccccactaccctcccccccccactcccacttcttggcccttgctttcccctgtactgaggcatgtaaagtttgcaataccaaggggcctctcttcccaatgatggccgactaggccatattctgctatatatgcagctagagacatgagctctgggggatactggttagttcatattgttgttccacgtatagggttgcagacacctttagctccttgggtaatttctctagctcctccattgggggcactgtattccaaccaatatctcactgtgagcatccacttctgtgtttgccagaacacagcctcacaagagatatcagggtcctttcagcaaaatcttgctggtgtatacaatgatgtcagcgtttggaggctgattatgtgatggatcacctggtatggcagtctctagataatccatcctttaatctcacctccaaactttgtctctgtaactccttccatgggtgttttgctcccaaatctaagaaggggcaaagtgtccacactttggtctttgttcttcttgagtttcatgtgttttgcatattgtaacttatatcttgggtattctaagtttctgactaatatccatttatcagtgaatacatatcatgtgagttcttttgtgattgggttacctcactcaggatgataccctataggtccatccatttgcttaggaatttcataaattcattctttttaatagctgagtagtactccattgtgtaaatgtaccacattttctgtatccattcatctgttgagggacatctgggttcttttgagcttctggctattataaatgaggttgctaagaacatagtagagcatgtgtctttcttactagttggaacatcttctggatatatgcccaggagagatattacgggatcttctagtagtactaggtccaattttctgaggaaccgccagagagatttccagaatggttgtacaatcttgcaatcccaccaacagtggaggagtgttcctctttctccacatcctcaccagcatctgctgtcacctgaatttcttatcttagccattctgactggtgtgaggtggaatctcagggttgttttgattttcatttccctgatgattaaggatgctgaacatttttttcaggtgcttctcagccattcggtattcctcaggtgagaattcttttttttttttatatatatatttttattaggtattttcctcatttacatttccaatgctatcccaaaagtcccccataccctccccccctcccctcccctcccactcccactttttggccctggcattcaactgtactggggcatataaagtttgcatgaataatgggcctttctttccattgatggctgactaggccatcttttgatacatatgcagctagagtcaagagctctggggtactggttagttcataatgttgttctacctatatagggttgcagatcactttagctccttgggtactttctctagctcctccattgggggactgtgatccatccaatagctgactgtgagcatccacttctgtgtttgctaggccctggcattgtctcacaagagacagctatatcagggtcctttcagcaaactcttgctagcgtatgcaatggtgtcagcgtttggaggctgattatgggatggatccctggatatggcagtctctagatggtccatccttttgtctcagctccaaactttgtctctgtaactccttccatgggtgttttgttcccaattctaagaaggggcaaagtgtccacactttggtctttgatcttcttgagttttatgtgttttgcatattgtaacttatatcttgggtattctaagtttctgagctaatatccatttatcaatgagtacatatcttttgagttcttttgtgattgggttacctcactcaggataatgccctccaggtccaaccatttgcctaggaatttcataaattcattccttttaatagatgagtagtactccattgtgtaaatataccatattttttgtatccattcctctgttgaggggcatctgggttctttccagcttctggctattataaataaggctgctatgaatatagtggaacatgtgtctatcttactagttggaacatcttctggatatatgcccaggagaggtattgctggatcttcccgtagtattatgtccaattttctgaggaaccaccagactgatttccagagtggttgtacaatcttgcaatcccaccaacagtggaggagtgttcctatttctccacatcctcaccagcatctgctgtcacctgaattttttatcttagccattctgactggtgtgagatggaatctcagggttgttttgatttgcatttccctgataattaaggatgctgaacattttttcaggtatttctcagccattcggtattcctcagatgagaaatctttgtttagttcccgagccccattttttaatggggttatttgattttctggagtccaccttcttgagttctttatatatattggatattagtctcctatctgatttaggataggtaaagatcccttcccaatatgttggtggtccttttgtcttattgacgatgacttttgccttacagaagctttgcaggttcatgaggtcccatttgtcaattctctatcttacagcacaagccattgctcttctattcaggatttttttcccctgtgcccatatcttcaaggcttttcaccatttctcctgtataagtttcagtgtctctggttttatgtggagcttctttatccactgagatttgaccttagtacaaggagttaggaatggatcaattcgcatccttctacatgataaccaccagttgtgccagcaccatttgttgaaaatgctgtcttttttccactggatggttttagctcccttgtcaaagatcaagtgaccataggtgtatgggttcatttctgggtttttaattctattccattggtctacttgtctgtctctataccaataccatgtagtttttatcacaattgctctgcagtaaagctttaggtcaggcatggtgatttcacccgagtttcttttatccttgagaagagtttttgctatcctaggttttttgttattccagatgaatttgcaaattggccttcataattcattgaagaattcagttagaattttttaaaaatatttttattacgtattttgctcaattacatttgaaatgctatcctaaaagtcccccatactctccccccaactcccctacccacctattcccactttttggcaatcgagttcccctgttctggggcatataaagtttgtgtgtccaatgggcctctctttccagtgatggccgactaggccatcttttgatacatatgcagctagagtcaagagctccggggtactggttagttcataatgttgttgcacctaaagggttgcagatctcattagctccttggatactttctctagctcctccattggcagccctgtgatctatccaatagctgtgtgttagcatccacttatgtgtttgctaggccccgtcctagtctcaaaagagacagcgatatcagggtcctttcagcaaacacttgctagtgtatgcaatggtgtcatcgtttggaggctaattatgggatggatcactggatatgacagtctctagagttagagttttgatggggattgatttgaatctgcagattgcttttggcaagatagccatttttacaatgttgatcctgccaatccatgagcatgggagatctttccatcttctgagatcttctttaatttctttcttcagagacttgaagttcttatcatacagatctttcacttccttagttagagtcatgcctaggtattttatattatttgtgactattgagaagggtgtttttttctaatttcattctcagcctgtttatcctttgtgtacagaaaggccattgacttgtttgaattaattttatatctagctacttcaccaaagctgtttatgaggtttaggaattctctggtggaatttttagggtcacttatatatactatcatatcatctgcaaaaagtgatattttgacttcttcttttcaaatttgtatccccttgatctccttttgttgtcgaattgccctggctaggacttcaagtacaatgttgaatagttagggagaaagtgggcagccttgtctagtccctgattttagtgggattgcttccagtttctcaccatttactttgatgttggctactggtttgctatagattgcttttattatgtttagctattggccttgaattcctgatctttccaagacttttaaaatgaatgggtgttggattttgtcaaatgctttctccgcatctaatgagatgatcatatggtttttgtctttgagtttgtttatatagtggattatgttgatggatttccatatattaaaccatccctgcatccctggaataaaacctacttggtcaggatggatgattgttttaatatgttctgggatttggttatcgagaattttattgagtatttttgcattgatattcataagggaaattggtctgaagttctatatctttgttggatctttctgtggtttgggtatcagagtaattgtggcttcatagaattagttgggtagagtaccttctacttctattttgtggaatagtttgtgcaaaactggaattagatcttctttgaaggtctgatagaactctgcactaaacccatctggtcctggactttgtctggttgggagactattaatgactgcttctatttctttaggggatataagaatgtttaggtaatcaatctgattctgatttgactttggtacctggtatctgtctagaaatttgtccatttcgtctaggttttccagttttgttgagtatagccttttgtagaaggatctgatggtgttttggatttcttcaggatctgttgttatgtctccattttcatttctgattttggtaattaggatactgtccctgtgccctctagtaagtctggctaagggtttatctatcttgttgattttctcaaagaaccagcatctcctttggttgattctttgaatagttcttgtttctacttggttgatttcacccctgagtttgattatttcctgcagtctactcctcttgggtgaatttgcttccttttgttctagagcttttaggtgttttgtcaagctgctactgtatgctctctctagtttctttttggaggcactcggatctatgagttttcctcttagaaatgctttcattgtatcccataagtttgggtatgttgttgcttcattttcattaaagtataaaaagtctttaatttctttctttattccttccttgaccaaagtatcattgaggagaatgttgatcagtttccatgtgaatgttggctttctgttatttatattgttattgaagatcagccttggtccatggtgatctgatagaatgcatgggacaatttccatttttttttgtatctgttcaggcctgttttgtgaccaattttatggtcaaatttggagatggtccagtgaggtgctgagaagaatgtatatccttttgtttcaggataaaatgttctgtagatatctgttaaacccgtttgtttcataacttctgttagtttcactgtgtccctgtttagattctttttccacaatctgtccgttgatgaacgtggagtgttgaagtctcccactattattgtgtgaggtgcaatgtgtgctgtgagctttactaaagtttctttaatgaatgtggctgcccttgcatttggagcatagatattcagattgagagttcctctcagaagattttacctttgatgagtatgaagtgcccatccttgtctttttagataactttgggctggaagtcgattttatttgatattagaatggctactccagcttgttttttcagaccgttttcttcgaaaattgttttccagcctttcactctcaggtagtgtctctcttttcccctgagataggtttcttgtaaacagaaaaatgttgggtcctgtttgaattggcagtctgttagtctatgtctttttattagggaattgagtccattgatattaagaaatattaaggaaaagtaattgttgtttccttttatttttgttgttaaagttggcattctgttcttgtggctgtttccttttaggtttgttgaagaattacttttttgctttttctagggcatggtttccgtccttgtattggtttttttctctgttattatcctttgaaggactggattggtggaaagataatgtgtgagtttggttttgtcatggaatactttggtttctccatctatggtaattgagagtttggctgggtatagtagcctgggctggcatttgtgttctcttaatgtctgtataacatttgtccaggatcttctggctttcatagtctctgttgagaagtctggtgtaatcctaataggcctgcctttatatgttacttgacctttttttcccttactacttttaatattctatctttatttagtacatttgttgttctgattattatgtgtcaggaagaatttcttttctggtccagtctatttggagttctgtaggcttcttgtatgttcatgggcatctctttctttaggtttgggaagttttcttctataattttgttgaatatatttgctggccctttatgttgagaatcttcattctcatctactcctattatctgtaggtttggtcttctcattgtttcctggattttctagatgttttgagttaggatctttttgcattttgcattttctttgattgtcgtgcccatgttctctatggaatcttctctacctgagattctctcttccatctcttgtattctgttgctgatgctcacatctatggttccagatttcttttttagggtttctatctccagctttttcttactttggtttttctttattgtgtctacttccctttttaggtcttgtgtggttttgttcaattccatcccttgctttgttgtgttttcctgttttttctttaaggacttctacctctttagcagtgttctcctgtatttctttaagtgagttattaaagtcctcttgatatcttctaccatcatcatgagttatgcttttaaatctgagtgtagtttgttgggtgtgttctggtatccaggattggctgaggtgggagtgctgggttctgatgatggtgagtggtcttggtttctattagtaagattctaacatttccctttcgccatctggtaatctctggagttagttgttatagttgtctctggttggagcttgttcctcccatgattctgtcatcctctgtcagcagacctgggagactagctctcttgagtttcagtggtcagagtactctctgcaggcaagctctcctcttgcagggaaggtgcacagatatctggcattcagacctgcctcctggccgaagatgaaggcccgaaacagggcctgtcccagaagctgtgtcatttctgtagtctgcactcttacttgcacagactagtaactgagagatccaggaccagagatggctcccccaggtactccagcaaagccctcccaggtgaggcggacacctctcctctggcagggaaggtgcctggatatctggagccctaaatgtggtttgccccagaagctgcatcccttctgcctgtcccagaagctgtgtagcttctgtagttcatactctcacatgcgcagacaagtctctgagttgtcagagaaccaagatgtttaccccaggtgctccggcaaaatccccagaggatgattttaaaactcataactcaagtcctaccatgctaccttttcttcaatcccttactgctttcttatcttggtggagaagatctcatgggatctgtctctctgtatcttttggtttgccattaagagtcactttctacattcactgtacatttattaggttttaaagagaaatataaatggcatgaacacacacacacacacacacacacacacacacacgatttagaatgtattagtatatacacatatatactatataaggcataatatattcaattttttcatttagatatactactgtttatagagatgtttactataattggtttacatatttacgaatgctaactagtcccataatctataatcatttagccagagagctagaagaagtgatggcatatgttctagcctgagttcctctctgaaacaaaagatggaagatatctgaattggaagacagaggggagacagaatttccccccagtccacatttatgtttttttttctttttctgcctctcatctggaaatacaaatacaatcattatcccagtcaagttgcatataaaattaacacctacattgccaagggaaaaacacatgtacaggatcagggaaacaaggcaaatgtttacaaaattgtaaaatttaaaaacattcagcagaacacttatatttaaggctctttgatatttgtcttgttttctaagtgggacctatcaaagaaagtttagttaacacttagcttgacaataagtagattgattttaaaaagtacaatttttggaattgtttttttacattccctgactaatagcttattaattttcaaagggctgtagctacatgagaccatcattttttgcctacatggatcccatgtacagaatcaaccaaaccctagagttattttacttagaaatttgattgctacacctttttcattgtgatcagtatttggtttcctattactgatattacagtcttccatatctttgttggcttaagtgatgcatgtttttcatctcaccgtcttggaggtcagtaatctgatgcaggtcttggcattaaggtcaaggtgttggccaatggattcttcttggggagcaaagaaaaagtctttttatttgccaccagggcttgaggctgtcttaagtcttcaaagtcagcagtaactggctcttctctaaatctgaactttcatatataaggactcatgtgctctgtgggtcacacccagataatgcaagagttcacctggtaagagccttaattccctcttaaactgtgattcccttttgcggtgtagcctgatatactcatggttactatacattcactgtgcggccattggtcagcttaccacacatagaatgttaaggaaatctgtattgctagtagattttatctgtatacaataaactaactaggcctggatctattggctttcttgagtacattttcttgtatgtgtgaagaagaaaggataatgacaacttctagctgttggagattttctggcaggccaattatgaagatctctaaggagagtcacagaagtaacatttatcttcattgatcactaattctgtgaatattcctgaaatgaattatgaataatgaactttcacaagactctcatctattttctctatgccttatttttggtgctcagggatcatgctagtacttcccatgaatgcttcccacgactgctgaaaatcaggcaaacacagatttctaatgatatggatctctaaaaaacttgatttggcttatggcttagagtgcatgtatcctaacagtgactgtaatatttgatactcagtataaattaaaaagtgagggttagtgtgaattctggatctcttgtgaaatagcagtaattttcataactatttttgactactgcagtcttagtattaagctaaagtaaaaaggttaatataaatgtttgatgtgaactacagaattgtttcattagaaaaatcacattctctttttaaattaatttatgctattaacttgcacttttctcataggaattattttctgagaattagaacacgatatgccatatatggagcacccattttaagttctggttcttaagatgtatttactggcatctacatttctaaagaaccaattatttaaccacattacagctattgacagacaaaatgtgtgatatgtgctcaactagatctgttctagtagattaattttagtttgatgagaagatgacattttagaacatatctaggtcagatccagtgttttgcaacagtgctctagcctatagaaagatgtctggccttcgttctcacatccctatgtacattgctgtaatttctaaataatgagagagaagaagcattgattgagcatctcttgtcactaaatgaagcctccagttccaggagtcagttccacctaatggagttgttgacccaaggaattccattggaaaccccaaacaacccaaggtattaccaaggtcattgattgctctctgcaaactcatgtgaagactgggatgctgaagacaagacctacacaattcccttggtagggagatgtcaagctggtgcctacttagtgcctttatccctacggactagtgttcatatactggaaggtatgatgcacactaccaaaggagaaatgtgaataccaactcagctataaaccctttgatctaaagtggtgatgtacatacacaacgagctattgtaatagtggcaaaaggcttatgggagcaacaatcagatatttatttacttttagcacttatttcatgagagaatcagttttcaatgatgcccaaggacctggtactagataggccatagacttaggggaaaaccaaatactactaatctgctaaaagtggagcaacaaaatgattcctattgacattccactatcctcatagatgcatggcttccttagccaatatcagagaagcttcttttaaaatagataggaataaattcagagacccataactgggccctatgggggagagagagagagagagagagagagagatttgaactctcagttctaaatgggatgtctccatcagttccttcccttcaggagtcagggaaccttgcagaaaaagggggcagaaatgatttaagagccagatggaatgtagaacacccaagaaaaaaggcctttagaaacagcaagaccaatacatacatgaatgcacagagcctggcaacatgatccacagtccccagcagtgttcttttgtttgtttcttagtaaactcataaaaaggccccacctgtaaacttcctttgagaggaaactgtgcatatgatgctgtagcacggatcacgaaagagataaaatgaatatcccaactttgtagacagtcatttcttttaaatgcccacatttatattaaaaactgttatttctcacaatctagaaaagattgtagcagagcaattgtattacacagattcaacataaccaaattcattatctatctgaataacaaatgtcatccttcctccccagcactggtctcatttctttaccagcctttcctcctcattcctgattttgtattcacaatgagaaatgttagcaataatagctttaataatggcaacagtgtcttgaatttttatagcacatttcctctgggaggtttaaagtggttcaaatgaatttcctcgtttcactaatgctttctagtgagttagagtgtgtgataggacataacctcagctttgcagtgacctttctcattatgttcctgaactttatctcccatatgtctctggaatcagaggagcctattagttcctggaagtggtgcatgtatgtgcatgtacgtgtgtttatatatgtgtgcaggcacatgtgtgtatgtgtgtgtgttgttttaaacttctttctcttcccacgttctgcacatctgtaggcttagcaatgttctaaattaaagaatataaaatggaaatgcaaggagctcgctgaaagcaatacttaacagaagtgccaattctgtttatcagaaatgtgactatttaaccttaggttatatgcaaaatggcaatttccatatctaggcaagtagaggaaagaataatattcaagaaaatctatcttataaaatattcggctttggaggagttggaggcaggaagcaaaggttgagagatacgggatagcactctctgcatgctaagagcattttattaagcaacatttctgtgatgttcctgtggttggctactcactgctctcattgcagcatgcaaaattgtagagtattgaaattattttggagcaataatgtctcaaaaggaatgattcaaggcttaatatttgtgtgattttttttatttaatagtttttagttctaaatactcggaaacatataaacatgaaaatataaagacagccatgtttttctatcacaaaaatcttaatgttatgctaaaacatgacactcatagtagcatattgaatcataaaaatggtcatattgtagccaaaagtcacatgaaagatttgaaatgtgatttagaaatggcgattaagtaacttactattattggagaatacttttttttttttgcatttttttttccattttttattaggtatttcgctcatttacatttgcaatgctataccaaaagtcccccatagccacccaccccctctcccctacccacccactccccttttatggccctggcgttcccctgtactggggcatataaagtttgcgtgtccaatgggcctctctttcgagtgatggccgactaggccatcttttgatgcatatgcagctagagtcaagagctccggggtactggttagttcataatgttgttccacctatagggttgcagatccctttagcttctttggtactttctctagctccttcattgggggccatgtgatccatccaatagccgactgtgagcatccacttctatgtttgctaggcccaggcatactctgacaagagacagctatatcagggtcctttcagcataatcttgctagtgtatgcaatggtgtcagcatttggaagctgattatgggatggatccccggatatgctagtgtctacatggtccatccttttatctcagctccaaactttgtctctgtaactccttccaagggtgttttgttcccacttctaaggaggggcatagtgttcacacttcagtcttcatttttcttgagtttcatgtgtttaggaaattgtatcttatatcttgggtatcttaggttttgggctaatatccacttatcaatgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttccttccagcttctggctattataaataaggctgctatgaacatagtggagcatgtgtccttcttaccagttggggcatcttctggatatatgcccaggaggggtattgctggatcctccggtagtactatatccagttttctgaggaaccgccagactgatttccatagtggttgtacaagcctgcaatcccaccaacaatggaggagtgttcctctttggagaatacatttttaaacatctatatttgaaatgctcattaattttgcacacagttctgaaataaaatatggatccaactctgtagaatcatttttcattttgtaacaagctttttggcttaaatgtcatatatatatatatatacatatatatatatatatatatatgtatatatatatatacatacatacatacatacatatcttgaaatgtgaaattctgggcattggagaaacagctccaaagcaaagttctgtgcaagcatgatggcctgagtttgtggcctggaatcatggagaaagttagatgtgatggtgtttgtgtgtaatccaagagctggagagagagactcaagagtaccctaggggtttgctggttggaaagcctagcctagccaacttggtatagccagcttagagagagaccttgtcgcaaaatattcacaaattgttatatgcaagtatttactctgtgtatcatcacatcttatatgcaattcttcatttttcatcctaagggacaaaatagcctttaactgccttcactccactgtacttggattaaactttagttagagcttaattggccttcagttttcattagtttttcttttctcaaatagcattatccttggaaagcttgcatttataaactctttgttcctttttttgtttgtttgtttttttgagtttttcgagacaaggtttctctgtatagctctgcctgtcctggaactcactttgtagaccaggctggcctcgaactcagaaatctgcctacctctgcctcctgagtgctgggacaccaccatgtccggctctctttgttccgtttagatgtatgtattctcctagctacttccagttttagaaccctggagtatatttttaagaagattcctttgagacatggccatcgaagaggaaagaatccaatccccccgtgtttaggaaaagcaggaaactaactcaataccacccactagtcagcacaggtatcctaaattactttgacacccttttcacctaatatcctctggtacttttcactatctaatcacaatgcttaaaactcttttgccttttgttttagaggggcagaggccatttttttttctctcactatagtactgtggtccttttgttgcaaccatcttgaataaagtctcttgcctatttatctctctagtcaaagacatttttagtgctaaaaaatatcataagattcaaatgtatgtttttttgtgattctgtagtttgaaaagtatgaattcatttaaataagattttatgttatatttatactgagcttattttacattctatttatcaaaatatatttttggaattatatgcaaagttttacatatgtaagaactacagtttggggctggagagatggctcaattgagtaagtggttgtgattgctatacaagcataaggacccatggttagacttctgacatccacataaaagcagtatatgcttacatctttagaacaacagtggcagtgaagtggagacaggtttcttcctagggcttgctggtgagccatctatgccaaagtgagctccagtttcagtaagagaccttgtctcaaaaattaatgtgaagagtaatggaggatgacataggaccctgacctctgtcctacacacaccattgcacctggccccaaacacttacaccccccaaatcattatgatttatcattttaaaaatagctatgcatttataagaagaaaaggttcatgttataacatgctggcagatagatagcagtgtctggccaactgtcactagcattcccgtttggtgttcttcccagaccctaacctgaaaaagtaagactacaataaaatagtggctgctagtatttttgtgaagctacacattttttttcctgttgtctcaaactgaagtcattttatttcagcatcctaaatggagtccaaatgcttcaactattaaaaacagctttagcagcatgttgtggaaagctatagagagaagctcagtttggagctctcatgtttgtaaagctcctaacaattctctctcttctgcttcttcccagcacaatcatttcttcggaaactaacagacaaaaaaggctttgtcactggaagtattgacttctgagttatccaagctagtgactgctgctgaatataagcaggtttctagaatacacaagagaaaatgaaggtatgcaagcagaaagctttagtcttttaatgaaacaaatataagcaggactcaggatccagctctgaacctacatttagcaaatataacttgtcaggcatagaattgatgcctcttgtttttccttttgttcttgttcttgttttccttgttctcattttcttgtttcttctccttctccttcatcttctccttcttcctctttctcctccttcttgttttttggtctcatccttttccttcttcttcctcttttccttcttccccttcttacatccttccttccttccttccttccttccttccttccttccttccttccttccttcctccttcctcttctttctcatcctcttctcttcctttttcccttttccttcatattctttttctgccttgtttgcctcaaaatgtcagaatataatgtgagaacatcacaatcagtattgtgaataatttgtttttatgattcaacacatacagaatgattgttttcaaccctcatataaataaaattactcaccaatttcttttggggagagtatttttagaatatttttttggaagaagttctgcaatcttacttatattctggttttattatctaaaacgtttttaaaaaaatattgtaaatgtaccacaatatctaactatgagatcctaaggtaaaataatgaaataaaataaacaaatctaaacaggcatgtaagtgtattgccaaagaccagccttggtttggagaggagttcttgagagaaggggtatttgagagtggctaagcaactagtagtcaaatagtggatacaggctgacactctgtattctactcaagacagttttctctgaatatctccagacaattcattcagatagcttagcacctacagaccaaagcccagtcttttatttacacatcaattcagtcatttactctaggttcccttttgattattccatgaatcagattcccatgacctttgctccttgatactcagaaaaagacagtaaacacaattttttaatcattgcaagtaaattcagaaatctgtctgcctttgtaaacacagacagtaagctagctgagatattgccatgaaaccactactccacaaatctctttatctctttccttaatctttctaacaaagtggctcatagtccagctgcccctgctctttcagattcatgaagctcctcatacaattcatattgcatccctatattttgcataattgagaaattatatacatttggactcatgttttcagagttctttcccacagccttaaggactgtcctaaaggccatagtgttcagcatcttattaaggatcacagacacactcttgactcttggactcattctgtttctaattatcatggagtaattaatcttagcagggagaacactcccagataaccttggcaacaagaatatttcccagaagaacatgaatttatataacatatattacaagcctcatacccagtaaattttgatacctgtggaggcctatgtcctgctgtctctgttccagggttgaggaatgatgtcacaccagatcttccagagctgtgcaggactcagcagcatatgctggtttttaccttgacacacagatattcaaattgaagttgtcttgaaagtacaaaccctaatgtagtaaaaagtatttaataaaatccctgtgtggggctccttcctgcctttaaccactcatattcccaggtgaaagacacacatacacacacacacacacacacacagagagagagagagagagagagagagagagcttttatatttagtatggcttaaacagcacaatagctggggaactgcctaccctcaatactgttaaaacctgtcttgctatccataaccccattatgtttcctcttgtctgcttctatttccaattggccaccacacatggccacattttatggctcagataaactatggtggccctcctttctcctctgctgtacactcttctattccactcactctctctctctcttctctgatgctttctcaggctttctaacctgggaaacctcaatgccctatatgtttcttctccccagctattggctgctgacatctatatttatttatttagttaatcagaattaactgggggcagtgtccctctggggaggccaccacttagcattagaatacaagcagcattaggccaatccaccatatcctaattttgttctgtggattatagtttttattatgataatctctgatttcattaataaaaatatatctgtaattataccaagaataagtgatatatcaaatggaaagtatttaactatgcttgtagcaggaatatagttgaattagttgaacaaaatttcagctatatctgggtcctttcagcaaaatcttgctagtgtatgcaatagtgtcagcatttggaggctgattatgggatggattcccgggtatggcattctctagatggtccatcctttcgtctcagctccaaactctgtctctgtaactccttccatgggtgttttgttcccaattctaagaaggggcaaagtgtccacattttggtctttgttcttcttgaatttcatgtgttttgcagattgtatcttgtatcttgggtattctaagtttctgggctaatatccacttatcagtgagtacatatcatgtgagttcttttgtgactgggttacctgtctcttgtgaggctatgcctagcaaacacagaagtagatgctcacagtcagctattggatggatcacagggcccccagtggaggagctagagaaagtacccaaggagctaaagggatctgcaaccctataggtggaacagtaaccctccagagctcatgtttctagctgcatatgtaccaggaaatgccctagtaggccatcattggaaagagaggcctgtcggtcttgcaaactttatatgcctcagtacaggggaatgctagggccaagaagtgggagtggggggaggggaagtggggggagggtatggggggacttttgggatagcattggtaacgtaaatgaagaaaatacctaattaaaaaaaacaaagtttcattaatttaccagaaattaaggtaggaaaatcaattattcaactaggtgttaaatatcaaactataaataatagagattataactaaaaacaaagagtcctacaatttattattaacaataaataattgccaaatcatggtaatattatatataacttaagtgtagataaactcttcttgaattaatttcttcttgtctattttctgattttccccttatgacattgtgtgttagttgatttcagtggcagtgatttcagtggttcttgtatcagctaaaaatggatggaaataagaagcatttgatggctaaaaaagcatcctgccaacatattgtctaataagtgcagtggacagcttattcacttcacgtgtgtatttcgatatttgcaatacgttttgcagttgtacttagcatctaacctttgggcactgagtagcaacagagaggtaaacaattcctggactcacttcatccataggaagtggatttaaaagtagtagtacacataactacatgatagcaactgagtaaagaagtagaggtactgcatttgtaagactccttttgtttgcttgtttgtttttgttttgttttgttttgtttttgagacaggaattctctgtgtaactgtcttggctgttctgaaactgaatttgtagtccagactggcctcaaactcacagagatcttcctgcatcacttcccccactgttgggattaaagatgtgtacaaccatacccagctagaacacttaattcatttatcttaaaatgttctgaaaagatgttacctcttatctctttaaaccagttttaaccaatcaggtagtatcattagtggcttaagcatgcaaatatagaagtgagagtctctgtaaacacacccttgaatatggttagaatggtggaagggaaccagtgacttggctgtgaaggtagcatggtggacatgctcagggccaccacctaggactggaatgctttcatctattaacttttaagagttgacttcagtcctttgtagaagggggagcaaaatactcatgggagataaaggatgggaggaaatttggaggaatagaggaggggagggggaaaagggggagacaggatcaggtgtgagaggagacagactacaaatagggatgatatacaggagggtcaggaatttgaaaagaggtatgtagcaataggggatggggaattgggggtagccaccagcaagtcccagattctaggaaagcaagaagctcccagaacccaactaggatgagattagctgaaattcccaacaaaggggagggagaacctatagagaccatttccagagattaggcaaggcctcctgttgggggatgggaccactcactcatctccaaattatgaatccagacttgctcctgtttaaaggaaatacatagaacagaaactgaaggaaagatcatctagagactaccccacctggggatccatcccatatacaaactcaaaacccagacactatagtggatgccaagaagtgcttgcttccaggagcctgatatagctgtctcctgagagactctgccagagcctgacaaatacagaggcagattcttgaagccaaccattggactgagcatgcagatccaatggaggagttagagaaagaactgtaggagctgaagggatttgcaaccccagaggaagaacaacaatatcaaccaatcagaacccccagagctcccagggactaaaccaccaaccaaagagtacacatggagtgatccattgctctagcagcatatgtagcagaggatggccttgtctcgcatcagtgggaggagagatccttggttctgtgaaggcttgatgcacaagtgtaggggaatgcctgggtggtgaggtaggaatgggtgggtgggtgggtgggggagcactctcacagacatatggggagtggggatgtgatagggggtttccagagaggaaactgggaaaggggataacacttgaaatgtaaataaataaaatattcaataatgaaaaaaaaaaaagagttggagcatcctatgtctttgaaaccttgagtttccatagaaacaattgttgataaatttataacatgcttatcaaattttataacatgtttatcaatttataacagttatcgaaactaagaagaggattgagagctctataaccttgtaaagaagggaaaactaaggctctggtaaagatgaagagaaaatcacctagaggaggctgaaaatgaaatgtgctcaaattagaagaaaattacaagataaaattagaaaatgagggaaatgtacctttaaagcgttttaacaacacacggcaataataacatatttactggcattttagtgtaaaaacccctagttaatatgaaattttaaaatgctaaaccatgaaggaaagatatgactcataaaattaaaagctaagaggaggataaagaggaaaaggactagttttatagatgaatgaatataggtacattgtgacttctaacaagactgcgggtcctgactgcgtccagagtatctgtctgttgatttcttgtgcaaaaacatggggtcttcaaaaagctgttagtactgctctctggattctctcagcagatcctgccttctctggtatattggagggaagggatatgatgctgcagtcattttggtgctaatctggtagggccccacaaaagctggaagatatacccaaattatctccatctgtatgtaaatgtaatgcattcataatgagagctaaaccccaaatgtcttccacttttacccagctttatcgattgcatgccatataataaaaggagatttataaacagcacagaaagtcaaagagcatatttgcactataggaagactccctgaagcatttacacaactgccttcctgtgattcgcatttgacaaacacgatcttcagcagatttacatagcatctcctgagtgtgctgttgcactgcatttattaactgccttatagacactctttaacatctccccggctttgcttaatttcaaaatattaaaaagtaagcccctgacacgctgacagcagtatcaataataatgaagtatgtttcttggcttcttccgaagagcttaggtaacttttactatctgccaaagatttgccagaaaatgcagtttttagtagtctcatcgggctttcacgaggaatctgttttcctagagctacagagagaactctcttatcaacggggaaaaagtggcctatttgatattacggagcagattcctggcaaaagactgcagtggggaactgtgggcaggattccctgggagagcctggcaagtgagtccctcacagagccgcaaaggaggcaggatgtgcagtggggagggagagggtcgcagtgtgcatacagttgggtacacagcagactccaccgatcctgcaggaactctaaccctagaggccctacggagatcccagtgaagacagattctttttttaataccctattcaagcaacctgactcagctgcctatggaggcttccaagcaagcattacacagctacagaaagtatccagagacaggtttcccaataactgattactttgaaagggtgtattttttttcctccctacaaagacacattttatgtttagtgtggttggacgttagaaatctaagttatgcatttcatgttccgttctggtttagctcaattacggtgaaacaacatttcacctggaaagcatcagtttctctatctagtgatatttttgaaactgagttgatatatcagcaggaaggttctattttttttttctaacttcttggcatcagtctctgtacacagtgagagaataacaaggctatctttggattcactgtggttctataatcttgtttgaggtgcttctttttgttatgaacaaccacaagagaaaaaacacacggaaaatctcttgagatacttaaaaactacttaggtctttgtctataaatattaaatacctttttattccatatgtttaagtatacaaatgtaaatgttaagaggataagataaggaaccttgtaccagatcaacatttagaatacaaatttgtttctgatgagcatgagcagagcacacttttaataccagccctccgggtgcaggtggacctctgtgagtttgaggccagcctggtttatgtagcaatctctacgctggcaagaattgcacaggcagaccctgtgacaaaacaacaaggaaacaaaaataaaaaccatttactttgcacatttcagaatgtttagattgactgcagtttagaagaaaaattttactttgttgtaatacgaatttaggaatttcccccacccctgtttttcaattacttctaagaataaagtacgctgctaggccagggactatgagtctcttctcaaagatttcatagcacagtggctgcaatgggtgagagaaattcataatatgaaaaactaagatttcttttacatatatctctacattattgttgatggaagaatttttaaaaattgactttaagaaaaggacagtatatttttattgattcttaaaattttcctgttaactagtaaaaaagtaagttggagacatttaggtttgtgaggtgggactgacaatatccaactttggtggcattagttcagcaacacatttaaaattacacaaattgatacaggcaattagtgatagtcacaaatgaactatttgaaacatgcctgtcaaacattttacagaccacaatgcaggcatagcacacattcaataagtgtatacaaatcaattataaaaatttgtgtggcacaacactttctgaacagtaacatataattaattgcagtttaaagcactcaacaaatcttgaaatccatcaacaatcctcaggcccgctgagtgcttctgaagtctccagcagtttgtacaaatgaaatagaaaattaaacatgaaagagacctgtctccacattgagggaggctcagaatataaccttggcttcatccattccagtgcacacaaactcacacaattatctctaatgcttcagtgttgctggatgggagagcacagggtgggttgcaaggtgctctgtgtcctctcgcccaagcacaggcatctctctctaaggtgcagacacagcagcagcccatcactaactatctcttcttgaccttactttctagccttttggaactgggatcacgactctgtaaaaggtctctggtttttggttccacatgagaagctcatgaaacttattcataagatactactttgtgttttcattctggagttacttagggagggggggggagtcagaataagaatcaaattaatcagtactactgtaacagtataagttatagacagttaagcctattctgtacgtttctatttcatgttcatagcatctgtgagatgcacccaagttacaaaatgcctaacagacaataaaataactagcaaattagtagttcagaaatttctatcatctatctatctatctatctatctatctatctatctatctatctatcatcggtctgtctgcctgtccatccatccatccatccatccatccatccatccatccatctataatgtgtgcatgggtgcagctgtgcatgtatcataacagatatgtggaggtgatagggaaacacttggagttcattctgtcctgccacctgtgggatttgaagactcaactcaggtagttcagatgtcacacaggtgcctctagctagtgaggtatctcatgaatcctcacagttaagtttaaagaaatgattggaaccctaagataaatgcagacaatgaaaacctgtattatgaagtttgagagaagcaagaattttataaaaagacaatgtaaaaaaataatgtagctacagagaaaccctgtcttgaaaaaccaaaaaaccaaaaaaaccagaaaaaaagtaatgtaggaattaaaatgtcatctgattataagataacaccacataggcaaaacatatattagcaagcccagctgctatcttgaagatacatccttggccctctgtggacacagcttctgtgtgctgaccctgaggaaaccatttctagaatgttttacctcacacataatttcctatcacagataatttctcagcccagacactgattgtacctgtaaagcaaatgtttaatttcagtggtactgatttcttgttaatcatagctgattcttcaactgcagctgaccagaaactacatattattaatcaaaaatatcataaactgcctcttaatagaattcctatttttctctgaaactccataagatctgcttccattgtctgcattgctcttagcattatctttcaagttcatacagaacaggccattaagctttgagctctcagcttttctccttcaccttttcaattcctgtagaaatttcaatgtctgtggaaaatcaatgctgtaagtcacaaactctgtcagaaaaatgctgggattttttttttaacccaaagcaacaagcacccttcacaatccctcgttaagcaatataactcaagactgtcacaacaatacatcatgatcttggtacccaattttgtcaaagttgggctattttgctgtggtaaaatatcatcgtcaaaacaaggtggaggaaaatggtttctttggaatactcatcccagtcccagttaaacatgaaaaggaagtcagagtaggaactcaagcaggatcctggagtcaggaactgaagcagacgccatggacgagcagtgcttactgggttgttctgcatggctgcctcaacttgcttatacaattcctgaccatctgcccaggggtggcactgatcacagtgtgttaggccctcccacatcaatcattaatcataaataaataaataaataaataaataaaagaaaaaaagaaaaaggaaagataaatggaatgcaatacagacttgcctttctttcagactattctgaagaaggaatttccccagttggcacagtgtcttcccagatgactttatctcctaacaaaagactaaccagtacagaagcttatatgaacgtatattttgtattaagatttcagacaaccatggggagaattgcactgagaaagaatcccaaagagtgaagaggaaagtgcatagctggagtttatagtgagtctgaaaacagctcaggcagggcttggtgctgatgaaaggccagtgccatataccgtctgtggaaaatgaatgttgtaggttactgccacagtctccgacccacagagacaataatgacacggacaccaagtgggggtcacgcagcagcttctttacttgcagctttttcacttccagctctctccccagctgcttattcttcccccgtccttcttgcagcaagcgctatactcctatactcacggcaactgacctcatctcgctccacaccacctcatccaatcagaatcacactccaggcacgagctcaggtgggtcacagataggctgacagatctgggtcacgaggaatagtctagcttggcaggcagcttacgcatgcagttttattgtgcatgttcgggcaaggcagtaaacatgtggggttcacggggcctggcaatgggccaggatgccattttggctcatgaagccacacctgcttcccacatctcctttttgttttattagtagctctgggatcagcatttgtcttaggtcgccccatccatgccacatccttacctgtcatgggagtcatgaactcactttcgccatcctgtcttaggttggtatgcacacgtgagggtcttacccgtcattgattactgatccagcattttgagccaacattggggggatgttcctgcttccaagactgccatagcctgaactaaggctcgtttatcagtcctgtgccacctttgcatgtgtgccatccaccaaagcattcctccacaaacaacagtcagcaggagcgcccaaaaggccatgcctccccaatttttttaagaattccacagttccctggatgatatccagccattgtttgcagttgcaatctccacatgggtgttgttcacagcaacaaccaatgctcgcaattccttcatctttgtgttgagatcatgactccaatttcctagcagcaccacaccaattgcacaagacagatttgcagctctggaaaaattctgatactgaacaaaggttacacacattcctgacatatgagtaatgcaggaagcaaatactaactgctccaaaatattcatctgttcctgcaaccaatccattttttggttaaccataaggataacagctttcaaatttgtattccagtggagccaaagccccgatttcctcttttcagtcccattgaagggaagctagcatggtgactaggcaaaagcaaaatttgagcaattgtatctccaggggcaatggtagacacccctctgggggaggaaaccatgattaacctatccctcatagtcaggatcaatgacaccattaatcccttaatggctgctgaactatgtcctaataagaggccaactgtgtttttaggcaaaggacccttaaagtctgaagcaatcatctgcacacccatttctggggttaatatgagtctggtggtggcgcagatgtccagtcctgcacttcctgttgtagctcttctggggacacccatagacgattgcgctggggaatgtgttgaaggttcggccacggtgtgggagtctgctgcatggccccatatatttgagggccctgaggctgggggccccgcactctgtttttaggagtgagaagttagcaggcaaccatctacatcccacttggattgacattctccaacccaatgatttcctttgcaacagcgaggacataacttgggctgccacatgcctgtctgaatctcctgtcttcctttgttaggacagtctcgcttgaaatgacctggctgcccgcaagagaagcatccccccttgattccctcctgccatccaccctgatgaggaatctgcctttgagcctgaactatggctgctgctaacccctggttggtcagtggagtgtccaccacatctcggcaaacctttagccatacatccagtgatttgctcttataagggcatatggtgtctctgcagggtttattggcttgctcataggctaattgcttgaccagtggcattgtagcatcaacatccgggaatactctcctggctgtctccactagtcgtgctaggaagtctgcaacttctcattgggtccctgtatcaccctagacaagctggccccaaggtctccagtgcctgatagcatcttccaagctctaagagcaaagttattaatctgctcataaacctgtataggataacctgtttgattgttggcaaaattcccttgccccattaacatgtctacattccaggctgcattggggagtccagtggcagcattagctgcagcctgttcaacggcatgctcaatataagcagccttccatgttaaataacctcctcctgaaagaatggtcttgcagaggttctgccaatcaaaaggcatcatacagtacggctgtaggcactcaacctgagttatggtaaaggcagcctggaccccataagtcaaaactgactccttcaatctttgtacaaccttccaatccaggggttcatgataccattgcccctgttggtcctgaaatactgggatgacccctgcaacagcgggcacatttttccagacttctgcaggaagactatgctttccccttttgtctccctcatctttataggggtgaggagaaggcaacggaggggctgatggttcgggcggcctaccacaactcaaactccagtgggacatctgactacagacgccactgtcactatcagtcctggcactgtcactagtagacccctcagagctagattccttcttctctttcttatctttggtttgttgtctaagctgtttaggttttcggctgctagcctgagaagcaatctccttagccccctcaagcgcctctgctccttcctctattttagcattgtactttccactgctgtccctcaagcacgccctgaccaagactcagatggttaacatttttactttcattttagtcgcagttgaacccatattaccgaaattgccttcatctctattcctgagagtcttagtgctccgtccccttttttccgggcacctgacaggcctgtgcttttttaaattcccttcgtctctattcctgagaaccttaatgctccgttccctttttttctgggaaacctgtctttactgataaagcagtagctgcttaccaaaatttccctactgctgcttactaaaatttccttactgctgcttaccaaaatttccttaccactgcttactaaaatttccttacagctgcttactcaaaatttcaaaggtctgtactttctttacttactgttgccaaccaacgggatgagttccccgtacgggccaccacttgctgcactctctgacccacagagacaagaacgacacagacaccaaagcgggttcatgtagcagcttctttacttgcagctttttcccttccagctctctccccagctgcttcttcttcccctgtccttcttgcagcaagcgctatactcctatactcggggcacctgacctcatctcgctccacaccacctcatctaatcagaatcacacacgcttcaggcacaagctcaggtcagtcacagataggctgacagatccagatcacgaggaatagtctagattggcaggcagcttacgcatgcagttttactgctcatgtttgggtaaggcagtaaacatgtggggttcacgggacctggcaatgggccaggacaccatcttggcccatgtggctgcacctgcttcccacagttacaaaccttgtcagtaaaatttgtagtgcaatggagatgatggagaagtgccaactggaacagatgtcattcccaacttcatatctccaaatgcttgaggatttaaaatcggaacataattttcacataaacaattatgaattgccagaattagggatttgaggagaaggcctagagaaatcttgaaaaataaagacaaatgaatgtttgagaatctaattttcacaaatatgtgatggtatagggtagactttctatccatctaaaatatccctgcaaagttatagacatgggtgttttcataccagcctgttgcatggctaatatcctgcattcattcttctgggatgtggcgcatcattgagctgtttgacaggaattaggatggatcgtgtccttggcatctactatggcctttgtataaccacatttcagagaccttactgtctattgtcatactacttaccatctttaagtcaggtacttgattcctagctgggggggttcctctttctttagttgtaatgtatatgtacttcttgacattcgccattgaaataaatcctatttactttatcctctataatttgctgaggtctaactaaaaaacgaacctaatttcatagctgaggttatcaataaatatttattatgcattatttatatgtatatctagtctcatgcccagacaattttctatattgattttagaagtaatctggatttagttgtaattctttggataaccaggataagagatcaaacttcattatagtcagtcccttcagcccacttggtggagatcccagctctcatctcataagctcactgtgtgattttcatgatagagaattataatatggccaaaaaggctgtgaaaatatccaaagaatattgtaaaaatataatattctcatggaggaagttagatataagtgcttcagcagagattaaaaaaaacatctgaaatagcactagcctcttcagtgaagagtacaacatggagcattgtgaagtccaaagtcctccatgagaaaaagaaatgcaacctacatagacaaaatcagctctagatttccagagttaaaagttggataatggaccacacacatgaggccttattggtcattcagtaatattacttacttactgcagtcattctttctacatcacaactgataattcatttgtgactttaaattttacagctttggaaaatgtttttcttgtaaataagcctccccttactgcaaaatatgggatggcttttactcttaacaaatgaacatggtcaataatataacagtagagattttcttttttaatttattattatttattaattattctattcatttacatctcaaatgatatttcccattccactacttccctctcctccttcccctttgctttacgagagtgctcccccacccacctaccctctctgtcccacccctccatcatcccctttcactggggcagcaaacctccacaggaccaagggcctctcctcccattcatgtcagataaggccattccctgctacctatgtatctggatccatggatccatccctgtgcactccttgtctggtggtctagtccctgggagtactgtgttccattccgatgacattgttattcctatagggtagcaaaccctctctgcttctctcctagggtccccgagctcagtctgatggttggctccaagcatccacatctgcattggtcagttgttctctgaacctcccaagttgcagtcctcccaggatcctggatgccctggtggggcagtccctggatggcctttcttcagtctctgcttcttctttttcttttttctttcttttttttttttttttttgtccctgtttttccttgggacaggaacatttctgggttgaaaactttgagatgggcatgtggctccttcccaccgctgggggccatgcctgtctcctggaagtggtctctacaggttctatctccccttctctgttaaaatcatcccctttgagtcctgggagcctctcattttcctggcatctgggacccttcagtggctatccccagttcctcaaccctgctgctacatatttttattcaatttcctgatcctctgtacctcttgcctgtccccttcaatacctgatactgcctccttgtttcctccccttctctctccctcccaggtgccccctccctctacctcctgtggccatcctgttaccccctctgcctgactgaagcatccacactctggtcttccttcctcctaagctccctatggtctatgggttgtacaatgggcattctgggagtttggaataatatccacttctcagtaagtacacgccatgtgtgttcttttttgtctgagttacctcactcaggaagatattttctagttccatccacttgcctgcgaagttcatgaagtcattgtttttaacattagagattttcaatgcatataatgatcaatattttcatcgggaatgtaatatattatctaaactacatagaacaaggctccaaacgtcagagcaaatgtactatcacacaacagtgctaataaacaattcctaattacattagctcttctcatatctgccgagctgggtctctaggaccattgctgttaattctgttgtactggatcatgccaaatctctaggatggagaagccaaaatggggcttatacatgcatgcatacatacatacatacatgcatacatacatattactataaaggcaatgtttttgagttgctaattattcagtagtcagctttcatttggatacttacaaattgggctccccaatcagcaacgtttagatatctgcttgtcaatggaaatccagtcaagacagggctgacagccaagcttaattgcttagtattgtcttgaagaagatataaccaagacataaggattattattaatattataattattatttccaaagactcggtcttgcaagcattaactatgtgatttttattttgataagcttttggttttcagaatcttgaaataacaatttttgtatgattagctagactgaagaaattcaagtaagtctggtcttaaaacaaagttgtaaaatgtagacacaacttacatctctaagaaattataataacacctactgtttgaattaactaatatctattgttagtagagtgaaatacagaaatgatttatgtaaagaattataatattctaaacttacatgttttgaatagaggatactaagtaagggaagacaagtggaaatgtaaacattataaaattctccaaaacgaagaaatccataaaaatcaaactacccttccagtgcttgaatagtaataaagtaacagtattttcaatagaaagatccataagtaaagacatctattgaatgccatagatttactatgaacagtcagaaataattaggacttcctggtgaatatcacagaaactagggttggtgtctggttcagtttggtcaggatggcttctttgggttatagtacttttttataaatgagagaaagagacagacaaggtgggagcaaagaagagggagagggagagagggcggagagtaaaatcttataaatggaacagtttttaatacataatacgtcttttaattcttaattcatatcattttgtttcaaagtatttgtagaaataaagctaactcttaactgataatttataatgggaaataggcaaaacctctttatcctttttgatattttaactctataactaattgatcaatagagcatattgaatttcacttatatctatcactttgccttaattgctaatcctgccttaagttggtgcttgtaatctatgctaggaagtgcaatatcatacttctaattggcattcttgtttcctctatattcttccttcaggccacctttcatattacctttgaattatctctgtaagagagaattccatttgcccctctcaaaagcaagcaagacctggacaaatcttcctgcatgccttttctactatgaattcttgtggcatgttcaggattggtagcccatactctcattctcattctatcttttctttgcagtacattaatattaacatatatgttgaaagtcctgatctctgatttaattattgacttattattgccaaggcttcagccttatttcaagtggtttgctcttccagaatggtgatttttgtgttgaaatggtcatcaaacatgaaggttaaatgggaggggtgggggcaatttggctatatatatatatatatatatatatatatatatatatatataattttttgagacagggtttctctgtgtagccctggctgtcctggaactcactctagaccaggctggcctcaaactcagaaatccacctgcctctgcctcccaagtgctgggattaaaggcatgcgccaccactgcctggcaatttggctatattttagtttagttatctactctgaaaaatccttggttatatacctccttttcatcacctccattatctatggggtctttatcccttgatatacactctgtcacctgtcttctctatacagccaagtcttacctgctctggagtctgtctcctaattccatactttctttgaagctctgtcttgtatcactgacctcattcctttcctgtggatctgtttgcgtgctactttatatgtctaccacagtgctgaaacctttctccctgggagtacagttagctctcaatctcctgttttctatatacctctgagaggttcttgaggatgcaagccttgcctgactttattcccccatgacaaagatgaaagcaataacttcacgaggaagaagctggctaagcctatcagttggatgggtcgatatttccataagtatcttctgaagcaatatttttgtgggaagtcagtgggttttctgtaagaatgaagaatcctggtcaacttagtttgggaaatttggttgaaataaaaagtaaaaaccctctttctttttctgacatggttatccgaatctaaaatgctaatgtttgtttttctctgtgatggaatagtagtatcgaatactaggatgtgcctagtatttccaaactatagtggctacagaatacgtttttgacagattgtcctactacactagcttagaagatctgtatggctcatgttttagaagttggaacaattggtatctccccagtaacaagatctagaagggttgagttaggaaccccctctttacctggatttgccatgcagagatgctctgatctgcatgcagctgcagccattggcttaggctgcagaggcatctcagcatacctcagcaggacagtattagaagatttctaacatttagaatgttgacattgtaaagagttacagaccattcctgattctgtaatttatactagtatattatgtactgtaataaaatttgtacaatccaatattgttactttattgctcttaccttattcatgttgctcacaaatttcgcatactttctgtggcatttgaggattctaaaaccatacttttatagcacacaattgtatgagctctctaaaagaatggtatgctattgctgagaggcaaaatgacatatgacttaaagtagctcctttttaaaagaagggactttgttattttctaatttcaatatgcatgtcagtgatagatatgtccagagtgcagttcatatgtgattccaccaatttcttagtatttaatgtgtacccattttttctcctgaaatcagcaccttcagttattaccaggagttggcttgaggaactatgcttcggtttctatcattgccttcatctctaacagtctttaaaagaattgagcttcaccctttgtagtttcctttagcttgaatgctatgctgtgaacacagcaggtcctctaaagatattactaggctgactcccaaggaagtaagcaccttcattaggttttgcaggcatatgatgataggtagagtgttgttcagggtggtgggcagaagtaccaatcacctggagaccagaaacataattcaaaagtccctgatgagtaagaattatatatatatatatagacatatgctggtagaatagaaggggaataatgaggatacaagtgtataatgagtaatgaggaaggagctagacctgagtacctcaggaaaataaaaggaaaagaaacaaacagcaaaaagccccaatgaatcactaaagcatccatgagtcagccataaaatgttttgaaaaaacacaagactttctctaggatctgtcaaaggactataagaggcaacattaatgcttgaggaccatttcatataaagtttggcaactgagatgccttaaaatgttttttgagctaaagaattctaattcagttgatatgcacattgatatatgactgaaattcaagtattcagtagactactgagaaaaaggatcactatgtgagttcaaggccagcctgggctacaaagtgagaccatatcttaacaagagaaacaagtcaaaacagaaaaaaaaaaaagaaaacccaaataaaaacagacatacatacaaataaactaatcccttgatagatagttcaatggtgcaacattcctgaaaacttctgtgcccattaaatttctctgaatattgaaagaatttcctgacccaaactgagatctcagattccctgttataatatgggatgtaattaacatcaagtatcctttgtgtttttaaccataataaaatgacagctgcagatcttgaaagatatttatggatgatgaagattgaatgtcttcctgtccatatagtttctcagtctagagagcaggaattccatgtagtcaacctgggtgtacctctgatggtaaataatcactgcattttgaatacacatgttttaggattttaaaggcttataacgaatcaataaatttatatgactattttggaaaattcatgatgaacattaaataagtaaaattatttctgtttcaacattcattaaaacattttttaattaaaggtaacttttaaataagacatgtaattggagaaaactgaagcacgtagagttttagcatagtttttgacacattgtaaaaggacactctcacaaacttatttcattagtggggtgtggatataccaaaaaaaattctagaaccaaaaagtagaatttccctgttttatgtcacatagtcaaaacaatatagttggtacttagatgagaactacctcagcttcacacatttaaagcaatgataattaaaaaaaattacagacaagaaaaaaagaaaaacaacaacaacaacaacaacaaaaaacaaaacaaaactataatccagccactctgctgtgaagactcccaaatatcctatatgagctctacaactgttgaactggagcctgggtactaatctccagcttctctcggcttatgctccaactcactaaccctaacagtatgccattttgaaagagaatctcccaacatccatttgtgctccctactttgagtctagttctctgaagacaaataccggaagcagtctgagatacaagtgggcaaaagacttttgtgagactactgagaaaggagaaatgcgcataggaaggaactagccactgtgaaattattagtagccattggaagctctacatgggatgataactctcaaactgccagtttgagaaaatggctagtccattaatatttctgcctttctcagacattagatatgaactttcctggaagggtatgtccccagatgaagtagatatttgtaacttagatgctgaagaaacagagcacttgaatttctgcagtcacaaagccaccgttggaccataaaccctctctctacatcttgctggtgcatctccttatctgtcctactgatagctcgagcagaggctaattgtcttgaagccatggtgttatacatcttttattcaaaggaattaaataagaaagtaaaaaagaaaataagacctctattttcataggtaatagttatttagtaatttatccattcatcttctctatataatggaaatattttttaaaaggaaaaatatcaaagggtaaacatctctctctctctctctctctctctctctctctctctctgtgtgtgtgtgtgtgtgtgtatgtgtgtacttatgcatctgtatactggaggcctgagaacatggtcttattgagaagttcatacatcatcatagtagtgttattatcagaccaaatcaagctaagaatgtcaatgaataaattgattgggcggtctgttctctacagatgatgggattaaattcaacattaacagtgtgctaaaaaaaatatgttttcaaatggatgaaccttgagaacattctgctaaatccacaacaaaaagacatactataagattgccattacattcaacagacaaaattgtcaaattgttggaagaaggaagtcgaacagtgactacccatagttagtggaacctagagggaagggaactgtgtttaacaggcatagcacagttctacatttgctaaagcaaacctcctggagatttgctctcagaaatgaaactttgatctatatgtttcaaaatggttaaaatgttttttttgtgcatctgagatgatgttaaaggtggtgagagagtcaccctgaatgagctgggtacatcttctctgacatcagtccttgctacaatgggtgcagtgagcaggagacaatcagtcatagaaagtatgaagataaaagtaagaaattggaatgaactggataaagtagaatccaggaggttctaaaagttgaaagagaaaaatacagaattcattcttggagcttctagaagaaagttgtcctgtagatgctctgacttaagcctataacttctcatttcatgaagtcagagtaagagaaagtgataaattaactttgtttgaaagtagtaactctgtgaggacttgttatcagtaggaaactattgcatgtgcaaaagctttgaggaaagaaggcctttataaggagtccatggtaactctagttagcagaaggcaggcatactcttctttgatgtactcagaaaagggctgaatcgaagtgaggtaataacttactcatttttccctgaaagaatagaggttgatttagaaagtgttggattccccagtgactatggtaaaactgtttcctaccagcttctgtgcacatctgttaggatttccaaatactgctcacatctagattttttacattttaattgaaagaaataaaattctttccataagcatgttcacatagattgcttgaaatttgattaagtaatgtcaacccaaatttaggatgattttgtatagctctatttatactgatattctgaaagttgttgtagttgtactctgctttcttctaaatgacaaatataccccaaagaggaccatgaaaatgtcaactgttgtcacttgtccaatcatgttatttcacaggaacaacttatctttctttgtatatttttcaaatggagaaacattatgatgaattgggtttagttagatctgtgccacccttgttaacactaaattgtatctaaatctaatatcactgggagatagattgtatatatccactgaattgctgccttagcaaccactgtgttatatatccactggattgctgccttagcaaccactgtgttaagattcttttccttcgggaagtgtaaacatcttatttcatgatggcaattaatatccatagtctaatacagaaatacaaaggcaagacagaaagaaaaaaattataaaaacatgctccttatgctgtgtgtgttattattttgtaggcattaatgaaaactgatactaaaaccaatagattttttaaattctaccttactttcattatagactaacaatgccttctaattttcccttctccgtggaatagaagccctcaaagcattattgtaaatctgaacagatgatgcaaaccattttaaagatattttatgataaaacttgtggtatagcagttaatgacagaagagggtagaaatgccatctttaatgtgacagtttagctctatgagtatgtgattgaagatactttttcttcttttgttatataataattccattgctatgtagatttgcacatagattcttaacatttctctctagttttattcagctccattagaaagtatatatctatcagttttctattagcataaaatacagatcttttatgcctcctattaatgggtaaaaggcaaaacataagacttagactttatgggcacagcattctcacatggatatgtagcatttttaaagcaacaattttattgcaacacttttaagtgtaggatttatttaagatctttaataaatttcagttttatattaggacaataatttacttttactactcttatctaaaataaaccaatcaccaactcttgaaaaataagatttcctaataatatatcaacatactctaaagcacagaagaggtggtctctgatgtgagcataccagcctctttcttcctataatatatgactctaaaatatagtttttaatatgtaaatgatatagataaacttttatgtagctagtttaataaagactgaaagttgttttttgagttttaattttaatcaaattctgtactgtcagaaatttgtagttacttctgaatacagtatgtaatgattctattaatagaaattaatgcttcctacctctgcttaagaaccacagtacataatggttcatcatagttatcaacttcactgggttgaaaagtgccttataaatgagttaaatgattctgggtgtgtctgtctatagagagaattccaaccctgaatgtgtgtgtcccataggttatagcaatgagtgaaataagatggagtcaaggagatactgcagtagcaaagatatattccacatttcctctctctctctctctctctctgtctctctctctctctctctctctctttctctctcttcccccctctttcctctctctctcccctgtctctgtctctctccctcactatctctttctctatctctgtgattctgtgtctttttgtctctctgtctttctggatctgtctctctcactctctctccttactaccaccattgccaccatgtttcttcaatgtttagatgtgagctgcttttttttactgtagtgttttttatgcccttgtggacggaagtcttaaaaattgtgagccaaaataaggaagtctttctttaacttttcattttatttgcttttaaagagtctctgtgtatcccaggctgaatttaaaactattgatcctctttcctccactaaccacacacttgaaatacaggaggatttttatgtcatgtacgttgtcagagtgatagcagagtgaacatacttttagacataggaaggtatgtgagtctggtagtgtaaatttcaagctaaggggttttgttttgttttatttgtttgttttttaccacatacagtattttctctacaacactttaaaatatctatgaatatgtatttttctctcccacagtgtcaattctctaaagactcattacacaccaagcactgttaatagggtccctgagggagctcacattctagtagagagataaagctgtaatcatgtaagaaatataatgtcaaacacccggaggtgcttagagaggacaaatgtgatgggtaacgcgactgctgaagagtactgctgttatcgatggtcagggatatcaaagtctttctttgagcatcttgaaggagatcttgcttgggatttcagtagatagatgataaattccacctaatgggagctctgagaaagactagcaagcacgaaggcactgagaagttattgggagattagtaatttttgagctttctatggaaaagagagaaaggctgaagctgaggctatgaacttgaaccagattttatgatgtcatgtaaatcttgggagctgagactgtaattggattttgaagtacctggaatattttaagcagataaataatgagattttaactgcactaaggaagatgtctccaaggctgctcattttgcttgttagcactcacagtcatgagtgcccgaggtatgtcaacattatgcttataatttctctttatcaacctcctcccctccagtcccaccatctccatttcagaatagaacgactgatctattttccctaccttcctgctcccaatccctgtctttcctcatctgctctagatttgcccctttgcaccgtcttgacttgaaaattcacctgcttcccaacatttctatgttaggtgcagcatccctgtgaagacagatcaagaaggaagtctggtgatttgacaccagatgtcaggaggtcagggaaggtggattagctctgaaatattggcatgaagaattgaatttttcaaaggaagagatttactgttgagaaaaatttaatcttgagttgatacaaaaagtaaagactcaataatatcatagggatgaacagcacccagcttttctttactctgaatcctcataaaggatataatatctttgggctaccttggttttgaaagattggatcctgaaaacaaatcgtgatcacgtaagtgtgggtgctgtgtacttcagaaatgcttagcagtgggattctgcaaacactgaagaaaacattagcatccatttagctgccatgggaaagatccaagttaggttttaacttcatttatatctgggtcagtattgtacaagtcagtatgttattcaggacactgcttggcctaatggaaatgatgtcagacaggtttgtgcatcactgggtgataacaccctagaactctctgtgctgtaagtttataccacagtgattaatcctgcatatgggaatgacatacggacctggtgtccccttttactcacaatcatttgtcaacgtagctttgtctatctctgactggaaataaagggccatatttggtagtcaccagatcctactgaaaataggtcattatcctttgctctgttctcaactttccttgtaagtatgcaaaaagacaacaatattaatgtaaatttaaggctgtaagaattaatgtttttctcatctgtgggtcaagcatattcttggtctcatctctggagtggctgtgcacctatatagtgttttctactcatggccgtttccatgacaacaaggaaagcaaccattttaaaagggaacaaaatggtcaagacagtagactgataggtttttgctatcacaaaaattattttccatgtaaaaacagagctttaatgttttccatgaaatgatgtagtccagctaggtcaagaaggaggcttgcttcttcaagtgtcatcctagaaggatctgtgctaactcctggtattcatcatagcaatgttgcaggtgtgccagcaaaatattcagccactctcatatcctgtccagaaagaggtactaaggtgtccagggtaaaaaaaaatgggattgacttagagctgaatctcccactggattggtttttgacaaaatctcctaaccttgctttcaggattttattactaaaacccataacattaatttttttcactttgaatgcatacaggtggtgttgaatatactcatatttcatcgtagatgcccagagcatttctctctttaaaatatccactccgcagctctcttttcttccccatcccaatctctactaatctgtgatctgctttctctttctatgactttgattgatactcttggtccctcacattaagaggatcatataacacatgtctctttgggctagcctattcaactttgcacaatatatacaaaatttatgtatgtgacaaacattttctttaaaagtgattaacattctactatacttattacactacaccacactttcacatgctgagtttatgcttaacttttcacaaagcaggaaatggtaagtcattttttttcctcagggcattattgttatcatccagtgaaaactatgaaacactacagatctatttaccgctattatttagagagctatactcaagtagagagggtgcttaagatataaaatatgaattcatatatctttactgtcattttttcttgttatatgcaagtaatctatttgctctggggccacgacatattatctatgttatcaattctccgttacctgagtaggtgtgctaaaaagacaggagaatcattcctcagatatgtgtctgaaattcctcaagtcccgatgctgagaccacagccattatagatctcacaaagcctcattcttccgatctttaatatggacagaagctatgccagaatcagttaaaaaaaaaaaaaccaaacaaactgatgaacattttatacctttgaagttattatatttaaaaattctgttactaaagctaaaattttgttgtattatagaattctcatttcagatattccaaccacttccttctttcttccagttctaatggcaacagaccccaattatcgtagactttagtcatctacagtattgaacctgacaagaaccagggtctatttgagattattatcccttatatttttggatccaaatactttttttttctgtactatctaggtaccaaataagagaatgactttaccactaaggacctgtaacagtgcagttgtcaaggtattaatagatacagcaataggtattaagaggtaaacattttgaaagactccaaataataaatatgctgataaaaatttaagttatactcacttttcttaaagttgaggaaaacaccaaagcaattatcagaagactatcacttcaaatattttattacctatctagacacctgataatgtaagttattgggcaaagaagcaagcagagggctcatccaataccttgatggccctcagaaatttaccacaactcattcacctggacataatattcactccaggcttgtgttggggatagagtgagtgaaagaaatcaggaagtgccaacttggctggatgagagaattattcagattaaagttagcttagttgtacagccactctggaaatcagtctggtggttcctcagaaaactgggcatagtactaccggtagatccagcaatacctctcctgggcatatacccagaagatgttccaactggtaataaggacacatgctccactatgttcatagcagacctatttataatagccagaagctggaaagaacacagatgtccctcaacagaggaatggatacagaaaatgtggtacatttacacaatggagcactactcagctattaaaaacaatgaatttatgaaattctggggcaaatggatatatctggagaatatcatcctgagtgaggtaacacaatcacaaaagaagtcacttgatatgcactcactgataagtggatattagcccagaaacctagaatacccaagatacagcttccaaaacacaagaaaatcaagaaggaagacaaactcatggatacttcatttctccctagaatagggaataaaatatccgtggaaggagttgcagagacaaagtttagagctacgatgaaaggatggacccacctgggggtccatcccataaccagccaccaaacgcagacactattgcatatgccagcaagattttgctgcaaggaccctgatatagctgtctcctgtgaagctttaccagtgcccatcaaatacagaattggatgctcacagtcttctataggatggaacacagggccccgaatgtactagagaaagtacccgagggctgaatggatctgcaaccctataggtgaaacaacaatatgaactaatcagtagcaccggagctcgtgtctctagctgcagatgtagcagaagatggcctagttagccatcattgggaagagaagctccttggtctagcaaactttatatgcccctgtacaggggaaagccagggccaagaagtgggagtgagtttgtgggggagcaggacgggggtgggggagggtataagggacttccgggatagcatttgaaatgtaaatgaagaaaatatccaataaaaaaataaataaagtaagcttaggatttatgaactgttgtttgattttaaactctgtaacaatcttgccagtagacacatgacttcatcacaagtctataaggtagagacatgaaacttggaaaacttcagttatccaccaagcaaattctaaatgaaattcaagtcctaactgccttataccacatccaggatgtaatgctcactgttctccacagagatctctgtcaaatgccatccttgaagacagaataactgtgatcaattatgacatagcaccccaccattctccacctaaagtcatattcccgtcactgctcaaagcacttcgttctagccatgactcttatccccagaaacacttcccattagtgggcatcctcgtgcacacagacttttcagacttggaaatcattacaggagtttaaatatgctccaagctcatactgaaagggttcctctcctaatgatgcaaatccaccagagtcgaccgtatgaaaaagtactcaccaaaagtactgagagtgctgaatatatttgtacattccaaaattattcacgcaaagcacatttatttttaagaagtttcttgaaaatgccttttataattgagtatatggtaatgataaacttaacgagatattccagttctatttttcctacaagttatcttatgtattatagattgttatcatagttaaggtaataacttcaaaagtctatacagtaaacataattttgcatatttatttatataaacatataaattatatttgattattaagataacatagagtagagttgtatgtactaagataacatagtagtagagtatatctagtaaagaaatatttgttagtctatttaataacttaaaaagtgtccatataacataaagtaattaatactttttatcaactgagtgagttttatcaatagtaagaatttgtgtgaactttgctaagaaaaatggtgaaagcataaggttcagtctcacagttctcaacagcagatatacttttgagtcatctgagcaacttaaaaaatgccgtagatgtggccccagtttatcagcttctatgtagctgatatggactgtaacctggagaatgggagtttgaacaaattctctttcacatctaaggttaattacctctttcctaatacatttgttttcccctaaatggagcaatcctaaacacaatgtaagacaacaatgcacaaacaagcaaacaaaccaagagagactacttctaatccatcgcactaggaacaattaaggttccccttttgaaaagggggacagtatttgacaagatgatagctgattaaaggaaaacattcaacaaagcctcccatagtccaccatcccctgtcttataaaccacatacagatattgcttcagctgaaaaacatacagatctatactgagtctgtagacagtaatgactccctctgccatgtgtgtatgatatgctgccattcacactgcactgaatccaaaaccatggaacataatagaaaactcagcagagctggtcagttccaatttctttttcctttcttccttccttcctttcttccttccttccttccttccttccttccttcctctctctctctctctctctctctctctctctctctctctctctctctctctttctctctccctccctccctccctccctccctccctccctcccttccttcctttctttcttttttctttttctttttttttttttcgagacagggtttctctgtgtagccctggctgttatggaactcactctgtagaccaggctggcctcaatctgagaaatctgcctgcctctgcctcctgagtgctgggattaaaggagtgtggcaccacgccaggcttagttccaatttctcaatcgcaaatgtcacagaatatgtctcacagaatagtcttcttattcacagtttagtaacttcaagcaaaaggtgaaaatgaagccaggcttgatgtctcatgactgcaataccagcatcagaaagcaggggaaggaggatcagaagttaaaacaagtctggaaaacacagtgaaaccttgtccaaaaagacaagggctggggtttttttggtcagtggtaaaggcatctcctatcatgtgtgtctggcacctgcagaagccagaaaagagtgttggaatcctttgaaatggatttacagacattacagcttgtagtctgagtggtacaagtcatatctaggtgtccctcaagagtaccagatactttaaccactaaggtgattctccattccctgagtcatgtttctttagtcgagtttgctttaagtttatgttcacattgattattatgaaaataatactgtccaaatttcaggtttatttcttaaaatcttgtaatttccacacttcctttattgagccctttgaacacaatggtgtgaaaaactcaatggaggctactgaagatcaaagtcttgaaggatagtagtattgaggtacaccactgacagacagcaatgtactccaaaggttgttttgtacatgaagatccaagcaagatcatagcacaatgagtgaattcagacaagaccacaaaatggaacatccaactgagtcacagacttacagaaaaaaatattgtgattttaaatcactaattttaaaatgtggcttaatatgctacatttggattttttagtatttatttatttatttggaattatatccatgaacactgtatttgtacatagtttagtcatcccccttttccccaactcctctcgtatatctctcattatctctcaaattcttgacatttaaaaacatttttattaggtattttcttcatttacatttacagtgctacctcaaaagtcccccatagcctcccccttactcccctacccactcactcccacttcttggccctggcgttcccctatactgaggcatataaagtttgcatgaccaatgggcctctctttccagtgatggccgactaggccatattctgctacatatgcagctagagacatgatcacagtgggtactggctagttcatattgttgttccacctatagggttgcagacccctctagctccttggatactttctctagctcctccattgggggccctgtgatccatccaatagctaactgtgagcatccacttctgtgtttgctaggccctggcacagtctcacaagagacagctctatctgtgtcctttaagcaaaatcttgctagtgtatgcaatggtgtcagcgtttggaggctaattatgggatggatcccggatatggcagtctctagatggtctgtcctttcgtctcagctccaaactttgtctctgtaattccttccatgggtgctttgttcccaactctaagaaggggcaaagtgtccacactttggtctttgttcttcttgagtttcattagtttcaccaattgtatcttatatcttgggtattctaagtgtctgggctaatatccacttatcagtgagtacatatcatgtgagttcttttgtgattgggttacctcactcaggatgatgccctccaggtccatccatttgcctaggaatttcataaattcattctttttaatagctgagtagtgctccattgtgtaaatataccacattttctgtatccattcctctgttgaggggcatctgggttctttccagcttctggctattataaataaggctgctatgaacatagtggagcatgtgtccttcttaacagttgggacatcttctggatataagcccaggagaggtattgtgggatcctctggtagtactatgtccaattttctgaggaaccgccagacttatttccagagtgcttgtacaagcttgcaatcccaccaacaatggaggagtgttcctctttctccacatcctcgccagcatctgctgtcacctgaatttttgatcttagccattctgactggtgtgagatggaatctcagggttgttttgatttgcatttccctgatgactaaggatgatgaacatttttcaggtgtttctcaatattcctcatattcctcaggtgagaattctttgtttagcttcaaatgatttccattacatacacttgctatggtattctatcactgtgttgcaatagttttagtttctggagcacttgaattttgtgttttcagatttacaatggccaacctctacctttttgtagaacaggtgtcagtagatactgatgaatattttccaaagttgatccaaactctagtttgaatcttaaaggactccctgtgcagcaggcttagatccctggcataggatccaatgcgaaggagaaagacttcaggtgtttgtggtgtacacacacaggaaattgtgaactttgatatcttccttttagcttcatgggctaagcagaacagcttgaccctatcacatgcaccctgccactctgttctgcattaccacagaactaatgcaacaagattaattctgtgttctctgaaatgtgctaaactgtaataaaaatacaactttctgattttaaattaaccaaacctctgtgtaacaaactgctctgatgtatatttctgttagggtttgctccataattttaatcatcattagtactgttttgtttgcttgtttgtttttagtcattctatgtagaataatttaaatctagcaccatggctgctcgggcagtgaagtacatataagacctaggcctgggtgatccggcaggaattcagacacactacacatctttcgtccctctggctgcaatacagacacgcccttagtacatacatttaatctcaaaaaattgtaggtaaagttgttttgtagaagaaagcagccatgtttgaaattgatgtcttattgaggggaagacaaagtgacaactcagagaaagatttgatgaaatgaatcagagatagtatatgcctaattctcctgagaaagggcaggaaagagaggttatataagggagggaggaagggagggagggagggaagggaagggagggagggagagagagacagagagagatagagagacagagacagagagagacacacagagagacagagagagacagacagagagagagagacagagacagattgcaggagaagaaaatgttgctcattagagccacagaatgagaaaaaaaatcagaagattagaacagatttccagagttagtttgacgccaagcagagagattcagtcagaagtcaggagaggacagaatcagttactttggagaggagtttgggctagaacaggtgatgaatcactctgcttcctcccagcccgtttctctcttcttcccctttgtctgccctgtccttctggcccagcctcagttgccagttccttattctaccaaaatagaaaagaatcacatttcttactcatccaataatcaccaatcagcatcacgacagcacatggctcatctccctttggtgccttttggcattgagggccaccttcaccaagactggttgcttttaaacatgaaaatcttaaacaatcgtcttttgcacaggtgaggaagaacaagtattcgacgcccttctatggtattctatgacaacaccaaacatcctgacagcatttggctctgccagcacagcaattaacaattgaaaatacaggtacacacttacatagccatttgataccctgtgttttgagggtaggttatctcaataagttctactatggatctcttcattcacttgtaatagtggtattttaataatggccctattttgtaaatctatcttaaagttttttgttgataccaaatttctattttctttggggactctcagctccttcatcatatcttgacagctttacaatagcttgcaaagtatttttaactgtactagcagctatcaacattaattgaatattttcatttcacatcattaaaaatggagtgacacagactgactctcttgtctgaaagatgggaaatgtaatgttttcttttatattcataattttcctgatacatctttaacttttgtctttaaattttttatgtaaatttcaccaataattataactccatttcattagtttttaattaattaattagttaattttacactccatttcatttgtagagatgtatattatgtcagcaacttagactcagagcaagaggataaaatagaacatgaatttggaaagttacagtgagtataattcactaagcaatggtctcattttcatttttcttcaaagggaaactaaataattttaagcacattaaagcatttatgaaaaaattagcatatattaggccacagaagaaacctagataaaatattaagtcagaaagaatacagctttgacttctgacactgcaatgcaaattgtatatccatagcaagaaaagaattgaacatgggtttctcagacatttggaaagtaaaataaataaccaaatacaatttttgaaacttttagcaactcaaatgaggtaaaatatctagacattaatgaacattaaagatttcttgataaaattatgggctcctagcaaagtacagtgaaagaacacatttaaaacaatacttttagtgcagaaaaaaaaatgaaaacagtggtttaatttcctctttgctaagctaagagaaaaaacaagttaagataagccgagggaattctcaaaatcacacctaaaagtcaatgaattaaaactaagaaaagaaaaaaaaatacaaaaatatgaaagcatcactttttccctcagggagagcacataaatgcctctctgagatgtcttcttgcaaggattagaatggttggcctaaaaagacaaaacatgcctttcctcagatgcttccaaggagcaaggtccttttgaagaagctatggtcacactgggatgatggcctcacttcaggccacaactagcacaatacgatgcaggcagtgcacaacatggcctctgtctcccagttcaccggcatctactgggcccttattgcactaccttggtgaggtgacagtcacagaggataagatcaatgccttcattaaagcagcaggtgtcaatgttgaacctttctggcctggcttgtttgcacatgtcccccccccccccaaagtcaacatcaggagcctcatctgcaacataggggctggtgaacccgctccagcagctggatctgcttctgctggtggtcctgccttgtccaccgctgctaccccagctgaaaagaggaaggtggaagcaaagaaagaagaatctgaggagtcggatgatgacatgggctttggtttttttaactaaactacatttgttaaaatgaccaataatgagctgaacctggtttcatttttttttttttcatgaaaaaagaaaaacagcgacttttggtgaggatgatgaagaagctttgtacagcaatgctaaaagtatcaggccgagagagagagaggggggtgggggagggagggagggagggagggagggagggagggagggagggagggagagtgactgaaatagatgaaacagaatgatttactaatgtcacttctaattgagtgtatacatagaggaaatcagcataaagaataagtgtttccatggtcttgcctattgttggagttctcaaaagtcacactttggaaacaatgcaaactggtgagtatgtagagaaaatgtgccatgtatatacaccggaccactatttagcctttaaagaaaatgaaatatggcatttttaaaaagttggagttgttatgcaaagggacagacttagaaaggcaaacattgcatgaccaaaatcaatgtgaaatctacagtaagttgattgtatagaactagaatggagaggtggttctggagccatggtaaagagaagcaccggggaaatgttgatcagttggatattaaactgcaagtagaaagggaatattaaaaaagatcagactattcatttttacagcacagagattgtgattaatagcaatatgttgaaatattttaaaacattaacagcagatttagtcaattacaacttattagaatattgaaaatgaggatgggagcagatatcttagagcaaattagtagatcagttaaaatgtaaacatgtcacatccttgaaaagattagtataagccattactatacaatgaacaattagagtccaagccttgaattgacctattatagaaatcaccacagacacagaaaatgattacaatataatatgaaaatttcagtgatatatctctgagatattagtgtaatacaaatacaaggtaaatttaaatgctaagatttttttcaggaaaagacagaaatgatcatatgtcaataaatacaggaaaatgggaaaatttcttcaattacacattagaaatggcagaaagattattttgtgaattattaattttaaatatagtgaaaaagaattgatataaagcccactattttcaggtactgagggtgagaaaagattcaaatttgtcattactaaatatcatttgtgcctatattattctatgaaaacatacaaaaatgaaactcctagacattatctactgaaaaattgtaagctgcctggaactatgtaaaatattttatgtaaaaataatttaaaatattattaaatatgacaaagtatccagattttcttgttccatgaatactactcatgttattcatatgtggaatctatgatacagttttctcaaatttgaagtgaaatcatgattaatttaataccttatcttcaaaggcagttgataagattaaatgtcaataaagacttttggtatcccaagtctagaagacaattcctttatagaaacctgtacaaatgtatccaactgtagatacctgaatgcaatttcttacatgaaattgaagacgaacgaagaccaaagtgtggacactttgccccttcttagaattggaaattgggcctagcaaacacagaagtggatgctcacagtcaactattggatggatcacagggcccccaatggaggagctagagaaagtatccaaggagctaacgagatctgcaaccctgtaggtgcaacaacattatgaactaagcagtaccccggagctcttgactctagctgcatatgtatcaaaagatggcctagttagccatcactggaaagagaggcccattggacttgcaaactttatatgccccagtacaggggaacaccagggccaaaaagtgagaatgggtgggtaggggagtgtgtggggggggagggaatgggggacttttgggatagcattggaaatgtaattgaggaaaatacataataaaaaaatatttaaaaaaacattaagaaaaacccaaaatggaatttacctcactagtaagaaatagtcttcatccccagaagacctctgcccatgtttagggagaaaaggggaggttgtgagagagaaaatacctgtctctttgtagggctttcaaacctttcaaataaagttactttgacacctactgagaaatcctatgcacaaggcacctcaaagcttctgccacaggtgaattcacaaatatgacacaattttgccccagcaagtttattctctatgaaaggaggtaagaaaagacttaaattttaccaaagtctaccaaggtccatgtatgatattagttatggctgtgggtgtgtctcaaaaataattaggcacttcagaggtatggaccttcttcagagtgctaatgattttagagttttttttttttaatctaatgattcaagttcacaacagtagcttctgaagtacatctgtccctgaggatccatgcagagctctttctaggattcctatggatattgaaattcgaggatttaacttaaaacgatgcaatatctgcatacaacttccagacattctctccaacttttagttatatcctgagctctacaaacactaagtataatgtaaatgttatgtaaaataatcatatttgattgtttaggggatagtgaaacaataagggctatataacctaagaaagagatatgactttgtatatatatttatttatttattttggttgagtttgtgagtacagaacatgcagttatgatgattgcttatggaatggtattctgcacttttaatccattttgagcacatgcctcaaaccaggaaatacctcccctaaggtattttatgactcatgtttccaagggaaaaatttctagggtaactcatgggtaaatgataaataaatataatttagttaatttgtgacttctaactcctttactgtttagaaacacaaagcaaagacatggtaagctattctattacttggttaagccatggggactcacagataggagagtgagaagagtcagtcctcctcaaatcactcaattgtcagcacattttaatgaaatgccagtttttttcatggcaaatccagaagggaacatctgcaaaccaactccctaagggctttgaaactgaaataaagtcttcatttcatgtagctcagcactctacaagttcaaaaggtaagaaacacttccagtgtgcatagactgtaaggtgcatctgaaaaataaaagttttgatcatgtttgacatcacaggcccattgttgtcagccaacaggagcttaacatctgttttgacattgccaatgctgaagactttaaatgaatatctaagttacttaagtgctggttaatcagcatggccgtcatgttcctattcactaactcattcacaggaggaagaaattaatttggctttaaacttaacatgaagatttttaaagaagaaaatctaaatttattttgaatatgttacatctctattatcattaagtgtaagatttgaaaaactacagggtagctaaattttaagttaatataaagtttgaaaatgtttgtttaattcctcagtgaactgatatatttgtcttttcagttgctgatcaagcctttgcttccatgtaagatggggtaggtcattgtagggtgctctacccctcaaaacgttcaacttgatctgaagctcagggttttagtaaaattagatttgttgttttccagaagatatgatgtaaaatggtaagagcaactttttattttttgaaatttaaatagcaggtattagaatgatatcatgtttcttttattgttgtataatcttaatgccccttgacttgccataatcattagatttaaagacagccagtggaagaagttccctgtactgatcacgttttccatctttttagtactttttaaaaaccacacaaatcatttttaggcatttctcataaaagataagctagtaattcctttattctgaacttttatatgaggaggcaccgactgaatgctaacttattgtcatgatttgattagttttattataaaatatatgtaagttatccattttaaataggtagcttcattaactcattttacttgccaaggtggagttttagtggcaagaaatataagcttgagataagctaaactttttctcaataaagtggagagggatagagtaagaatattagtgtccttcttatttcctgcacatgttcctgtgtatataatacacacacacactcacacacacacacacacacacacacacacacacacacacacacacacaccacatacatggtctgccattattaatttctataatatctaagtttacttagtataaaatttaaaatattatgcttttcttctcgtattttagtcactatagctataaaggactggtagttgacttaagatttaggagagctagaagtgattatttcttcaataaaacttccaattttgagtctagtaatcaatttttacttttaaacatttttaggacatttttatagcatgattataggttttgaaacaagtactatttgagattgatagagatagctagaatgtacacatacatttttgtttttgcacatatatgtgggcacacatgtccaagtggatgcatgggcatgtagaatgcatgtgtttcatactcacagttgatattagataaatttttctactctctccacagtattgctcaaggaaaggtctcatgatggccctggagctcaccagtcatggttcatgtcgctagccagcttgcacaggggatgccctgtctgtctccagagtgctgggattgtagatggctatcacgtctgcctgattagggagtctgaactatggttttcatgcctatacactgagtacttgatctgctaagctattttctcagctctaaaaattcagaattgtgaatatacactaatctatatcattttataccacaatccatgctcacaactttaggctatccttaattaagtagtaatacaatgttttacaatttttcatttttatgtatgtatttttactaatataatagtgtgagttagtataatttttctgtatttgaatgtgattaaatacaacttggactttcagtcattgtgtaaataaatgtaacagtcagcaataactaggttaacttgatcactaagtcctgctctttgccatgttcatgcatattgattgggtttggaagaaaaatcccaagctccactttagactatgtatcatataaatttttagcttttattagcagcttgatagtgattaaatagttgcaaaatattttttattaattggaattcatttcattttataattctaaacatttttctaatttaaaccttgaatattttaataatattagttttattcattgttcctaaagatacatagtactgtttaatgactcaaagttgtactctataaaacctaccacaaataaagtatatctgcatcaatggttcttttataaataaattatgcaataataaacaacaggagggaaaatcctgtgtagaactcaaataagtatataactactcttggtacccctacttacattactttctactctttgggcatattgtttgtttgtttacaagggccccttaggactgcctttcatggtactaaaaagcatcacccaaaagagggaggcatccaacagtcctaccgagctctgatgcctatgaatcacattaatgaccagcatggcacagtgataaccctaggggtacaatagtggtgtgcatatgttggagttcactaatggctcctgaactgaacttaagacccacttaacaaaagggagaccatgcctggttatagaaacctagataactaattattctgtgctagtgacgtcaaagttattggagaaaaatctacaacaactaatttactaaaacagcataatccttaacaacaatctgtaacactggcccttatgtaccctcagataaatatagtcttcattctccatcaaggaagctttgctttgaaacaaatgcaaactattgtagaaagccacaaccagtcaatatgcagaattgtgggtcccagtttcaatggatatatctaaagaaaccttgcacatcttaggttcagggaatattgtgggagacagggatggaaagattgtaggagccagaagatcatggagtttgctgtgagattatgtctccgtgtgtgtgtgtgtgtgtgtgtgtttgtgtgtgtgtgtgtgtgtgtgtgtgtagtatatgtaactactcttactgagatcccactggagaagaccactcagatgcagtttatagacaatttcaattctttttccatctgtctgagactacattcaggtattccagatccaagtgtaacactgagtatttagggcaagagtaaataaaggctaaaaccatatcccagtatctcctccactttggaagccttttctgaaagtgatctaattctcccaggccagtgaaacatttgctttcatcaaggccccctgctccatcccaggaatttgatgatttatagcaattacccttttcttcttttccttcatttcctgtgtgctaatcttttaagacaatccagctgactaagatagtgccagaccccattcaatggagaaaaaatggagttacccctacaattagaataaaaacaaagtgttcttcctgtgtttgtatgcttattcttttgagcatatactcttgattaagaataagggtttgcttctttcaaacacttaaatatactatgataataatgcatattatcacacatatttgatatatatttcttttttaccttttgcctgagtatattttattccataacttttaaaatttatttttattagatattttctttatttacatttcaaattttattccctttcctcattttacctccgaaccccccctataccacccctcctcccactactcactaacccacccactcccacttccctgtactggcattcccttacactgggacatcaagccttcacaagaccaagggcctttcctctcattgaagttccccaaggccatcctctactacatatgcagctggagccttgagtcactccatgtgtgccgcagaccctctgggcccctgtgcctgtgtaggaaagagtctctagagtagatgggcaagattaggatgtagtgacagacagccaaacacacaagagaggtgtttaatctgaatgtaatgttccattcgagcctcagacttttataatacagaataaattgcaaatcataacagaataaggcacattgaatttttccaggtgcaaaaggagtgacttcaaaaggaaccagataaatgtttaacactagagattagcacagatgcaaggggagtgactacaaagggaatttgtagggaccagataaatgtttacattagaaattagcactttctgccaggcaagagttttacacttagagttcatagccccagggtagttaactcttgacatgcctcaagaataatgtagtgtcactgaccccaaaattctctaggcctcgttaattcttatctatatctgaagactatctattttcagtatagtatacaaatttgctcttggcatggaatgtagtctgtaatacgaatttctatctcagtgagaattttagactctgcagacaactgaattaatgactgtgctttattgttttatggtagtgcttaattagttactgaatgggttaagctccttgctgctatctggaatctaagaacactgggaaaaggctttagctatgtcagaatacaatcttaaaaggcatttactataaggtaatgcttaatagagtgcacgtgaatctatacactagactaatgtggtggaaatttgaatattatgggttagggaaagaaatgccataactctgggaggaaaatttccatggaactcttatcctcgtgaaacagcttccaggcttttcgcctgacaaaccgatccaaactggagagttggctttcgccagacatccaggagagtcctagaaattcatttctcatgagcagcttttggcatttctacctcacaagctgactccaccagagtgccctgacacatgtgtactctttggttggtggtttagtctctgggaactctgggggtactggttggttcatattgttgttcctcctatgaaactgcaaatctcttcagctccttgggtcctttatctaattcctccattggggaccctatgctcagtccaatggatggctgtgagcatccacttctctaattgtcaggcactggcagagcctctcaggagacagctgtatcaggcttctgtaaacaagcacttgttggcatccacaatagtgtctttctgactttgagaactatatatgggatggatccccagatgggacagtcactggatggccttcccttcagtttcttctccaaactttgtctctcatcccatggatattttgtgtcgcgtccaactcaaccagcaagtaaaatgcaaccacaggttcttcttaaagcagtttactcaggcagcttctctcttcaaatcccccgcctctctggttacaagtgttttttttttcccactccagccacaaccacgctcccaccaatcaccacaggtcatatcacctcaccaggcaggcttgctcagccaatcagggattaagggcaggccatccactaaacatgggcttgtttactgcctggaacagatttctgttcgcctggcgagggattccagaatggcttcccacaattttgatcccccttctaagaagtaccaaagtatccacactgtggaaatcatccttctttagcttcatgtggtctgtgaattgtatcttgggtgttctgagcttctgggctaatatccacttactagagagtgcatatcatgtgtgttctttggtgattggcatacctaactcaggatcatattttcaatttccatccatttgccaaagaacttcatgaattcatcatttttaatagctgagtgctccattgtgtaaatgtaccacattttctgtatccattcctctgttgaggggcatctgggttctttctagcatctgactattataaataaggctgctatgaacatagtggagcatgtatccttattaccagttggaaattcttctgagtatatgcccaggagaggtatttctggaacttctggtagtactatgtccaattttctgaggaaccttcagactgatttccagagtggttgtacaagattgcaatctaccagcaatggaggagtgtttctctttctccacatcctcgccagaatctgctgaatttttgatcttaaccattctgactggtgtgaggtggaatctcagggttgttttgatttgcatttccctgatgagtaaggattttgaacagtttttcaagtgcttctcatccctttggtattcctcagttgagaattctttagctctctatcccatttttttagtagggttatttgattccctggagtctaacttcttgagttctttatatatattggatattagctctctattggatgtacgtttgtacgggtcttttcccaatcttgtggttgccgttttgtactattgataatatcctttgccttacagaagctttgcaactttatgaggtcccatttgtcaattctttatcttagagcataagctattggtgttctgtacaggaaagtttcccatgtgcccatatgttcaactaatttcagtgtatctgattttatacggaggtccttgatccacttggatttgagctttgtataaggagatattggatcaatttgcattcttctacatgctaactgccagttgaaccagcaccatttgttgaaaatgctgtcttttttccactggatggttttagttcctttgttaaagatcaagggaccataggtgtatgcattcatttctggatcttctattctattccattgatttacctgcctatcagggtaccaaagcatgcagattttacaattactctctagtacagtttgaggtcagagatggtgatccaccagaagttcttttattattcaggaatagtttttgctctcctggggttttgttgttccatatgaatttggaaattgctctttctaactctatgaagaattgatttggaattttgatggggattgcattgaatctgtagattgctttctgcaaaatgaccatctttactatattaatcctgaacaatccatgatctccaatcatgggagatctattccatattctgagttcttcttcattttttttcttcagagaattgaagttcttgtcatacagatctttcacttgcttagaataacaccaagatatgttatattatttgtgactattttgaaaggtgttgtttccctaatttctttctcagcctgtttatccttttagtagaggaaggccactgatttgtttgagttaattttatatacaggcactttgctgaatatgtatttatttctttttgtaggttagaggccatgtaaaaaaataatgaaaaaagaggacatgaatttgaaaagcaccaaagaggcgtattgagagtgtttgtagggaagaaaacaaatggaaaatgatataattatattataagctcataaaactagagacataataaaaattaaaataaataaaatttgtgacaaaaatataaaagactttatataattacatcatgttacccttctctctcttcgcttcaatctctcccatccatatccttgctccctctcagattcacaacctctttttggaggaattgcaattgtacttgtaattgtaattagtactttttcacacttattactcgcatacatgtcaatatataaatagtaagtacaaccttttgagtctgtttagtattgaattgtgtatataatttcagggctgacagtttgtattatataaagaagtaagggtctcttccctggggaagactagttctcctgctttccccattccgtagatgactatcattctttgtctatgagctaggccctatgaaattctcctttctatatacatatgtctgttggttattgtctccttgtttaggtcctgtttaggcagtcatattgttatggtatcattggtaaaatttccctgccatttcttgaagtcaactttactgcagagcactctagcttttataactttgtcctctctttgtgaagttccagaacattgggtgtaggggttgtgctgtagagttatctgtttacccataatctgtttttttccttctgcattttgatcaggtggttttctgtaattgtgtctatatgtctcaagtagatacttttttaatgaaagtgagagatatcagataaagtcagaggcctgggtccagagttaggcctgtgttatggaaatggcagcatggtaatagagtttagatatgtgtggttgggagggagtcaccagaaaaagctagtttgtaggcctcatgtctggaggcaagtctgtaggagtggagatggctttaggggctgagggcatggtacagggacttaccaagccctgaccaagagttatttatactgtgaatgtcattagaaagaagggaaatctgagaaaatgtcagccacaggaagccctaggatagatgacagcagaatatagagaatgtgttttgactgtcgaggttgaaagagaacagatacttccctaatagctaatttagttcaggctactataaacagatgatctaatttctacaaattttacttaatttttctataacagaaaaaataacattaggtaaagtctaaggaaatattaataaaattgatactttattaattgaaaatatttacttgatagacagaatctcttattgatggatcaattttgttcctagactattcattatgcttttttagacattcaattttattgaaaataggattcagttctcagaaaaaaagacagcctgtaacaaagccaacacatccttcctttttttttttaaatttatattcttacatgtcaagtaaaatcattaaaacagagcttagaatactgcagtaagaaagaaccaattattcagtaaggtctttttttttttttcctttttttttagtggatgaaaactaacatgcaattatttctaaatttaaaaggggaatttatacagtacaatattgtttatcataactactttaagtacattacttggaattttgtatgtggtatttgtctccaacacaatctgtatttgaagatatgtcagatttgtctctttacggaatcatgcagttttagaatttacatctgccatggctgaaggctataaagggttgtctctttaacaacaacaacaacaacaacaacagcagcagcagcaacaacaaactttcagcaaaatattcaagtagtagttgcaatctagctcctactttcaaattttattataaaacagattatatttattaaatctgtgagataagtagtaagggataccagttccatgctgtatgcctatgggctaagtctttagaaccgcaccttttggaagagtctggtaacagaaacataattattttgatcctctattgactgcagtgcatatattaacatgcatattctctggtgaatggcagcataatgtagagaaagaggactctggagaactatatgcagttcactgtttccatagcaacttgagcatacactgagaagatctgtttccatgactatcctcttgaacagtgtaatggactgagtaaaataaagtaactgattgttaagttctcattgttcgattttaactgactttagagtggcatggacaggttatcaacatagtgtattaaattaacctcacctctgttacttaataccagtgtggttgtttaaaaaagtcacatttctatatatttcctataaaaattctggtatgctatgatgtgcaaagaagcaactactcttgtttcggtaacctggctgacatctgaaacagatatttctaagacagggttcagaagcagaactgtttctattctggaaaattactttattctaactggaatttagtatgcaattgtaaatgcaagtaatcagccactgcagtattagcagtaattatgatgttggtgaacaatataagtcagagatgtttttatattatttacattgattgttattgcaaactgcaatgtttatcagatcatcacagtccttgctatttataaggaaaaggagttttgctttgtcacgtctatgttttaaaatatttcaaaattgtaactcagccagctttcattctaatcttacctgatttgcctgatacgtttaaaaacctcattttactaggttatcctttcaacctaagactagatctaagctttagtgtagggctggagataggaatggtttcaaggttcatgatcttgcacttgcatcaaagataatcgggaagaaacatcagactctaattcttcagaggcatttgcatgtgttagggtgagaaagtgatgcgagtttgccgttcagttatttaaatatataagctgctgaatacacagtaatagaataatctaaacaggaaagtaaacagcataggaggaactccttgaaattcagcatatgtaaaagtgtagtttcagaaaatgaagagatgacagttggaattatatgtgaagatttaataacaggtgtctttaaaaatccattcaacaggaatacaaaacacaaaaaacatcaggaaccttacacaagagagagagaagaagaagaaaaggaggaggggcaatgcaaaaagacaattagaaagtcagacaaaatagtgaaaggataaagacagcatcttgaagaaatcaggacacaaagtaaatgttactgatgatgtctcagaagatgcacaagtccagtgagtgcctcccatgggaaactgccagtctataatcctgcatccagaaaacataccatttaaaatttacaatgaagtaagtacattcttcatataaagaacagaaaaattttcttgctggtagaaataaattatatggaacattaaagagaggtatcagaaagatgtctgaaacaagaaatttgtccctatgtcacaaaagtgaagagtactgcaaatgataaagtttaagataaaagtcatttttcatattagtaaaaagtttctttataaaaaagaagagggacaatgtaatagtataaaatattgaaaagattcaattaaatcaagacatgaatctgttttcagacaaaagattcaatattatgaaattggtaatttttttcaaattttaagtataaaaattgagtctagccaggcggtggtggcacacacctttaatcccagcacatgggaggtagaggaaggcagttttctgagtttgagaccagcctggtctacaaagtgagttccaggagagccagggctgttcagagaaaccctgtttcgaaaaaccaaaattgagaaaggaaaaaggaaaaaggaaaaaccaaacaccaaaaccccaaaccaccaaaaaccaaaaaccaaaaacaaaccaaaaaccaaaccaaacaaccaaaaaccaccaaaacccaccaaaacccaccaaaaaccaaaaaccaaacaaccaaaaaccaaaacccaaaacccacccccccaaaagtaattgagtagaaaagtgtgtagattgtttatcatttcaaattagtttaattctaaactataaataaaggttataatttcaatacttactaacattatgaagacaatgagcttcggtactcgcctgaacagaatagttaatgatagacatttgcacacaagagtccaagtatgtagagaagagattctgggaggtcatggtgagaaactgaccacttgaaatctgaagaaaagtccatatttaaatgtgcaaaataaagtattatgtaagctatccagtgtttggcattttgctaaggaagttctcgacacactcagttttgtgtgaggtgataacagaggtagattctagaatgattgttgccattgtgctcaacaatgttaacagagaacttgaattatcacagagttttaagaaatgtgagtatcaatacagattcaatggcagaaataatcgaacaattaactatgattctcaaccattattttcatggaaatgtatgtcactttaaccaatgttttaagtttaaaaacacgtgatttatgacattgtgacatcactttgaataggtacatcactttgttaaagagtaggtcagcagccaatgactctactggacagatatgtggcatttagatggtaggttttattggaaaggtactattgggattcttctttctcttgttcctccctgcctgtcctttggtcagatgcttcatggtgtggtgtccttctcacctcttgtgcaaatacagcaaataccataactaaaacttccttccttatgaattgttcatctcaagtgtttgtaaaatgatgagaagttaacacccatcttaattagggttcctattcttattggtgataaagcaccatgatcataaacaacatggggaggaaagagttcatttgcttttacttttctcatcacagtctatcacgtaaggaagtgagagtgggaactcaaacagcgtaagaaccaagaagcaggacctgatgaacaggtaatggaggagtgctgcttacaggcttgctctccatgccctgcatagattttttttttaattgctccaaggactactagcttaggggaactagaagcacaatccctaattgagaaaatttaccacaggcctattttatggaggcgttttctcagttgagagtacatcttttccaatgactaacaaaagttaagttcaattaaaactatccagcacaacaccattgtaggttcaataaactaaagaaaaagtaccaagttaatttgatcagaaaacattttataccacctaggaaagaattcctgcatgttatgggcaagattcagcatagcaaattctgttataaaatatggaataatggcttctttcaaagtaataactggccatcaatccctttttctgaccttggtttgacaggaccttattttaaatgcataagaaactttactttttatcatagtctaaaattcagttaagtcttttgtataattaatttgatagtggaggcatttaagtgaccaaatactatcacattaatgacaatgccttttatgttctactgtagtgacttttggtgcaactttgtgaacctgggttcaccagttcatcagataaggcagcaacagttaaaattatgtaaaaacattttcagtaaacctccttaccccagatcctttatggttttttagatgtatgactgccaattaatcttaaatgtcaaaatgtccttatttatagaaacaaaactgtggatacttttatcattatttttgcaagaagaatgacttgtgagaggcaaaatatattctatgtctataatgaataaagatgacaaactttgaagaaacaagggtattacaaaggagtaacctgatactgaatgtaagatcctaattaatgcatgtctatatgaagtcattttatattagagataattagtgtgcagtaggaaatatcttgcttctgtatttctctttgctatatcttcagattcagatgtaatctctaattaagcatatgtaagattcttaaagagtaaaaatttaaaaatctaattatccttctcatgcagctatgaccacagcgggatatgcccactgctacactagtggtgtggtgttagaagaataaccaacctcttgaacattttttatttaaagcccactccatgagatggtatccctacctgacacttaaagaggcaagactagataggacattgaacctagcagaaaatccactactattattctgataaatgaatatagcattaaaataataactaatgacatgtttatatacccagaggtcactctatcactaaccctcatctcgtcattgaagcttcttgcagtagatggaaattaacacagagatccacaagtcgacagcatacaaagggtgtgagactgtggaacactcagccttaaatgggatgtcattatcaaatacttcttttaaagtctcaggaacccatgagaaatagacagaagaaagattgtaagacttaggggtagtggatgactcaaagaaaacagtttttcttttttttcctgacaaaactgggctgatgcacatatgaagttacagagactataatatcatgaataagacctgcacaaatgcaaatcagatgaattcaagagggacaaggtcaagtgcacacagactgaaacctagccataaagttatctacaattgatagctgctggaagaataaaaatctatctttaatggagtatcactgggtataccatgcacacatagggcagagtccatcctcatgattagttggccaacacaaagcacaatccatctattgtttgttgtatatggttgttgagagagagagagagagagagagagagagagagagagagagagagagagaggttataaacataaaataattctgggctggtgatataactcagctgttatagggtttgcccagcatgcaagaattcctgagttcagttcaaagtattgcagtgcataactctaatcccagcactcaagatgtgaaagaaggaagagatgttaaaagctacattggctatagaatgaactcccctctgaaaagtatggagggaaaaagtcagaaaaacattgtcagcatacttctaaacctgagagtaattgtaagtgcataagttaagtaggaatggaactgctgatttgattatttacctttctttcactcttaactgcaaaatttacatgtgttctctttcattgcatgtttattacatgaagtttatacagtgtgggaggaagaaaacttgaagttacttataaaataaaaaatatagttaaactggaactatgtaaagattataagtctaggagtatagatcactttaaaatttcatctgccatacaccacagcaattacatatcatgacagatattttgaagtttttaaagagaccatatatttatatgggtatttgtattatgagattgctctctctctctctctctctctctctctctctctctctctctctttctctctctctctctctctctttctctctctctctctccatagagaccaaaagaagattagggatctcctggagttgaagtattaggcagttgtgagtcatccagcattgttcctgggaactaaaggtaagcccactgaagaacaagaagtgctcttaacctctgagccatcattccagcctcttctatgaaacttttaatatagctgaaactgaatctttattattcttgcatctactgtaagtagattatatgtgaagtatttatatttgattgattcttggggatttgacaaaatttgcataggctattttagttatttggctgtatatctagaaggaaaacacaagcaatggtagtggcagaacatctccacctctaatcccagaatgtcaactacatacccagcaggtgttaacatgtccatttctcattttcatcttccctaattttagacttatggaacgagaaaatatgatgagttgtgtgaaagaaaaatgccaaaatgttagaacacacttcagaaaaattgttttatatgagtctttcagaaactggaaccaagaagctttggaagatatgtcacgatgaaagcacataatgcaatcagtgttcacatcagcttttcttgtattgtcttttcttatttgtattgactaactaaatgtaggtaacttagccagtacacaatgaggaagacagccctgttttggttagggttttactgctgtgaagagacaacatcaccaccatggcaacacttatttgaaggcagtgaaaggaggttatttaccaccctgtgtatatcctgagtgtatataacctcaaagcctgcctccacagtgacacactacttctaatgaggccatacctcctaatagtgctactccctatgggtcaagcattcaaacatattaatctatgggagtttcgtattcaaactactaaaattccatttctcaactctagtgctcagctctgttgtgggcaacagagaatattttcaggaagtaacaaacaataacatgcaggctgtgatgagtcccattattagtaacatggagaaacatttgaacactctaatatgtatatgcttgcatagtactattactcctctctctctagtgacatttgatgatgcctgaagacatcaaactctggagaggaagcctgcaggaagtttgagttgttgcctgtctcttggaaaattggacagtggaggagtttgtttgcatgcccaagtgcccaaggctgaggctatagccagccatactgattaattaatgtgaatttaggtttaagtaagcatgtagcaaaagcatgtagcttccattcataaaacctgagttccagaccagctgttagaaacaaaacctctgtaggataagagtttcatttgaagaagctcatgattcttgttataagggcttggagaaggtgagcccattccttcaactcattgtttatattgaagtctggtaaggcatgttcagaattatctccagactcagcatttcctgtttgggtttggctgagagctcaggtggttgccgtaccgagctttcctggctagtccatcttgactttatatcaggattttgacttgtttgtgtctggcttgcagagatatgagtcaatattcaatcagtggaaagtgtgcttaagccaacaactttaccctttccttttcttgtttttcccgtttgtagggcaggtctgtcacaaagaatgtgtacaggttagagagcatcagcagtcttgagaaagtatgatttgaaagatctcaagaaataactattctgtgtctgagaagactatgattcttcagtcaccacagtattttcgattcatattatttctcatgcttgctttgtacgtgtaggaaaatatacacacagagacacacatagaaacacacacagtcacagacagacacacacaactaatggtgtagatcagtaactagtggacacagaggcacaggaagccttgccattaagcagtctgctggcagaatctctattctacaggagttacttctctttctattaaggctttcaattaattgaataaggcacatgcatacaatgagtactcagattcactcacatggcaaaattcaggatttggcagcaaaagcttcaattcccaggtaaatcggaggtagaatcttgcctgaacaactgagcgaaagcctgtcaccaagctaaaataaataaataaataaataaataaataaataaataaataaataaataaataaataaaagtgaaaaggaaaagagaaggcacacaaagaccaggtttgaagactaccctctccccagcccccatttccatgttagcaaacagcagaacaagcaaggagcaaatcctcccagaaacagctcgaactgtttgatcagatactcaggcactgagatctcgttaagctggcaccattaccacacagccttcctctggtttagtgttttctctgggatgttgttctgagtcctttagctaagctatgaggtatatgtattataggacaagtaaggactttttaatatatattgttgtctctcaaaatcttcccataactccagttgatagtgtcctgaatatctctccctaagaggccttcagttccttttattttgagcatgctgaaaacagcaagttatttttctctttcatctactgctctgtttaatgataatatcattcaacttataagccttagtatcatttaattattccccctttctctattgaatgtcaaactcactaactgaacaaagttattatataccttataaaagtcaggtcatatttttaatattgtacacacaataatgaagagttgataatacacacaattgcccaaataattttagctgtgataaaatgccatgaagggaagaaactgtgtgctagaagactgtaaaactaaggaatatcatgcagaatggaagggatcaggccaatctgggaagacaatcctggactagacagggtaagtgcataggcacaagagtgaaagaacagatgataaagatgtctagccacaggtgaggagaatttattttcacaatgacctttaggtagctgttatggggtggataccacattttttaatcaattaattatgtaatatattatatattatattattatctagcaagggctagacaagtatctattccataaatgaattcctgtgcgaactgagaaaatggtggttagaaagagtttctagagcttaaattcacctatgataagtgggccaagtaaggactttgctctctgcaggagactttgagagccactgcctgaagctgttttattgctctaccatgggtcaaggaaacactaagaaacccctacagtatgtataaatcctggcaaagcacaggcaaggttctgattttgctagactaggcattcccgttcagtgtttggattacaccgtcttgatcactttggaatatattcacactaaataaccctggagattgattaaaagattaagcttttcctctcttaattaatctcagcatccacttattgctttatctactaaaagcaatatgatttgctcaatctaccaaaatatttgctctaatctaaaaatgaagaggtaatgaatttaagaatttagctagatttcaaattaacttaacgcaccctcctccttcaccaaccccgtagaaaaaaaaaggcagatactgtagcttagaatatatcatgtcatgaagatggaacaacatttgcataaatcccaagtgatttaccacacaaagaatcagaataataaatcagtcatatttattaggagagtcaccttgatttttaaatctatcatagatttacaatattgatattcatagtccatgaatttggacaaaggtaaaaaattgaaatagaacatggcattctagacacaaatgttcactggcagtggagactggaggtgctcttactctgtctgtggctactccagaccatacagcagcacaggctctggcccacctctcctatgagatgtttttgtacagagcctcagagatgccttgaataaacaatagctttcaataaacaatcacctcttttcactcttttcatcattctcttatttatcagtgtatcattcaatatgatttcctgttacatacacatgtgtgtgcatgttcatgtatgtgtaagtgcatttgtatgcatatatgtgtgtgtgcaagtgtcttccctctcccctttctctctctgtgtctctctcccctcccccgctctctctctttctctgactcatatcatattctttcctgatcctccctttctagactgctgaattctggaatggtacaggttgaaatcatactggtctatcttcttgaacaacatgcacgatcatgttcattaccatcactttaaatatcatctgtgcatcaaaggttttctaaatgtccttgtggtccagatcctattcagagcttcagtatcattaagtcaattttaattgcctttcatttatctcctttttcaaagactcaagttaatcttatgatctaatatgttaattacttttacttcattttggaagttccctgccataaaagccactgtcccctttgcatggctctccttgcttcactcttgacatcctcaatacagagactgtttagaaatgcaggacattgctcaatgctcaaaactcttttgtttgtacttagactaaaccaactgttgttacacggcttccttggttctatggcattgtccctgccattttatatatgctagaattatttgatcctctaagtaggtaatatctcctgaaatattttggagtttgttgtggtagaatttacctatgatgtttttttacattttcacctaaaatgatatctgtatctttaaaattgtttcattttatttttaaaagtataagtacataattttccccctttttgttctttcctcccaatcctcccatgtatttcagtcgccctctctcatggctccttttcctttagttgttacatatgtacattcctaactacataaatataacctgctcagtatgtatgctgttacttgttatctgtatgcatatgattttgggactaatcaccttaaaaactgaaagtttctttcttagaaagacataggtcctccctcatagtatttctttcccacacctcccacaccttcccgcctttacagagacactgtatgagtgggactggaggagaggaaggctacaatcagaatgtaaaatcaataaataaatgaaaaataatagtttcttgatttttcatcaatttttcttttaatttggtattgccatccagtacatgaattaaataaatatattgaataaggtaacttatattatcattaatttaacaaagaaaataaaacagtaatgtatataaagaagttgactaaagtcattcacataccacctgtactggctagttttgtgtcaacttgacacagctggagttatcacagagaaaggagcttcagttgaggaaatgcctccatgagatccaactgtaaggcattttctcaattagtgatcaagggggaaaggccccttgtgggtgggaccatctctgggctggtagtcttggttctataagaaaagctgagcaagccaggagaagcaagccggtaaggaacatccctccatggcctctgcatcagctcctgctacctgacctgtttgagttccagtcctgacttccttggtgatgaacagcagtatggaattctaagctgaataagccctttcctccccaacttgcttcttggtcatgatgtttgtgcaggaatagaaatcctgagtaagacaccaccaaagatttaaattgagaaccaaaactcaaaacatgtactcttcaaatataatacatattatgttcatactacacacacacacacacacacacacacacacacacacacacacacacacagaaaccatttcatttggtcagcttaaaattcacagaagatttctatagattaattgataaaagagtacttatgatatttattataactattctcatcttataatctactatggtcaagattatttaaagaaataatgaccaataattttctcatttaaatgacagaaatcaaaccacagatacagaacttccagagaacatgataaagacctgaaaaaaggtgatgccaagtgtattagtgtcttttctgctgctgtgataaaacaccacgaacaaggcagcttatagaaaaaagagtttatttggttagggctcataatgatggctacagtgtggcaacaggtgccaaacatgcctgctggacataggagctgagggcttagagatcacttcttgagtgggaagcaggaagtagagaaaggaaatggggaatgagacatggcttttgaaacctcactggctaccccagcaaggatacacctcctaaactgacacaaataacgccaacagctagggatcaagtgttcaaatgcctgagactgcagaacatctcattcaaattactacatcaaggtatattacatttataatgtatcaatgaagttatatatgaaatattaactgtgaaagaggacaggggaattttttttcttacctataacttaagaactacagcaaccatcactgagaaaccaatgtgaactgattttctagggtttctgtaacagagtaattataacagaacagcagaatttattcttgtcctagtgtgaagtttagaattctgaagtccagaggtggttgggaccacatttcttttgagttcttatctttatcactataaaatccttctccatgcacacatggccttcttcatgtatcttcagcaacatggtggggcttcttcatattacttcctttatcagggcacacgcaacaaaacttagaggacattatatttcaatgtcatgccttatcttgattcaattgaaagctcttatttcaaaatagcactaattctcaaatacagtgtattaaaatgtccacatatcacattgtgtggatattttaattcactgtataacacactggaaccaagaaaagagtggaatattataaattttgaaattagcaagtcaccaacttacaattttacacacacacacacacacacacacacacacactgaagtgttttttgaacggttcacacagcaaattctctttgtattaggaaggcatctttgggcctctctgtgtttcttggtgagtgttataatactatattgtactgtacatacaatacaatactgtactgtataccaagaacatcttttcatttaagccacttctaataattgtttacactgaaggtaaactagaaaagcaaggaaaagcataccattctagcacaacactcagctgctgtctatctgaatagagactaaccttgcttaccttcccaagaaggacaatatgtttccccatccaggcttcctggctgcaggacactccccatgtgcaggctctacttctttgtgctgttctgtgaagtttaggcttcagagatacatactagtgtgctgaacaaatttctatagtgtttactataacaggtcattttctgtcttttcatataagcttccacatgtcattggaggggtagcttactagtttgtgctggtggaaattctgattttagtcttcctcaatgtcatcatgttcatctcagtagcataaaagtatctcaatgaaagaatcaattctcaattctctcttcttttctggaacggattataaatgtattagattttttactgtattctttatgctctaatattggtattgttattactattatattaattattattataatccagcctattgaatataagggcctctggtttcttcagttatatggaaagctctctttatgttttcttttgctgagtctttatatcatttactatttactatttatttttaaaactacatcctttattcccccattccacactctgactgctccacatcccatatttcctttgcaaccccctgtctcaacttggatgttcccaccccttatcccacctgacctctgaactcccttgggcatccaatctcttgagggttagctgcatcatctctgaatgaatacagaccttgcaggcctctgatgtatgtgtattgagggcctcatatcagctgctgtgtgctgcctgcttggtgatccagtgtctttgagatcttggggattcagattaattaagactgctggtcctcctaaagggcggcactcctcctcagtttctttcagcctttcctaattcaacaacaggaatcagcagcttttgtccattggttgggtacaactacctgcctctgagtctttaaactgcttgttgagtcttctgggatgcggtcatgctaggaccctttttgtgagtgctccatagcttcagtaatagtgtcaggccttggggccttcccttgtgctggatccctctttggacctatcgctggaccttcttttcctcaggctcctctccattttcatccctgtattctttcagacaggaacaattatgggtcggagttgtgactgtgggatgccggactcctcccgcatttgatgctctgtcttcctgctggaggtggactctgtaagttccctctccctactgttggtcatttcatctaaggtccctccctttgagtcctgagattattttacctcccaggtctctggtgcattctagagagtccacccaacctcctgcctcctgaggtggtctgtttccattctttctgctggccctcaggacttcagtcctatttcctcaccaaataccagatcaggttcccctcttgcctccaactccccaccccaccactttccctccaagaccccccatttgtgattgctttcttctccctcccaagtgggactgatgtatcctcatttggacacttcaccttgttgaactttttgagttttgtggactgtatcttgggtaatctctctctctctctctcatatccacctattagtgagcatataccatgcatgtccttttgggtctaagttacttcactcaggatgatattgtctagttctatcaatttgcctgtaaaactcagggtgtcctcattcttttttttttttttttttttaagaatttttttattaggtattttcctcgtttacattttcaatgctatcccaaaggtcccccatacccaccccgcccaaatcccctacccacccactccccctttttggccctggcgttcccctgtactggggcatataaagtttgcaagtccaaaggacctctctttgctgtgatggccgactaggccatcttttgatacatatgcagctagagacaagagctccggggtactagtttcttaatagctgagtagtattccattgtgtaaatgaaccacattttctgtatccattcttctgtcaagggacatctgggttttttccagcttctggctatcacagataatgccactatgaacatagaagaacacttgcccctgtggcatggtagggcatcttttgggtatatttccaagcgttgtatagctttgtcttcaggtagatctattcccaattttctgaggaacctccaggttgatttccagagtggttaccaatttgcagtccaaccaacaatgtcagagcattcctctttcttgatatcctctccaacatgtgttgttacctgaggatatcattttagccattctgattggtataaggtggaatctcagggctgttttgatttgcatttcttctatcactaaggattttgaacatttctttagatgcttctcagccatttaagatccctctgttgagaattctcagtttagttctataccacatttttttgattgggttgtttgggtttttggtttttttggggggggggcgggcataggttgttttgttttgcttttacagtgattgaatattaatttagatttcttttttttaattaagtattttctttattcacatttcaaatgttatcccctctccttgtttctcctctgaaaatccctgtatcccattgctcctctccctccttactacttcttgagttctttataatatattttggatattagctctctattggacatgaggttagtggagatatttttttcccaatctgtaggttgcctatttcccttattgattatgaccttcaccttacagaagccttccagtttcatgagatcttatttatcaattcttgacattagagcatgagtcattggagttgtttaggacatttcttcctgtgccaatggctctttctcaatttctcttccattagattaagagtatctggttttatgttgaagtcctgatccacttggatttgagctttgcacaaagtaacaaatatgggtctatttttcattcttctacatacagacagccagttagaccagtaccatttattggagatgctttcttttttctattacatatttttagcatctttgtcaaagatcaagtcctcgtaagtgtgtggttttatttctgggtgtccaattctattctattgatcaaacaaagtgtctgtctctgtaccaataccatgcaatttttatcacaatagctctgtaacaaagcttgaggtcccggatggtgattcccccagctgttctttattgttaagaatcatttttgctattctgtttttttttttttttttttgctttccagatgaatttgagaattactctttccatgtctttgaagaattgtgtttgaattttgatggggattgcattgaatctatagattgcctttgataggatggccatttttactctgttaattctgctaatgcatacgcatgggaaatttctccattttctgagatcttcaatttctttcttgagagacttgaagttactgtcatacaggtctctcacttgtttggtcagagttaccccaagatattttatattatttgtggctattgtgaagggagttgcttccctaatttctttctcaacctgtttatcatttgtataaagggaggctactgatttatttgagttaattttatatctggttactttgctgaagttgtttatcagctggagaaattctctggtagagtttttggggtcgcttatctatactatcttatcatctgcaaatagtgatacctttatttcctctttaccagattgtatcctcttgatctatttttgttgtcttactgctctagctaacacttcgagtactatattgagtagatatggggagagtaggtatcattttcttgtccacgattttagcaagatagtttcaagtatgtctccatttaattttatattggctgttgatttgtagtaaattgcttttattatgcttaggtatgggccttgaatttctgatctgtccaatacttttaacacaaaggagtgttgtattttgtcaaatgctttttctgcctacttgattgtggtgaatgatggttttgatgtgttcttggatttggctttccagaatatcactgagtatttttgcttcaatattcataagcaagagtgttctgaagttgtcttttttggttgagtccttgtgtggtttaggtatcagagtaattgtgccttcatagaaaaagttaggtagtgttccttctctttctattttatggaatattttgaggaaaattggtaacatgtcttctttgaaggtctggtagaattctgcatcaaatccatctggccctgggcttcttttttgttgggagttttttaaatggctttttctattcccttgtgtgatatgggcctgtttagtttacctgctcttgatttaactttggtacatgttatctatctataaagtcatccatttcttctagattttccaattttgtgaagtataggcttttatagtaggatctagtgattttttgaatttcttctgtttctgttgttatgtttcccttttcatttatgattttgttaatttgtgtactgcctcttggccctttagatagtttggctaggggcttatatattttgttgattctttcaaagaaccagctttttattttggtgattctttgtattgttttctttgtttctatttggttgatttcaaccctgggtttgattatttcctgcgttcttctccttttgcttatgtttgtttcttttattctagagctcacagttgtgctgttaagttgttagtgtcagatctctccaggttctttaccagggcacttagtgctatgaactttcctcttatcactgctttcattgtgtcccatagtttgggtatgatgtgtcaactttttaattaaattccaagaagtctttaatttctttctttatttcttccctgaccaagttatcattgagtataggattgctcagtttccatgtgtacgttggctttctgtagtttttgttgttattgaagactagctttagttcatggtgatctggtaggaggcatggtattatttcaatcttcttatattggttgaggttgtgttgagaccaattatatggtcaattatgaagaagggaccatgaggtgctgagaaggagtattcttttgttttagggtgaaatgttctgtagatatctgttaaatccatttggttcatacctgtcttagtttcattgtgcttctgcttagtttctgtttcaatgacctgtttattggtgagagtgtggtgttgacattttccactcctattgtgtggggttccatgtgtgttttgagctttcgtaaagtttcttttatcaatgtgggtgttcttgcacttggggcctagatgttcagatttaagactttcctttggtggattttccctttgattaatataaagtattgcttgacgacttttggttgaaagtctattttattggatattaagatgccagctcctacttgtttcctgggaccatttgcttggaagaccccttttccatccttttcctctaagatagtgtctgtgtttgttattgaggtgtgtttcttgcatgcagcaaaatgctagatcttgtttgtgtatccagtctgttagcttatgtctttttataggtgcattgagtccattattattgagaaatattagagaccactgttggtgcctgaaatgtttgtttttataggtggctttatgtgcttgtcgttctctgcttttggctctgttgtgagatgcttaatatcttgtcctttctttgatgcaggtacctttcttgtgttggagttttgcttccaggatcctctgtagaggtggattggtagatacatattgtttgaattcagctttgtcctggaatattttgctttcttcatctatgtcgattgagagttttgctgggtatagtagcctgtgctggcattagtgtttgagtcagcaggatctcagaccaggctcttctggctttcatagtctctgttgagaagtctatataattctgataggtctacctttgtatgttacttggcccttttcccttgaagctttaaaaatctttctttgttctgtgcatttagtgttttgatcttgtgtgaggtaacccaatcacaaaagaacacgcatggtatgcacccactgataagtggatattagcacagaagctcgtaatacccaagatgcaattcacagacaacataaagctcaagaaggaagtgtgggtgttttggtccttcttagaaggggtaacaaatactcacaggaacaaatatggagagacagtgtggagcagagactgaaggaaaggccatccagggactgtcccacctggggatccatctcatatacaatcaccaaaaacagatgccacgtagtgcatcctgacagaaacctgatattgcagagactctgccataacctgacaaatacagaggcagatgcttgcagccaaccactgaactcaccacaaggccctcaatagaggagttagagaaaggatcgaaggagctgaaggggtttgcaactccataggaagaacaacaataccagccaaacagagctcccagggtctaaaccaccaaccaaggagtacacatggaggaacccatgtctcaagctgcatatgtagcagaggatgggcttgttgggcatcaatgggactatctattttcttcctacaaagttgtacaattaaaatgtcctttttatttaaggatcatcatctaccttgtcttcatagaaaaatttcccctacaaaggtagatctgtgtcaggactttcacttctgttctaagtggttttgtccattcttgcagcaacaccatctagccttgaataaagtattaataggtaaacaaatccagtttaccctctaacttttttctatatggtatttaaggaggttttaattttattcaatctgtgtatttatatgcatatttaaaaattatctcaataattaaaatattgttacaatattgatttgaaatttattaaatttttagatcagtttggaaagattttttatctttactatgttgaattttctaatccatgaatatagcacatccttctatttaggccttaggagaataagatggattgtggacttcattttccataagattcacacaacaaattaaaatgaaaaaatatccaaagagctaaaatgattaacaaatagtgggagtagtttaaaaatgaattagtactggtagttgtttccaagagctgttcaaaggagaaatgaaataatgtgcaattagaacacacaagaaaagaaatgttgctgtggtctgtgtaggtattttttttaaataaactctagacatttgcaactaccttgagaggtgttaacatcttaatctatgaaaataatataatgaagtttattttaaaactcaaattataaacttaaaagaaaaacacagaaactaaatatagaataactttttttttattattattcagtgttttggactaattagaaggagagcttaccttgaaatcacaagcatctgtatggtaggctactcttgaaaccaaagtttactctctttggtacacatagttatttaaatctgttcttttcaagttctcatataccttcattaaagaactaatgagacttacttgtaattaagagcattcatttatataagcatttgtttaaaaaaatctatagaaatgactttttttggaaatccagtattttcccctatactttttgtctatgatattaatttgatttcagccattgccttttctctgtatgtatttctgcttagattatcatacatttaaaattattataacttaaaataattagttcccagtataattaaacagtggtattttaaataatataatacacatctatctaaaatgatgagacatatatttatagaaatacgtgtttgcaattttttgaaaaaaatgttttcacattgtcttagttaattttctattgctgggaagagacactataaccaaggcaacttacagcaggaaggacatatgaggcttatagtttcaaaaggtgagtctatgaccatcatagtcatagtagcagacaggtacggcactaaagtagtagctgagaatatatgtcataattcagaagttattagaatgacacttggaatagagtgggctttttgaaaccttaaagactgtcccaagtgacacaccttctctaacaaggacacatctcctaattcttcccaaacagttccaccaactgagggccaagtatgcaaatatatgagcctttgggaccattctcattcaaacagacataagcataatggttaatattattactgatttttaggtttggaacttattttgaagttaaataatctagccatgtagagacaaatccttcctttaaggtatacatatatattcatttatttatttaaatcaacaaatattgaaactccttacacactacatactattgtgagtatagaagataagaaatggatggaataaaaatctttcttttcttttggaataaaattctaatggatacatataatgcacaagataactgtcttagttagggttttgctgctgtgaacagatactatgaccaaagctcattttataaaagactacatttgattgaggctggcttacaggttctgaggttcaatctagtatcaacgtggtagcatggcagcatccagacaggtatggtgcaggatgtatttagagttctacatcttcatctgaagactgcatggaaaagattgtcttccaggcacttaggatgtgggtcttaaagcctatacccacagtgacacacctactctaacaaggccacacctactccaacaaggcctcaccttctaacagtgctactccctgtactatgcgtattcaaaccatcaaaataagtaacttattagatgcaagaagtatacatgtgtatacttcacatatgtatgtgtatttatgtatatgtacatgtatttctgtatataaccatttgtgttatactaaacatgaattaatatgaaaatatgcaccctaggtttcacatgaacctcatgattcaatcttgtttatctgttatttcctactctaaaaatgggaaacaaggatgacaacacagatgacttgtacaagatagaataatagttttcttttagtgtgactaagtgttcatattgtagatctgtgatgtcagacaacaatactttgttttaaaatttagagtaattgtgactcctttgttatgtttagaagaaaactgtttcctcaaacccactacagttcagactaagaatgcagaaagaaatggtggaacttaaaaacatgtgtgttttgtaagttatggtatagaacagttcacataatttctgcttatgccacgttgatgggattttagtcaaatgaccacacccactatactaaaggatgagaaagtagtattgtcagtaattgtatgtaaaacattcaaagattgtataataaaatgcatacaggaagattattgttacaaaacataaaaaccatttaaaatcattattatttgaaggagaaattgaaatacatcacgaggatgatacaaagttatttggtaattaaaagagataaaaattggttaagaaaatcttggatgaaccattctgactttaaaagttttaataaaagttttaaagattaaattctgaaaggaataagaaaggtacaaagttaaatttttgataaacaaaacattcagtctaatgttgagacatgcttaaagagtaggagtattactagtcagccaaaaattacattaatagagaatattcaatttcaagatataccctatgctggtattaaaagatggacattataaatgctgtgggtttgagtgtttattaaaaatttctaggctaatattcttcaaaatatgttgccttcttgtctgctgtctgtatgcctgtctgtctgtttgactgtctgtcatctttatttttgcaatcccaaatactctgggggctgaggcaagagtataacaaatttagacccactgtgggtgacagtaaccaaatgagattttctttcagtgtaaaatgttaaaatatattaagtgatgtagttcagttatagaccacttacgtagcatgtagaaagcacaagattcacatttcaatttgggaatggggaaggaaaggaaaagaatgatggagagagagagagagagagagagagagagagagagagaacacccctttaatgtggaaagattgctatttgtgtaaaagatgaatttttatgtaaagaaagaaattactatttaaaaattggacacgtgggacctgaaactttgtttgaaatgcccaattttcaaataaaactgacaagatctgaaataaaaggtcaggaagccacatattgagtctaacatcaatcaactgaaattaattctaagtcaacctagatgtactataggaagtacttcaagggagctattgcaaaccaagttttaaaatatatttaaagacttcatggaaagtatgacactgattttaaaaaagcagagacttttaacaaagatataatatgaaacaattgtaaattttagtgccaaatcatgaagagttatgatggcaaatgatagaaatcacaatctgaaaggtctatagaaatcatccaatttcaagaggacagacaaaagaagtgtgaagaaacagaagcagtatggattcaaagtcatgctatgaaaatattacatacacatcaattatataattaattggactccaagaaacagggggaacatggctcaaaagtcttgaatcattataaagactagatagattcatgaaacttacaaatgccaaagggagtgtgaatgaccacacccaacacaagaaaagtatttgaaaattccagtacctttgagggaagacctagatacactttgtcttagtcagggtttctattcctgaacaaacatcatgaacaagaagcaagttggagaggaaagggtttattctgcttacacttccaaactgctgttcatctccaaaggaggtcaggactggaactcaagcaggtcaggtagcaggagctgatgcagaggccagggagggatgttccttactggcttgcttcccctggcttgttcagcctgctctcttatagaatccaagactaccagcccagagatggcaccacctacaatgggcccttcccccttgatcaccaactgagaaaatgcaccacagctggatctcatggagtcacttccccaattgaagctcctttctctgtgattaactctagtctgtgtcaagttgacacacaaaaccagccagcacatacttgttctgaagtacacaccataaattttgtagacaatggttatagttggttttgaacagtaatttccacattaaaatatttcttggcagctatacaatcagttgactattcagtgaaagttttaagaattagttgcagacaggtaccagcaatgctgtttccattttaatttgattgtgctgtttatgactatctaagcaaacattagaccaaaattatcttctgcttaaccttgcttttggaaacttgttccatcataatatattacagtctattccaggagacagtaagtttcaagagggaattcttcagtgtaaataaaagtaaaagacaagaaaaaaaaatatgtgaattgagataaagaagataatcaagagatacactcagaatgccctgagtttgggagatgccacatttttcattttagaaaaagtgggaagaaatggaaggcaggttaattatgtaaacaatctcttttcaataactgagcaatgtcagtacacgatgctactgatgagcattgtaaaaaaaattatactccagtatatgtgaaattaaaacagtaaatactatatagctttattctttccaatagtaaaataactagattaaatattttaccattaaaaattatttttgtgtcatagtatggatcattgagattttccattgttaaccattcttattccatccgtttctgctattgtttctattattcattttcttgtgcttaattcaacttaatttgctgttttctttcaagaggacaatgtaaaataattaattcttgaactgttcttttatgtattctaatatagtgttgaagagatggctccgaggttaagagcactgactgttttttcagaggtcctgagttcaatccccagcaactacatatgactcacaaccatctgcaatgagattggatactctcttctggtatgtctgaagacagcaacagtgtactcatatacttgaataaatgaataaaatctatt

SEQ ID NO: 225 - DNA, 12515 bp, Mus musculus
agtgaaagggatgatttattttgaatttttttggctttttgtcaatgtgggttaacatttttagtgagttatttttcatttgatcatgttattcattttgctgctcaaattatcccaagtttgagtatgaggagtcctttcaagcagattccaggatatttttttttccatttacattttccttaagacttaaaatctccttttctgaattagtctgagagttccaattatttgatgagtcgtggtattgcttttagtaaagaaagtatatttgtgaaccactgttttaagattaggtgcattaaattttttcttgtaatctcacattgaggtcttctgagagaataatccaaattttaaaaccatgtagattttgaaatgctaaacaacagtaaaaacctaagacttagaacaaaggctaccataaccgcagtgaacctatgatacacagatgttgtagcacatatctttaatcccaattacttcagacagtaaaacaagtaggtttcccgaacacatgttttcaaagctagtctccaagagaagtaattaatgaggaaatttgaattcatttgttgaaattttttgttttttaagatttactttatatatgagtatactattgctgcctttagacacaccagaagatggtgttcgatcccattatagatggttgtgagccactatgtggttgctgggaattgaactcaggacttccgaaagaacagtcagtgctcttattaaccaatgagccatctctccagcccatggtgaaagttcttgtttctctgatctaaaactattgtataggtcttaaagactgaagcatcaggaaagtgaaatagatgctaatctgtgcttcctaaaataccctgtctcaaaatagtaatagtagcaaaaagttcccatagtccaatagaacaacaaataaatgatatagtttttaaaaaagatttatttattatatgtaaatacactgtgcctgtcatcccagaagaggacattgtattttattagggatggttgtgagctaccatgtgattgctggaatttgaacttaggatcttcagaagagcagtcagttttctaaactactgagccatctttccagtccaacataataaatgttaaaagaatatgtatattttgttttgttttgtccttcccccccccctccccttttcttcttttggttttttgggatagggtttctctgtgtagctctggctgtcctagaaatcactctgtagaccaggctggccttgaattcagaaatccacctgcctctgcctcctgagtgcttggattaaagtatgctactactgcccgtctatgtatatatatggttcttttgtttgtttgtttgtttgtttggtttttggttttttgagaccgggtttctctgtgtagccctggctgtcctggaactcactctgtagaccaggctggtctcgaactcagaaatccacctgcctctgcctcccgagtgctgggattaaaggcacgcgcgcgccaccaccacccggcatatatatggttcttaaacagtaaacagacctctgaagtaaaagtgcaccaaggtgttatttttatcacttaggagattgagaaatcaaaaagttgataaagcactgttcataaggctgaggggaaaggcctcctaacactttagaggtaggagagtggtttaggtgtagctgtccaaaaaccaaccataatgtagaatataatgtcatgtaagggcagtcagtgctcttaaccactgagccatctcgccagcccctgtcctggtttcaaaagcaggaaatctgcacagctgttttatacttaatgcacaaaattaacttggttttgggacagacatattatatctgtgtagctacagtaatacaaatttctatatagtctttcttggtataaacagagacttagtaaattccaggatgctaattaagctggtagtgcatgcatttaatcccagcactcaggcatttggattctattgagtgtacatagtagggagaccctgtttcagaaatcaaaaaacaaagccaaatttctggcaagtttatgaacataaatattctacaacttcagggaaaaaaaaatgtaggcatatttgtgtgaagaatgcatttctgggtgtgtattactcaaagacagcctgcttaacattttcccttttgttattgcttttgtcagatctggattttagatgatttaaaatcctgctatgaatgtaaactattataccaacttaatgctttttagagtgtagactttgtaattcacatgtgactttataaagtgtgttttttttgccaggcgtttacagcttttagatggggaatatgaagtggccatgcaggaaatggaagaatgtccaataagtaagaaaagagcaacatgggagacaattcttgatgggaaggtatggatgacttagaggttgcacctactgtggttgtcagttcctattttgattgttttctttcttaaagaggaattgtatttgaaataaggagtcttttttttttttcacattaaaaaaattaatttatgtgctggagcgatagctcagaggttaagagcactgactgctcttcctgaaggtcctgagtttaaatcccagcaaccacatggtggctcacagccatccataaggagaatggtgccctcttctggagtgtctgaagacagctacagtgtacttacatataaaaatatgtcttttaaaaaattaatttacttatttgagataatatgttactatgatctgtctttcttgggattctgtaaaccatgatggcttctaaggcacaaagattcctctgccttccaaatgccagcattaaaggcatgaaccaccacattcaacactaaatctgcacaatatgctatgcttaggtttggtgtggagtgccttttcccaccgaatcatattgcttgtgcttagactcccttgggtgttaatagttagaaaaatgcaagcaaattggtctagtcagaaaatgtaatagaggacatggtgcttaagaaaggctgggtgtcttgagttacatctctactgggagttaactttgtgacttttgtcaggttaactcatttggccgatttttctcaaatttagggctagaattgaaaaggtaaaatatgagattgaaatcctatttagaaatatgttttaatatcacatttagaaatgttttgtggccgggtggtgctggcgcacacctttaatcccagcacttgggaggcagaggcaggcggatttctgagtttgaggccagcctggtctacaaagtgagtgccaggacagccagggctacacagtgaaaccctatctcgaaaaaaccaaaaataaaagaaatgtttcatacgagttttgggatcaaacttggtctgttatgctttgtagcaagttcttttacaaagaggcatctgaacatcaaacagcaacttttagatagtggatagtgaagagcaagaagaactgatacccaaaaagatagccactaagaaagatgagattttgacaggatttctcattttgtgtccgtgtgtgggggttggtggttggttgagacaggtttctttggggaccaggcagaccaggtaaacgagatttacctaactgccacttaagtgctgggattaaaggtgtgtgctacgcccatccagcaagacttctgagtctaactttactttttgttacatatatcctacgttttttttttttaattactgaaattggtttattgggaattagttttaaatatgatttttatttattgagacaaggtcttactgtgaacagttatcagcaccaatattgggttcaaaattcaactccgggttatctcatcccttcttctggcttctttgggtctgcactgaagcacatatcttagctgtgcacatgtatatatacataatttttatttatttttaattcttttttttttaagatttatttgttacgtgagtacattatagctgttcagatggttgtgaaccttcatgtggttgttgggaattgaaatttttttagaactgctgctcgctccgttgagccctgctctgtcacccccagctttctctggcccaaaaatttatacttatgtatgctgtagctgccttgacaaaccagaagagggcgtcagatctcattgtagatggttatgagccaccatgtggttgctgagatttgaactcaggatcttcagaacactgagccatctctacagccttacttttttgtttgttttgctttgttttgttttttttcaagatagggtttctctgtatatccctggctgtcctgtaactgattttgtagaccaggctggccttaaactcagaaatctgcctgcctctggagtgctgggattaaaggcatgtgccaccccgcccagctatgattttttttaaagatttatttattatatgtaagtacactgtaactgtcagactctccagaagaggggatcagatctcactaaggatagtttgtttctaggacttgaacccatgacctctggaagagcagtcagttcacttaaccactaagccatctctccagcccttgatttttattttttaaggaaaaaaaaaaaaaaagcaaagagtgttctcagctgctgagccatctctgcagccccaataatgagtatcttcatttcatgtctgtaatatcttgatgtcatcgtaactctgtcctattttatgtattgtttagaggctgcctccatttgagacattttctcagggacctacattacaatttactcttcgatggacaggagaaaccaacgataagtctacagctcctgttgccaagcctcttgccactagaaattcagagagccttcatcaggaaaataagcctggttctgttaaacctgcacaaactattggtaaaaatactgttgctatctaaataatggttttaatgttttagacttagagtaattcagttgtggtttggttgtctttaattattcaggaaatattctttgtcttatcaagtatcattattagctatggtcagttaagaatttgcctatattaagccaggcagtggtagcatatgcctttaatccctgcgtttgaggccagcctggtctataaagtgagttctcagacagccagggctatacagagaaaccctgtctcaaaaaaaaccaaaccaaaaaaaaagaatttgcctatattaaatgtaaagttctctaaagactttatttatgaccatgtttctgggagtttaagtttgtctttaacatttctgcagaatgttttttacctttaacatttctgcagaatgtgtttactaccttcagatgtgtctgtaattatcttatgtcaatttagaacacattttcccaataatttgccacagataagaaagtgattggttttcaatacatttttaaaatgtaaatcattgagctgcatagaatatttacctagcgtgatcaaggccctggcttcaaaccccctattctgcacctaaattacaggtacaggtaagagttctgctgtattaagtcctaactatctgtatcataagaacactgctcttgggcaggtgagatggctcagtgggtaagagcacccgactgctcttttgaaggtccggagttcacatcccagcaaccacatagtggctcacaaccatctgtaacaatatctgacgccctcttctggagtgtctgaagacagccacagtgtacttacatataataaataaataaatcttaaaaaaaaaaggggggggttttagggttgtcaggcagtggtggcacatgcctttaatcccagtactagggaggcagaggcaggagaatttctgagttcgaggccagcctagtctacagagtaagttccaggagagccagggatatacacagagaaaaacagtctggaaaaaaatcaaaaaataaagttaaaaaaaaaaaaaaaaaacactgctcttgactttagagcatctaagtatttttatatctcagaagagggaagatttctctttgttgtatggtcatgtgcaactgttaacatgcatcaaaagatgaggtgtgtgtggcccacagtagatccctttaatctcagcaggaagaggcaggttcaaggcttcatagagctgttcgtgacaacctgaattgattcccaaatcccacaaggtagaaacacagaactgactcctgaaagttgtcttgtgacctccacacgtgcaccctggttcctagggatcttggatgggagttggggaggggggagaagcctgaaattctgttatgtgtcagtttttttccacacaacagtagttcagcttttgtaagtaattgccacttcataacacttcatataacaagtgttaaaacttgtacacaaagataataaaattgaaaaggtaaaaaagaaatgacgcatgttgtgggaaacatttcctaagtaattcatgctttgggcacttctcaatatattcttgctaatgaaatgggtaaaagaattatagggaaactaggaaacaaaagctttatgacaggagattgtatatgtgatcattaattttgtcccatactaaataatagtacttaaatatttgacaatacgtctgatgaactatactaaaatcttgaaagattttggtggatggggtgattttaaaacaatcagttttcactttctcataaccagtcaaaaccagtcaggttcaggtttgaaccatagtgacaaagtatgtgactggcatttgggagggccttggctcaaccacagcactacccaaaacaaaacaaaaattcctgtgaccttaaagtttgtggtgttggtctgttgagatggctctgcagtcaagagcactgactgctcttctggaggtattgagatctgatgccctcttctggtgtgtctgactgaatacagctacagtgtacttatatataataaaaaaataaatctttgggccggagcaagaaggggaaaaagaaaaacaaacaaaacttgtggtgaactgtgggttattttctaatggcttaggatatcaaagggttttattgtagtgtttttgtttgtttgtttttaaagtatatatgtgagtcgctgtgttaaaaatcacatgagaagagggcattagatcccattacagatgattgaggcaccatgtggtttctgggaattgaactcaggacctctggaagaacagtcagtgctcttaaccactgagctatctctccagcctgtgatttttgttttttgagtaaaaaaaagaaaaagatgtcctcccaggattatgtggcgtatatttttaatctgagttcatgggagtaagaggcaggggatatacgagtttaaggccagcctggtctacagagtaagtcccaagacagctaagactatacagagagaatctctatggcacagtggcatgagtcctcagtatagacctttcattatcacttgaagttacagatatatcacaattataaatctttaattttgtcaagatactttatagaaaggagtctttgatcaattaagcaggtgtgtattttcagctgttaaggagacgctgactacagagctgcaaacaagaaaagaaaaggataattcaaatgaaagtcgccagaagttaagaatattttatcaggtaaatgcaactgattggcctactaaagtaattggtctaaaaaatgtatcattagaattgtatttcacatctgaatatttttcaatggtatactgttctagaggtgctaaggaaacagtgcctagaaatgtacaagttgtgagcttgacaactttttgttttttagttcctttataacaataatacaagacaacagacagaagccagagacgacctgcactgcccgtggtgcactctgaactgccgtaaactgtatagcttactcaaacatctaaagctctgccacagcaggttcatcttcaattacgtagtaagtagattttacttttgtttcccagtagtacaagtcacacacaacaacctaatataaagggcactttgcatgtaaacaggaagaagttctgcccaggttacagtggctgagtcagttcattttttttattttgtataataatatttgcatatatcatagattcactaaatatacttaagggaaatttttcttcttgagtaagaaaaatagtttatacaaagtttctggccaggcgtggtgttgcacacctttaaaccctgcactcgggaggcagaggcaggaggatttctgagttcgaggccagcctggactacagagtgagttccaggacagccagggctacacagagaaaccctgtctcgaaaaaacaaaaaagaaagagagagagagacagagagagagaagaaaaatagatgtttcatataggattatttatatcttctttttctaaagaccctattttgtttttgttttctttatagtatcatccaaaaggtgctaggatagatgtttcaatcaatgagtgttatgatggctcctatgcaggaaatcctcaggatatacatcgccaacctggatttgcttttagtcgaaatggaccggtaaagagaacacctatcacacatattcttgtttgcaggtaggcagaaagcttacgctctgtgttttacttattatagataagagtgtgtgggtgtatgagtgcatgggtgtataaagagagaaagatatgagtttgttcaacttggttctctccttctaccatgtgggtcccatggattgaatttagcagtcagcctaaatcgaggaaaaaagtattttggtacaatcttcatttcagtattggtttgtgaaatagtatactctttggtttttcaagacaggatttctctatgtaaccaccctgggtggcctggaactccctttgtagactagtctggcctggaactcaagagactcacctgtttctgcttccctagtgctgggattaaaggtgtgtgtgccaccatacctggatgacatagatttgtggaatttcctaccttggggctttcaagatggatggttaaaattagttgctcttgtagaagacctaggtctgtatgcatacatacacaataacctacaaaaaagggatatactattcacactgtttggatagtatgtgaaatataaatgattctatccctgttgtctaatgtcttaagagatgctatcctgcccagcagtggtggcacacgcctttaatcccagcacttagaagacagaagcgagtggatttctgagttcaaggccagccagggctatacagagaaaccctgtctccaaaagaaaagtaaagaaaaagagattttatttgcagatagccaattacttctcttttaattgagctttgtaactgtgcaatagtgttgaatttacagtggcagttttgtctgctgaaatgaaagcttcattttcataaaacctaaaaatcagaatttttggtttgatgtgtatctctagctatattctatttttctacttttgtgttagtatatttatagtataataaatactgggctgaagaggtagctcagcctttaaaggtcaggctcacaaccaaaacaatatgtaataatatatctctttgtgacaatttgatcatggttatactacatttatgtgtgagtatatgctgtgtacatgtagatgcccaagaagccaaaagaaggaagtcagatcacctgcagctggaaataccagctgttgtcatctgcccaatgtggtactaggatcctctgcaaggcaacttcaccactgaactatttcttcagctccctcaaatgtttccttttttcgttttgtttttgttatgttttttgttgtttgttttttgcttttggtttatttggttgttttttgggggtgacagggtttttctgaatagccctgtctgttctggaactcaggatatagaccagtgtaggcataaattgtttttggaacctacttttagtaaggattcaacctctcccttatctatcccactacccagcggagatagtggaaaagaaaagttattaggattgaggtgcggggatagtagacctgtttagttctttggaggccagcttgatcttcttgggcagcggttcactattgtagcaaacaccaaatatgattcagcagctgcagaatagtcctttgagcaagcagacagcaggaagctgtagttcagtcctagagcaaacaccaggctcacctccataaggccacagaagcaacaaggtcatgcaggaacctttgagcagctctctcacttgaggaacttctctcactgtctgcattaaccacaggttgagctcaatatacctagtaaggcaaacctatacattgatggctttagggaagaatatcaaggtggaacaaacccaaccaaacctcactgctcatctcctacttcctattgggtcatatttatacatataccaagcattctttcaccagtttgctatagcaaaacatcttttcacctgtgtctgcttcaggaaaacattctttcatgtgttctttttttttgttttttgttttttgttttttgttttttttttttttttttggttttttgagacagagtttctctgtatagccgtggctgtcctggacctcactttgtagaccaggctggcctcgaactcagaaatcagcctctggggggctggtgagatggctcagcggttaggagcgccgatggctcagcggttaggtgcgccgactgctcttccaaaggtcctgagttcaaatcccagcaaccacatggtggttcacaaccatcagtaatgagatctgatgccctcttctggagtgtctgaagacagctacagtgtacataataaattaattaattaataataataaaaaaaagaaatcagcctctgcctccccagtgctgggattaaaggcgtgcgccaccacgcccgtctcatgtgttttgttaacaagacattcttttacctgtgtgctcccagtaaataatcatttgacagaactaactttccaaagaaactagaagtttccacttcagcccagactgaccctgaactcagagatctgcttgcctttgcctctagaatgctgggattgaatgtataccccaccccactttgcccctttgaatattttttaatgtgtcctacctagcaatttattaattttccttatatacatttttgttttgttttgttttgtttttcgagacagggtttctctgtgtagccctggctgtcctagaactcactttgtagatcaggctggcctcaaactcagaaattcacctgcctctgcctcccaagtgctgggattaatgccatgagccaccacacccagctcttatatacatttttgtttggttatttgctttttaagagagagttgctctatgtggtcctagaacttaactatgtagaccaggttggccttgaacctagagatctgcctgcctctgcagataactcctgctgggctcttttatacttctctaattttttcttttttctttttgttttatttttcaaacccagaaagccattgttgtctttgaaattttaataattagaactgtggctatatagctcagcctttgatctctatttcttgagggttcagagagggaggttatatgttgtgtccattttgccttgtatattgggggggggggcagtataaaagggtgctgcttcaactacttttatgttttttgttttacaaaatactaacattacagataatgtctcatggtcagtgtcatatgggtgtacacattgtcctgtttgatctcttgattttgttaggccaaaaagaacaaaagcaagcatgtcggagtttcttgaatctgaagatggagaagtggagcagcagagaacatacagcagtggccacaatcgtctctatttccacagtgatacctgcttacctcttcggccacaagaaatggaagtagatagtgaagatgagaaagatccagaatggctgagagaaaaaaccattactgtaattaccttttattttcctcctccccagtagcacccatacaagtttgtttttttttttttttttaagatttatttattattatatgtaagtacactgtagctgtcttcagacacaccagaagagggagtcagatcttgttacggatggttgtgagccaccatgtggttgctgggatttgaactctggaccttcggaagagcagtcgggtgctcttacccactgaaccatctcaccagcccccatacaagttttataactgtcatttacaaagttatttaagtaaggaaaagtttactctatgtgagtttctattaaatacttttatttttattttttattgttgttttataactcagaattttccttaagtgaaagttggttttattaaatgctgccggatgtggtagcacatgcctttggtcccagtactctggaggctgaggcaggtgaatttctgaatttgaagacaacctggtctacaaagtaggacaggcagtgctgtgtagagagaccctgtct

SEQ ID NO: 226 - DNA, 320742 bp, Mus musculus
ttctgtcagatctttctctgatattccatattttctgtcattcaattagacattgctttcgaacatggatgtgttcttctacatataaactgtagttttgatattttggattaaagtcaatactaaggccttgcctgtactaaaaccagagcgattgatgttgtgtgtcttgggctgaaccacaccctaagtcacaacaggttcaagtatccctacccagtgtgatgtcagtttacttctgtacaatttcttctttctgaaatgaaaaccaagatccacatatactactcttcagtatgttgatatctgtttcattttttctgacttctacttgggactttattataatgttctttgaagatcggtcgatgacattctgttccttgtgagattatattccttaggatttttaatctggaagattttgctggtagtgtaggtggcaaagtatgtttactttgttctcaattccttgtgtgggatagagctttactgtgttgtatatgagaaatacttactagttcttgtgtttattcattcttagcaagaaatttcttatttcctatttcatgaaaaatgtatgcgttattttgtgcatactttcatcaattcatttttaaagtagtttttttgtttgtttagttggtttctttttgtggttgttgtttggttttacgagacagggtttctttgtgcagtcctggctatcctggaactcacttcatagaccaggctggcctcaaactcagaaatccacttgactctgcctcccaagtgctgggattaaaggcatgctccatcactgcccagctctaagcaggtttctgactaaaaaacatgtcctaatgaattactacattcaaatttattttatatactgtcaatactgttagccagttactttggattgccagttattttctctgaggacttgaaaaatattattccattcactcctgcttttaacctatttataactatttattactaatgtatgctactgtagtgtcaccacactgatggtaagggacaggacaagacaataggaaaagagatctacattgttatagcacttagatgtgacaaaagccagatatatctaggagtagagcaagccaatctgtaatagcgttccctagggaatgctaagctagtatgctatgttcttcttctacttaagaatcccagtgtctgaacacactacccattactattatagtttgtccactttcaaaatattgggatgaaacaagtgatagtaaaaattgaccgcaaggctgataaggacagaattaagtctctttagagtcagatatgtacttgaagaaatgccagtgtcaagttttaaagtcaaagtcctactgttcttattgacttcttggtgaatgtaataccatgggttattcttcccatgttagaatgagctcttgttcagtctccataagatgaaagatgtacttttcctgttatacacacagacaaaaataattccatgatatacattcattccatgtatttactgttattgaaactaaagcctaacatatatcagtcatgcaggaatttaggatctgtttctgaaatgttgacaacaatactcaccctttatgtcacaggcaagattcataaagtgacatgctttgtaaaaatgtcctgattattccctgaatattcatgcattcctatgcccagtttttctagcccatttgatgttgtcttgaaatgcctgggtcatagagatttacatattataaatttatgacagcattatatttttccctatatctacatttccgttctacagaaagtcctcttaccactcaatttcccatcacatgagttagggattatcctcatttctttcatgcatgttacagctgttagaatatttacagagaaacattctggtagagtatttgtactatccattttctttgctattggaggtatttcaaagctcctaaagttttctttaatttgtgctatttaaatctcctggtgctagcattttcaggtgaatggcctttgtaggaaattagtgtggaggctttgcacatccttgtctctctctgcttagtagaatagaaggatgacagatgtcttcagtttttgtagtgataggtttaggatgatggctactatgtttattagactcagtcatgttctttctttctttcttttttttttttttttaaagatttgtttttttttatgtaagtacactgtctctgtcttcaaacacaccagaagaggacatcagatcccattaagaatggtttgctgggaattgaactcaggacctgagtgatgttctttctcttccacattcttcagagctttcatagtgatccactgtgatattttgccctaggcctttcatagatatactgacatggttgagagccttctctcactgattgtatgtactttgtgccttgagttatttggtttgtgctttttgaaacagtcttgcatctatggcatgaaatcaagttgagttcattttctatatccattagagagaatttctttattattttattcatgcatatttttatggtcatttgcttttgcatcccggtacagacagctttgtgtgatgactgcaccacattccctactttctgtattctgcaatgttctctgtgcaagatgattgagggattttctaaagaaatttgtgaattaggtgctacatctatttagtctcagatagtgttaaaagacaccctgcaggccttgatttccatacttgcttattgctgggcctagtgttaagacatagaaagctttcttgttcacttgttcctaggatatcatttttttccctgttagttctcattaattgtgtatgactttctatggtactccatcatctgctatttcccagtttcaatataaactaatgaggcaggggcatcaaaagagaccacctgtatacccgttaaaagctaagagaaatatttgacatgagagaactataaggtcaatgtaatacaaaaatgtgctgaatatttgcttataccaactttgtgtagtaatagtatcttgatgtttagaatgagttcttatgtttttattcatgcataaatatgtttgtgtgtatgtatgtatgtatgtatatatgtatatatgtgtatatatatatgcattagtatttatttcaggagaccctgtcatacattcttactttcttttttttttttttttttcttttcttggctttttgagatagacattcttactttcatttggaactacaacatcgttaccaggtagaatctttgtctgtattccaagacaacagggcacatatagtacatagatacactgtatctgcctgtgagaatgaaatggaatctcatcatagggttaggtgtggtattctagtatgatatctaatgaaatactattcaactatgggcatcattcatggtgggcactagccatttgtctttgactctagacccaggaagataagttctcaataacaaccctgataatagtgttttacagcctggatgcatatactctgtgtttatgtcaggtgtccattgaagtcagaaagagtcctaggattatattcatattccttactacactaaatatgtcactccatgctctcatgtctgtagaaatgttggcaagattccttgtatcatgttgcttttaatgtcatttcatgtggtttatcattgtccattacattgttgtagtaatttcatttttttatttgcaaaccctgttgtgaaacttcaagaagagttccaatatttgaaaatggaaaaaaaaagaaaaaaaagaaaaaaaaaagaatgagttcttctctggtaaaattccaggtcagtgtgctgttcacatttctttgaaaattcctttttcactcaaatcattccatatttctgttattgatatgtggtcatggtatgtaaaggatttattttctatgatattcattttcttctgggatgtggagaatttaatggttgggtcttatcacatatataataccattatattccctgaatctttaactgtgaggacatataatttccatggactgaagacctgcaagtctcaaagataatctattgtaaataatgctcaaattttatcaattgctaatttctactttggatggagttgtgtccttttatattagtatggaaggaagttctcatgtgtcacttaatttgcattggggtccctgtgctcagtcttattgttatctgcaagcaccacaaatgcatttgtattggtcagactctggcatagcctcaggggatagctataccaggctcctgtcagcaagtgcttcttggcatctgcaatagtgtctggggttggtgtctgaagatgggatggatccctaggtggggcagtctctggatggccatttcttcagtttctgatccattctttgtccctgcatttcctttagaaaggaaccattctgggttaaaaatcttgagatgggtgggtggcccctttcttcaactgtggtccttgcctatgcactgtatatggtctctacaggttcagtccccaatttgttgggtatttcagctaatgtcatcacagttgggtcctggggaactcttgctttcttggcatctgggactttctagtggatacagccagtttctggctacaccccgcagtgctacacacctccattcaattttctgactctcaatacttctcccctgtctcctcccactcctaattcgcctctccccacccatctaccccccccatcctctctccctctcaggttcctctctccctttacttcccttcataatttttctcctaagtaagactgaagcttccacagtccttcttgttaggcttcatgtggtctgtgagttgtatcttgggtattccaagctttggggctaatatccacttatcagtgactgtatacaatgtgtatccttcttaggatgatattttttagttccatccacttgcctgcaaattttatgaagtcattgtttttaatagctgtgtgttacccctttgtgtaaatgtaccacattatctttatcaattccattgttaaaggacatctgggttgtttccagctcctggctattataaataagtcttgaatgaacataatagagcatgcgtacttgttatatgttggagcatcttttggatatatgctcatgaatggtatagctgggtcctcaagtagactatttccagttttctgaggaactactagactgttttccagagtggtcataccagcttgcaatcaatcccaccagcaatgggttatcttcccctttctccacatcctaaccagcatctgctgttacaggagttttgatctatttgcatttccttatgactaagaatgtcatttctttaggtgcttctcagccattcaagattcctcagttgagaaaactttgtttatctatataccctattctttctttacatttttaaatatattttttattagatattttcttcacttacatttcaaatgctatcccctttcctagtttcttctccgaaaatcctgtattcccttccccctccgcctgctccccaagccacccactccctcttcctggacctggcattcctctatcctgggacatagaccctttgcaagaccaagggcctctcctcccattgatggccgactaggccatcactgtaacatatacaggtagagacacgagtacaaccttgttttctttgactggtggtttagtcccagggagctctggggttactggttagttcatattgttgttcctcctatagggctgcagaccccttcagctccttgggtgctttctctagctccttcattggggactctgtgctccatccaattgatgactgtgaacatccacttctgtatttgctaggcactggcatatcctcacagaggacagctgtatttgggtcctgccagcaaactcttgttgacatctgcaatagtctctgggtgtggtggttgttttggggatggatccccgggtggggcagtctctggatggtccttccttcagtctcagctccaaactttgtctctgtaactccttccatggatattttgtacctccttctaagaacgatctaagtatccacacttgggtcttccttctttttgtgttttgcatgctttgcaaattatatcttggatattctaagtttctgggctaatatctgcttttcagtgagtgcatatcatgtatggttttttgtgattggattatctcactcaggatgatatcctccagatgcatccatgtacctaagaattccatgaattcattcttttttttgttttgtttttggtggttttgtttgtttgttgtttcgagacagggtttctctgtgtagtcctggcttgtcctggaactcactcagaaggtcaggctggcctcaaactcagaaatccacctgcctctgcctcccaagtgctgggattaaaggcatatgccaccatgccaggaaattcattctttttaattgctgagtagtccatctgatttaggattggtaaagatcttttcccaatctgttgctggtctttttgacttatggacagtgtcttttgccttacagaagctttgcaattttttaaaaaatatttattttattttattttatcttattacatgtgagtacactgtagctgtcttcagacactctggaagagggcgtcagatcttgttatggatggttgtgagccaccatgtggttgctgggatttgaactcaggaccttcagaagagcagtcagtgctcttaaccactgagccatctcaccagcccagctttgcaattttatgaggtcccatttgttaattcttgatcttacagcacaagccattgctgatctgtgtaggaattttccccctgtgcccatatcttcgaggcttttccctactttctcctcttaatttcagtgtctctggtcttttgtggaggtctttgatccacttagacttgagctttgtacaaggagataagaatggattaatttgtattcttctacatgataaccaccagttgtgccggcaccatttgttcaaaatgctgtcttttttccactggatggttttagctcccttgtcaaagatcaagtgaccgttggtgtgtgggttcatttctgggtcttcaattctatttcattgatttccctgtctgtcgctgtacctggaccatccagtgtttatcacaattgctctgtagtaacgctttaggtcaggcattgtgattccactagaggttcttttaccattgagaagaatttctgctatccttgtttttttgttattccagatgaatttgcaaattgccctttctaattcgttgaagaactgagttggaattttgatggggattgcattgaatctgtagattgcttttggtaagatagccatttttactatattgatcctgccaatccatgaacatgggagatctttccatcttctgagatcttctttgatttctttcctcagagatttgaagttcttatacagatctttcgcttccttagttagagtcacaccaaggtattttatattatttgtgactattgtgaagcgtgttgttttcctaatttctttctcagcctgtttagcctttgtgtagagaaaggccattgacttgtttgagttaattttatattcagctactgcactgaagctgtttatcaggtttaggagttctctggtggaatttttaggatcacttatatatacaccatcatatcatctgcaaaaagtgatattttgactacttcctttccaatttgtatccccttgacctccttttgttgtctaattgctctggctagaacttcgggtaatacattgaatgggtagggagaaagtgccttgtctatagtctctaattttagtgggattggttccagcttctctccatttactttgatgttggctactggtttgctgtatattgcttttattatgtttaggtatgggccttgaattcctgatcttcccaagccttttaccatgaatgggtgttggattttgtcaaatgctttctcagcatctaacaagatgatcatgtgtttttttgtctttgtgtttgtttatgaagtggattatattgataaatttctgtatattaaaccatccctgcatccctggaatcaagcctacttgatcatgatggatgattgttttgatgagttcttggattcttttagtgagaattttattgagtatttttgagttgatattcttaagggaaattggtttgaagttctctatctttgttgggtctttatgtggtttaggtatcagagtaattgtggcctcatagaatgaattgggtaaagtaccttctgtttctctttagttgaatagtttgaggagaactggaattaggtcttctttgtaggtctgttagaaattctgcactaagtacatctggacctgggctttttttggttgagagacttttaatgactgcttttatttctttaggggttatgggattgcttatgtgatccgatttaactttggtacctggtaagtgtcaagaaaattgtccatttcatccaggttttccagttttgttgactataggattttatagtagaatgattttttttggatttctttggtttctgttgttatgtctcccttttcgtttctgattttgttaatttggttactgtctctgtggtgtcttgttagtctcactaagggtttatctatcttgttgattttttcaaagaatcagctgttctgagtttgagtaaactaaggaatttctgagttattaaaactggcaagtaaactctaaattttccctgtagactcagtggttgaggctgagtgaaacttcaagattctgatcccagggttctttattaagtataattttggaaagaaatttcttggtaataattgtcttagtcctctgtgcacaatgaaggtgaaggtgtgactacctcaaaagtcttttgcaaagtacatgtgtttcttttttaaagttggattctaaaaataagggcctagaggaggatcaagcatacagtgtagaggacaccaagctgtaaggtacatgtcctatgtcccccaaggatggtttgttctcatggagaaacaataacctaggattgttgtctgggacaatttaatagtctgggactttcaggtgtggtgtggcacaacaactaccacaggtcaccaagctgcttactacatccattccttcacttctggtaaaaaacaaacaaacaaacaaacaaataaacaactgtacttctcttgcactgaagaacaaactctggttttataccctagagcttatttttatttatttatttattcatttattttagtttttcaagatagggttcctctgtatcctgttcctccctggctgtcctggaactcactttgtagaccaggctggcctctaaatcagaaatccgcctgcctctgcctcccaagtgctgggattaaaggtgtatgccaccacgcctggcctagagcttatttttgatcataatatccttttgttctctacagaaaaaaaaattatggatgtatctagttcttaggatgttaatgttgtgttagtgtaaatggaaagacaatcaaaagatgttttctagaatataaattatgttgttgagatatacaaagtgtgattacattgcttgactttatagacataaaacatggaagtgctgctggcataattccagcaatcaaacactgtggcaggtgtaaccctaactcatgtccacacacacttgtgtatatagatatataacatttaaccaaagtgcttttggtattcaagtcaaattagacattgattggttattcccagtaaattcatgacatcattgccctaagcatattttctgaaaaggaaaaattatagatcaacgtctttttggttggttctgtgtatatattttactttgtgtacctttcaaagcatcttccctaatgaggacactggaatataagagtcaatgttcttactggcaccagtttgcccttttcatatacagtgttttgtgtcagccctgtctttagcaatgaagacttattgtcagtttgtgaaaagcaaccccttttgttgtcagtggcctgcattctctgggtatttttatgagatcactttggctagcaactttcttgatgtaacacagttgaaaagacaagatcaactggaactccatctctttcagtattcaaagacttcatttaaaccatcttcatacacttataaagtggtacttttcaaaaaaaatttttttttgcagatatcttactaagaatgtatccaacagaactccatggagtcttgctccgtggtcctttcctatgcattggcagaaccatgagtgtgacaatatattatataaaagatcttaccttctaatagatggagaattttcctggacctcacagccagttacctaatcctttataaaactctgttaaagattactgttcactgtcccattctttccccacgtgatggttcccttaatgttctagaaacactccaaagctctctcttatgcccagccagacagatacaaacaaacaacagattactcagatagacacaaacatggagacaaaaggcagacagaaagggagatatacacaaggtagccttcaggaagttacagatttaaactaactgaacagacacacagaggatggaaggcacagggaacatgaagtagagaattcaactttggactcacacttaattaaatgctctgaggaaaaggcttttatttctttccttaactcaactcagatgcattattaaccaccagtatgtttaatctactcacatatgaagaatcaattaacttgtgaccttttttttttttttttttttttttgcataagtacaatatgggaaaaactaaaagtcaccacaatgggaaactagtagccctgccatctgaaaggtgttcatgggctttgaaccctgttctttaaagtcagacccccaggtttgggcttgtgcttctgagctctcgcctccatgctgagctagaatccattttaacctctcataatcatcacaacaggttttgaacctaagaggtcacatgagaatcctggaactcattacaatcatgaaaagagttgacttcctagcaatagtctaatgagacttgggtaaatctcgagtcttctttccccagcttatactgatatgcatgggtgtcatagagtgtttcagtgaacaatcaggaaactatttatcaacaaacagtgcagtgtgtattgtaattttgttctagtttttctttctttccttcttacttttttttcttcttcttctttttttttttcacttttttgacaaaaatctagacagttttccaaaggagtttctcttaattgcctcacccttcaagcagtaaataatattgtgccttgacttaatatcattttaattcaccattttctttgactgaggtacccacctcctctaccttttctttaagtctgataatctgtctcccacagtttctctatgtttttgtttttgttttttttaacctcactacattttcttttcaggtgtttttttgtttgtttttttgttttttggttttgttttgttttttggcattcctgagcacctattgaactcaattttaatattttatagtgtcctcaggcatctggtattattttcttgttcatggttcattttgttcctgtctgagtggattcacatggtttacaaactttaatgtccctgatgtgtgttttctattctttatcttggatatcacataaattgtgctccttataggatacttctatggtttgcagtttgagccgaggacattttatcatagtttctgtttgttttgggtatttgttcttagcatcagaattcagagggattgcttaattgtgtgcatttttagcctacattgctagactcacaatatgagaagttagacaggattagttgtatctgaagggttcagaacccaggttcagtgtcctactacatccagctctggtctagtctggcagcaaccttgtggggaagctgtgcagagtaggtcatgggaagttttgtgagaggcagcctgcaacagatttgggggaggggttcctgatggagagtgtgagattcctgcataaattgatgagtttaaggaaaagacaccttaaaagccaaggaaaaagcaagcaagcaaacaaacaaacaaaaaatccaaaacaacaaaaattagtgtgaagaagtgggtagctaatgacttaaaagttcctgaagtaggtggtcttagaagaattccaggaacctgttgaatattgggcgggtccagaaggcggggctaggcagaagtgaagggaagttcctaggtttcatcattctctttgtatcttggttgcctggtggtcaggaagtcctggagggaaacttgtgcctagtattagtggaacatgaaaacttccttaagcaacagttgctgtgctggcctcctaggacattgagcagctggtcctgtcaccttccaggtcagaggagctgttgtactggttaatgggcaggagcagggcaggtgtgtggagcatggttgcattttctgcctccactatctcaattctgttgtggatatcttaccattatcaggaagtttgagatcctgtgaattgggttcatggtgatgttttaattaattttatggttgccagaatatatatacataatatattattattattcatttaaataaccccgtagatccttggccttctctggagtttgtgtaccgggatggttgtcttttcaaaagccttaatagagctcctcgaattcaaattcattcatgctttcttaactcgcctgttcctccatttgccatttcatttccctttctccaggaactgaataggcacccagagagagctttgtagatatttgtcatatgggggaccagtgcagatttgattgaattagaaaatattctttttaaagtaccgtcatgttgctgtacatattaatattaacctagcaaagttatagtctccgttagtttaacactgaggtatatgcagtctttgatgtaaatacagcattgagaaatgtgtctttataggcttagttattaatgtcacaccttaggtttgaataaaacatgaagacaggattgcagcaaggtacagctgaggagaagatatatagtaggttctgtcaaccctgagtgtttccagagaaaaactaattgtaccatgtgggcaagttttataaaataatacatcgtgaccaagagatggatttggtcacatgctacaggcagtttaataggccattgtagtttcctgtgaggctttatcattttcccaagacataaacctgcagcaatgcacgaagatacctggttcttatgctggcggtgcagttaatttttggcttttcagtctgagggagaaagcattcagagatatctgattgggtccagactgaaccaggccatcaggtggggggaggggaattgaggatgtgttggaggatagaggggcaggtcaagagataaccagcagccaagaaagtacctacccaactatgactttattgatatattaacagacaccccagttagccattcctcctgaatttctttgaatccttccaaggttcagcccagcatgtgtgagaggataatttcaagccaagatactttaataagtgggaagcttactatggattaagacaaaattggacagtacctttggaataattatgaatgctcactttcctaagaaaaatgactccttgcttcatgaaaagcagtctgcccatgcacattcatggtttgttgagttctgcgctgtggacttcttacaggtgtggtaatgcttagacgctgcactcaggagttttttcagagatctcttgttggagaaggtcaaaagtttggatcctgcatttcacaatgtttttcttacattcttccttgttctgcagtgtttctgggaaatggaatctgtatgtgtgctaactgtgtgactgactctcacatctctagggtaaacagaaatcctcagggaaaaagagacgttctcatgatatcttctctttccttcatgtttatccttccacctggtgttggcatctttcatttttgtcacatgaaaaggtccaggttctttttgaacgatattttcccattttcaggtctccattactcagccaaatctgcataactataaatcaaatctaagagccctaagatggtaaaggccaaggagactctattgaaggatccaggtgtgttagaggctttgaacaaggagtggggtgtgggttcacctgaaaatgtatgtattcctatgcccattttttattacacacttgatgctgtctgcaaatgcccagggcatcaagttttacatgttgtaaatttatggcagtattgtatttttccctgcatctccaatttctgttttacagaaaatcctgttgtcagtaaattttccatcacatgaattagggattatactcagttcatacatactacaattgtttgaatattcacagagaaacattctggtattatctggtttctttggtattgcagatattacagagctcctagagtttaatctaatctctgctatctaaatctcctagtgcttgcattttcaggtgaatggcctttgcacatgaagtgtcccagagtgcttgcacagttagcatctcttctttccctgtaccgtcccttgttattcatgttttcatccaatccttgtgtttcatatatgttttaaggaaggttttggatgggtatccatgctgtcatatattcataatcccatgttccatggtaaatgacagcaggggtttccataactccactttctccttcttttacagtctttgcctttttcccactgctggctttttattcagcactctctgaattggcagtttccctttacaaaccatgtttggctgagttatccagaaagcaccaacaatttaaatgtatttccagtatttctacatatagcagtatgtcagttataaattcatttttgggcctgtggtcattttgtttttttttttgttttgttttgttttgttgtttgtttatttgtttggtttgttttttgagacagggtttgtctgtatagccctggctgccctggaactcactttgtagaccaggctggcctcgaactcagaaatctgcctgcctctgcctcccaagtactgggattaaaggcgtgcaccaccatacccggcttgggcctgtgatctttagagtgacttttgaccagcttctagtgaatgtctatttcctttgtaggctgacctcagttcaaaccagtaaagtttctgttacctatttgtcactactacacctgtcaacataccttgttagacaggttggtattacagcacaagggtcagtcagtatctagggagaaccattaatgacaccttacacccatcagcctgcagagatccttttagcagtatgtatgctaaaccagcatatccaagatccttttagacactgagtgctcttctcacttatcagattgttctttaggaatgtataaaaccaaatgatacatttttttatattttttcttgtattctatagcgtgttaagtattttatcagattggattatttcttgggatacttgcaagtcttgacttaaagaattatcttttttgtaattcgagaaaacttaccttcctcatatccttatttgaacattgaaaatattctaagtcttacttgctccttgtaagcactgctgtactgtgataacttagtttggaagcttgtttgtcttctgagtagagtagaatgatgacagctgtcttcagtttgtgcagtgataggcttaggatgttggctaacattagactcagtaatgttctttctgttccacattcttcacagctttcatagtgatgcactgtggtattttgctgtaggcctttcatagatatattgacatggttgtgagctttctcccactgattatagtttatgccttgagttgtttggtttgtgcttgttgaaacagttttgagtctctggcatgaaatcaagttgagtttactttctgcatcattagagagaaactttttaaatgttgcactggtgcacccatactattattattttttgtgtgaatgttttcgtggttatttgcttttggacccaggtaaggtcagctttgtgtgataactgtaccatattccccttctttctgtgttctgcactgttttatctgtaaattttttgtgggatttttcagaagaaatttgtgaatttggtgcagcatttgattattcctgagaaagtgctagaaggaacactgagagcctgggtttctgctcttgattattccctggcctagtgtttattgttcctaggaaatcaatatttcccttgtcaattctgtttcattttctatcactttctatggtactcgatcatttgctttttttcccattgtcaatctatacttctcaggctggggcattggaagatatcattcatatacctgtcaaatgccaagagaaatatttgacatgagattaatataaggtcaatgaaatacataaaaagcactgaatatttgctgatatcatggtcatgacaactttcttcagtaatagtatctacatgttcagaatgaattcttatgttttcatttatgcatacacatacgtatgtatgtgtgcatatatgtgtttgtatgtgtattggaatgtatgctaggagaccattatcacactttctttctttctttctttctttctttctttctttctttctttctttctttctttctttctttcatgtgaacctataagagtggtggccagagatgaaatctttaacagctagactccaaagagtgtcattgcagtcatatttattactgattgggaacatgagaacttcctgcaacaatgcctcaatgcagatacacggttgttcagacagatgttccaactttgatagtattttaacagatttgatataatgagggaattattccaagggcattaccctcaaatgactcatatatatatatatatatacacagtcccttgcagccaacagtgaggttctaccatttctccttcttgattttgtatgtcaaattattttatgcaatatgctctcagcataaaatatattcatagtaatactattcataaaattgcatatagaagttgtatacaactcaagtgtcactttacactaaagacacttaccttgagtttttaaataaaatttctaaaattttctctgcaccccatcccacccctcctctccacccctccaagaggatatccctacacctcaccattccaccaggcctccccaattcctggcacttctagtctctggagggttaggtgcatcttctttcactgaggtcagaccaggcagtcatccactgtttatttgtcatggtcatcatgtcagctgttgtttgctgcctggttgttggcccattttctgagagatcttggggggtccagttcagttgagactgctggcatatggatggggccaccttcctcctcagctccttctgacttttcctaaattcaaccacaggggtcattggcttccatccattggttgggtgctagaatctgcatcggactcaggtgcttgttggacctcttagagggcagccatgccaggctcctgtctataagcacaccacagtatgagtaacagtgtcactgccctttgccttcccttgatatggatcctaatttgggcctgtccatgggcttcctttctctcatgttcttctccagttttgtccctggagatccttcaaacaggaacatttctggatcagaggttttgtgtataggatttcaactccattactccacttgatacctgtctctccactggacagcactttatccaaggtctctccctttgagtcctgggagtctctcacctcctaggtctttggaacatgggagatggacctccatagcctacctcctgaggctgtctatttccattttttctactgattctcagggcttcagtcctcccccatccctcacaatgactgatcatgtttccccttcccctctctgtccctgcttccactcagttctctccccacttcttcccccaaaaatgctttcctctgtctcccaagtgggattgagacatcctcacttggaaacttgagctttttaaccctctgtagtcatttatgttttattatatactttttttggctgatatccatttgttagtgtgtacatactatgcatgtccttttttgggtctgagttgcctcactcaggatggaattttctagttcaatccattttcctccaaagctcctgatgtcgttgttcttaatagatgaataatactccattgtgtaaatgaaccatatttcagtatcgattcttccattgtggggcatctgggttgtttccagatcctggctatcacaagtaaggccactctgaacataatgcaacacaagcccctgtgtcatggttggtcatcttttgtgtatatgcccaagagtggtatagctgggttttaaggtatatctatttccaatattctgaggaatctccagattgatttccagaatagttgaccagttttcaattccacaagcaatggaggagtggtcctctttctccacatcctggccagcatgtgctgtcacctgagctttttatattagccattctgattggtggaaggtggaatctcagtgttgctttgatgtatatgtttctgatcactaaagactttgaacatttcttttgaagtttctcaaccttccacagttgcttcattgtgaattctctgtataggtatctacctcattttttgattgggatgtttggtttcttggtggttagcttcttgaatcctttagatatattggatattagccttctatcaagtgtggagatagagaagggtttttttttcccccaatctgtaggttgccactttgtcctatttgctatgtcatttgcctgacaaaagctttctagtttcatgaggtcccatttgtcaatttgtgaacttagagcctgagccatttgagttctttttaggaaatttcctcctgtgaaagtcagtttggggctctttcccactttatcttctgtttccttgattgtatcttgttttatgttgagttccttgatccacttgaacttgagctttgtgcaaggtgataaatgtggatctattttcacttttctacatacagactgccagttagaccagcactggtgattgaagatgttttcttttttccattacatatttttggcttctttgtcaaagatcaattgtctgtaagtgtgtggtttaatttctgggccttcagttctattccattgatcaatctgtctgtctctattccaataccatgcagtttttatcactattgctctctagtaacacttgaggtcagggatgatgattccttgttgagaatagttttagctattctgggttttttgcttttttaaatgaatttgagaatttttctacaactttgaacaattgtgttggaatttggatggagatttcattaaatctgtagatggcttttggtaggatggccatttttactatgctagttgtactagtccttcaccatggggtatctctccattttctccattttttataactttaaaaaaagaaatgaagtacactgatttttaaacatagcagctcctatgtagtttgcttgtgtgtgctttctggttgctaaatctagatatagagtctagttttaagtgggaaattacctttctgtttttcaactccttcacagactaagtttggctgtcttggaaatatctttgtggatagatcttgtacacataggtgtgtattgctctgtctcctgaatcctggagttaaagatgtgtcccatgatacctggacctaataatgttttcctccttagaacttgatctgttccaggctgttcttggactttgaaacctgcctccattttcaaactcaaaccagaaacttaactgggtgaaattttgtctgagatcatcactctctcactttctgttactcctttattcctcacaccatgagccttgttcttttaaaccatccctttccctttactgactcattagtgtagctacctctgtaattttaggtacttggagccccttatacaaatcatattgcatgcttatagtttgcgtagttgagaaattttgggcaatgggtgcggggaattaaaggggattcccacatcccaccagagctccagtgctctgggcaagtggacagcaatctccatgaggctcaggtgggcatctggctgtgggaagctatggatctccagtccgcaggggtagagagggagcagtttgtggtttctgggtctcacagaggccacagaccacaggtcctcagtcatggatatcccagatgtcattgtatgttgtggaagagctgagaacaaagtgagggctctgggggcaactcggtcagccccagagctgaagggagaatggagcagggggataaggcactctgtggctcccaggatgtgagggtctttggtctgatctggtgactagaaatgctgagaggctttgctgctggaggtgacatgtggctctttagggtcaggcctattccatcattgaagaacagagggctttgatgagtggagagatggttcctggttttaaggtgtttattgtagaaagtcagagagagggagaggcgtagggaagtagaagccagccatggccatgtggagagagggaggaaaggatagggaggaggagagctagagatgagaataagagatttaagagcttaagagagagaggaggggccaaacagccctcccccccttttcttttgtaaaacagaactgttagagtggcatttttatttttaaatcattaagactggtcaagaaataaaacagaaacatagtaaaatgtttaaaaaattaaagaatattcttccaagtataaattttataaatacaaaacaaattcacaaatgactttgaatgctaaataaacatctagttaataaattcagtcggcactggctacggcacgtcagagctagagaattggattcattcatgtgtagtgttgaaaccatgtgctcatgaaacagtcttaagacacattctctaagctgttgtctacaagagctactgtggagacaaagcctccttatgaccgaaactcctaaagctcaatgacaaaataaatcattgttgaaaaattattttccaggatacctgaacacatgaatgatctcaaaatgcacaaaagcctctgtaaaccaggactgtacccagtacagctataaaacttagtagatactgaacaaaaactgtagcaaaggaaatctttcctacattctcctgagtgcttaatagtaaattgagaatatagtgcaggccacacttggatgtggtcaaccagctgttattgctttatacgtgtatctgctttagagcatggtttaatgttccattttcatgaacgatttatgtttttcttcacgtatagcctttagaaggacaaaattagatccgtgacttctatgcagctagtgcaaacagccccttttatagtgggctgggttacctatcccttgcagcattactgttaggaggagctggtaactgaggttggagtctagccagaatgccaggagcttgggaccttgtcaacgtgacagatagtcacaggattattcagttgtggggctccgtgttgtcagacacccgtgtctgggaacgtagctcactgttctgtcccttgtagagttttctactgggtctccaaagtaagctttgctcaattagaacacaggctgcctttcacagtcccacagagaaaagctctaaagaatagctttaattttaaattatataatcttcaactcatgttttcatagttctttcccacagccttaaagtctgtcctgaaggtcataacattaccattttcctgaggaatatctgacacattgttgcttcatggaatcttactgtttctggttatggagacataaaccttggctgggagaacattctcccaaaatcttggctgcgagaacattccacttaggaggaacttgtagtacagtgtatatgttaccatttgagcaagccgtatgcctacagcaaccatcagcactggataagtcacatatagtattgaccctgctcccttctattgctatcccagacctggaagacagacttttttctttaaagttttaactataggaatgttattctctatgtttttattttcactgaatgcctatataaaaccagtggaaccatgaagtaatcacaaaatgcatcacacaagattcaggtaaaaatcacaccttattttgtgtgtagaaagaaagaatcagtctgtgtttcttttcatgagcagcaagtaccctttacccctgagtcatctctctagcccagaggtttagaggttctgctacagtttcatgattgatcctgaatataaccctgagttctatttttggaaaaatgaaggaagaatcataaatgatagtaatctttgccacccataatcatgttagatgaatgatctcaaataataaagataagaatagtaatgaagtgaaagaatcataaaaggatctggtccttgcagtctataatcatgttagatgagtgatctcaaataataaagcaaagaatattgctgaagtcaaaagattcagactttaagttggacagtaatagatttatgtgcagtaattaatgaagaattagtaaagttcttatgcaacttaaacattcctttccattgtaacaaatcattttactttttcattttgttgttacatgtaacatttatttactcaggttctcttaactattctgaagggaaaccactgtggaatttatgaaattattatctgtattggttttgtcatgaataagaaaatggtacatgacaataaggctacctaatgctaattttttgtttcactaaatattctcaaactaaatctataatacatattttaattcttcatgaaaagattttcttttaagttattcttgtgttttacattccatactctattttcttgttctagaaaggatgcagcattgtatataggccttaggatctcaagtgagcattttagactaaagtctggctgttgacacccaactgcatacaggataggaacagggtctccatttgagcaaaggtgacaggttttagaatttgttagcacagtttcacttaccatcatttaccatctgagatgtgatactgggatcaacaaagtattcttaaagatacattcctgcatccagacctcaaatgtatactttattatgtctcaataactctggggatgctgaacccacaagataggagtccccaatcttacaatggaaaactggaaaatcattctaatctagattgtgagaaaacactccagagtgtcatctacccaacaagaggatgccttcctgtgccaggtagtacacagataataatggattaataggtttcatcacttttcatgaacactcaatgatatttttttacctcattgagcagacattatatccatgacaaccatcacagtaaaggctgatcactccttatctgaaaattcagattccaatacatccccaaatttaaaattcttacattaccacagtgatgccatcagcgaaaaaagtctgtggtcttatgtgatctcagtttttattgtcaccttaactaaatttagagtcacctagggaacatgattctagacatgtctataagcacatttcctcagagcttcagctgagaatggaatacacaacctggatgtatgcagcaccaaatagtggactgtggacctgggacaagtaacaagtagaaagtaagctgagcaccaccatgcatctctctctgcttcagtagtgcagacacaatgtgaccattcacattcatgccatactttccttgcaagtcaggcttgtatttctctggaaccaagagcctgtcctcttaaagaaatccttgtgtaagttgtttttgtcaggactctattctgtctgtctgctgtctgtctgtctgttatttatctatcatcctagttgaatgagtatatgggcatgagattggaggtcagagaataacttgcaggatatgcctctgagagggtccatgcaatagaactcaagtcaccaggattgtgcagcaagcacttttagctgaagagccatcttattggctcttgtgttaggctctctaccccatggatgcatgtgtacaaaacacataagaatcatgtgtttgaatttgttcctcatgtaaagatgtctcattatgtatgtaaatgtttgaaaatactaaacactaaagtagatctaggctcaagtagttcagaccagcgacagttgtcctgaagtagcttccattggtctatgtatgctatgccacaacaccaaaaagtgcaatgattacccaacagaaatcttaactgctcctagttctgtaggctgatgtccactgtcaggcactattggtctggcttctgaaggtctcttccttctcttctagatagccaccctcccacaattgctgtctgcttgtactttgatggaatcccctatttagaagaacagcaatgttactggagtagggccagacctttacctgcttaccttcctaaaagtcttggcctccagacacagccatgtgctgtggagtttagacctggacacacaggttggagccaatgggggttacacacagttcaagctgtgctgctctctcttctctgcagggtgtagttctgatgctttgtatgggaatctgcttgtgagcacagaagttcctgttacctagttagtttttaatcagtcaatgaggatgctagctgctaatggctaagaagaggtgggaattctaggtttccataggcaggctaagagatgcaagaggaggaaagcagattcaccatgctttagagtgagcaaccagccatgagatgttaaggataaggtttctctgtgaagtcctgactgtcctgaaattttctctgtagatcaggttggccccaaactcaagacattctcctccccagctacaccaattctggcttgattcctcattgctaattctggacagagagcacaggtcagggcccagcaaggagatcaagaggacaaaccctttagacactccaggaataaaatctgcagcacccagtgtggctgtggccatagacagttgaagtgaattactgctcttcagttagtggccctgttgtaattataaacagtgactgtaatatccacttcacctctcactggcattgacatagatgatgaaagccagctccagatatcacacaatatactcaaggtcacaatctgaaaccactctgaggtctctctgtttaggctgaaatgctcagagcaaggtaacagccaggcagatgaggatattagattgacctaaaatgtgaattcctagaacatcacagtatcccagatcactttttgcagaagaagtacataatgttgcaatccatactacataacaaactcggaagacacatgaagcaaaccttcaaagaaaacatatagaaataatctggtgatgtggcacacaacacaactttaatcccagcacttgagagggtaaggcaggaggatctggatgtcaagttcaacagtggcttctacagataaaagaatagaaaataaaataaatgaaatgaaataaatgttggttaaaatatcaaccaacctgtcctacaatccaacttccaaatatgcaagaagttgtgagtaaataatgtgtattccagtcttcttattatctagtctccttccctgcctctatgtttgataaacttattttcttccaggaaatataattattaaggaaattctcacacattatactatggatgaaagttatcgacagtatatacagtgaactaagcctatgaatgaagtatagatgtggctagacagtgctggatttttccataaccttgattatgaatgattgtgagtcaccacctaggtactttgaacagaattctggccctctaggagaagttagcatcttaaccacatcagcacctctctaaacccaagtcagaaaaaaaatgtttcttaagtaaaagatgtaatacttggaatttgaaggccatagcgaggctgcctgccatgtgcttgcctgccacagggtggagaatccaaaggaggtctgagaagatgagcagagcagagatctaggaaatcacatagagaactcaaaaagatacatcagtaggtgaagtttcaaaagcgctgattagtcaggaacttgtggtgtgaggtcaggatgagaccatgaccagagtacagtgcaggttgagggttgaacaatgcagctcagagtctgagaggattcagggaaaggtaggacatatttttatagaattcatccttgatgctaataagtgagaggaagcatggacagcaagagagaagttgtaaattttataattgtgctaaggaaattttagatgtaaaaaatgtagaaattagatgtaaaaactgtagatgtagaaattttagatgtaaaaaggggcaaattcaaggcatagcttgacttattaggttcatgaggctcccatttacaaagataggaagagggggtacactgaggatgggggggtacaaatgaggaccttggctattggtgtatgattaagacactttcaatattccattttaattatatatcttggtgactaattttttgtatattttatttatttatatttcaaatattatcccctttcccggttcccctccagaaaccccctattacttcccgcctgcttctatgagggtcctcccacatgcccccacctactcctgtctccattccctggcattaatgtacactgggccatcaagtctacacaggacctaggacctctcctcccaggcatgcccaacatgaccatcctctattaaatatgtagctggggacatgggttgctccatttgtactcgttggttggtgatttagtctttgggagctctggtgtgtctggttgtttgatattgttgttctccctattgggttgcaaaccttttcagctccttcagtcctttctctaacttctgccatatggaccctgtgttcagtccattggttggctgcaagcatctgcctttgtattttttaggcactggcagagcctctcaggagacatctatatcaggctcctgtcagcaagcactaattgtcatccacaatagtgtctgggattgttgtctgtatatgggatgaattcccaggcagagcagtctctggatggccttcagcatctgttccacactttgtttccatatttcccttagacaggagagtggggtgaaacaaatttaatctttggggttgtgaggtctgatcccaagaggacttacatatcacatgtaattagttggaagacatatgtgataaaacaaactctagtgtgagttttcactgtacttcatataattcttgggtttctttgttctgcttttattgtcattttagatagggtctcaataagaagtatatctggacagacacttgttatatagaccgggctggtcttcaactaagagtcatctacctacatgtgctactagtagtgctgggatcaaaagcaagtgtacccaccataggttcccatcttattttacataggtctccctaaatattctgtgctagctaggaaatgaagatccccatgcctcagtcgagataccaagtatgagtggctacctactcttgtctttaattttattttttttaaacaggatcttattaggtttgccttatcaagggtgttggtggagtaatgtgctaccaaccactctcagacagagtaggtgagatgagtgtcctgttctcccattctgttctcagtgttgttcttgaagcccaagtgaagaggaatgttaatttatacaaaggcctgaggagagatgactcaatcacttagagctgtggatattttagtagagaacctggatttgatgaccaatacctacaaggcatccaatgctgtattatgacagagcaaggaagacaatgcctccagtcctccatcttgtgttgttgctaaggccatttcaggtttaatttgaatttgatcttcttgatgaatcctatgggaattactaaacttcatttctagaaacccaagttcaagatatcctagatgactttctcagcctgtttgtgctggaatcccctctggctaactgcttatcttagattgtatcagacactacttgcttctgtgagtatcccacttcagttgcctcttgtgaaaatctggtgctcaggaaactcagtgcccttgctagcttagcccccttacctaggataatgtttaagaagcaattattgtgtacagttgtctccctatagaggtctgtatgttttttttcaatttttttgttagatattttcttcatttacatttcaaatgctatcccgaaagtctcctatactctcccccaatcctgttcccctacccacccaccccagtttttggccctggcgttcccctgtactggggcatataaagtttgcaagaccaagttggccatcatttggaagagaggtctgtatgttaaccttgatatttgctataataatctacctctaacattttggacctaatttaaaccaagcatgcattaaatattaaatactgatcaagaggtggaccgatgttaggaaaatctctccaattttcaaggtagaatggactcagtctcatgttatagccgtttttttgttttgttttgttttaagtgttaaaatcaattaggcgaccacatgttcacaggagcctattttattcctaaaggactacaattctcagcactcgaagaagttatgtgcttcctcggccgaggaggcttccaggttaattttgagtattatagatgcaaacgatgtatcttgatttcaggtggaagaaggggaaatgcaaacttggtgttctgagactcccttaggtaagcttccagactgctacatggtgagtacagggtcattgcccacatctgggtggagcaggctgctaagtctctggagctggtgtggtgtggatctggatggtaaggagtagatagatctggcaccctgtgcagtcttatttagttggacttattccctggaccagacaaccccgatttacaacaagccaataggccaatccccattgatagtttctgtgtactctgctggtgaaatgaaccaattcaagaaagattagattatattaagtgccagttcatttggaagctgctcttggatgagttcactggccccaagcaccgagttaagggaagtcccaaggtgtgaaggggcgcagaaagggggaagagaaagagaagaatcaggcatgtacagagagagaagggagaaagagggcaagagagagagcctcacagagagacacagagagagacaaagatggagagactgacagagaagatttattcaatcagtgtgcagaggaatattaagccagaacagcagatatggctagcctgcaatagttcaggaagaattagaaaaggtgatattctaagcctacataaaattgtacagagactagaaacgtccatgattacgctaggtaagcagactgtggccatatgcttcagagaagacaactacctcaggttagtaagattacttagacagagctccttctctaaagcaaggaatatgcttgggaaaggtggttatggtctggagccaggaccttcggggaaaggttgtgtccaatcttgagaagccaactcttgccaccatgtcgggctgtggttattagtcccaagtctactgttggattgtttagtaatgttcccgatatatcctgtgttccctgcgaacagcatggatttgatagaccctccagagttttttccattgtatgacagtttcgctgacttcatagaagtgtcccctctctttacctgttccctctgtaagtagtatacaagatgctattcttaagaagcttactgcatgatatgtagctgtgcaagacttatgttgcaagatatctgatcatgctctgaaccctgagtgtaacaagattaaataaaccatgggtcaagaagtgccagaagcaaccagctgacaggaagggaacctaggattattaagtaaaagtcacagagagtaagagggaattgggagcaaagacagagagatgcacaggaagcagcatttaggtacattcagtttggaggatgtcatttgagaaggtgtggcagaaagagattccttctgggatttcacataaagagaaaggtgaacagatgttttctctgcctctctgagctaccaggcttccacccagcatctggctcctgacacttccttgaccaaattgaattgatttagaatttattaaaaacaacagacatctcaactgcagcttttatgttttccatcttcgagtttttctaattttctcatcctctgagactttctgcttaggagcctgtcactgaagaattatctgatgtttagaacattgttgtacttatgaactaattctggaaatatctttgctgtgggaatctcccatctgtctaagtggttggaattgctttctgtagtccatatatacacaagtagatcttgcattccaataaactggtacttttgcttaagcttacagccatatttaatatagtgtgaggaattttaagctttaaacatgctatcctacagtgtagtactcaacttgattgtttaaaatatttttaaagaacaataacaaaggcaaaattatttatttggacatctcatattatcatcttttaaaacctaaattaatgcttagctataaccttaatttatataattttccaagtgagctaaccaggatttgcatgtatatcatttgctgaaagtgtcaaatctagacgcttaaatcatccttctaaaatgaatatgctattatggatattggttgataaacagtgatgtttgtaagtgtctgctatcttgatcagttgaaggcagtcacctaaccctttagagatttctctgtacagtatcccattcctttcccacgtgatgcttttcttgctgttccataaagattgcaaagatttttcttaaagtaagctagaaggacaaaaataggcatcagagagacacatacagagtatacacacacacacacacacacacacacacacacacacacacacacacacacagagagagagagagagagagagagagagagagagagagagagagagagagagagaaagagagagagagaagacatatacacagagaaagatgcagaaagcagccttgaggtagtcacacattcaaactcatacaccaaacagacagggtggaatgtacagggaacatgaagtagaagtttacaatttagatgtactctttgttcaatacctctgagggaaaggctttcatttctttccttaactcatctcagattcattattaatcatcaatgtgttcaatctattctcacaggaagtatctattagctggtgccatcttttttttttttttttttttgcataagcttaatgtggggaagtatataattcaccatgatggaaagcaaggagccctgccatccgaacgatgtccaagggctcagaatcatgtactttaaggacagacccccaggtctgggcttgtgtttctgagcactcacctccgtaatgagctggaatctatttcaacctgtcaaaatcatcacaacagtttttgatcctcagaaatcttctgagacacctgggcctcattataatcatgaaaagagttgacttcctagctagaatccctaaagagacttgggtaattctggagacttcttcctctgcttatgcagatgtgcatgtatgtacattgagaattatagagcacaatcaggaatatatttatgagcaagtttttaaacagtatctattatagtcctaagtctagttgttgtctccttgtttgtttttaataaaatctggacagtgttcccaaggtgtttctctattttactcctcacacattacaagcaggatatgatattgtgccatatacaacattatttcagttcatcattttctttaactgaggtgttccagcaactctacaatgtgttcaagcctgatattttgtttctcacaggaactcttggtattatttttctttgactcacagcatttttcatttcttttttcatttcatttttgtgggtatttctaactacttattgaactcaattttcatatcctaagttgtcttcatttccttcaggcatctgctattatttcttgttcatgaatcattttgttcctgtcctctctgagttgattgacatgcatctcctgatcctcactctgagttttcagttctgtatcttggatatcatataaattgctctccttaggggatatatactatactttaagactaggacattttaacatcataatttagagggactattttcttttttgagtttttggcccaggagtctggtattgcaacatgagaagttagtcaacataacttggttttgaatggcccagaacccaggtgtagtgtcctaccacatccagttctggtctggaatggccgcaaccttgtggggaagctgtgtagtgtaggccctgggcatcctgacagctgcagttgtgtggaaggcaccctgcaacagagttggtggagtggtatctgaggggagggagggcctacttgcctgattagatgcatttcggaaaacgacaaaaacaagcaatgaagtaagcaagccaggaaaaccaaccaaccaaacaaacaaacaaacaaacaaacaaacaaacacagctgagaggtactgggaagctaattcattaaaagggtcctaagtcggagggttttaaagaaacatgtagcaggaaactgctgtatattgtgtggaaccagaaggagttgtcccaaggaactaggccatagtaacaggaaataccaccactcctgcattctctgcatattctggatgtcctcgtggtcaggaagtcttggggggtgggggtggggctagagccaagtattagggaaactcgaaaacttctttagggtacagttgctgtgtgggcattgtgggagagtcacctgtgataagtctgtcctggaacctgacatgtaagaggaactggcagaagtaaagcaggggtgtggagcaggggtgattttctgcagccactctcactattctgttgtgaatatcttacaattgtcaagaagtttgagatcctattgaggtatcaaaatggaagccagtagatgtaagtttatacaaaaaaaaaaatcgggtctcaaggttagacatgtccagccagctgcagctgctgggagttactagcactactacatatttttttctgccttctttcccctgaagaaataaaattcctggtcagtcacctaacgtgctgcatcagggaaggtttgcataccaagctggaatatacactggtgtgaaatgcttcagagttgagtcctggtggtctttgtggtttcaatatctgggcataacactgtgaactggggttcattgtaatgttttaatgaattttatggattccagaacattcttctaaaacattgtagatcctatgcagtatctgtagtttgtacatggagattctctttggtaaagccttaaagagctcttcgaattcaaattcatccattctttcttaacacctgtattcctccatttgccattttaagagtacctatttgccaggacaatgaattcatatgcttcctcagagagctttatagatattaatcatatgaagatacagtgcaggtttgattggattagaaagtttacattataaagcaccatcatatggattgtgactattaatatttattgtgtgaagttatattctccattaaacatgaagataggatagcagtaaggtattgctaaagagaagatctattgtaggttctgttaaccctgaacagacctgctttccggaaaaccagctgaaagagtggctgcagcaggccccaaataagggagggggaggggaaagtctatgctctgggtcactggcagtcagcaaaagacagacccatgggtgagacacatggggactgggaactaatgcttggagccagtgctcctgagccactgagataaattgtccaggcctgacttggaattttcagccaaaggaaagtaagtgtctcaaaagttaagaggaaagtctcacccaagggaattagtcctagaatgaggatcatggaaatacacggttagctccaagctcaagaactcttcggtaggaccatgagggcatttactctgaccaatgggggatggggtttcccaggactgggctagggagtgttggtctagatgcaaacctacagagtttctaaatctcagtcatggtactacatgatgtgtttataaaaagataaagaaagaataggttctatgggtgtgtggtgaggtatgggggaaaggggtgtctcaatgggcctatgcctagacatccctttcccctgagggaccagccacatgatggtatagtatagaacagagtttattcaggacatggggaggggaggtaagagggtagtagaggcagagaaacgcagagaaagggagaaagtaaagaagtagaggccagccatgaacatgtggagagaggggggagggaatggggaagggacgggggaaggaagagcccaagtgggcaagagagaagcaagcgatcaagagagcaaggaaggtgcaagcagccccttttgcagcaggccaggcctacctgactgttgccagataaatgtgagggtggagtttagacagaatactaacaggtctccactgtcagtagaaagaggacatgaatatggtttaggccgattctatttcaataatgattctagaaaatttcactttgaataatattaaatgtggtaatatcaatttcctgttagaggcagtacagacaccagtgagttgattgcaatatttgattagttttgagtttctgaaataactgttgcccattgacaatagtttcttttacccatactgaaagcagcctcaggctatatgtgtgacaagtctcaggtttatacatgtagcaaatgtcagtggtagtttccctcgcagggcctgtgaccttccttattggattttagccagattctcagtttagtctaagcaatttttcctgaggagccggactcagcttgaacaggaaagccttttgttatccacagatagtcttgccgctatgatgctagtggccatgccttgcctggcagattgagattgtagcatacagggtgcaaatctgcatatggccgttgataactctgcctcctgccccagacactatgaatgctaccaccagggagtccaagataattgatggcagagtgaactgtgtgatctgaggggttttttttgtgtctgtagatctttatttttccgaggtatgtttctgcttttcttacattcttgagaggttttatactgagcaatgtctaatttttaccacagagctataaatgtaccttttattctcataatgcaattgttgtctgggaggattactgcctttgcctgttaagctaggcctagtcctggaagcctcttgcctccctacaatcttatctagacctagagtgttttcagcctctgaaatttgctgttgaataagctccccctttcttgttccttctcaactttctttctttttttcttttttattagatattttcttcacttacatttcaaatgctatcccctttcctagtttcccccatgaaaatccactatgccctcacccctcatcctgctccccaacctacccactcctgcttcctggcctgcctcggacagtgcggtgggaatttcacctaagtggtcaggaacccaatgtgactggaaccaggttgtgaataggatcggtgtgacagacagacagacaagcactcagtggtgaagctgctgctgctgctacaaaatctttacctcagggttcagattacacacacaatcaagaagaaacaattttctcttggcaaatcacacatcttagttcctctttaaacctaacacaaatatagcttactaggaaattaaatcacccctcggcactcgcctgtggttttgctgccagactgaactttcatattgactcaaggctctcataaccttttatttactactctaataatctcattcaacaacacatgcattgtcaatctaaactttgtaatatttcttgcttatttcttttattcccaaatatgtctactccttaccatctagaagtatctccaaatgataggaaaacatacaactgccatctcaaggtccactgttaaggcacaccaaggagccctacttcttattctttcccatagacttaattctgaatatctcttttttgtcccatttttcacaatccatctgactaagttcttatcataacttccagtccagggaagtggaatatctgttggattaaacttataagggccacaatatctaggttcttcccaccatcctctactcagcttccctagaactgactaatcccccctcttcactgttaatcctaattcctgtaaattctggatttcttcatcctgtatagtttctcttttacttctgacaattttattaatgcctaattctaattgttgtattaaattaatggtggcacccaaaatcagcaactgctatccaggcaagcatgccaaggacactctttgtcctcccagaaggggacatgtaatgggcagactgccagggacctccaggaggcttagctccgcagagcacaaacctcgggtctggtagccattcaatgagtttttctttcattgctacacagactccactggagttggtgtggcagctcccggttttttatttttttaagcgaagttggtaacgatctctctgaatagtactgagagacctcaaaatgagcctaaaagtaaatggaaagattaataagactatgaccaccagagccaagaccactgcaccaaaaattatatattgcagccaatccacaggactaaaagatcttaaatcttcaggaaaaatagaagctaatttattcacatcccagctatccaaatatcgttgactaataactgtaatttgttcctgtaattgtttcatatcataggagatactatcatctttccaaatatctatcaaatgggcccttgtcctattccattcttctaaggatgaattataggacaacagtgtaacacgaatatattgaaatttaacatgacatttagtggacaatctagctttaatatttgccacctcctatcccatttccaaaactacatcttctaaggcattaatcctttcttccaatttcaaatcaattatcctttattcagacaaggctaaggtaatatttctatgcaattcattaacaaatgttgcagtttgcatacctttcaccagagcagtagttgaaactgcaaaggtagtaagcattgctatcatggcagatattcctaaaataagagcagccataaatcttttaggcctagttagctcattaatattttttacaacctctaaagtcgaattataccaagattcttcccctatatctactggcaggaaaacataagcagggcgctttacaatcatcataatagaaaaatccttattaattcctgaagatatacaattagtaagaatacaggatttataattaacataataggaatctccttcttgttgaatagaaaccaaggaaccatgccccaaaagcatggcatatggatacgccaaacaaactgtaactggggtagcctcactaatcacagccttaggtttcttcaaaagaatcatattagcagaagggtacattctgaataaatgaggatggcctgaataaaagttcccatctttatctttatgataccaaataggactgacctaaggaattacttccttaggaattagaaatcattacaatcattgactctaggttctctcttgattattctatgagtcagcattttaaaactgtagaacctttactcctagaaaataaaaacagaaatacatttgtttttgtttgtttgttttgtttttaaacatagcagctcctatgtatgttgcttggatgtactttctggacataaagattattttattattatacctttctctctctctctctctctctctctctctctctctctctctctctctctctccctccatccctccctccctcccttccttccttccttccattttttcatactccagattttattgccctcctggtcaatcctctgagtgttccacctcccacacttcctgcccacctctctgtctccataaggatgtcccctcctcctccccacctgaccagacctctaaacatcctggagcctccaatctctccaggggttagatgcatgctccctaattgaacccagacccagcattcttccactgcatatgtgctaggggcctcttatcagtaggtgcatgcttcccggttgatgatcgagtgtctgagagatcttgggggttcaggttaattgagactgctggtcctcctacagggtgcccctcttcctcagcttcttccagctttcccctacctcaaccacaggggtcaggagcttctgtccatttgttggctgcaaacatctgtatccaactgctcttgggtgtttcagaagacagtcatgatagtctttgtgactgctccatagcctcagtaataatgttaggcctaggggcctctccttgaaaggttacaaggttgtggggaataataatcttatattgggtcggggaagaggactgaagccctaaggccctgcatatgtataattattctcttacccacttgtaggagttctctggaatttcattaagtttgtttctgccttctttgaatttctgtgcttgttccctctttatgtcatttgtccacattgaatggtgttcagattatattttgacttttgcctcttgtgtttgtttcataatttatttgtcatgagaattggtattgagttagtgatttgtggtatggtaattttattaacattgtcaaattgctttagctccagcgtcttaattttcttttgctgtgtgtcatttaggtcaggtggcagggatttccatatcaggtgttgtgaattaactttgagaatcaagggtggtgggcaggaactaggttacagttacagtctaaatatatcattacttactttcatgagtgcacattgtcaagattcctggtatcattttgctttaatttttttttttatgtatataatgtggtttagcattttctgtaatggtgttgtatttatttcatctttgaattattcagaccttggtctgaaatttcaagaagaattcaatctttgttcttcacagagaccctgggagaaggacagcaacaagaatgagtgtgtgtctggtaaatacaccacaggtcagtgtcctttccacatttctttttttaaaaatctctttttattcaagtcatccaaaagttttaatctctatatgtagaatgttatctaaagggcttattttctatgatctacattctttttggtcagtgtaagagcagcaatttgtattttcagacacatctccataacacttttagaaaacaattatccttcaacctcatctgcatcaaaaaaggtatcttaattacttctttttataaagtagaaaagtgctgctgtcctctgcgcccacggagacaggaacgacatggacacggataccaagttgggttcacacaacagcttctttacttgttctccttcttgcagcttttcttataaaactccccttacaacagcttctcttactacaactagcttctacttagggcaagggctaaaaaacaaaactcctatccttgcatctttggatctcatctagctccaccccacctcatccaatcagaattcacacacgctccagctcaggtcggctgacaggtccggatcacaaggaatagtccagcctggcaggcagcccacgcatgcagccacactgtgcatgctcaggcaaggcagtaaacaacttggcccatgcggccacacccgcttcctgcagaaaagctttttttttggggaggggggggttcgagagttgtagccctgtctgtcctggaactcactttgtagaccagactggcctcgaactcagaaatccacccgcctctacctcccaagtgctgggattgaaggcgtgcaccaccacgcctggctgaaaagcatttttgtccagtatcaaataggtagttttccattacagggtctgttaaccttcaaggacgtggccttggacttctcactggaggaatgggaatctctcagttttgctcagaggacattgtacatggatgtgatgttggagaattacaataatctgttatttgtgggtaagaataaacttactgttgaattcctgtatctttctttaggttttcctactatgtgcttttgtaaatgctctgagatatgcagagactcctgaatgagagaaattctagttaaaaatcataactttttcattgtgtttccttcacatttctctgctttctttggaaaaataaccagtgctatattctctgagatcactccttatctcttatctagcttcactcaagataaaaaagttcaagcaaaaatttaaatatccagaacaagaaattatatttctatacatataatagtttcaattataaaaatcttactattgctttaaaatgttcccttatttatgaatctaaaaatatacaaggtttcaagtggacatagagctgttgttttgcacaatttttttttatttaactttttgacatttgatctctgtgtttagatctgggacaccataatctttatcctagcattttggatattgaagcaaatctatttagtaatttccctgaggctatcagttatatcataaatttgtacctgaccaagtttatacctgattcagtgttactctgaataaaattataaccataaaattagagatattttgtttagaattctactttctgaaaattcactagagaaggatcatttatttgtcccagcttatgcaaagtacaattttcttttttattggtcattttatttatttacatgtcgattgttatgccccttcttcattccctgtctggaaactctatatcccacccctccccccccagcttttatgatgatgccccccaccgatccacctactcccatctcatgcccctaggattctcctatgctgggataatgaaccttctgagtaccaagggactcccctcctgttgatgccatataaggcaatccccttctatatataaagctggagccatttgtacatccatgtgtacactttggttggtgattttccccttcgaagctttgtatggtcttgttgtttgatattgttgttcctcctacacagttgcaaagcccttcagcttcttcagtccttcccttaactccttcatgtagcccccctgctcagtctaatggttggctgcagagatctgcatctctttggtccagtctctggatggccttaccttcagcctcttttccatttttttccctctttttccttaacacgggagcaattctgggttattatatttgaggtgggtatgatgtccaatttgaaactgaaatttagcaggttactatcatttccaatcatttgatatagaccatatttgaagttcttttgaggatacatgtaatgattcaaaaaaaggagaaaaacctctcttgagagtacgaatccatgagatcactgattattgaatcacttactccttatataagtaattcatgtcacctctaattgcccctccctactttttttcagaaaatcattgcatatgtggaaagtatgagaaggtcttggatcaagacagccagtacattgtccatgaacacatgaatattcaagagaagtcttctaaatgggacaaacttagcaatgtgatacttgaagccccccaatgtacaccttacaaaactaatcacacctctgatgctcttcaattttcgaaccaaaaaagacttaagcccaggaacactaaagaagtttgcaaatacaatgactctgtaaacagtttaactttgttttctaccattagtctcaatcagggaatccacatgcagaagaaaaaacacaacggaaatgcagaatctgagaaggcttttatttctaaacataaagtcatggtgaaacgaaataatactggagtgaacccttacaaatgtagtaaatttgacaaatatcttacccagagagacaaacttcaaagtcagcagagaatttatcatgaaaagaaacattacagaagtagtaaaagtgacaaatgctttacccatcagatcgatcttagtatccatcagggaattcatgcagaagagaaaatttataaatgtagtgaatgtgacaaatgctttacccacaaatttcatcttaatattcatcagagaattcatacaggagagaaaccttacaaatgtagtgaatgtgacaaatgctttacccaaaaatctcatcttaatattcatcagagaattcatacaggagagaaaccttacaaatgcattgtatgtgagaaatgctttactgaaaaaggcaatctgagaattcatcagaggattcatacaggagataaaccttacaaatgcagtgaatgtgacaaatgctttacccaaaaatcccatcttaatattcatcagagaattcatacaggagagaaaccttacaaatgtagtcaatgtgacaaatcctttactgaaaatggccatctgagaattcatcagagaaatcatacaggtgagaaaccttacaaatgtagtcgatgtgacaaatcctttactgaaaatggccatctgagaattcatcagagaattcatacaggagagaaaccttacaaatgcagtgaatgtgacaaatgctttactaaaaaattcagtttgaggattcatcagagaattcatacaggagagaaaccttacaaatgcagtgaatgtgacaaatgctttactttcaaaggcagtctgaggattcatcagagaattcatacaggagagaaaccctacaaatgtagtgaatgtgacaaatcctttactgaaaatggctgtttgagaattcatcagagaattcatacaggagagaaaccttacaaatgcactgaatgtgacaaatgctttactttcaaaggcagtctgaggattcatcagagaattcatacaggagagaaaccttacaaatgcactgaatgtgacaaatcctttactgaaaagggcaaactgagaattcatcagagaattcataaaggagagaaaccttacaaatgtagtgaatgtgacaaatgctttactgaaaaaggccatcagagaattcatacaggagagatagcttacaaatagtttgtatgtgacaaatacaatacaatgtcagtctgagaaatcatcagtttttaatacagtagagaatatttataaatgaagtgaatgagacaatcctttaccaagatatatcatcttaaaaatcattagagaatacttacagaagagaaacttttcaattatatcgaaggtatgaatcctttactcttggcctatttcctagaatgttaacagtgaatacttacaggatacaaacttaactcatgcattgtatgaagaaatatctttgacttcatttcaggtcaaagagaatatctaataactttttaggcaaagtatttctgttggggaaagtgtggcctgtgttttattcacgttctattcttgacaacaattgaggctccacactagagaattagtatgattatgaaaatcatgtgaaaactttcatgcaatgttcaaatcttaaataatgtcaactattttttgcttgaagaaactctgaaaatgtaaaaatgtagaaagcttttcatgacacctttttacttgttcacccttaaatgttacaagatgaagacaagttgggaagtgaggagatattattgtgtaacacattcattgagacagaaataatccatttcaaaaggaaactatttaaggtctttaatgcagtcctaaaaatatctaataaaactggtaacattctgtgtatttaattcaaatgagccaattgagaaaaattatacttaaaagaatatctggcaaactgagccacccagacagcatattctttatcctataaatatgcttacagatgttacgtgtgcttcgagtattcagtaataataattcttctcaaatgcttggttcacattataggataacaactgatcattatttcccatttattgaacgaaagtcctataggtctctgaaaaatgctgaccgttgatacatattacaagacattgtggtgtactccactctaccgtaaggaataaaatagatttccattcttttcttaaatcatctacggaatcttaatattttgcacatctcagaatatacattctgaagaaaaacaacagcttttgtaactaatagcgaagtcattaacatatgctgcagtgtgtatactttgcactaaggacacagaagcaattgctgtaaccataatagaaactatcaggacagccattcctgctaaaatcatgcctatggcccttttagatcgcaacaacaattctgtggttgcatgctcaagaattcctaggcctttatcatcataccaatccttagttaaattaactggtaaataaacataatcaggttgcttaacaatcaaaaaattacttaaggtataattaacacagttagttatttgacaattagtacagttaacagtattattatctatcaataaattcccactcaaagaagcctatggctctggaacacacgaacatacaaaaacttcagtcttattgtgtttgtcctgaaatgccatgatattccacataggaatccaggtaattgtggacgcccactcgccagcaagtaagatgccacaacaggatccttctgcaacatgtttattgggagagcatggactgcgtaggcgaaagaccccgagccccagaaatggtgctacttatataggcctagggagtgacatgtccataactgattggttatgctaccagtacctcattaatatgcctcgagccaggcagtgactctgcaaaaaactctggcacatgcgcacattggttgtttacccatattcatgggcattggcttactgaaaccagtgccatcttgtaatggcgtttgcggcttcccacatctccccctttttattgtaataaaatgatgctggattaggcctatgcaattatgtccatccgctacggctcctgttttaggtcgttcctctgtgtcacagccttacccgtcatagggtaaccctatcgccaccaggccccgtgtcttaggttgctctgtgcatgaggaaagttgcccatctttggataatgcaatgctgtgtgacagtaattgctaaatgacttattttgttcgtcctgaaatgtcatgatattccctataggaagccaggtgatgttaattcttttaactgttatcatcccaagggctgcaatggcttttcttaatgaagaaaaataagtttcattattttttgtcccaattccatgaaccaaattaataggaggatgattagtataatccaaaatattccaatcacacagggtggtattagagcaaaggcatgaaattgtaatatatgtccatcagaatactctcctaaatatttggtttgattgacataaacagtaatatctacagtctcatcccaagtgacaggatgaattataggtggatttggaacatatgcccaataaacttatgcagagctgcctcgatgtaacatccagataatgctaatcaatagggcaatcagctgtattcgatcctgtgctgtcatagacgttatcattcgaggttcctggcggtggcgttgaaaagaaagacgaaacatctgtctttaatattcccatcttggttttcagcatggcgtacacactgggttggcaaccacctaggggaaggtgtgtctgttgggaaaacataaacatacccacggccccataaaagtacaggatctgggctgtgtaatgagccgtccatcggatctttccaataaactaaaggttttgctttgtcttcgggatgccagtgcctgtcagctgcagacaacccatcagcatccaaagttaaaaaatttaaagtaaacaacgtatgagttagaaagatgaattttatagtaaccacatttagccaaaacaataggatccaaaactaaagcttctcctaccaaagcttggccaatacaatcattgcctgcagttgaaggtctgggaagatcagaatgaacttttatatgaccaatttatatagaattttttttcaagcaagaatggtgtttgttccacaccacctccagtaggatctttgtgacaagttccacagactgagtgaggcaattgacgtcaaaaggccctgtaggtgtatgagtcatattaaaaatcaacaaatgtggactggtgagatggctcagtgggtaagagcatccgactgctcttccgaaggtccagagttcaaatcccagcaaccacatggtggctcacaaccatccgtaacgagatctgactccctcttctggagtgtctgaagacagctacagtgtacttacatataataaataaataaatctttaaaaaaaatcaacaaatgtaaacgcaaagaatcatctatataagtaacaaactgtttttcagtagctcttttctacttgtaaggccaacaagttaaaactcaaagagaggtaggatcagcactccccctaagaatatcaaataagagtttcaattctcctgtagtaagctttaaataaggatgaagccaattaatatcacttgacagcttttgactatcatttaatgtttttaaattgtccttatgaataagtattttctgagagaaagcaggttgatttgtaagcctaaaacctaaataattataagcatcttaagtttgcactttttttttttttggagctatttgtaagcctttatcaggtaatgtttgtagtaaatttctacaacatagaagcaagttctgaggattgttccctgcttataagatatcattcatgcaatgtataatgtatattattggttattgctgtctactaggttgaatggcttgtgccacaaatttttgtcatagtgtaggactgttagccatgccttaagaaagaactatccattgatactttttcattggctctttaaaaatagtagaaagaacactgaaagcaaacctttcacaatcctgagaatgcaaaggaatagtaaagaaatgatcttacaaaatctattgctattttataatatcctttatgaatgtctccaactgcttgattttttttaagatttcaaaacactgactacagcacacaattcaattatctgtgccaaagtaggagtaaactccaaagaataaacatgtgatccaatcacatatacttctttcccatagaagggctgtttataaatacagtggatgtatttttttatgggatgcatgcgtaaaattacaggaattacaaaagcatgcatagaagcaattttaacaacttttgtgtaatgattatcaattttacctaaagaattactatgtcagagacgaaatctcaatattctgcaataaccaatttaattgctgtttgagacaagaaatagacatctcatcaggtttttaagatttttaaaaaaatatcttcatgattttatcttacaaattttgattaacaccacaacagcttcataatagcatgttaaaactttacttagagatgaagaaagatgattccacattactgttctcttaccaaagaattgctgtgggcacattgagatacaataactaaaataagcagctaatgtttaattaccactgattacaatagataacaattgattacagaagcttcctctattctatttagagtgggcagaccagaatgtaatgcctttagaaattctacaccctcattgacatttcatatatctaagtttaaactttattttgagtaacatctgcatagatctgtaataatgttttgtgttaaaaataattctcgggctggcaagatggctcagtggttaagagcgccgactgctcttccaaaggtcccaagttcaaatcccagcatcccatggtggctcacaaccatccataacgaaatctaatgccctcttctggagtatctgaggacagctacagtgtacttacatgtaataaataaataaatcttttaaaaaaaataattctcaggaggcaagtagaggtgaaatcccaaaacttcactgggcagggtttgcaaaaccgaagaaacgccacacctgcctccatgaggctgctctgagctttgcattacctcaaatataatctgagcatactgccagagtcctggcccaaagattatcccttctgcagtgaggacagattccaggggaaaaatttgactgtatgtctatgcttctaatttttggacagtctttcataagatgatttatacttaactttagtgctggaagcattgcctgtactgtagcccctgcaagcagcaacgatagccaaactgattgtatgagggtccaatttctacacaaagatgaatatatccagataagtctgtctttgctttgtatggcctgatgtctacagggagctgcattagtgttctcataaggtagacgcttataatcatcctaattacaatatataggtgagttaaaaatcatgagcttgcgatcaaactgcactcagtgaaacactgtcaattttaatcataatttttaagtttcttttgcaatattagaatatatccttaacttttggaaagcaaaactcaattttaaacaatatagtctctttaaaatcaataccaaaaatcatcaccttcacattatgaagtttggctacctgttcttatatatgaatgcatgacagtgcagcttttcatacgtcattgaagagacattgctttaatttctatcctttataagtctactttctagaataataattacacaaaatattatcccaatttagaagtatctttaaaaacctgttttcctgggttggctcatgccatgtgttgtttagaatgactccaaccttgagttaccaattttaagctaactttctgttataagcaaaattctgttggcccctttaagaattgcttgtgtagataatcagcctctagcagggcttttccacctctacttgactcccaactgcagtgcagtgtaacttatcagtttttgctatgcaaattgagactgcctttgaaacaagttaaactaaatcaaaggatggacacccagcagataaagttttaaacatttatatttttcaacatgaaatacagaacaacactcattcaaacaacaaaacaaaaacaaacataaattgacagacatatggacaatttggtgcaccaagaacagacaatagacagacagggattagaacttgatgtctcaaagggacccagatatcctaaccagaactaagaatatctccataagagacagagaggaagcaaggcgtctcccgatttcctcctgtccctaggagagctctaaaatagcttatttccatttttcttctcttttgctaaaaggtcccgaacaggggataactgcttttctgaaacctagtctctctatctttttctctctcatgttcaaagtctaattctttatctccttcttctgggaattctgccagcaaagggtgaggagtcacagtggtagcttctgatagttgctgcccagtgccctgcttttctaactctcctaattactcctcaaacttgtcaaattctttcatatatatatgaatacacacacacacatatcattcctacttctgggaattaagaacaacgtaaatgtaagaatttttctaacacctgttattatgtttttgtagttttgtgttttactctttatttattttattttattttaaaccctattcctcccacctagagcagctcttggctgtgaacaaattttcttaacccatgttcctcgtgtcttgagggattccttgagatcctgttaaaaacaattcatgtctacttaatgtgtgtcccatattctagccactcttcctacctttctcgggtttactgtcgatggagtcccccatgcccatttctcatctcctgtatctactctcaggcattcctttactaaggaccacaaagtaaaagcttcaatgggcaccttttcaggaccatgagcagcctaaaagcttctaattcgctcaccaattttattccatgtttccacattaatagtaccatccctaggatggtaggcctggtcagagtccctcattaacttgtaccatgaagcttggccacaggacagcagtagatcctctatttgggggattcaagagatcaaatgactcagacagctggggcattactagctctgcactgccaccccagggacagacagagccctagtatgggaaatatttattttaggagaatttatttgtctccaagagaacttactgttcctcttacaaagaacagggtattttgtgtacataatttgttacacactcgatgcccactgctgcaatctctacctaagttgataagtcctgcagagtaacttcagtcaatgtcaaatggtaacaacaactaaatcaaacagtagccatgaatttgaaagcactgtgtatttaatgcaaggtaaatgaaaaagaaatgaaataacatctgattggctctcccggaacacccgcccccttctcatcccgccgcccgcccccctcggcacgcccacagcggaggaaggaactgagcgcacaggcgcggtgctgcctctctcagctggtttcccgccctccttccttccctcccagtcctctcgcccctcctcaggcccgagcatcttcctccttctggcgccatccttagctgagctttcgccagggaacgtcttcctagtccctcaggcagcggtgcgggcgcgaccctgctctacgctcgcggttcctggggaggagcgtagcaccagagcacggggggagccgccctgccaaccgcgcctcggcgaccccgtggggctgaggcgacgccgcaccccgcagcctgagcgcacagcggccttgacccagaactcggagccgtgagcgccgcccccacccatccggaccgcggtcatggccgagaccgaggagcggagcctggaaaacttcttcgccaagagggacaagaagaaagaacggagcagtcgggcggccaacgttgcgagcggcacggacgggagcagcgcggcggcgggctccaggccgggcaatggccggagctcggtctcaggtgccaggtcgggctacttagggagctcgggctctggtgctaggtccagagacagcgggagcgcgggcccggccgacaaggccataacgaaggatgaaaatgagtggaaagaatttgagcacatagaggttgattacagtggattaagagttcaggaaatgcaaataagtgaaaagcaagatggtgataatgagaagagagaagatccaggaaataattgggaagaaggtagaggtggcagtggagcagaaaaatctccaggtccctggaataaaaccgttctggtacaagcgcctcctgctccagtaacagttacagaaaccccggggccagcaatgcccagtggtgtatttaggcctcctgaggcaaggctaaccacaacatggaaaactccacaaggaccaccggaaatatacagtgacacacagttcccatccctgcagtccactgccaagcatgtagagagccggaaggataaagaaatggagaagacctttgaagtagtaagacacaaaaatagagatagggagaaggtttcaaaaaaccaggcccttaaacttcagctagaccaccagtatgctgtgcttgagaatcagaagtacagccacacacagtataggtaaggaatggtctttgctaagcctaccaaggtaattagaccacagctaaccaccaagaacagccagtcatcgttttgatttctggatctacagtgactgactgaatacctcaagtccagtgactgtccctgttgcattatggaagttcaagagtcacgactgatcttgatgtgtgttggatttaggagtgtttcattgtcttaagtatttgtgaattagattcaacagtgtttccatagttgctctgcgtataaaaccaaacctgcagccagtggccattcaaacatctttatgttcagatactgagccttcgcaaggttgactacctcagatttgctgcccttagttatagatttcatttggatcacatcttcgacataaggttacagctactagtgtctgtgtgaaccttgaaaccaactctactggattcctgtcagaaagccttcagaagtcagacatctgggttctgatctgctgtaaatgatgaagaggtaagtgatcttaattaacctgttctgtgcctcatcctaaggcaaactctgtaggctttgcctatgttagactccctggaacaagccactctcagaaatgatgtgtttggatcatctgtgtggggcttatgatttataatttaagtttttatttgtatgagataactgtggatttaattcaaccaaacttgggtccaccaaatggggagtgggtgggggatagtcttatttctttgaataatttttcattcagatagtgttgttcggttccacattaagaccttgctttgacttggagtaagttctttaagggcatattgtgtggagaaatagtctgaaagaagcattggaattgtaaagtgccctaaggatttgccaatccggaggtgaaaccagatagcctttgatacatataaaggacagtggatctgctgcactccaggtgctgctcaagcctcctaatcaggtctaattgaattgctgtggacgaagtgtggtgtctgatcactgctgtggacagagtatggggtctgctcaggaggagagggtttcactaacctggcttttaacagttcaaagcaacaggagcaaaacacccaagttgtgcaagaatctggcatagtgtctgataaatccttgtgtgtgccccaaatgtgaaggttataggctattctgtagatccattcattgtttagccagctcttgacattcaccttgggaatatgttcggtaatcacttggagacgcaggggaatagccagtaatgtagcatttctgttgttaataatttcagtttaactatctagtagtacttggctctcagaaaagtttactgctaaatttctttctacctaatgaaatagcctgtcagttacctactttgtcactacagatggttcagtacacatactctatgttgacatatgactatgtgatatgatagtagtgcctgggtttctctctgtaaacgaatccctttgccaaacacagttcagacttgctcactactgacaggagtgtaacaagaaatggatgttttcccagcttgaagcatgtttagtggatttagggcagcagtgtgggaagcaggaggtggaggccagtgtctcctaccagactgtatgccacttctgggcaataatgctggcatgacctgaaccagctaggaggaggtggggtgattagagacttgagattcttagttaaactgaagacttcatttgggcaccagaaaccttaacaaataatctcacaccttgagccacaaacttctattaaaagatgctttaccccagcgtgacacacaaacacactttctgtttggggttatggtttaagatgtgaacagaaacaagatgaggtttatttaatgccatactgtactggaacgctgaagatctgcagcagatgtaaattccaagtcgtgttattttttaacattgtgaaattatcaaaatgcacatgaatcaagttttaataacactgtctgggtggatgaggctgtccattgcaccatttctttctttgggttctcaggcatggttcctacagtgtaagaactctgtaacatttaacaatgaataaatagtaaacctatgggaaaaaaaaagaaaggaaataaaaaggaaaggatatggcttctcctaagtatggtgaagtagaatgtttcttatcaaaagaaagagaatagctagacacaggaacagtctacaatggacagaaccatgagcctcatgaggagagggaggaggcaaagccagaccaagaggccaggagggtaaatgatcagtaaaaaagaccaggtagccaaatggatgcgttacatgaggaagagcagctgggaggacatttgcccagcctctgtgctaggtgtctggaaaggacagcaatgcactgtatgtaacaggtagggatagaggactgtttggagaacctggaaccaaggactgatttgatttgttaattaggcaccttgaccttttgttccaaggtttaatattcaacattagggaggactgaagagattgaaatgatttaattgtaatctcaaaagttattttttaaaaaaatgaacgttcttttatttcttctctgcctaaattatcaatggaggtaaagggagggagggacttaggtgggagaagtgagagggagggaaaaaggggagcaggatgagttatgggtgggagacaagagagcacccagagggccagaaaaatgaatggaaatatggagcagtagaatttggagattggagagaaacctctagaaagtcttatagacctggggtgttagaggcttcctagatcatgccatgtctccatattgatgataatgaactgaacctctgaacctgttaaccatccccattgaaatgttcttttgtccttataagtgttgccttggtcacctgtctgttcacaacagtaatccctatgacagcaattcttaataatagagcttgatgaaaggctaagctacaggagatattgctcaaaacagacacatgtatgaaagtagctgatcaaaggaataaaatttttcatggctgggaaacattaggaatagaaacaagtaaaaagtcagatcagagatgcatagaggtaacaaaattgaaagatcaataccaagacaatataattgtaaaattcccaaggtacaacaactttattttggtaggtacttttccctcaagaatttgagaagtttaatcatgagaaaaagcaatgtcattgtaacagggggcacagactggaatcaaggtgacctaagccaccacagcttatctcagaatcattattgtaaatatttctttttgtaaaaagattgcagataaagctgatggaaatactatatgttgccagagtgaaatcactccatacacaagcagaagatgaattaagaaaagttgctttagtgactgtgtgctttcatgacaggctaattatcagactcatcagcctagcataaatttgaattcaatatatgctgtcactcttaagtttcttttaggttgagttcacagattatgctttgaacaagttaaatatggactggagactgcatatctaggctcttaggcagatggaaaatttacgtagtacagatattgtaagagtcgtttcttacataaccattttcctaaaaaaaaaaacccacaaagatagcagtatataattttcatttgcacataatttttattattcagccgggtgtggtggtgcacgcctttaatcccagcactcaggaggcagaggcaggtggatttctgagttcgaggccaccctggtctacagaatgagttccaggatcagccaggactatacagagaaactctgtctccaaaaaaaaaaaaaaaattattattcaaattgttttgttttcctccatgttgggatgaccatatgtttgtaaaaaagacaatattttgatgtattcccaaccatttttgaacatctgttagaaggctcagagtgaaatgtttatagggtgcaaatctaacaacctgaccttgatcactatataacaaatgtccatatttcctctcttgtcagggcactctgggggagtcagcttgtgaggcagaaatgccaaaaagctgctcatgagaaatgaatttctaggtctctcctcctggatattctggcgaaagccaactctccagtttggatcggtttgtcaggcgaaaagcctggaagctgtttcacgaggataagagtccagggaaattttcctcccagagttatggcatctctttccctaacccattatattcaaatttccaccacattaatctagtgtatagattcacatgcactctatatagtattaccttatagtaaatgccttttaagactgtattctaacatagctaaagcctttttccattgttcttagattccagatagcagcaaggagcttaacctattcagtaactaattagccccaccataaaacaataaaagatctgtcatttactcagctgtctgtagatagagactaaaagtctcactgagatagaaatcttttactacaggctacattccatgtcaagtataagttgatatactaccctgataagggggaactctcccgacaggataagttttactagacctaagaatttagagctcctgataactcactactcttaaggcctatcaagagttaacaaccccctgatgcttttaggctgatcctaggcagggcttgttatccctaatgtaaacatttaattagtccctgcaaattcctttctgctgtaactggtgaatttcagtgtatcttgtctttttgtgacttgtatcctctgataattcgttgtaatataagtctgaagctcaaccagaacattacattcagatccaacaccattctagcgtgttcgactgtctgtcactacatcctaatttgcccatctactctagagactcttttctacacgggcacaggggaccagagggcctgctgcactctcttgaatattttgttccccaatctaggtaggactaaagcatccacactttgatcttctttattcttgagcttcatgtgtactgtgagttttatcttggttattctgagctgtggagcagagaatgacagaaaagccatcaagacgctgacccacctgggaatccatcccatgtacagacatcaaacccagatactaatgtggatgccaagaagtgcttgctgagaagaacctgatatatctctctcctgagaggctctgccaaagcctaacaaatacagaggtggatgcttgaagccacccgttggactgagcttgggttcacgatggaggagctagagacaagacttaaggagctgaaggggtttgcaacccataggaagagcaacaacgtcaaccatccaggacccccccccccccccccagagcttacagggactaaaccaccatccaaagagtacacatggaaggatccaaggctccatctgcctacgtagcagaggatggccttatcaggcatcaatgagaggagaggcccttggtcctgtgaaggctccataccccagtgtaggggaatgtcagggtggggaggcaggagtaggtgtgtgtgggagcacctgtacagaagcacagggagggaggatgggatagggggcttccagaggtgaaaaccaggaaaggggattacatgaaatataaataaataaaatatcagcatcaaccaacattagccactgtgaaaattctctggcactcatttgcggtctgagaatgaaacaactatttagacttaagtatgaactaatacacttgaaaaaatataattgaagcataaaaatataattgaagcataaaaaaatgtccagagtacatcctacaaagttgttttccaatttgcacatatctgtcctggcctaaatccttgtaaaaatacacacatacacacacacacacacacacacacacacacacacacacacacacacacacacatgaatgcattcattcctgttaaggtttcttaaagcctatctacagaatttctcttcagcatgaatttgttcatgtaacagataccaagcaacaaggcttcaagtcagaaaactcaatccttcctcgagagtgcgatcataatatttgaatagattgttgatccatatcagactcctttcttcagaatcaataatcttgtgttaccgggtacaagtgtgttacctaagaatattagcaaatcctttatagacatatattcccctcagtatgcattttttcagatgctcaatactacagtaatatgcaaaatatctaacacgttcattatgcactaaagtttgtactcttgtgtaaagctatctatcaggaggtaaaattcaggtacaggtttagctctctattggacaagttaacaaaagcagtttagttaaaaagaccaaagcccctgtcatttaggactcctcggactcttccttctttgcttccactttcttctcctcagctggggcggcagcagtggagggagcaggaacaccagaaggtgcagctccagcagttggagcaggcccagcagccccaacattgcagatgaggctaccagtgttgacattggccagagcctttgcagacaagccaggccagaaaggttcaagctgacaccagctgctttaatgagggcattgatcttaacttctgtgaccatcaccttgttgtcttgcaggatgagggcagagtagatccaggcaagctcggagacggacaccatgttgcggactgctggcaaggtgttagtcgctggatgatgtaagggcctcaccccaacgtggcattaacaaactgaacacattaacagggtttctctgtagacatcccaatggctatcttaggaagctgacagtgacctatggggacctgtgctgccccatgcccatgtatgcttcacccgtgcagtgccttcctggctgtgttaaatcaccagtgctgtggactggactcagtcgacccctcaactcgcaggggcccctcaactctcgggagaatcagagtcctggtacacaggcatgaaggaatcagcagggtgacaaacagatgcaaacacaagagagtgttgatctgaatgtaatttctcaaaggaagcatcagacttatgatacagaagaaaataaggaagttaggtgacacatcacccaaggtacattgaggttacccgatgcttaatgactctttacacaaaaaagaaaaatgcatacataaagactgacaggaactaggtaatgtaacaactgagacaaagtcatctctatctaaggtcagctatatatctaaaagccaggtgtgaggtcattatgttcccagggctggtcctttcttgcccaaaccatagttctaattctcatttattgtttagcccaccaccagccagctcttagtaaatatctaactatgctatgcttctgggctagtgaaagtatgtgctagggagttctgttctaggtaaccttgtcatgaataatgcaatactctagttcctccttaaaccacatctcgacctacttcctaaagcattgtaaattcttgtaaatgtgagtgactgggctgttattctaagtgattttgttggggactttcttctattaagtaatgtagtctgccatatataactatagtaagaattctaaacttactttgctaagcttgccctgagatttctaactctatttagtagatagtaatgcctgaattctttcactgtctctttttcaatactggaggcaatccgtgttaatcggtaacagtctaatgaaatcccaagtccagggccggctcaagggctggctaggacattggtgaaggccaggaagcaaagttcaacctaatttagatatttgacaaatcattccttggagacactgataataaaacaatactgaaaaaaagcacacagacccattcacctattaacgcaaggacaagtttgaaacattcatgctatgggatgccaaggctccaggagacttccatgaaactttttgcctcaggaccttgtctaagcttttggacttgccacacagatttcactggagtggctatggcacaccagcacctggatctgtaaggttctgcaaagaaaggctttgcacgttcactcttctgcctcaccagtcttgatttctgaacttataaatttgaccataagctacttgtgaagtaaaagatcgaacaaaagaatgagggttggcgatgactcagaagtttaagagcaggggtgggtgtggaggggtgggtgcactggggagaaagctcagcggttaagagtgctgactgctcttccacagattctgagttcaattcccagcaaccacatagtggctcaccaccatttgtaatgggatccaatgctctcttcaggtgtgtctgaagagagctacagtgtgctcatatacataaatacaaaattaaaaaaataaagttaggagcactggcctgctcttgcagaagactcaaaattgattccaagcatcaacatggtggctcccaaacatcttcagggacctgattccctatcctaacttctgagggcaacagacaacaaatggtgtacatatatgcaggttggcaaaatgttcatacttgacaatagaccagagaaatagtgtttttaattaatgggctatctccccaagcctctaaatcacttcttaaaatgccggaatgtatataaactcactggcagcatatccttggcaacctcactaaaactgtgatgtagctctaaatatcacacaggaggagcaatgataaatacttacaaaattttaaaaaaaaagaaaaagactggagctggacacttaaagctagcttcaaagcacaaggccctctcctggcctctgcagctacttgcacctgtgtgtgtgtgtgtatgtgtggcatgcgtagtgtgtatgcatgttcatatgtgtgtggtatatatgtgtgcactttcatgtgtatgtgcagtgtgtacagtgtatgtttgtatgtgtattagtgatgtggtgtgtatgtgtacagtgtatgtttctgtgtgtatgaataacgtgcagcatgtatgtgcatatgtgtaaacaaaaatatttgtctctaggtgtgtaacaaaggtgaataaaataaatctttttaaaaaatgagttgggctggaaatatggcttagcaggtgggagcactgactgttcttccagaggttctgagttcaattcccagcaaccacatggtggatcacaactatttcttttgggatctgacatcctcttatcttgtgtctgaagaaagtgacagtgtacacacatacataaaagaaataatgttttttttaaatgggtcaaaataagtcctatctgaaaactaaaaagttgttctgggctggcgaatggttccattggtaaagaacctggaaaaacctgactgcctgaggtttggattctcagaacctatataaaaggctggatccaggttagagagatggcctacttgttatgagtacctgtttctcctgcagagaaccttggtcaactgtcttcactcacatcactgctcacaacaggttatctgatggcctcttctgaccttctaacacacttgcacacatgcagggaaaacacattaataaatttcaaaaaattaaaaaaaaaagaaaaagaaagaagaaagaaaaatttaaaacctggacacagccacatgcttgtgttcgtgtgaccccagtgtttactctcactctggaactgagaaagcacagacctctagcagtcagggcacatctgcctggcaaacaccactaaatgtcagcgatgtaggaaaatcaccacatgatcaaaatctatgacactgtcctaaagggtttttctcttcaaagacacagggtgcaatctcataaaacaactcatatcaaacatttaataactttagtaagccaggccttgtggtgcatgtctgtcacctcagccttcagtagcctaaagcaggatgacaagtttgatgccagctagtattaacatagcagaaactttctctaacaaacaagggtctgaagagatgactcagtgattagagcagtggctgatttcccagaggacctgggtttggttcccagcacccacaaggtcatacataactattaactcaagttccagggaatttggtgccttcttctggtctctgtgggtactgcatgcacatggtgcacaggcacatgcaggcaaaacacccaaacccacaaaaaggggggaaaaaagtaaattcattaaattatgcatggtggtacgtgcctgtaaaaatacatacaaattgacaatgtgttcagcatgcaaagtatactccttaaatagcataacaccatacatgattttaaaccacagagagactggagagacagctcagtgtttaagagcatttactgattttgcaaaggacctgggttcgattcccagtatccacacagctctggctccaagggatatggtgctctattctgacctttgtggacaccagagattgccatggggcaattacgcaaaataaagctaaagaaaaatatttagctgaataaagtttgaaggttgaaaaaaaaaagtatatcaaggccaaaagttattcccccacaaagactgctcaacgtttctgtagtctgtgcaggtgaatgtaaggaactaagagttgctggagtgatgagaaacaggcatttgatcaccctgacagaacaggcagataactggtccccagggccaccacactaactgtgtcctgaacagtgttcacttagtccatgtgtgctccatctctgctgtgtgtgtcaagacagtatctgcctatctgcacaaggcatagcacataatgatgcaattaggctaagcaattctccctttgaccagtaacatggcttactgttagctaccttgattattacaggaagaacatgtgcctggagccacaaaagctcttgactaccagagcactttatgagaggtcctgtcatccagccacacttaagttgctccctctctaggccaggcttgtggacaatgcacagcttagcctgcatacctgcaaagcacagcagtgaaactttatccagttcgatggtgtgtgtggtggtggtggtggtggtgggaggtccaccagcaccatgttatcattcttggtgactctcccgtggtaggtcagctcgagccatggcttgtgcttgttaactggtgggagaaaaagggaagcaacagtaagatgcagatcactgcttcagcgttctgctgcctttgaagatgaacatgtgtcgtctagcttccacacagtgcacatacacacaggaaagcaaagccagaggcacataaatcaaagagagcaaagagactgatcatctgaaaagggtgaactgtggtttgattatgggagtgccccatgtaaaatctaacccagatcatgaagacagaaattgactccttccctccacaagaggctcctgcgacatgagctctgacagagcgacatcaggagggtcatcattcctaccctctgtccccaaggaggcagaatgggatggcacaatagcagggatgcctgagggctttgacggaatccagtaaagctcacggcagtgcgggccaaccttcatcaaaggttcatggaacagaaggcacctctactatgcaatgggagatgggcaactcacccactgctgagacctcagtatattttatatgaaccacactaagaaggaagctgggacaactcgggggatcagctcgtggcaaactgctcacaaacaatgaagactcagacacatctcaccatcctgtagttttagggttctctctgtctctctctttttctctgtctctctctttgtctctgtctgtctctttccaagctaaaaactctaggctggtttcaaatttaaccttcctgcttctgcctcccaaacttctgggatcacagctgcacaccactgaaccccactccagtttttcattttacaagggaaactattaattcagcttgtaaccaatatcaacatttgattcaaacttgtattgatgctttgttttgctaataaaattacaagtataataaaataaaattgaattttattccaacatttgaatccacaagactctcttttttgatttttttggtttttcgagacagggtttctctgtatagccctggctgtcctggaactcactttgtagaccaaactggcctcgaactcagaaattcagctgcatttgcctcccgagtgctgggattaaaggcgtgtgccaccacgcccggctacaagactcttaatttaacatgatgtcaccttgttttttccagaaccacagggatataaaaatagtaagcataatgatgtgtggggcagctgccctgtcctaacacagaatggacaggctcactataacagaaaatctacagctgaaaatggttaacacatttcagagaagaacataactttatgtcgatttaatctactgccattccaggattctaattttataattcacaatttctcaattgctcctttcaagctggcagtataaggagagatatcgccatttccagaggctgaacttttcaataattaatgaatgttatttttagtatttcttcacattgctgggcatggtggcacacacctttaattccagcactcgggaggcagaggcaggcagatttctgagttcgaggccagcctggtctacaaagtgagttccagaactatacagagaaaccctgtctcgaaaaaaccacaaaaaattttttcttcacattcaatttgcattatgaaacatttatggaaagaagcgactgatgtttctgtaatcatcctctctcgaaccaccggaagtttatgggcggaaagtcaaggactccatcaggcatcttgaagccctagtgcagcactccattgcatgccacaacatcaaagccagctacattcgtaacagcaaacctcatgatcacacctgttagagtgtcggttttctggggttactctcaggcaaaaatgatctttgtgactacagatcttaatgattagaaacttgattttagaatctatgaatgccaggcagcagtggtccatgacttaatgccaatgctgtgaggcagaggcaggtggatttcttagtttgaggccagcctggtcttctgagcaagttctaatatagccagggcaattcaagaaaagcttgtctcagaaaaacaagaacaatcagtaagaacagtgaagctcagggttaacttcaggtaggaaagtttatcccagcacatcttaattctgtgggtaaagaaggctgttcttctgcccaagtcacatgaccaagagattctgcctggttattttcagatccactatgtgccacagagcccgacaccaatcatactcgacaagtcttcttctgctgctttatttcttttgcgtgaagaattccatcggctgaaagaaagaatttgacatatgcttcctataccagaatacctatggtggccatactgtaagtttcaaccatctttaaggcatttcaaatataagtgaacctataaaatcccaagacaaactgaatcttggtccatcaaatggctctgcaatcctgagatatcgccaccagggggcagcaggtgctcgggttgacatgcgtgaaattatgttttgattaaaaattaacctctagcccaccccgtggctactaaaggtatatcagcagcccgcattgagatgctcggggtggaaaagtacctgcgactgtgttctatgtcacatgcccacagtcttctgcaaattcagggaagcttccagactcccaacttccaccactctgcttggtaaaagatccccccaaaaaatcatccaaatttgccatggatctgggttttaacacacagataagtctgtctaaacacacttgaaggccgctcaagggaaatgaatggcttatttccctctccagtggcatgagtgacaccaggggtgaggtgaacaacatctagacagccgagatcgagtaaagacaccctcccacccatgtatgacttagtggaccagggagtctgtggagttactcatgggagcacagtgactcgaaagcagcttcagcatagaaaactgttgggagccgcccccacattcgccgtcacaagatggcgctgacatcctgtgttctaagtggtaaacaaataatctgcgcatgtgccaagggtattttacgactacttgtactctgcctttcctgtgaacgtcagctcggccatgggctgcagccaatcagggagtgatgcgtcctaggcgaaatataactctcctaaatagggaaggggtttcgatttcatgattgaaggggctttcgcttttggggctgggggtttgcgctcctagctcctgaagatgtaagcaataaagttttgccgcagaagattctggtctgttgcgtctttcctggccggtcgcgcgaacgcgtataacaattggtgctgaaatccgggacgagaaaaaatccgggacgaaaaaatacaagaaaactcgggaccggcgcaaggaagatccctcattccagaaccagaactgcgggtcgcggtaataaaggttcccgtaaagcagactgttaagaaggattcaactgcatgaattcagaacttttcagctgggggaacagagtaccagtgagtacagctttacaaggtacgcctggccttgaactttctaaggaaattcaagacagtctatcagaagtaaagtggaaaatggctttgcaaggtatgtttggccttgaattttttctagtgttaggagcccttttgttccttttcacatgttatcaggtgattaagatagggctgaaaattctggatgaaattcagggcaatctatcagaagtaaagcggggagagagagtaggagcaaagagaaaatatggtacacaaaataagtatacaggcctttccaagggtcttgaacccgaggaaaagtttaggtcaggtaagaatacctggggagagattagaaggaaggaaaagaaaaaagaaaagaaaaaagatcgattagcggaggtctctaggagatactcgtcactagatgagctcaggaagccagctcttagtagctctgaagcagatgaagaattctcctctgaggaaacagactgggaggaagaagcagcccattaccagccagctaattggtcaagaaaaaagccaaaagcggctggcgaaagccagcgtactgatcaacctccgggcagtcggtttcaaggtccgccctatgcggagcccccgccctgcgtagtgcgtcagcaatgcgcagagaggcaatgcgcagagaggcaatgcgcagagaggcagtgcgcagagaggcagtgcgcagagaggcagtgcgcagagaggcagtgcgcagactcattcattcccagagaggaacaaaggaaaatacaacaggcatttccggtctttgaaggagccgagggtgggcgtgtccacgctccggtagaatacttgcaaattaaagaacttgccgagtcggtccgtaaatacggaaccaatgctaattttaccttggtgcagttagacaggctcgccggcatggcactaactcctgctgactggcaaacgattgtaaaagccgctctccctagtatgggcaaatatatggaatggagagcgctttggcacgaagctgcacaagcgcaggcccgaacaaacgcagctgctttgactccagagcagagagattggacttttgacttgttaacgggtcagggagcttattctgctgatcagacaaactaccattggggagcttatgcccaaatttcctccacggctattagggcctggaaggcgctctcccgagcaggggaagccactgggcaattaacaaagataatccagggacctcaggaatccttctcagattttgtggccagaatgacagaggcagcagagcgtatttttggagagtcagagcaagctgcgcctctggtagaacagctcatctatgagcaagccacaaaggagtgccgagcggccatagccccaagaaagaacaaaggcttacaagactggctcagggtctgtcgagagcttgggggacctctcagcaatgcaggtttagcggctgccatccttcaatcccaaaaccgctccatgggcagaaataatcagaggacatgttttaactgcggaaagcctgggcattttaagaaagattgcagagctccagataaacagggagggactctcactctttgctctaagtgtggcaagggttatcatagagccgaccagtgtcgctctgtgagggatataaagggcagaattcttcccccacctgatagtcaatcagcttatgtgccaaaaaacgggtcatcgggccctcggtcccagggccctcaaagatatgggaaccggtttgtcaggacccaggaagcagtcagagaggcgacccaggaagacccacaagggtggacctgcgtgccgcctccgacttcctattaatgcctcaaatgagtattcagccggtgccagtggagcctataccatccttgcccccgggaaccatgggccttattctcggccggggttcactcaccttacagggcttagtagtccaccctggagttatggattgtcaacattcccctgaaatacaggtcctgtgctcaagccctaaaggcgttttttctattagtaaaggagataggatagctcagctgctgctcctccctgataataccagggagaaatttgcaggacctgagataaagaaaatgggctcctcaggaaatgattctgcctatttggttgtatctttgaatgatagacctaagctccgccttaagatcaacggaaaagagtttgaaggcatccttgataccggagcagataaaagtataatttctacacattggtggcccaaagcatggcccaccacagagtcatctcattcattacagggcctaggttatcaatcatgtcccactataagctccattgccttgacgtgggaatcctctgaagggcagcaagggaaattcataccttatgtgctcccactcccggttaacctctggggaagggatattatgcagcatttgggccttattttgtccaatgaaaacgccccatcgggagggtattcagctaaagcaaaaaatatcatggcaaagatgggttataaagaaggaaaagggttaggacatcaagaacagggaaggatagagcccatctcacctaatggaaaccaagacagacagggtctgggttttccttagtggccattggggcagcacgacccataccatggaaaacaggggacccagtgtgggttcctcaatggcccctatcctctgaaaaactagaagctgtgattcaactggtagaggaacaattaaaactaggccatattgaaccctctacctcaccttggaatactccaatttttgtaattaagaaaaagtcaggaaagtggagactgctccatgacctcagagccattaatgagcaaatgaacttatttggcccagtacagaggggtctccctgtactttccgccttaccacgtggctggaatttaattattatagatattaaagattgtttcttttctatacctttgtgtccaagagataggcccagatttgcctttaccatcccctctattaatcacatggaacctgataagaggtatcaatggaaggtcttaccacagggaatgtccaatagtcctactatgtgtcaactttatgtacaagaagctcttttgccagtgagggaacaattcccctctttaattttgctcctttacatggatgacatcctcctgtgccataaagaccttaccatgctacaaaaggcatatccttttctacttaaaactttaagtcagtggggtttacagatagccacagaaaaagtccaaatttctgatacaggacaattcttgggctctgtggtgtccccagataagattgtgccccaaaaggtagagataagaagagatcacctccataccttaaatgattttcaaaagctgttgggagatattaattggctcagaccttttttaaagattccttctgctgagttaaggcctttgtttggtattttagaaggagatcctcatatctcctcccctaggactcttactctagctgctaaccaggccttacaaaaggtggaaaaagccttacagaatgcacaattacaacgtattgaggattcgcagcctttcagtttgtgtgtctttaagacagcacaattgccaaccgcagttttgtggcagaatgggccattgttgtggatccatccaaacgtatccccagctaaaataatagattggtatcctgatgcaattgcacagcttgcccttagaggcctaaaagcagcaatcacccactttgggcgaagtccatatcttttaattgtaccttataccgctgcacaggttcaaaccttggcagccacatctaatgattgggcagttttagttacctccttttcaggacaaatagataaccattatccaaaacatccaattttacagtttgcccaaaatcaatctgttgtgtttccacaaataacagtaagaaacccacttaaaaatgggattgtggtatatactgatggatcaaaaactggcataggtgcctatgtggctaatggtaaagtggtatccaaacaatataatgaaaattcacctcaagtggtagaatgtttagtggttttagaagttttaaaaacctttttagaaccccttaatattgtgtcagattcctgttatgtggttaatgcagtaaatcttttagaagtggctggagtgattaagccttccagtagagttgccaatatttttcagcagatacaattagttttgttatctagaagatttcctgtttatattactcatgttagagcccattcaggcctacctggccccatggctctggaaaatgatttggcagataaggccactaaagtggtggctgctgccctatcatccccggtagaggctgcaagaaattttcataacaattttcatgtgacggctgaaacattacgcagtcgtttctccttgacaagaaaagaagcccgtgacattgttactcaatgtcaaagctgctgtgagttcttgccagttcctcatgtgggaattaacccacgcggtattcgacctctacaggtctggcaaatggatgttacacatgtttcttcctttggaaaacttcaatatctccatgtgtccattgacacatgttctggcatcatgtttgcttctccgttaaccggagaaaaagcctcacatgtgattcaacattgccttgaggcatggagtgcttgggtgaaacccaaactccttaagactgataatggaccagcttatacgtctcaaaaatttcagcagttctgccgtcagatggacgtaacccacctgactggacttccatacaaccctcaaggacagggtattgttgagcgtgcgcatcgcaccctcaaagcctatcttataaaacaaaagaggggaattgaagagattttaccccgagcaccaaaagtgtctgtgtctatggcactctttacactcaattttttaaatattgatgctcatggccatactgcggctgaacgtcattgtacagagccagataggcccaatgagatggttaaatggaaaaatgtccttgataataaatggtatggcccggatcctattttgataagatccaggggagctatctgtgttttcccacagaatgaagacaacccattttggataccagaaagactcacccgaaaaatccagactgaccaagggaatactgatgtccctcgtcttggtgatgtccagggcgtcaataataaagagagagcagcgttgggggataatgtcgacatttccactcccaatgacggtgatgtataatgctcaagtattctcctgcttttttaccactaactaggaactgggtttagccttgattcagacagccttggctctgtctggacaggtccagacgactgacaccattaacactttgtcagcctcagtgactacagtcatagataaacaggcctcagctaatgtcaagatacagggaggtctcatgctggttaattaactcatacatcttgtccagatacaactagatgtactatgacaaatagctcagctggggtgtaaacaaaagtttccgggattgtgtgttatttccattcagtatgttaaatttactagggcagctaatttgtcaaaaagtctttttcagtatatgttacagaattggacggctgaatttgaacagatccttcgggaattgagacttcaggtcaactccatgcgcttggacctgtccctgaccaaaggattacccaattggatctcctcagcatttcccttctttaaagaatgggtgggattgatattatttggagatacactttgctgtggattagtgttgcttctttggttggtctgtaagcttaaggcccaaactaggagagacaaggtggttattgcccaggcgcttgcaggactagaacatggagcttcccctgatatatctatgcttaggcaataggtcgctggccactcagctcttatatcccacgaggctagtctcattgcacgggatagagtgagtgtgcttcagcagcccgagagagttgcacggctaagcactgcaatagaagggctctgcggcataaaatgagcctattctagggagacatgtcatctttcaagaaggttgagtgttcaagtgtccttcccccaggaaaaacaacacgggaccagaccaggacccctctgggtgatgagcctgggaggaggttatgtgtacggctcctttacctacacactggggatttgacctctatctccactctcattaatatgggtggcctatttgctcttattaaaagaaaagggggagatgttgggagccgcccccacattcgccgtcacaagatggcgctgacatcctgtgttctaagtggtaaacaaataatctgcgcatgtgccaagggtattttacgactacttgtactctgcctttcctgtgaacgtcagctcggccatgggctgcagccaatcagggagtgatgcgtcctaggcgaaatataactctcctaaatagggaaggggtttcgatttcatgattgaaggggctttcgcttttggggctgggggtttgcgctcctagctcctgaagatgtaagcaataaagttttgccgcagaagattctggtctgtttcgtctttcctggccggtcgcgcgaacgctaataagagaaaaccccacctcagggccagtgaggattcctaaaggctacatgcctggagctctcttccggactttcaggaggctcagcacagcatgaaggctaattctgattgtctagttgattggatctggaattaactatgagtcacacctcagtgtgggtctatagaagtgtttctagggtggatgaagattcccagagcagacagaaattcaaggcaaatatactactatttgtttgtctaccttcattccttcctggtgagtgtgcctatcccatttctttgagaagcccagtttttcagcctttcaatatggactgaagcccagagactctccaggaatgcccaaggccttcaacaccagattggaactgctaaggcatccagcatcttggatagaggaaccactgggtccatatcatggaagtcaatgcaaccagtcttccttatcatatgtattctgtctcagttccctcctaaaggaccctgactaacacatgtgttattgtgtgaactcctggagggcaggtgttcctgtctctgtctcccatgtagggagctggcatgactggctagaatctccatctctgaacttctctgatgctcccttctggagcaacaaatgccactatccttgaatcagacaagacagtatgacatgacagagtaggcagctgccctttaagatgcaatttcagctacccccaaaaaaacacacctccacttcccacagctcccatacctacacctcccacaccaaaacctcccacaacttctactcctatatctcccatgtctctaccacccacacctccacctcccacaccttggtgaccgtctacagtcactttggttccacagcaagagttcaggttccatttgcaaatttgacctgcttgcagaggtgctctcgaccttagtgtccccagactggaaatgctgttgacagctactctaactccctctctggaaaatgagaaggtggtactcagggtccctgctcctgggttacaactttgtcctccacctcttgctcctcctccttctctacctcctcctcttcctcacgtttctctgtcctccttttaactcaaaagtgatggatgactgacaaggagcaaatgagtcagaaataaggaagcagaaaaagagaatgatgttgccaacttatcattcagaggtgctctctgagacagagaatcagagcaacaccatcaatcacacagcagacgcccttgcaggcgatctgtggtgtcagccattgcatgagcaattggaccaggagcctagggctacctgctagccaccacagaggaaggaggctgtgtagacacataaaagggggacaattagcccagaggttagagaggacaatgagaacctgctttcttgcacaggttggactccctgtgagtcctacttgggccagactcaaaacaggagagaaatgaagccaggaggtgctcagtgtggaacctgtagccctttgccacactgagggtgggagggaaacatgagttcatctgaatggatggagtcctaggaagctgtatctcggccatggctctgcaaggcgagtgcatcctacatggatggatataagattgagagagcatgtgagaccttttcccccttgccgcagaccttctgggcccctgtgtctgcgtggaacggggtctctcgaagtgggttggcaaagcgtggatgagcgacaaacagacacacacacaggagagttcgtgtggaatctgagtgtaattttacaactcgagcatcagactttttatgcagaggacaataaggaagttgggtgacatatttgcaaggtacaattgaggtaacaggaatcttacataaaacagtggaatgcaaacacaaaaggtctaactggaaccacccaggatagaatacattgataacagctgggatcaacaagggctccacctaaaattcactaatcttagaagccagggtcaagggcttcatgcccttgccatagttcctattttggtctcttgtatagtccaccttccccttaagccattgtaaatacgtgtgtatgggtgtaactctgctatagtatctattctggtttctcctttggtgtgaaacttccttcttcctaagtgatggtaaattcctgtgtaagggagtgacttagcttttacaatcttgctgaattctaaacccttgatcttggtcaaggacgcccttgaactgctggaacactggcggaaggctttagccatgtcagagcacttataataggaaaatactgaaagagagcatgtggatccatactctagactagcgcggtaatggaactcgggaatgaaaaattaatgtatgggtagagaacactagactccaggaggagagcttccttgaaactcttttgcctcatgagtgacttttaagcctttcggcttgtccagttgactcaaccggagagcgtagcatcccctcatatttttatttctttatttcttttttccctttttttctttttttggtttttggtttttcaagacaaggtttctctgtatagccctggctgtcgtggaactcactctgtagaccaggctggccttgaactcagaaatctgcctacctctgcctcccatgtgctgggatcaaaggcgtgcgtcaccactgtccagcctatatttttatttcatactttaaactttattataattttgatgtatagattatcgctgcatattaagttgtgattttttaatctccttggggattggtttttcttcatgtacacacaaattctttgcagagtcctgtaagtacatgaacagagcttcttccagaaaaacatccagtcatttttattatccagttagtagatctgtattttattaggggctagaaaagtttaaaaaaatgtattcatttattggtctataaagtattataaggagatgaataattataattttattttgtaatttgatgtctatatctgttaaggtttgatgagctcattctacaatagcctgtccctgtgtattataggtaatgtcagtggactatgagaaactaagagtcaaacatgaattttaatatgcgttttaagtttaaacaatggtattttctgattttgaggccttggcattataaactaatgaaacaaatactgtatcatatttttgaaagtttccccaggttaggccaaggcataaataacaatgagaattaagcatacatacatacaggcataaaggcaaactttcgaaaagacaggacatatgtaacatttgtctgttttaaatctcagggattaaaacaggggttaaatacccaagctgagctaacagctttgcaggaatgcaggaccagttttctgagtgcaatggtgatttgtaatgtaagatcttgctaagttactttcataggaaaatcaacaagcttttgttaagaaattaaactaatccttaccttcatgtatattaccaaaaagcatagaatgaacttgaacatgtccattagaggaaaggcaatttctaaattgaagggggcctgtccttcatatataaaagacaatgtatctcggctgcatcatggtcaggaagtgatagtgggagagtagtcagagtatttgtggtacctccttaagctgcagttgctgtgccttacagaatattcagcagctagtactttcaacttcaaggtcagagcagctgttgggctgggaaatgggcaggagaagaacaaggtgtgggcaggggtttattttctcctgccactctcacaattctgtcatggatatcttaccattttggagaagtttgagatactatgaacctgggggttttggtgatgttttaattaattttataagttccagaatatttttctattttttaaaagatttatttattattatatctaagtacactgtagttgtcttttagatacaccagaagagggcatcagatctcattacagatggttgtgagccatcatgtggttgctgggatttgaactcaggaccttcggaagagcaatcagtgctcttaaccactgagccatctctccagcccaagaatatttttctaaaataacctcttagatccttggaagtatctgtatttgtacacaggaattctctatgctaaagcctcaataaagctccttgaaatcaaaatctcccatctttcttaactccccatttttctgtttgctatttcatttccctttctccaagggactgaataggcatcccaagagagcattttagatattagtcatatgagggaccattgcagatttgattgaattagaacatgtaggttataaagcaccatcatatgactataaatattaacatttactgaataaagttacactcttcattaattttacactgaggtatatgcaggctttgatgtaaatacaccattcagaatatgtcttcacagatttagatattaatgctacatcttaggtttgaatgaaaatgaaaacaagattgctgcaaattatgactgagaagaacatatattatatgttctgttaacccagagtatcaccagagaaaaaccaattgcaccatgtgacaaactttattaatatttatattgtgactaagatatggactttcatcacaggctacagggagttgtatagggcattgtaatttcctatgaggctttattagtttcctaggacttgcagcctgcagcattccaagaagttacctgtttcttaggctggtggtgcttagagattaatttttggcatttcagtcttagggagaaagcagtctgagttctctggttggatccagactgaaccaggccacataagccctagcctttgcatctgagagtgcttacccaccgatccacccactcctacctcatactactagcatgatacatcactggggcatcaagtatgggaccctcttttttatttcttaatgtcatttgtctcatacattctgttttattttcattcctcctggcatctccacattaggactgaccattcaggagatggtactaaggactcgtttcagtaaaaccccaacaccagtagctcagcaaagaacacacaactcagttacaatatttataagctgcatgccttgggcagatattccactatactattctattctccagcttttagaacccttgctatctgtggcttttcaggcaatgtgttcttctccatctttcttccaccttttcttcctctaacttcctctgcctccttcatctcctcgtctgcttcttctttttccgtctttgcactctctaaaatcttcagccccacttttcccttctattgcccaatcacaagctctggcctttattcgaccagttaaaatggagagaaggttcacatgaaattgcatgagtatatagtccactgttcattggggcagcccctcttgaggaagcagaataagcattaaagtacaaacagcaccagggcaatccacattttgttcaatcccttttgttcaactaaaaggatcttttcttcacatataaattgagcacaactcttgaattatgaaaatttaaaagtaaaagtaccctaaacacccaggccatccatcttctccatttagataaagcactctaccgtctattctaacttaaaaggcttacaattctatacctgaattatctcctggttttagcttgtatctgaaaaccatcctctcaaatctatatcatgtcagtcagtcctaatcatcttgagttagctatgagtatacaacaagtcttcagcacatgtaagaaattgaagcacatcctaaatattacctgaaaatatagaaagcataaaacatagcttccaaaacccaaccaaactatagacacagctaacaacctggacagtccctcactcctcaaaatagtggagcatcagtcttcagtcttctggccaggatcatctgtcagaactttgtaaagcaaaattttgaaggactgcttagcctgtattggcagatctattagttgctcttccaaatagaatgtcctatttctgggcaggagttttgtctgttgatgaagtgaggcaattcttctctgtggctatctcgccataactggagcaactccactgatgcacatttcacatttatacaaagaatgggatgctgtcaggagcagacatgtctctagtcaaatgatatataataatgaaattgccttaataatgaaattgccttattgttgtattctgtggacttcttatgcctttgaaaactatctatctacgcaaagtatatctgaactgttaagccttgactactctcaaccatttctgattgaagtatctcaaaaaaaaaagcccttttataattaaaacaggactatgattctgttacctggcccttaacttgtattttcattaatctaaaaatagtcagtaatagcagacatagaaggactaagtccaagctttttatttttttttaaagatttatttatttattatatgtaagtacactgtagctgtcttcagacactccagaagagggtgtcagatcttgttacagatggttgtgagccaccatgtggttgctgggatttgaactctggaccttcggaagagcagtcaggtgctcttacccactgagccatctcaccagccccaagctttttattcttaaatgtgttgcatgggcacaaatcctatctaatagcaacctattcttatttttctagtattctaattttaataatactatatcctgtctttatcttccctaccacttttatttatctaagaaggaaggctagagaagaggaaaggaaaggtagaagtccctgagtctaagatctctagggattttgttgccctcctttgcctgttacgtatcccgtttagagttttcttagtcttctccacaatctctagtcctgtagggttatatgatatttttgtaatatattttatataataacattttaaaaagctgcttcatcatactagagacatatgctggaccattgtgtgttttgatttgtatggatattcccagaatggccataacctctaacaaatgggtagttacagaatcagccttttctgatgctgaggcagtttcccattgaaatccttattacgtgtctatagtatggcgcacacatttcagcttaccaaactttgtaaaatggaatacatccatttgccaaatgacatttcttttagtacccttacgcttagttcctgaagataatggaatttgattgtataatgagcaagtagaacattgcctcacattttccttggctctttctttaaatctttgctgttaacatgattttttatggaattctaaagcctcttttactctttctatcaatagctggtcaatttcattatcaccttgtgccagagggcctggcaaacctgtatgggatcttatgtgtgttatatatagtggatcactcctgtttcttatcttttgttgtagctgaagaaatagtgaagtcaattcagattcatcctgaatacgattaacagtctgtattggaaaaacaaccctttctgcatattgaaagtcagttactatattaagagactcttgagaatctgacaacactgtgagtattgtacataattcagatctttgaactgatttatagggacattcagcgacctacatcttctgatttatatcctgcctttcctgatttattagtctcagcataacatgtaggggctccagataatggaatttcctttattttatgagggaaaatccacatagttctttttatgaaatgaaatcatttgttttcatggtatctgttattaatctctccaaaaagttactgcatgttctttaccaagattcactcacgttgtgcccctaaggaggcaatctctgcattagtagaaggtaccactattttaggtggatccattccaactacttgtcaatgtctcactttttccttttaatatcaattcagagaccttctccatgtaggtttttcttactgtgtttatgtgctaaaaaatccattcttttattatattcatatatttgtttgtttgtttttgagcctgtttctctgtatagcgctggctgtcctggaactcactatgtagattgggctggcctcgaactcagaagtctgcctgcctttgtctcccaagtgctgagatcaaagacatgtgtcaccgctgcctggcaaatatccattctaatttataatcttccctctgcatgggaattcctggagggatatgggtagaaattaagatgactaaaatgcaggccatatttggacaaatacagtctaattgtatagattccttgcaccttgtcgcttctccaggccacatggttttgttccatctttcttccacctccttttcttccatcttccactttctcctttgtttccttgcttgcctctcctccttcccctcttctccctctctaaaacctccagccccacgtttcacttccactgcccaaatcacaggctttagtctttatttgaccaatttgaccgatttaaatggggagaagtttcacattaaaacaccagagtatgtgatccactcctccttggggcagctccatttgaggaagcagatttagcatcaaaatggaaacagccccaaagcaatccacaacaaatactaccctaaatacacacccatgacattcctccattgggtcaaccctgtgggcacagagccatggcctaactaccatggaagtcccccactaaggacaagacaactgagtccaacattcacttttctccttccacaatttttcccttttttattaatttacccctgtgtctcatctggccattggtagcctcccttcccacttaagggagccccaaataaaatctctttggttcttccttttcatcagtggcatgaatgtcagtttctctgttctggaaaacttctggactaaggcaggagttctatccccatgtatctctctgagaacatgatacatggatgagagctttctttcaagccaagaaattcatagtgtattcaggtgctatggactggactcaggaagtccctcaactcacaggaaaatcagggtattggtgaaagaccccaccataaggcttagcaagctagctgcagtaacgccattttgcaaggcatgaaaaagtaccagagctgagttctcaaaagttacaaggaagttcagttaaagattaacagttaaaaatcaaggctgaataatactaggacaagggccaaacaggatatcggtggtcaagcgcctgggccccggctcagggccaagaaccgatggttcccacctgggccccggctcagggccaagaacaggtggtacccagatgaagcggaaccagcaacagtttctgaaaaagtcccaggtcccccaaatgaccaggaaatatcccaagccttgatttgaactaaccactcagctcgcttctcgcttctgtgcccacgctttttgctccccagccccagccctataaaaagggtaaaaattccacactcggcgcgccagtcctccgatagactgagtcgcccgggtacccgtgttcccaataaaagcctcttgctgattgcatccgaatcgtggactcgctgattcttgggagggtctcctcagattgattgactacccacctcgggagtctttcatttggaggtcccaccgagattaggagacccctgcccaaggaccaccgacccccgccgggaggtaagctggccagcagtcgtttcgtgtctgtctccgtttccgtgcgtgtttgtgccggcacctaatgtttgcgcctgcgtctgtactagttggctaactagatctgtatctggcgagtccgcggaagaactgacgagttcgtattcccggccgcagccctgagagacgtctcagaggcatcgggggccatctctgtggcccaatctgtatctgagaacccggctctttgaccaagggatacgtggttctgttgggcggcgaggggccgaaacgctcccctcccccatctgaatttttgctttcggttttccgccgaaaccgcgccgcgcgtcttgtctgtctctgtgttgttttgtcattgttttgtcatttgtcggttcgttattgttttagaccgtttctaaaaatatggggcagaccgtaaccactcctttgagcctgaccctagaacactggggagacgtccagcgcattgcgtccaaccagtccgtggacgtcaagaagagacattgggtcaccttctgctctgccgagtggccaactttcgatgtggggtggccgcaagatggtacttttaatttggacattattttacaggttaaatctaaggtgttctctcccggtccccacggacacccggatcaggtcccatacattgtcacctgggaggcacttgcctatgacccccctccgtgggtcaaaccgtttgtctctccaaaaccccctcctttaccgacagctcccgtcctcccgcccggtccttctgcgcaacctccgtcccgatctgccctttaccctgcccttaccccctctataaagcccaaacctcctaagccccaggttctccctgatggcggcggacctctcattgaccttctcacagaggaccccccgccgtacggagcacaaccttcctcctctgccagagggaacgatgaaaaagaggcggccgccacctccgaggcttcccccccctctcccatggtgtctcgactgcggggaaggagggaccctcccgcagcggactccacctcctcccaggcattcccactccgcatggggggagatggccagcttcagtattggccgttttcctcttcggacttatacaattggaaaaataataacccttccttttctgaagacccaggtaaattgacggctttgattgagtccgtcctcatcacccaccagcccacctgggacgactgtcagcagttgttggggaccctgctgaccggagaagaaaagcagcgggtgctcctagaggctagaaaggcagtccggggcaatgatggacgccccactcagttgcctaatgaagtcaatgctgcttttccccttgaacgccccgattgggatcacaccactacagaaggtaggaaccacctagtcctctatcgccagttgctcttagcgggtctccaaaacgcgggcagaagccccaccaatttggccaaggtaaaagggataacccagggacctaatgagtctccctcagcctttttagagagactcaaggaggcatattgcaggtacactccttatgaccctgaggacccagggcaagaaaccaatgtgtctatgtcattcatctggcagtctgccccagatatcgggcgaaagttagagcggttagaagatttaaagagcaagacattaggagatttagtgagggaagctgaaaagatctttaataagcgagaaaccccggaagaaagagaggaacgtatcaggagagaaacagaggaaaaggaagaacgccgtagggcagaggatgagcagagagagaaagaaagggaccgcaggagacatagagagatgagcaagctcttggccactgtggttagtggacagagacaggatagacaggggggagagcgaaggaggccccaacttgataaggaccaatgcgcctactgcaaagaaaagggacactgggctaaggactgcccaaagaagccacgagggccccgaggaccgaggccccagacctccctcctgaccttaggtgactagggaggtcagggtcaggagcccccccctgaacccaggataaccctcaaagtcggggggcaacccgtcaccttcctggtagatactggggcccaacactccgtgctgacccaaaatcctggacccctaagtgacaagtctgcctgggtccaaggggctactggaggaaagcggtatcgctggaccacggatcgcaaagtacacctagccaccggtaaggtcacccactctttcctccatgtaccagactgcccctatcctctgctaggaagagacttgctgactaaactcaaagcccagatccacttcgagggatcaggagctcaggttgtgggaccaatgggacagcccctgcaagtgctgaccctaaacatagaggatgagtatcggctacatgagacctcaacagagccggatgtttctctagggtccacctggctttctgattttccccaggcctgggcggaaactgggggcatgggactggcagttcgccaagcgcctctgattatacctctgaaggcaacctccaccccggtgtccataaaacaataccccatgtcacaggaagccagactggggatcaagccccacatacagaggctgttggaccagggaatactggtaccctgccagtccccctggaatacacccctgctacccgttaagaaaccagggactaacgattataggcctgtccaggatctgagagaagtcaacaagcgggtggaagacatccaccccaccgtgcccaatccttacaacctcttaagtgggctcccaccatcccaccagtggtatactgtgcttgatttaaaggatgcctttttctgcctgagactccaccccaccagtcagcctctcttcgcctttgagtggagagatccagaaatgggaatctcaggacaattgacctggaccagactcccacagggtttcaaaaacagtcccaccctgtttgacgaggctctgcacagagacctagccgacttccggatccagcacccagacttgatcctgttgcagtacgtagatgacttactactggccgcgacttccgagcctgactgccaacaaggtactcgagccctattacaaaccttaggggacctcggataccgggcctcggccaagaaagcccaactttgccagaaacaggtcaagtatctggggtatcttctaaaagagggtcagagatggctgactgaggccagaaaagagactgtgatggggcagcctactccgaagacccctcgacaactaagggagttcctagggacggcaggcttctgtcgcctctggatccctgggtttgcggaaatggcagcccccttgtatcctcttaccaaaacggggactctgtttaattggggcccagaccagcaaaaggcctatcaagaaatcaaacaggcccttctaactgcccccgccctgggattgccagatttgactaaaccctttgaactctttgtcgacgagaagcagggctacgccaaaggcgtcctaacgcaaaaactgggaccttggcgtcggcctgtggcctacctgtccaaaaagctagacccagtggcagctgggtggcccccttgcctacggatggtagcagccattgccgttctgataaaagatgcaggcaagctaactatgggacagccgctagtcatcctggccccccatgcagtagaggcactggtcaagcaaccccctgaccgctggctatccaatgcccgcatgacccactaccaggcaatgctcctagacactgaccgagttcagttcggaccagtggtggccctcaatcctgccaccttgctccctctaccggagaaaggagccccccatgattgcctcgaggtcttggctgaaacgcatggaaccagaccggacctcaccgaccagcccatcccagacgccgaccacacctggtataccgatgggagcagctttttgcaagaaggacagcgaaaagctggggcagcagtgacgacagagaccgaggtaatctgggcgagggccctgccagctggaacgtcagcccagcgagccgaactgatcgcactcacccaagccctgaaaatggcagaaggtaagaagctaaatgtttatactgatagccgctatgccttcgctacggcccatgttcatggggaaatatataggagacgggggttgctgacctcagaaggcaaggaaatcaagaacaaaagcgagatcctagccttgctgaaagccctctttttgccaaagaggctcagtattatccattgcccgggacaccaaaaagggaacagtgctgaagccaggggcaaccgaatggcggatcaagcagccagggaggcagccatgagagagagcgcagaaacgtccacgctcttaatagaggattcgtccccgtatactcccagctacttccactacacagagactgacagaaaagaccttctgagactgggagccgtatacgatgaggacaaaaagtattgggtcctgcagggaaaacctgtgatgcctgaccaattcacctttgagctcttagattccctacaccggctcacccacctcagctatcagaagatgaaggcactccttgaccgggaagagagcccctactacatgttaaatcgggataaaactctccagcacgtaacggaatcctgtacagcttgtgctcaagtaaatgctagtaaagccaaaatcggagcaagggtgcgagcgcggggacaccgacccggcacccattgggaaatcgattttaccgaagttaagccagggctgtatggatataagtatctcctggtgtttgtggacacattctctggctgggtagaagcatttccaaccaagcgtgaaactgccagggttgtgaccaagaagctgcttgaagaaatttttccaagattcgggatgccccaggtattggggacagataatgggcctgccttcatctcccaggtaagtcagacagtggccgatttgttggggatcgattggaaactgcattgtgcttatagaccccagagttcaggtcaggtagaaagaatgaatagaacaatcaaggagactttgaccaaattaacgcttgcagctggcactagagactgggtactcctactccccctggccctctaccgagcccggaatactccgggcccacatggactcactccgtatgaaattctgtatggggcacccacgccccttgtcaattttcatgatcctgaaatgtcaaagttaactaatagtccctctctccaagctcacttacaggccctccaagcagtacaacgagaggtctggaagccgctggccgctgcttatcaggaccagctggatcagccagtgataccacaccccttccgtgtcggtgacgccgtgtgggtgcgccggcatcagactaagaacctagaacctcgctggaaaggaccctacaccgtcctactaaccacccccaccgctctcaaagtagacggcatctctgcgtggatacacgccgctcacgtaaaggcggcgacaactcctccggccggaacagcatggaaggtccagcgttctcaaaatcccttaaagataagactaacccgtggggccccctgatagtcatggggatcttagtgggggcaggagcctcgggacaacgtgacagccctcaccaggtcttcaatgttacttggaaagttaccaacctaatgacaggacaaacagctaacgccacctcccttctggggacggtgacagacaccttccctaaactatattttgacctgtgtgatttagtaggagactactgggacgacccagatggagttggttgccgctctcccggaagaagaaaaaggacaagactgtatgacttctatgtttgccccggtcatactgtaccaatagggtgtggagggccgggagagggctactgtggcaaatggggatgtgagaccactggacaggcatactggaagccctcatcatcatgggacctaatttcccttaagcgaggaaacactcctaaggatcagggcccctgttacgattcctcggtctccagtggcgtccagggtgctacaccggggggtcgatgcaaccccctagtcttagaattcactgacgcgggtaaaaaggccagctgggatgcccccaaagtttggggactaagactctatcgatccacaagggccgacccggtgacccggttctctttgacccgccaggtcctcaatgtaggaccccgcgtccccattgggcctaatcccgtgatcactgaccagctacccccatcccaacccgtgcagatcatgctccccaggcctcctcatcatcctcctccaggcacggtctctatggtacctggggctcccccgccttctcaacagcctgggacaggagacaggctactaagtctggtagacggagcctaccaagcactcaacctcaccagtcctgacaaaactcaagagtgctggttgtgtctggtatcgggacccccctactacgaaggggttgccgtcctaggtacctactccaaccatacctctgccccagctaactgctccgtggcctcccaacacaagctgaccctgtccgaagtgaccggacagggactctgcgtaggagcagttcccaaaacccatcaggccctgtgtaataccacccagaagacgaacgacgggtcctactatctggctgctcccgccgggaccatctgggcttgcaacaccgggctcactccctgcctatctactactgtacttaacctcaccaccgattactgtgtcctggttgagctctggccaaaggtgacctaccactcccctggttatgtgtatggccagtttgagagaaaaaccaagtatcaaagagagccggtgtcattaactctggccctactgttgggaggacttactatgggcggcatagctgcaggagtaggaacagggactacagccctagtggccaccaaacaattcgagcagctccaggcagccatacatacagaccttggggccttagaaaaatcagtcagtgccctagaaaagtctctgacctcgttgtctgaagtggtcctacagaaccggagaggattagatctgctgttcctaaaagaaggaggattatgtgctgccctaaaagaagaatgctgtttctacgcggaccacactggcgtagtaagggatagcatggctaagctaagagagagactaaaccagagacaaaaattgttcgaatcaggacaagggtggtttgagggactgtttaacaggtccccatggttcacgaccttgatatccaccattatgggccccttgataatacttttattaatcctactcctcggaccctgtattctcaaccgattggtccagtttgtaaaagacagaatttcggtggtgcaggccctggttctgacccaacagtatcaccaactcaaatcaatagagccagaagcagtggaatcacgtgaataaaagattttattcagtttccagaaagaggggggaatgaaagaccccaccataaggcttagcaagctagctgcagtaacgccattttgcaaggcatgaaaaagtaccagagctgagttctcaaaagttacaaggaagttcagttaaagattaacagttaaaaatcaaggctgaataatactaggacaagggccaaacaggatatcggtggtcaagcgcctgggccccggctcagggccaagaaccgatggttcccacctgggccccggctcagggccaagaacaggtggtacccagatgaagcggaaccagcaacagtttctgaaaaagtcccaggtcccccaaatgaccaggaaatatcccaagccttgatttgaactaaccactcagctcgcttctcgcttctgtgcccacgctttttgctccccagccccagccctataaaaagggtaaaaattccacactcggcgcgccagtcctccgatagactgagtcgcccgggtacccgtgttcccaataaaagcctcttgctgattgcatccgaatcgtggactcgctgattcttgggagggtctcctcagattgattgactacccacctcgggagtctttcattggtattcaggtgggcaaggagtcggtgttgagtgactatcagactttaacacaagggagtgttgatctgaatgtaatttctcaaagtgacccagtggaaaagacaagatcaactggaactccatctctgtcagtattcagagacttcattagaatcactttcgtacacttataagctggttctttttttttttttttttaaattccaaacatctttcagccagccaaagtccatggagtcttgtatcatggtgcttttctatgcattggcagagccacaagtgtagcaatgcagtgtacaaaagttcttacattctaatagatggtgattttcttgaaccttacaaccagcgttaatgcaacttgaagaaatttaagatttaaaactccagttctaccgtgtattcaactttatggtttagcatttttttcaaagaacaatgtaaaaacaaacattattttccttgtatttctcttgttatcaacttttaaaacctaacatgatgcattggtgcaatgataatttattaatacaatggtaatttatatacttcttcaaggtatgttcagaaactgcctgagtgtcatttgctgaaagcatgaaatgcagaggcttagcacaaccttccaaaatgaatataccattatgtgtactgattgataaacagtgatgtctgtaatcacttggagccagttacctcatccttttttaaaactctgttaaagatttctgtatactataccattcctttcccatataatggggttttcttgatgttcctgaaaatattgcaaaggtctttcttaagaccagcaatggagataaaaaagccaacaggcatacacacagagtatacagatagacacaaacatggagacagaaggcagacacacaggaagagagaaatacacaaggcagtattcaacaagttacagatttaaattaactgaatagacacacaggatggaaggctcagataagacgaagaagagaatacaactttggattcacagttaaattacctctgagggaaaggctatcgattttttccttaactcagatgcattattaattaccagtgtatttaatttgttcatatatgcagaatccattaacttgtgacataatttttctctctttttttttttgcataagcacaatatgggaaaatataaaactcaccacaatgggtaacaagtagccctgcattctgaaaggtgtccacgggctcagaaccctgttctctaaagaaagaccatcaggtctgggcttgtgcttctgagctctcacttccatgctggcctagaatccattttaactctcaccgtcatcacaaagtgtttgaaccacagaagtcacaagagaatcctggaactcattactttcattaaaagagttgacctcatgccatattctctaaggggactttggtaattcttgagtcttcttttcccagcctatgaagatatgcatgggtgtacatagagtattatagagcacagtcagggaatcttctatgaacaaatggctaaattgtgcagtatgtattgtaggtctttttctatctccttccttccttccttccttccttccttccttcctttcttccttccttccttccttccttccttccttccttccttccttcctccttccttccttcctctcttcctcccttccttctttcctttctttattctttcttttgacaaaaatctagacgcttattcaaagaaatttttctttattgcctcacccttcaagcagtaaataatattgtgcctaaatctgacatcattttaattcatcattttctttgactaaggcatccagctcctctaccttttgtccaagtctaataatctgtctctcacacgttctctatgagttattattatttgctttactgcattttattttcaggctcctttccttgtttatttctaagcacatattgaactcaattttcatatcctatgttgtcctcctttccttcaggcttttgctattattctcttgcccacgaatcattttgttcctgtcctctatcagttgacatatgtggcttacacacttttatctctttgatcatgactctgggttttcaattctttacctaggatatcatgtaaattgctctctttataagatacatacacagttgatagtttgagccaaagacattttatcttagttttactttgttttgggtattgagcatcagaattcagagggactgcttaattgtgtgcatttttagactagactcataatgtgagaagttaggcaggatctattgtatctgaaggattcagaacccaggtgcagtgtcctactacattcagttctggtctagtctggcagtaaccttgtgggaagctgagcagagtagatcctgagaagttgtgtttccacaacagagttggaggagtggttcctgatggggagggtgggcctcctgcatgattagataagattaagaaaaagacaaaataaaaacaaagaatcaatcaatcaaaaaatcaatcaatgaattaaataagcaagcaaggaggcaaaaatccaaaccaacaaaaattgctctgaagaactgggaagctaattaattaaaaagtcctgaagcaggtgggcttagaagaacagcaggaagctggtgagtattgggcgggtccaaaaggagtggcactgaggaacaaagaggaagtgacaggaatttctgccattccagcattctcaatgtgtcttggctgcctcgtggtcaggaagtcatggagggagactagtgcctagtgtttgcggaacctgaaaacttccttaagctgcagttgctgtgctggcctcctaggatattcagcagctggtcctgtcacctgccagatcagaggtgctgttgggctgggaaatgggtagaagcgggacaggcgtgtggagcaggggtgcattttctgctgccacccttacaattctgttgtggatatcttaccattatcagaaagtttgagtttctgtgaattgagtttatggtgatgttttaattaattttatggttgccagaatatttttctaaaacaaccctgtagatccttggccctctctggactttgtatactatacccggagggttgtctttgcaaaggccttaataaagctcctcgaattcaaattcattcatgctttcttaactcccctgttcctccatttgccattttatttccctttctccagggaattgagtaggcatcccgagagagctttgtaggtatttgtcatatggggaccagtacagatttgatcgaattagaaaatattccttataaagcaccatcatatggctgtaaatattaacattaaccaagcaaagttatagtctccgttagctgaacacagaggtatatgcatactttgatgtaaatacatcattgagaaatgtgtctatatatgctttgttattaatgtcacaattaggtttgaataaaacatgaagacaggattgcagcaaggtacttgtgaggagaaatttccttaaggaaatgaggacaacataggatatgaaaattgaattcaataggtggttataaatacaaaagaaaagaaaagaaaagaaaagaaaagaaaagaaaagaaaagaaaagaaaagaaaagaaagaagaccctgaaaagaaaatgtagtcaggtgaataataatcattcatagagaatgtgtgtgagacagattatcagacttgaagatatatagtaggttctgttgaccctgagtgtccccagagaaaaaccaatttctccatgtggaccagctttatcagataatacatcctgaccaagagatagactttggtcacatgctacaggcattttataggccattgtagtttcctatgaggctttattattttcctaagacatgcaaccttcagcacttaaagaagatacctggttcttgtgctggtggtgaggttaatttttgatgtttcagtctgagggagaaagcattcagagatatctgattgggtcgagactgaaccaggctatcaggtggggaggaggggaattgaggatgtgatggaggatagaggggcaggtcaagagataaccagcagccaagaaagcacctatcctactatgactttattgatatgttaacaggtaccccaggtagccattcttcctgaatttctttgaatttttccaaggttcagcccagcatgctgtgcggtgatgatttcaggagtaggtattttaataagtggaaaacttactatggatttttttcttttctttcttttttttgttttttgttttttgtttattgtttttttttttgttttttttttttgagacagggtttctctgtgtaaccctggctgtcctggaactcactttgtagaccaggctggcctcgaactcagaaatctgcctgcctctgcctcccaagtgctgggattaaaggcgtgccaccgccaggcttttactatggattaagacaaaattagacaacatcttttgaataatcttgatcacttacttactggattgctgtctggaatctgggtcaaaataattttcttccagtcttccctcctcctcttctgtgttgctcagaaaaagactctgtatgtgtgttaactgtgtggctgactctcacatctttagggtaaactggaatactcggagaaaaataggtattctcatgatatcttctctttccttcatatttatccttttctccggcattgacgtctttcatttttgttccatgaacagttccatgttcattctaaactatattttctcattttcaggtctccatatgctcagtcaaatctccataactgtaaatcaacactaagagcactggatagttaaggtcaaggagactctcacaaaggatccaggtatgttagaggtattgaacaaggggtggagtggggctcacctgccagtacaaagaggacatgaatttgattttgccagattctatttccttaatgattctggaaaagaataatattagatgtgatgatatggatttaccatggaaggcagtgctgtcagctgtcacttgatgtcaatatttaattaattttgatcctgggaaattgctgctgcccattgaaatcaaagtttcttttatccagattgaaagcagcatcaggctatgggtgtgagaagggcaatttatacataaagcaaatatcatcagtagattccctcctagggcctgtgaccttccttaccggatttttaggcagattttcactgtaatctatggatttttttttcctgtggagcttgaaacagaaaacctgttacccacagatagtcttgccagtatcataaaaatttccatgccttgtctggcagattcagattgcagcaagcaggttgaaaacctgagtatatacattgataactctgcttcctgccccaatttccctagcagtttttgtcactatgaaagttcccaccagggtgtctaagatgtctgctgagagtgaatggtctgatatgaggtggttttctccagaagatctacttgctttctgaatctcctattctgttcactctaaatgtttccctgtccttgacctctgttcttattgatgctctgtgttgcattaatccccattagagtggaataattatttttgaccttctctgtactggttggtttagttttgagtctgtttgccttatttctgaggtatgtttcttctcttctatccttgagatcttttatactgagcagtgtctacttttaaccacagggctgtataagtaagtttcattctcctattgtcactgtaatttgggaggattcctgcctacatctattaacctaggcctagtcatgtaagcttctagtctccatacagtattatctaaggcctagtgtgttttcagcctctgaaatttgctgctgaataagctcccccattctctctctctctctctctctctttttctttctttctttttttgttttgtcgagacagggtttctcagtgtagccctggctgtcctggaactcactctgtagaccaggatggccttgaactcagatctatctgcctctgcctcccaagtgctgggattaaaggcgtgtgccaccaagcctggcaagctccccctttcttattccttctcaatgcttaactagctgattcaactcgttttttccagctcaaactcctctccgagctgagttcttctctcagacactgaattgttccacttggccttaaattaactgtagaaatcttttctcatcttctggctccttctctttctcctgctcattctgtctttacctgttcctagcatgttctctcttcagtctgattctgtaaaactctcagaactcacgtgcagtgtcctagtacatccagctctggtctagtctggcagcaacattgtggggaagctgtgcagagtaggtccagagaagttgtgtgaaaggcagcctgcaacagagttggaggagtggttcctgctggggagggtgggcttcatgcatgattagataagtttaagaaaaagacaaaataaaaacaaagaatcaaccaaccaatcaatgaattcagtatgcaagcaagcaaaaatccaaaacaataaaaattgctgtgaagaattgggaagctaattaattaaaaggtcctgaagtaggtgggcttagaagaattgcaggaagctgctgaatattcagaaggagggttcagaaagaggggctctgaggagccaggcagaaacgacaggaagttctaccttttcagcattctccttgtaccttggctgcctcctggtcaggaagtcctggagggagactagtgcctagtattttcagaacctgaaaacttccttaagctgcatttgctgtgctggcctcctaggacattcagcagctggtcctgtagccttccaggtcagaggagctgttgggctgggaaatgggcaggagcagggcaggcttgtggagcaggggtgcattttctgtcgctactctcacaattcttttttttttttttttttttaaagatttattttattattatatgtaagtacactgtagctgtcttcagacactccagaagagggagtcagatcttgttgaggatggttgtgagccaccatgtggttgctgggatttgaactttggacctttggaagagcagtcgggtgctcttacccactgagccatctcaccagccccctcacaattcttttgtggatatcttaccattgtcaggaagtttgagatcctgtgaattgggttcatggtgatgctttaatcaattttctggttgccagaatatttttctaaagtatccctgtagattcttggctgcatctggagtttgtataccgggaggtttgtctttgcaaaagtctttataaagctcctgtaattcaaattcgtccatgctttcttaactccctggttcctccaattgccatttcatttccctttctccagggaattgagtaggcatcctgagaaagctttgtagatatttgtcatatggcgattggtggagatttgattgaattagaaaatttacgttataaagcaccatcatatggctgtaaatattaacattaacctaacaaagttatagtctccgttagtttcacactgaggcatatgcactctttgatgtaaatacagcattcactgatgcttcttagtgaaaggtttcactaagaatattagatgtgatgatatggatttcccatggtaggcagtgatgtcagctgtcacttcatgtcaatatttaattaattttgatcctggaaattgctgttgcccattgaaatcaaagtttcttttacccagactgaaatcagcatcagttaatgtgtttgaaaaggaccatttacacatgaagcagatatcaatcctggattccctcccagggcctgtgaccttccttattggattttagtcagattctctgtttagtctatgtatgtttctcctgaggagccagcctcagcttgaacaggaaagccttttgttacccacagatagccttgccactatgatattagaggccatgccttgcctggcagattgagattgtagcacaaaggatacaaatctgggtatggccattgataactctgcctcctgccccagtttgcatagcagtttctggacactgaatgctaccaccagtgagtccgtccacaatatttgttgacagagtggatggtctgatctgagttgttcttctccagaagatgcacttgctctctgaatcacatctttggtccagtctacacgagtttaagtccttgaattgtgttcacactgatgcagttggttgaatttggccttattatattgtggacaccaacaagagcttgctgacaggaggctgatatagctgtctcctgagaggctctattagtgcctgacaaatacagaagtgggtgctcaccgtcatccattggacagtgcacagggtccccaatgaaagagctagagaaattacccaaagacctgatggggtttatagccccagagtaggaacaacaataggaactaaccagtatccctagagctcctggagactaaaccaccaaccaaagaaaacacatggtgggactcatggctctagctacatatgtagctgatgatggcctagtcggacatcaatgggaggagaggcccttggtcatgtgtaagttctatgccagagtaaaggggaacacctgggccaggaagccagagagggtgagttggttagcagggggagaggcaataagataggggatttttggagaggaaactaggaaagtggttaacatttgaaatgtaaatgaagaaaatatcaaataaaaaaatgaaaaaaaagggtggaataatgactttcctgccttttctggactgtttggtttagtttcaagtctctttccatttgttttctgaggtgtgtttcttctcttcttacattctagaaagcttttatagtgagtggtattagattttccacaggactgtaaaactaacctttattctccgattataattattgtctgggaggcttactgcctctgtctaattaccatggcctagtcctgtaagcctctagcctctaaataatcttatttagtcctagagtgttttcagcctctgaaatttcctgctgattaagttccccctttcttctttgttcatttcaaatcctttttttttttttttaattttatttttttggttttcccgacagggtttctctgtgtagagtcctggctgccctggaactcactctgaagaccagtttggcctcgaactcagaaaagtgctgggattaaaggcatgcaccaccactgcccagcctcatttcaactcttaactggatggttcaactcagctgttcaggctcaaactactctcccagctgacgcattcagcctggctctcagacactgaattgctctgcttggccttaaattaactgtagcaatctttttttaaatcttctggcttcttctctttctcctgctcattctgtctttgcccgtgcctagcatgttccctcttcaatctgactgtaaaactgtcccagtaaaactgtgtccttctccctctctgtggctctactctctcaagtatactgtactgctgcccatgcactctactgtattcctttaccattctcttcttcctgtactgtctttctctcccttaagtagcttccccttcctctctcacctcaggagtgttgggcacatcctgttctctaagaactttctctgatatttcacattttctccattcaattagacaacactttcaaacatgtgcacctccttctacttagtaaatgtactttcgttgtttgggattaaagcaaatcctaaaggcttgcttgtattcaaccacagtgaggaaagctgtgtgccttgtgctgaaccacaccctaagtcagaacaggcttgaatatccctacacaatagtttagtttggcagaatttcttcctgaactgaaaaccaagattcacaaataatagtcttcattatgtagatagctgtgctatctcttctgacttctaccaagagtttcattgtgaacttctttgatgattggtcaatgaaaatctgtcctttgcgagactgtattccttagcatttgcaatctataaggtttgcgggcattatgagtggcaaaaatatggttcataatgtctccattcattgtaggggaaagagctttactatgtaggacatgaggaatatttcctagtgttcttatattcattcattcttcacaaaaaaatgtcttctttccgaagttctcatgaaaattttatgtcttattcttttgtgtatatttccattagattattttctatgtaggtttttgagtaaaacagtgtctaaacttatatatacatacactgtgtgaaaatatatgttttacactgtcaatacttgtagccacttttctgaatttaacattacagttgccagttattttctcttagggcttgaaaaatatgattccatgcactcctgattttaagctattcataaatatttagtactactgtatgctaatatattatcacctcttttgatggtaagggctaggacaagacagctggaaagagataaacattgttacagcacttagatgtgacaataggcagatacagttgggagtacaggaatccaatttctgagagactttcctagggaatgctaggctagaatgctatggtgttctagtactcaagagtcccaatgttttcacagtgcatgttgctctttgagtttatctactttaaaatggatgtgatgaaacaagtgatagtaaactttgacaggaaggctcaagcctgtggaattgtgtctattcagaatcaggtgtgtatttaaggtaatgtcagttgcaagatttaaagtcgaagccctagtgttcatattgacttcatggtggaagaatgtaaacccatgggttattcttcccattctagaatgagctcttgttcagtctccatgaaatggaagatgtgcttttcctgttatacaattagataaaacaattgcaggacacacatttattttatgtatttcttacttttgaatttaaagtacaacatctgtcacttgagcaggaacttatggtctgttgctggtagaaatgacaacaatactcagcctgtatgtcacaggtaagaatgatgaagtgacatactttgaaaaatattctcattactccctgaaaattcatgtattcctatgcccattttttattacacacttgatgctgtctgtctacaaatgcccagggcatcaagtgatacatattgtaaatttatgacagcagtgtgtttttctgtgcatctccaatttctgttttacagaaattcctgttgtcagtaaattttccatcacatgaattagggattatactcatttcatgaatattacaattgttagaatattcacagagaaacattctggtagaggatttgcattatctagtttctttggtattgcagatattacggagttcctagagtttactctaatgtttgctctctaaatcccctagcgcttgcgttttcaggtgaatggccttcgcacatgaagtgtcccagagtgcttacacagttaccatctcttctatctctgtctcatcccttgttattcatgttttcatcctatccttgtgtttcatgtatgttctgaggaaggttttggatgggtatccatgctgtcatatattcataattccatgttccatggtaaatgacagcatgggtttccataactccacttcctccttcttttacagtgttgccttttccccactgctggctttttattcagctctctctgaattggcagtttcctttacaaaccatgtttctctgacttgggctgaaagcaccaacaatttaaatgtatttccatatttctacatatagcagtatgtcagttataaattcactttttcagcctgagcttccagtgccatgtctgtatttcctttgtaggctgaccttagttcaaaccagtaaagtttctgttacctacttgtcactactacacctgtcaacatacattgtcacacaggatggtattacagcacaagggtcatcatctagggagaaccattaaggacaccttacactcatcagcctacagagcccctttttagcagtttgtatgctaaaccagcatatccaagatccttttagacactgagtgctcttctcagttatcagattattctttaggaatgtataaaaccaaatcattttttttgtatttttcttgtattattctatagcgtgttgagtattttatcagattggattattctcttgggatacttgcaggtcttgagttgaagaattatgtttcttgtaatttgagaaaacttgttttcctcatatccttatttgaacattgaaaatattctaagtctttcttgctctttgtaagcactgctatactgtgataccttagtgtggaagctttgcacatccttgtctgtcttctgagtagagtagaatgatgacagctgtcttcagtttgtatagtaataggcttaggatgttggctattatcctcattagactcagtaatgttccttctgttccacattcttcagagctttcatagtgatccactgtgaaattttgccctaggcctttcatagatatattgacatatatctatcagtgagatttctcccactgattatacataatttatgccttgagttgtttggtttgtgcttgtcaaaacagttttgagtcactgtcatgaaatcaagttgagtttactttctgcatctattagagagaaacttttttaaagttaccctggtgcacccatactgttattattttctgtgtgcatgtttttgtggtcatttgcttttggacccaggtaaggtcagctttgtgtgatgactgtaccatattcccctattttctgtattatgcactgttttctgtgcaagttttttgtgggttttttcagaagaaatttgtgactttggtgcagcatttgattattcccgagaaagtgctagaaggtacactgagagtctgggtttctgcacttgattattcctggcctagtgtttattattcctaggaaatcaatatttccctttttcccattgtcaatctatacttctgaggctggggcattgaaagagatcattcatatacctgttaaatgccaagagaaatatttgacatgagataaatataaggtcaatgaaatacataaaaagcactgaatatttgctgatatcatggtcatgacattatttcttcagtaatagtatctccatgttcagaacgaattcttatgttttcatttatgcataaacatatgtatgtatttgtgtatatatgtttgtatgtgtattggtatgtatgccaggagaccattatcacatattctttcatgtgaacctacaagagtggtggccagagatgaaatctgtaacagctaggctctgatgaatgtcattgtattcatatttattactgattgggaacctgagaactgcctggaacaatgccacaatgcagatacatgcttgttgaggaagatgttccaactgtgattgtatttaacagatttgatataatgagggaatcattccaagggcattaccctcaaatgactcattttgtgtatgtgtatatatgtattctccctggcagccaccagtgagtttctatcatttctccttcttgattttgtatgtcaatatattttatgcaatatgctctcagcataaaatatattcatagtaacactactcataaaatcgcatatagaagttgtatacaagtcaagtgtcatttttacactaaagacacttaacttgattttttaaataaaatttctaaaattttctctgcaccccaacccatcccttctcaccgctccaagaggatgtccccatacctcaccattccaccaggcttccccaattcctggcacttcaagtctctggagggttaggtgtatcttttttcactgaagtcagaccaggcagtcatccactgtttatttgtcatggtcatcatgtcagctgctgtatgttgcctggttgttggtcccttttctgagagatcttggggggtccagttcagttgagactgctggcatattgatggggccaccctcctcctcagctgcttctggcttttccccaattcaaccacaggggtcattggcttccatccattgggtgggtgctagaatctgcatctgactcagttgcttgttagacttcttagagggcagccatgccaggctcctgtcacaccacagtatcagtgtcaaggccctgtgcctccccttccttgatctgaatcctaatttgggtctgtccatggacatcctttttctcatgttcttctcaagttttgtccctgcagttccttcaaataggaacaattctggatcaaagattatgcgtataggacagcaacatcacttgatacctgtccctccactggaggtagactctacaagttcccccttgcctctccctttgagtcctgggagtctctcacctcctaggtctttagaacctgtgagatggacctcgatagcctacatcctgaggctgtctatttccatttctttctactgggcctcagggcttcagtcccccccccccaatccctcacaatgactgatcatgtttccccttcctctctatgaccctgctcccactcaggtcctttcttccttttttcccccatgactgctttcttctctcacccaagtgggatcgatatgtcttcacttggaaccttgaggtttttaaccttctttagtcatttaggctgtattatatacttttttttttggctgatatccatttattagtgagtacacactatgcatgtcctttcgggtctgagttacctcacctaggatggaatttgctagttcagtccattagcctgcaaagctcatgatgtcattgttctcaagagatgaataatattccattgtgaaaatgaaccatatttctgtatcagttcgcccattgtggggtatctggtttgtttccagcctctggttatcacaaacaagacaactctgaacatagtgaaacactagcccctgtgtcatggtggggcatcttttgtgtatatgcccaagagtggtatagctgggatttcaggtatatctatttctaattttctgaggaagctccagattgatttccagaatgattgaccagttttcaattccacaagcaatggcggtgtggtcctctttgctgttacctgagtttttatcttagccattctgactggtggaaggtggaatcttagtgttttgatttatatttatatttgatttatatcactaaggactttgaacatttcttttgaagtttctcagccttccacagttgctccattatgaattctctgtttaggtatctaccccattttttgattgggttgtttggtttcttggtggttaacttcttgtgtcttttatatatattggatattagccctctatcaagtgtggggatagggaagaatttttttcccaatctgtaggttgccactttgtcctatttactatgtcctttgccttacaaaattttctagtttcttgaggtcccatttgtcaattcctgaccttagagcctgagccattggagttttatttttaggaaatttcccgctgtgacagcaactttgaggctgtttcccactttatcttctatttcctggattgtgtcttgttttatgttgaggtccttgatccacttcaacttgagctttgtgcaaggtgtcaaatgtggatctattttcatttttctacatgcagactgccagttagaccttcactggttattgaagatgttttcttttttctgtttttgagtgactcattttcatgcttgtaagccctcatgtacataattatgtgaaaatgtctttcacaaccagtgtcccactgccaaatttctcaaaatagctttctcacctcacttatgtgcaagtgtctttcctgactgtgctggcacttaccctagcactctaagaaggtagccttcatgctccatgaatcctgtcccaatatttattgatttatgtttccacaacagctaattgagaatcaaagatgtggctctccagttaagggcacttcttgcactatgcaggtccagaatatcttttaccattgtcttggtgctatagcttctgcatttctgaagtctacagagctacatgcagtcaaagatcatgttccctaaaaaattgaaataaataaactttatttaaaaagtaaaaatgatctggaagtgttgtgtaggacacaagaaacagtacaggaaagagagtgagaggaaatgtgaagcctggatatgttaaaggacagctgacccttcatatcaatattttaccaattaggaaggatccctatgtatgataaaactattttgtatccatggaacccagagctggagactcttatgggttcattgtaatgtgagaaaagaagatttatcctatcaatgctgtatttaggtattaacttttatgaggaggcaccgtaattctgaagaaatttataatacatgaaaatgctgttatccagcatcccatcaaccaagaaatctgccccagaaggaaaatgggttgtatcagattccaccattttcttaatgtaaggtataagcatgagactcagatcttaatcctcaccactgatgttcccacactataaaatagttcatggttattaaacgagaatcattcatgactaatataaattgggttatatgttacatgtttagggatggatgaaatttgaagagaagttgttgctcctgcaaaggaacaggattagactgttagcaccacatcacgttccataaccacctagacttccagtttgtgggaatctcacctcctcttctgatgtccactgagagaaagcatgcaagcatggcacactcatacacatacaggacgaacattcataaataagactaaacaaaataaaataaaatgaacaatttaatattaaaattgtctaaaagcagtctagaggaatagtatgacatgcttctgcatgtgtatgggaaggtctttccacaaggcatagggaattgaagaattgtttagcctaatcagttaagagtccatgtgttagctcataatggatctgcttgttggaagcttgtagagaaagcaggaagcagatctaagagaggatatagtcacagggacaagcttaaaagcatgttctttggtgctataaggtcctgaacactaatttctctctggcactcagtagctggattgtcctatacatccaacaatgatttagcattcacatgaagttataagcagatttttatgagctgaattgtaacattctaccttttaaatagcccgggtacgtttcaattgataaatcacctcacaccaagttttgcatgcaagtaaagcagaaacaagtccatcttgaaggaggagtaagttagaaagctacacttttcttctcaacagtgtgcattagacactgatatgaatggttataagtaaatatgatgacaagtttatcatattgaagaaatccatgtgtcttagtcagggtttctattcctgcacaaacatcatgaccaagaagcaagttagggaggaaagggtttattcggcttacacttccatactgctgttcatcaccaaaggaagtcaggactggaactcaaggaggtcagaaagcaggagctgatgcagaggccatggagggatgttctttaatggcttgcctcccctggcttgctcagcctgctctcttatagaacccaagacccccttgtgggtgggacccagagatggtcccacccacaaggggccattcccccttgatcactaattgagaaaatgccttacagttggatctcatggaagcatttcctcaaatgaagctcctttctctgtgataactccagctgtgtcaagttgacacaaaactagccagtacaattgaccccttgtcaacttgacacacaaaaacatcactagtaagcctcaacccttacaatcttattcatccccaaggtctaaataactttaaacatcccacagcctttacatattcttaaaatttcaatctctttaaaatatccatctcttttaaaatccaaagtctttttacaattaaaagtctcttaactgtgggctccattaaaatagtttcttccttcaagagggaaaatatcaggacacagtcacaatcaaaagcaaaaatcaatgtccaaccttccagtgtctgggatccaactcacaatcttctgggctcctccaagggcttgggtcacttctccagccatgccctttgtagtacacgcgtcgtcctctaggctccagatgcctgtactccactgctgctgctgctcttggtggtcatctcatggtactggcatctccaaaacactgcatgacccctttagtcctgggccttcaattgcaactgcggctgcaccttcaccaatggccttccatggcctctcacagagtcgagccttagctgctcttcgtgaccccttcatgccttcaaaaccagtaccacctgggtgacccttacatattaccaagtcccgctgcagcaggagtacaaccttggctatctctggaacacagcctctttgtgctttcagaaaacacttcccagaagatgtcacctcaatgatgctggatcactgctaatttcttagctccagctaaccagcatcaatagtcccactaatgccaagtttttgctttagtagttctggtatcttgttaatcacaactgattcttcagccccagctaaccaaaactacagaatcttcacaatcaaaacagcaatggccctgaaaagagtctttaattttccctctgaaatttcacaaaccagacctccatcttctgcactgttctcaacattatcttccaagctcctacacagcatctgacagagctcttaacaacaaatggatcttcaagcccaaagttccaaagtccttccacagtcctccccaaaacatggtcaggttgtcacaggaataccctactcctggtaccaacttctgtattagtcagggttctctagagtcacagaacttatggatagtctctagatagtaaaggaatttattgatgacttacagtcggcagcccaattcccaacaattgttcagtcgcagctgtgaatggaagtccaaggatctagcagttactcagtctcacacagcaagcaggcgaagtagcaagagttagactcccttcttccaatgtccttatattgtctctagcagaaggtgtagcccagattaaaggtgtgttccttaaactcggagattcaatcttctggaatccatagccactatggctcaagatctccaaaccaagatccagataaggatctccaagcctccagataagggtcactggtgagccttccaattctggattgtagttcattccaaatatagtcaagttgacaaccaggaatagccactacaccatgatatttgccatttagattgagccattgcctgaggtggttttctgtaaaaaagtacaacacacttaataaatacatgtactgtttctgcaggtcaaatgaaataaggtgaattctaaacatgttctatgaggtagaaatgctcccagcaattttcagacaggctttaagcattctgattgctatctctatgttgtatcatgtggtttatatcagtaagaattttctatagatattaatggcatactgtgctgaagactcctattcagaaacattaaggaatatcccatttaatgactttgctcttttattttggagttataaggctctcctactccatgtttttccccttcccgtagctatggttcatgtaggttgagattctgaagagcaatcatggtggacagatgcagagaagctgccttgggtgggaaagggtcctaaggagctaatgggagtggtggagaatgacttgttgttaatgatggatgcaagctgacagttctgtactctgtggagacaagtctctaaatagctctttgcatatgaaaactcctttgcataagctacttccttaggaattacaaatcattacaatcatttactccaggttctctcttgattattctgagtcagcattttaaaaccttagaacctttactcctagaaaaaacaacaatacaaaaacagaagtacatttgtttttgtttgtttgctttgttttgttcttaagcatagcagctcctatgtatgttgcttagatgcactttctgggcatagagattattttattattactcttttcttttctttctctttcttccttccttcctgtcttccttcctctcattttttccacactctagattttattgccctcctggtccatcctctaactattccacatcccacacttcctgcccacctctctgtctccataaggatgtcccctcctcctccccacctgaccagacctctaaacaccctggaacctccaatctctccaggggttagatgcatgctccctgattgaacccagacccagcattcttccactgcatatgtgctaggggcctcttatcagcaggtgcatgcttcctggttgatgatcgagtgtctgagaggtcttgggggttcaggttaattgagactgctggtcctcctacagggtgcccttcttcctcagcttcttccagttttcccctaactcaaccacaggggtcaggagcttctgtccatttgttgggtgcaaatatctgtatccagctgctcttgggtgtttcagaagacagtctttgtgattgctccatagcctcagtaataatgttaggcctaggggcctccccttgaaaggtgacagggttgggagggaatcataatctgatattgggtgggggaagaggactgaagccctaagggccagcagaaagaatggaaacaggcaactttgggcctgtttagcaactttgggatcctactttggacctgttattggaccttcttttcctcaggctcttctccatcactgtaattctttcagtcaaaattatggatcagaattttgactggggttgcaaccccatccctcactcaatgccctgtttctctgctggaggtggactccaaaagttctttctcgcccctgaagggcatttaatctagggtctctccttttgggtttcttgagtatctcacctcctctagtacattctggagggtcccccacctcctatttcccaaggttgcctgtttccatttattcttctggccctcagggcttcagccctcttcccccacccaatatcagattatgattccaaccctgtcacttttctctcccatgtcagtcccttcctccctcctcactttggctctttatcttgttgacctgtttgagttctgtgggctgtatcttgggtattctggactttttttcatgactaatatccacttattagtgaatatatgccatgcatgtacttttgggtctgaattacctcactcaggatgataatgtctagttccatccatttgcctaaaaaacttaggatgtcctcattcttaatagctgagtaatattccattgtgtaaatgaaccacagtttctgtatccatccttttgtcatgggacatatgggttgtttccagcttctggctatcacagataaggccactatgagtatagtggagcacatgcccctatgacatgttggggcatctttttggtatattcccaaggatggtattgccggggcatcagatctatttatttccaattttctgaggaaactccacattgatttctagagtggttgtacaggtttgcaatcccaccagcaatggaggagtgttcttctttctctgcatcctctccaacatgtgttgtcacctgaggttttgatcttagccattctgtttgctataaggtggaatctcagggtcattttgatttacatttcttttatcactaaggactttgaacatttttttaagtggttttcagccattggggtgtccttagttgtgaattctcagtttactcaccattttttcattgcgttgtttgggtttttttggtggttatcttcttaagttcttaatatattttggatattagccccctattgcatatggagttagtgatggttttttcccaatctgtaggttgttgatttgtcttattgactatgccatgtaccttaaagaagctttctagtcaggaggtcccatttatcaactcttttttttgttgttgttgtttttttttgtttgtttgttttgtttttgttttttcgagacagggtttctctgtatagccccggctgtcctggaactcacttttagacaaggctggccttgaactcagaaatccatctgtctctgcctcccaagtgctgggttaaaggcatacaccaccaccgcccggctcaattcttgatcttagaacatgagacatttgagttctgtttaggaaatatcccctggtgcctaatgagttcaaggctttttcccactttctcttcttttaggttgtgtgtatttgattttatgttcaggtccttgattaacttggacttgggctttgtgcaaggtgacaaatatgggtctatttccatttttctacatacagacaaccaaattagactagcatcatttattgaagatgcttccttttttccattgtatatttttggcttctttgtcaaaaatcacgtgtgtgtaagtgtgtggttttatttctgggtcttcgattccatttcattgatcaacttgtctgcctgtgtaccaataccatgctgtttttatcactatagctgtgaagacagaattagactgtgtttcctttcaggaatagcaaatgccatttacccctgagtcatctcttctttccagggatttacacttctggtacacttttatgatagagcctgaatataatcctgagttctgttttataaaaattgagtgaagaatcctaaatgatacttatatgtccaaccgctaaccatgttagatggatgagctcaaataattaagaaaagaacaggagggcccccagtggaggagctagagagtgtacccaaggagctaaaggggtctgcaaacctataggtggaacaacaatatgaactaaccagtacccctggagctcgtgtctctagctgcatatgtatcagaagatggcctagttggccatcattgggaagagaggccccttggtcttgcaaactttatatgccgcagtatgggggaacgccagggccaagaagtgggagtgaatgggtaggggagtggggggctctcagggacttttggcatagcatttgaaatttaaattaagaaaatttgaaatgtaaattaagaaaatacctaatttaaaacaataaaataaaataaaaaaagaaaagaataggaatgaagtaaaagaaccttagatgattccttttttgtgtaatctgtaatcatgttagatcaatgacctcaaataataaagagaagaacattgctgaagtcaaaagtttcatatttttagttgtggcagtaatagacacatgagtaataatgtatccataaaaaatgaagtgttagtatgattcttatacatcttaatatggttatttccattataaaaatcattttactttatcacttttttcacatatgtcatttagttatacatgtatgtctaagcattctgaagggaaaccactgtgtaatttatgaaattattatctgtattgattttgtcatatagtcacaaacattacattatattaatgctacctattgctaactttttatttttatcattaaatattctcaaattaattcttcattaaataatcatttaactcttcttcatataaaattcttataaaatcatatcacaaggtatttgattgtatgtcttatttgtaattttgtttgtatacactgactttacacttcctaactgctacaatagaaagaaacgtatttcttttaagtcattcttgtatttggtgttctaactctctttcttctagaaaggatgctctattgtatataggtcttataatccaaactgagcatcttagactagctgttgacacccaacttcagataagagagatacagggttcctatctgagcaaaaatgacagttgtagaatttggaagcacagttttactcaccatcactttactatctgtaaactagatgtaacactggcattgttctttttatcaaaaaatgttcataaacgtatattcctggatgtagacctcatatatatacattacaatgtctaaattatgctgtgagtctgagtccattaactcatctaccttttactgagagaagacaacacaattatgactatgataattttagatgataccatttcttaaaacggcctcatagttctcatgacctaacatacttcctgttcttgattaggtttcagaatatgacatgaattctctctctgaaaggtaaccttaaatccaatcagaatatgttttactgtaattggtttttgtctgctgctttcataaagcaccatgttcaaggaaactaatagaagaaaaagactactttgggtaatgcttccagaggatagccatcaaccatgacagggaggacagatagaacattgccatgttgttgaagtagaaaggtgaaagatcacatcttcaaccccagtcactaaagaggaagaaagaattaagatggcttggatctatctattctttcttctcatagccaacccccatgtcatacttaattcagtaatgttccaacagctaaattcctcaaacgattgtgacccactgaggacccaactttaaaagataaaagtattatccaataggagaatcagccttctaatatccttgtactttttaaattgattttgatatcaatgtagaagacaaaactctaattttttgtatgggtttcctgtttgtttgtttgtaaaacagggtcccacactctatttctaactttcacatgtcctgatatagagaccagaatggcttttaggtcacatccctgacagctaggatgaaagacctttcgttgacgagctgattttttgtttgtttgtttgaatggtgtatcttcacatattggccattgagttaccaccaggcttacagaatttatttcagagtgagcattccttagatttttatatctctggataagatgttcacatcctgcacatgtataattattctcttacccacttgtaggaattctctggaatttcattaagtttgtttctgccttctttgaattcctgtgcttgttccctctttatgacatttgtccacattgaatggtgttcatattatattttgagtttgtttcataattcattttgtcatgagaattggtattgcattagtgatttggggtagggaaattttattaacattttcaaattgctttagctacagcctctcaattttcttttgctgtgtgtcatttaggtcaggtgacagggatttccatatgaggtgttgtgaaataactttgagaatctagggtggtgggaggaactaggttacacttacagtctaaatatatcattacttactttcatgactgcacattgtcaagattcctggtatcattttgcttttaatgtttatatatataaatgttgtttgccattgtctgtaatggtgttgtatttatttcatctctgaatcattcagaccttgatgtgaaatttcaagaagaattcaaactttgctcttcacagagaccctgggagaaggaaaacaacaagaatgagtgtgtctctggtaaatacaccacaggtcagtgtcctttccacatttctttttaaaaaaatctctttttattcaagtcatccaaaactttttatctctatatgtttaatggtatctaaagggcttattttctatgatctatatcttttgtaataatgagaatttaatgtttttccctttcatgcatataatggctttatagtttaacttgatttttatattgtgaggatatataattcccttggaatagagacctgcatgtctcaaataggatctattagaatgatgctcaaagaatagattgatggacattttctatgttgaataagttctgtccttttgtattagtgtaaagtaaggtctcttgtgccacataaattgcatttcagggatggtcatgtttctaaacacaagcttgtgaatgagggtatagaaataagtataaattcatatcactaaagaacatatataaaagagtataatttgtagaaggtaaaagtataagagatccactgtcttgaatcctgatagtaactatattattagctcctagggtcacagataatggaaggaaaatgtctttcttttaccattagtgtaattgtgagctgatacagatttcagtattctgacaacatttttttcacacctcataacacacagtaatcactgttgacacctgaaatctatttatctcaagagagacactgtccctgtggaaaattcacaatatatagatatttttccctccttttggtttcagaaataattttaagtcctgttttcttcacctttgtatttcatcacatgaactatattagtaaaatttttctagagaggatagctatggtgttgtgcatataccatcaattttcgaaaataaatgaatgtcctttcttatttttttgtctcttttccttagaagggaaaggcttgaatcagtctatgctaatcctcttcagtcaagctgtgcattacatagggaaaactgaagggttgtggcaatgtttctatttttcattacgatactattttctttacgtacataagtgtatatctgaaggtttttacgtacactgaatgatacattatgcccctaaaaccatgagtacagcaccaaaccctgggactgaattcagacataatagtgagctccaatatatttagagagaattagattagtttttaaagtagaaacagcaagtacctttaccctttaatcatttgttcatggagcaggtttacattttttgaggcatatttgcaataaagacagtatatagtctgtatattataatttttgataaacaaaggaagaatgatagatcacacttctctatgaaaagtgcaattgtgatatacatatggtcaaattctgaagaaaaaagttaaaattagaatactgaaattttcagttaggttaatacaatgaggaataatttattagattttaatgaatatttagtataattctccctcaatttaaaaacacagtttgatcaaaaattattatacttcattggaatgcattgccacatatgatatttgcttaaacatacatagctaatcattttatagtgaaagaccatatggtattagagaaattgttattaagcatatttatttatgtctccacaggagctaattaagagtcaaagatgtggctctgcagttaagctctcttcttcttgcagtattcagattcagttttctgtacctgcctggggacttcttttccttccagaactcttttttttcgagaatatcttttaccattgcctgcgtttctcatgtgcacagagctacatgccagcaaaagtaacattccatatgaaattaaagtcaataaacattatttaaaaattatctggaaatattacacaggacacaagaaaccatccaggaaagagaatgagaggaattgtgaagcctgaatgagtttcaggacagcctacccctcataacaacattttaacaattaggaatgattcctatgtatgataaaaatgtgttgtattcgtggaacccagagctggagactcttatgtgttcattgtaatgtaggaaaatatttatcccatcaatgctgtatttttgtgtcaacttttatgaggaggcaccgtaattgtgaaggaatttatgatacagaaatacgttgttatccagcatcccatcaaccaagaaatctgctccagaaggaaagtgaattgtatcagattccaccatttttttaatattttatttatttattatatgtaagtgcactgtagctgtcttcagaaactccagaagaaggcatcagatttcgttatggatggttgtgagccaccatgtggttaaataattttaaagctctcaaaaactgtttatttctattttatggttttgaatacattctcattaataatttccaaaagcatttgattttctgtgtcatatggaatgttcagtgtatgatgccctgatgttgcagttctaatgtgtttaaagaaaaaacttagtcatttagtccatccattatttctgcatttagtattctaccagtttcttctagaatgtgtgtagcattgaacttaggcctcagattgtcaaatggacatgttgtaatacaaatgtgagacacagctgcacataagactaagctagtgtccatacttgaacaaagtggacattgtaaaatttgaaagcatattttttatcataactttactatctttaatgggtcagtgggattctgtttgatatcaacccatatttcataaaggtacattactgcatctagacatcaaaagtacatgttatattccataaatgtttactgcttttgaaattacatcatgcattctcagtgaaaaagaaatataaggaagtctattagtagtttagaaagtttctttgaataaagtcaaagttcatttttcttcaatatatgttgcttacatttgcctgaatgtatgcctatgtgctatgtattcttttccttttttattttttttttatttagagagcctttctaaacgtgagcattatagtaagtcattctatagattgacagtggaagagcagcaattcgtatcttcagaaacatctcaatcacactttcagaaaacatttatccttcaatattttccttcctcatttgcatcaaaaaggatatctttttgttgttgttcttgtttgttgttgttcttgttgttgttttcaagacaggatttctctgtgcagccctggctgtcctatcctggaactcactctgtagaccaggcctggaactcagaaatctgcctgcctctgcctcccaagtgctgggattaaaggcattcgccaccacgcccagcaaaaaaggatatcttaattacttccttttttaaagtagaaaattatttttgtccagtatcaagtaggtagttttccattccagggtctgttaaccttcaaggatgtggccttgtacttctcactggaggaatgggaatgtctcagttttgctcagaggacactgtacatggatgtaatgttggagaattacaaaaatcttttgttcgtgggcaagaatgaacttcttgttgaattcctgtttctttctttcagttttcctactatatgtttatgtaaattctctgagatatccagagacccctgaatgagggaaattctagttaaaatcataacttgttcattgtgtttccattacatttctctgctttctttggaaaagtaaccagtgctatattctctgagatcactccttatctcttatctagcttcagtgaagttaaaaaaagttcaagtaaaaatttaaatatccagaacaagaaattacatttctatacatataatagttggaattgtaaaaatcttactattgctttaaaatgttcccttatttatgaatctaaaaatatacaaggtttcaagtggatatagagctgttggtttgggcaattttttttatttaactttttgacatttgatctctgtgtttagatctgggacaacataatcattatcctagcattttagatgttgaaacaaatctatttagtgatttccctgacactatcggctatatcataaatttatacctgaccaaatttatacctgattcagtgtcactctgaatcgaactgtaaccatagaattagagatctattgtttagagttctactttcgggaaattcactacagatgggtcctttatttgtcccagcttatgcaaagtacaattttgttttttatttattggtcttttatttatctacatgtcaaatgttatgccccttctgtttcctgtctggaaactctatatcccacccctccccctggcttttatgatgatgctcccaccacagatccacctactcccacctcatgcccctaggattctcctatgctgggatactgaaccttcacagtaccaagggactcccctcctgttgatgccacataaggcaatcctctgctatatataaagctggagccatttgtacttccatgtatactctttgtttggtgatttgatccttgagaactttgtgggtcttgatattgtttttcctcctacacagttgcaaagcccttcagcttcttcaggccttcccttaactccttcattgtggtccccttgctcagtccaatggttggctgcaaggatctggatctctttggtccagtctctggatggccttcccttcagcctcttttccattctttgtccctctttttcttaagacaggagcaattctgggttaatatatttgaggtgggtatgatgtctaatttgaaaataaaatttagcaggctattatcattttcaatcacttgatatagatatagatcatatttgaggttctttgaggatacatgtaataattccaaaaaaaaaggagagagagagagaaacctctcttgagagtatgaatccataagctcactggttattgagtcccttattcgttttataagtaattcatgtcacctctaattgccccattttgtttttgtttttgtttttttcagaaaatcattgcatacgtggaaagtataggaaggtcttggatcaagacagccagtacattgtccatgaacacatgaatattcaagagaagtcttctaaatgggacaagcttagcaaggtgattcttgaatccccccaatgtacaccttacaaaacttatcacggctctcttcaatactcgaacaaaaaaagacttaagcccaggaacacaaagaagtttgcaaatacaatgactctgtaaacagtgtaagtttgttttctaccattagtctcaatcaaggaatccacatgcagaagaaaaaacacaactgaaatgcagaatttgcgaatgtttttgtttctaaacataaagtcatggtgaaacggaacaatactggagtgaacccttacaaatgtagtgaatttcacaaatatcttacccagagagaaaaacttcaaagtcagcagagaatttatcatggaaagaaatcttacagaagtagtaaaagtgacaaatgctttacccatcagatccatcttagtatccatcagggaattcatgcagaagagaaaatttacaaatgtagtgaatgtgacaaatgctttacccaaaaatccaatcttaatattcatcagagaattcatacaggagagaaaccttataaatgcagtgaatgtgacaaatgctttactgaaaaaagcagtctgagaattcatcagagaattcatacaggagagaatccttacaaatgcagtgaatgtgacaaatgctttacccgaaaattccatcttagtattcatcagaaaatccatacaggagagaaaccttacaaatagtttacatgtgacaaatacaatactcaccatgtcagtctgagaaatcatcagttacttcatatagtagagaatctttataaatgaatgaacgagacaatcctttaccaaaatatatcatcttataattcattagagaatacttagagaagacaaacttcaaatatattgtaggtatgaatcctttacttttggcctatttcctagaatataacagtgaatatacttacaggctagaaacttaactcatgcattgtatgaagaaatatctttgacttcatttcaggtcagagaaaacatctaagaactttttaagggatagtatttctgttgggaaaaatgtggcatatgttttattcaaggtgtattcttgacaacacttgaggctccactctagagaattagtatgattatgaaaatcttgtgaaaattttcatgcaatgttcaaatcttgggtaatgtcaactatttatgctggatgaactctgtacatgtgaaaatgtagaaagcctttcatgacaacttttacttgttcaccctcaaatgttacaacatgaagaaaagtggggaagtcagaagatagtattgcataacacactgagaaagaaataatccatttcaaagaaaatttattaaggtctttaatacaatcctcacaatatctaataaaactggtaacattctgtatatttaattcacatgaactaattcagaaaaatgatacttaaaagagtatctggcaaactgagccacccagacagcatattctttatcctataagtatgcttacagatgttaagtgtgcttcgagtatccagaaatcataattcttctcaattgcttgtttcacattataggataacaactgagtatgagtctcttgtgatctggtcaaccactcctttcctattgtcctgtaactaactccaataaagctgaaagtttcaacaagtttgctttggttgttttcaatttgcacttgggatactgagatgaatatatgttgcatcttcccaggaaatgcctcacataaaaaaatacgcggaagtcataaatatttttgcaaggctgtatcataaagttaatagttattttcaagtgatagataacaatccctttggggtgtaaagaccctttcacagtggttgcttaaaagcataggaaaacacatatttccaattgtcttaaaactgagaaatcattcattgagctgcagggtagtctgctcacctaagaataatttgaattctatatcagtgtttagcattacaaaagttagaaacactgtattagatatggtgatttgtgttaattaaaatagggaagattcagctcagtgttccaggctagtattactaggttaagataaaaaggctcaagaaagcaaatatgtagaagctttcagagcctcagcagtaagtcagctctctcttgaattcaaggaaacatgagagaaaaatttagaaaaataaatgaaaacatggtttcatagatttcaaggatagctagccagactttgctgcgtctctgcatggttctgaagtcattaatacccatttattgaacaaaagtcttaaactctcagaaaaatgctgcccattgacacatattacaaagcattttggtgtcttgtcctgttgttacttaatactccactctaccataagtaatgaaatagatttccattcttttttaaatcatctacagaatgttaatattttgcacatctcagaatatacattctgaacaaaacctcaacaactcactattagggtattatcttcatcttaatttcatgtatgagttcattcatataaatatcatgaatctgtaaatcttagagaaaaatcctttttagagtagatgaggtgcatactcatgcacagtttagaaatccaaccatcctggaaatacatttgtaagtactgagaaaattacttttactccaagttcaagtatattagaatatttatcctaaattcaggaagtctcagaaaattaggatctaagaaaaaacattaaatgctacaatgaacaaatccatatcactccatgtattttccttgattaaaaaaaaaaaaccacggaaattgttcaacttgagtagaagtactgaatgataacaattcattggtctcaatactggaatttgatgaaacaggacttcctcattagtagaatctaagtatgagtagaagcagtagtggcccttgatttcaaataatcctaggtagtttctgccaattgcttcatcagggatgttgaaactcacacaccaggcaaatgaaaattagggggcttgagtagctcttatcagtctggaaattgcaaccagttagacagtctctcttgattctcattgcacatgatcagtggatttatgcctcacttcttaatgacttagagatcattaaccaaatctgaagtgacttccaggttcatgtaaaaatttctagaagtgcaaaaaacatttttgcacacattccttgtctgtggtacagcaagcatatggtgatggttgacaaaataggtccaggtagactgactgagttttgtggaaggcaacatgtgtagattgagaaagatgcaagtcattggctcaggaaaattaccatatcatgtttgaaaaacatggagactgaagatcagtggatttggaacattaactatttgtggaatagcattttaagatacaaagtaagagccacactataggagcctgatgggcatttctggaagaacttccagtggctagattttaaggaacccactaggtctatatcaataccttgcagggaaaggaaacttctcttcagctgcaggacaactgatgggacagcctggggatgggaaacatatggagcaggtggaaagttattccttggttgaaattgattttgttacaggagaactcagaagagggactgagggcctgaaggaagagagtgggatcagcagcccatccttgtcagtaggagtctggagctgcatggtgtggaactaggagtagagaacactgccttgggtcttacaaccatgtaaaaattcccttcctctgcagttgtccccaattttcagtcaccagagcagtggcaggaaatgcaaacaagaagacttggaaactccaaggtcacagaagctattaggctagtggacagacaggcactggaccaagattgaaatcccttactctgctgctcataataacactgatcctcaaattctattgtgcattttgtaactgtgtttttaaattgctgactatgtaaatgtgactaatcctgattttttttattcatcttattgttgcttgatacttacataattacataataatttctgataggatggtcttgtcggttccaaacatggttatatttttctggtggcaggtaaagctggtacaattcacatccatccatggtttttaacgctgctatttaatcactgtgctagtcaagatctttgccattggagattatacatccactggaaggtttaaatattagtcccataaggatccctggagttttcattgaatcttaagcatattttagcaatttttaagttagctgtctttagatttatcattatataaataattatttattttattttatttttttccaatttttattaggtagtccccccttcccccccccgctcccctatctacacactcccacttcttgatcctggtgttacgctgtactggggtatataaagtttgcaagaccaaggggcctctcttctcaatggtggccaactaggccatcttctgatacatatgcagctagagacaggagttctggggatagtgcttagttcatgttgttgttccacctatagggttgcagaccccttcagctccttgggtactttctctagctcctacgttgggagccctgtgtgccatccagtagctgactgtgagcatccacttctgtgtttgccaggcaccggcatagcctcacaggagagagctatatcaggttcctttcagcaaaatcttgctggtgtatagaatagtttctgtgtttggtggctgattatgggatggatccccaggtgcggcagtctcttgatggtccattctttcatctcagctccaaactttgtctctgtatctccttccatgggtgttttgttcccaattccaagaagggaagaagtgtctacactttggtcttcgttcttgaggttcatgtgttttgcaaattgtatcttggatattctaagtttctgggctaatatccacttatcagtgagtacatatcatgttagttcttttgtgattgggttacctcactaaagatgataccctccagatacatccattagcctaggaatttcataaattcattgtttttgatagctgagtagtactccattgtgtaaaagtaccacattttctgtatccattcctctgttgagggacatctgggctctttccagcttctgactattataagtaaggctgctatgaacatagtggagcatgtgtccttattaccagttagaacatcttctggatttatatatgcccaggagtggtattgctggatcctccggtagtaccatgtccacttttctggggaacctctagactgatttccagaatggttgtacaagcttgcaatcccaccaacaatggaggagtgtcctctttctccacatcctcatcagcatctgctgtcacctgaatttttgatcctacccattctgactggtgtgaggtagaatctcagggttgttttgtttttttgtttttgttttgtttttcgagacaggctttctctgtagccctggctctcctggaactcactctgtagaccaggctggccttgaactcagaaatctgcctgcctctgcctcccaagtgctgggattaaaggcgtgtgccaccactcagggatgctcagggtcatttgatttgcattccgctgatgattaagaaaggtgagcattgttttaggtgattctcagccatttgatattcctcagttgagaattttttgtttagctctgtgccgcatattttaatgaggttatttgattttctgtagtccaccttcctgagttctttatatatattggatattagtcccctatctgaattatggttggtaaagatcctttcccagtctgttggtggcctttttgtcttattgacagtgtcttttgtcttacagaagctttgcaattttacgaggtcccgtttgtcaattcttgatcttacagcacaagccattgctgttcaattcaggaatttttcccctgtgctcatatttttgaggctttttctaaacataataaaagcaatctacagcaaaccagtaaccaacatcaaagtaaatggagagaagctggaagcaatcccactaaaatcagggactagacaaggctgcccacttctccctatctattcaatatagtacttgatgtcccattcagagcagttagacaacaaaaggaggtcaaggggatacaaattgggaaggaagatgtcaaagtatcactatttacagatgatatgatagtatatataagtgaccctaaaaattccaccagagaattccagaccttataaaccgcttcagtgaagtagctggatataaaattaactcaaacaaatcaatggcctttctctacacaaaggataaacaggctgagatggaaattagggaaaaaacacccttctcaatagtcacaaataatataaaataccttggtgtgactcttaactaaggaagtgaaagatctgtatgatcagaacttcaagtttattaagaaagaaaccaaagaagatctcagaagatggaaagatctcccatgcttatggattggcaggatcaatatagtaaaaatggctgtcatgctgaaagcaatcagagtcaatgcaatccccagcaaaattccaactcaactactcaaaatatcaacttcaacgaattaggaaagacattctgcaaattcatctggaataacaaaaaacctagcatagcaaaaactcttctaaatgataaaagaatctctgatggaatcaccatgcctgacctaaagatgtagtacagagcaattgtgataaaaactgcaaggtactggtatagcgactgacaggtagaccaatggaatagaattgaagacccagaaatgaacccacacaccaatggtcacttgacctttgacaagggagctaaaaccatccagtggaaaaaaagacggcattttcaacaaatggtgctggcacaactggcggttaacatgtagaagaatgcgaattgatccattcctatctccttgtactaaggtcaaatctaagtggatcaaggaactccacataaaaccatagacagtgaaacttatagaggagaaagtggggaaaagcctcgaagatatgggcacaggagaaaaattcctgaatagaacagcaatggcttgtgctgtaagttcgagaattgacaaaaggaaaaaaagacagcattttcaacaaatggtgctggcacaactggccattaacatgtagaagaatgtgaattaatccattcttatctccttgtactaaggtcaagtgtatgtggatcaaggaactccacataaaacaggagacactgaaacttatagaggagaaagtggggaaaagcctcgaagatataaacatttattaagcagtgaaacactctgtattaagtttgtacctgaaatgtatgaactgtctgatataaatataaatatccccttgatctcttttagttgccttattgcttgagctagaacgtctgatactgtacgaaagagacttgaggacagtcgacagccttttcttgtgatagagaattctttcttgaaaactttgctgttaaaatggtggttttttaaaatgaaattcccaagcccatagtacacttcctatcaataactggtcaatttcattattaccctgtgccagagagcctggcaaacctgtatgtgttcttatatgtcttatatatagtcaattactcttatttctgattatttattgtagttgaataaatagtgaagtcaattcagaatcatcctaagtaagatcaacagtctctatgtgtaaaacaaacgtttctgtatactgacagttagttactatgttaagacacttgaaaatctgagaacaccatgagtattgcacgtaattaagatttttgaactgatttctagggactgccagccaccttacttaaatcttctgcctttcctgattttttagcctcagtgtaaaatggagcggctccagatattggaattccctttagtgtatgagggaaaatccaagtagtccattttatgaactgaagccacttgtttttagggtatctgttgttaataactccaagaaattactgcatgctttttaccaaagttcatgttgtgtccatagtgagtcaatctctgcattaataaatggtaccacgatttcagctggatccattccaactaatttttgaagtctctctcttttttttaataacaattcagagaccatctctatgtaggcttttaatttcttaccctgtttatgtgcttaaaaatatccattctaatatataatcttccatctgcatgagcattcctgtatgggaatgagtacaaggtaagataactaagatgcagggcattttggaacaatatgaactagttgtgtatcctgcatttacctttcttccagagctaagtccttctcagtcttggctggtaatttccttgggctatttatatctttatcaccttgtaaggtttgaaataaattgcttagcacttgattggccaagccaattgtaggccacagccagttagtatctcccaataatttctgaaaatcattgagagtcctcaaatggtctttcctgatttgcaccttttgtgacctatccttttgcagacttattttaggtaataaacaattaatagaagccactcgttatatttttttcaggggtgatttgcaatcttcagcaaggcaagttgttttgttgttgttgttgttgttttttggtttttttttcatcaaacattctttccatgatatttaaatctgaattagcaaatagaatgtcatctatataatgacagataatggattgggggaaattgtgaatcatctctaatggttgttgtactaaatattgaccatggccgagaccgaggagcggagcctggacaacttcttcaccaagagggacaagaagaagaaggaatggagcagtcgggctgccaatgcggcgagcagcacggacgggagcagcgcgtcagcggtctccaagccgggtgatggcgagagctcgggctctggtgctaggtcaggagacagcaggagcgcgggccctgctggcaaggatataatgaaggatgaaaatgagtggaaagaatttgagcaaagagaggttgattacagcggattaagagttcaggcaatgcaaataagtgaaaaggaagaagatgataatgagaagagagaagatccatctctctttggaagaaggtggaggtggcaatggagcagaaaaatcttcaggtccctggaataaaaccattccggtacaggcgcttcctggctccagtaacagttacagaaaccccggagccagcaatgcccagtggtgtatttaggcctcctggggcaaggctaaccacaacaaggaaaacaccacaaggaccaccagaaataaacagtgacacacagttcccatccctgcactccactgccaagcatgtagagagccggaaggataaagaaatggagaagagctttgaagtaataagacacaaaaatagagacagggaggatgtttcaaaaaaccaggcccttaaacttcagctagaccaccagtatgctgtgcttgagaatcagaagtacagccacacacagtataggtaaggaatggtctttgctaagcctaccaaggtaattagaccacagctaaccaccaagaacagccagtcatcgttttgatttctggatctacagtgactgactgaagacctcaagtccagtgactgtccctgttgcactatggaagttcaagagtcacgactgatcttgatgtgtgttggatttaggggtgtttcattgtcttaagtatttgtgaattagattcaacagtgtttccatagttgctctgcgtataaagccaaacctgcagccagtggtcattcaaacatctttatgttcagatactgagccttcacaaggttgactacctcagacttgctgtccttagttgtgaatttcatgtggatcacatcttctatataaggttacagctactagtgtctgtgtgaaccttgaaaccaactctacaggattcctgtcagaaagccttcagaagtcagccatctgtgtcctgatctgctgtaaaagatgaagaggtaagtgaccttaattaacctgttctgtgccccatcctaaggcatactctgtaggctgtggctatgttagactccctggatcaagctgctgtctgaaatgatgtgtttgtgtggagagccgtgccgcgagcaatcgcgtgcctgccgtgagcaatcgccattataagatgtcgctggcttccactgcgcctaactagtaaataagccttatgcgcaagtgcaagagtgaactcacgcctagtcactgtccatctcgctgcgtagtaatggggtgatgggcgaacaacgaatcaggagctgtcacgccacatcaggtgctgaaacgtcacactgcaggctatagaagcagcgccattttcccggttcggggtcttccctcctgataagtaagcaataaaagctttgccgcagaagattccagttgtcctgagtgtgttcttgccggcggggacaaaagctcgggataagtggcgctgagaagcccaggaactaccatcacaccggtgcaagggagatccctcgttcgtgaggcggaaccagaactgcgggacaaattacagctttatgaggtatgtctagccttgaactttctccagtgttagaagcctttttgttccttttcacatgtcaaaaagtggttaaggcagggcagagaattctggatgaaattcaagacagtctaccagaggtaaagcggggagagagagtaggagcaaagaggaaacatggtgcaccaattaagcatacaggcctttccacgggtcttgaacctgatgaaaagttaatgtcagggaagaatacctggggagagattggaaggaaggagaaggaaaaaagaaaagaaaaaaagatcaatcagcagaggtttctaggagaaggaacttatacccgccactagatgagtttaagcagctagctcttagtagctcagaatcagatgaaggacttagctcctctgaagaaacggacttggaggaggaagcagttcgttataagggagaaaggtaccagcaagataaaaagcgagctactcagtccagaaaaaggcaaaaagtggctggtgaaagccagcttgctgctcagccttcagacagtcggcttcagggtcctagtgcacctcagtcctatgtgcagaggcaccattcagaaccttatgtgcagaggtaccattcagagccttatgtgcagaggtatcattcagattcattcattccaaaagaggaacagagaaaagtgcagcaagcattcccagtttttgaaggagctgagggagggtgtgttcacgctccagtagagtatatacagattaaggagctcgcagaagcagttcgcaattatggagtcagcgctaatttcactatagcacaagtcgaaaggcttgtgaatcacgctatgactccctcctggtgattggcagactgtagtaaaagctgcagcccccagtatggaaatgtatcttgagtggaaagccttgtggcaggactcctgccagatgcaggcaagggccaatgccaccaggaaggggaccaaagaacgtggatgtttgaattgctttaggtcagggacagcatgctgctaaccaaacagattatcattggggagcgtacgcccaagtctcagctgctgctgttaaggcatggaaggcactaagaagggagaggcaagtcggcatttgaccaagattacccagggtgcacagaagtcattctcagattttgtgcccagaatgaaggaggcagcagggaggatatttggtgatccagaagcagctatgcctttaattgaacaattggtttatgaacaagctacacaggaatgcagatcagcaattacacctagaaagagcaagtggttacaggactggttaaaggtttgccatgagcttggatggccgcttactaatgctggattggcagcagccattctgcaggggaggaggcgctcagattcaactgagctcaaactttgctttaattgtggcaaaccaggacatttaaaaaaggactgcagagcccctataaaaaggtcagcaccaggattgtgtactaaatgtggaaaaggatatcattgggcttaggactgtcgttcagttaagatatacgaggcaggctcttgcagcctacaaggtcttattgttcaccctggagttgtagatcaggattataaaggggaacttcaggttctctgttcttgtcctcaaggtgtcttttctatatcacaaggggacagaatagctcaactaataattttgccaagcctacttggctgttttccttcctctggtattcctcgagctgccagagggattggttctactggaaatgattctgcttacttaataatgcctttagattccaggccatccttggagttagttatagaagggaaacaatttaagggaattttagatacaggagcagacaaaagtattatttcttctcactggtggcccaaaacctggcccgtaactcagtcatcacactctttacaagggctaggctatcagtcctgctccactattggctcccgttctttgagctggcaaatggatgtcacacatatttcctcctttgggaaaaatcaatatttacatgtttgctaatctgtctaggcagatttctttgtatcttgcaggaaattggtctgaaagattcgatgagacccttgaggccctgagagcggctgttctcaggatcaactcgacacgagtcgacctgtcattgacatagggtctctcctcctggatttcatctgctttttcttattttaaggaatgggtgggggtggttttatttgctgctgccatctgctgtggacttgtgtttatgctctggttggtttgtaagctcagaacccaacaaaaccgtgacaaggtcgttatcgctcaagcacttgcagccattgaacaaggggcctcccctgaaatttgcctgtccatgcttaagacctaaatggcatctgagttctctgctattgtgtcccacggatttgtggatacattgcactgggatataagagactcaacgctcattgatcagcacttacacctcgctgaggtttactaattagttttttggctggcctcttttatagagttccctaggtcatttagcagttactgtcacacagtactgcggtatccagagacgggcaactttcctcatgcacagaccaacctaagacacgggacccggtggcgatagggttaccctatgacaggaaaggctgtgacattggaggaatgacctaagacaggagccacagcagatggacatgactgcagaggcctagaccagcctcaaattttaataaaataaaaagggggagatgtggagagccgtgctgcgagcaaatgcgtgcgtgccgtgagcaatcgccattataagatggcgctggcttccactgcgcctaactagtaaataagccttatgcgcaagtgcaagagtgaactcacgcctagtcaatgcccatctcgcggcgtagtaatgggatgatgggcaagcaacgaatcaggagctgtcatgccacatcaggtgctgaaatgtcacgctgcgggctatataagcaacgccattttcccggttcgggatcttccctcctgataagtaagcaataaaagctttgccgcagaagattccggttgtcctgagtgtgttcttgccggcggggacaatatgtttggatcatctgtgtggggcttatgatttataatttaagtttttagttgtatgagttaactgtggatttaattcaaccaaactcggttccaccaaatgggggatagtcttgtttctttgaataatttttcattcagatagtgcttgttcgattccacattaaggccttgctttgacttggagtaagttctttaagggcatattgtgtggagaaatagtctgaaagaagcattggaattgtgaaatgccctatgaatttgccaatccttggtggaaccagatagcctttgatgcatataaaggacagcggatccgctgcactccaggtgctgctcaagcctcctaatcaggtctaattgaactgctgtggacagagtatggtgtctgctcactgctgtggacagagtgttgcgtctgctcaggaggagagggtttcactgacctggcttttaacagttcaaagcaacaggagcaaaacatccaagttgcacatgaatctggcatggtgtctgataaatccttgtgtgtgccccaaatgtgaaggttatggggtattctgtaggttcattcattgtttagccagctcttgacattcacctttggaatatttttggtaataacttggagatgcaggggaatagccagtagtgtagcatttctgttgtttgtaatttcaatgtaactatctagtagtacttggctcttagaagatgttactgctaaatttctttctacctaatgaactagcctgtcggttacctactctgtcactacatatagttcagttcacataccctatgttggcatatgactatgtaatacgatagtagtgcctgggtttctctatgtaaatgaatcccttgccaaacacagttcagacttgctcactactgacaggagtggaacaggaaatgaatgttttcccagcttgggagcctgtttattggatttagggcagcagtgtgggaagcaggaggtggaggccagtatctcctatcagactgtatgccacttctaggcaataatgttggtatgatctgaactagccaggaggaggtggggtgactagagacttgagattcttagttaaactgaagacttcatttgggcaccagaaaccttaacaaataatctcacaccttgagccacaaacgtcccttaaagtatgctttacccaagcatgacacacaaacacacattctgtttggggtatggtttaagatgtgaacagaaacatgatgaggtttgtttaatggcatactgtactggaacgctgaagacctgctgcagatgtaaattccaagtcttgtttttttgttttgttttcttttgttttttttttttcggtttttcgagacagggtttctctgtttagccctggctgtcctggaactcactttgtagaccaggctggcctcgaactcagaaatccccttgcctctgcctcccgagtgctaggattaaaggcgtgcaccacaacacccagcttttgttattttttaagattgtgaaatcataaaaatgcatatgaatcaagttttaatacactgggtggatgaggctgccattgcacaatttctatctttgggttctcaggcatggttccgacagtgtaagaactctgtaacatttaacattaaataaacagtaaacctatgaaaaaaagaaatgacataaaaaggaaaggatatggcttctcctaaatatggtgaagtagaatgtgtcttatcatcaaaagaaagagaatagccggacacaggaacagtctacaatggacagaaccatgagcctcatgaggagagggagcaggaaagccagacccagaggccaggagggtaaatgatcagtaaaaaagaccaggtagccaaatggatgcattacatgaagaaaagcagctgggaggacatttgcccaacctctgtgctaggggtctggaaaggacagcattgcactgtagcaggtagggatagaggactgtttggagaacctggaaccaaggactgatttgatttgttaaataggcacgttggccttttgttccagggtttaatattcaacattagggatgactgaagagatggaaatgatttaattttaatctcaaaagttattttaaaaaatgaactagttcttttatgtcttctctgcctaagttatcaatggaggtagagggagggagggacttaggtgggaaaagtgagagggagggaaaaaggggagcagaatgagttatgggtgggagacaagagagagcccagagggctagaagaatgaatggaaatatggagcagtagaatttggagattggagagaaacctctagaaagtcttatagacctggggtgtgagaggcttcctagatcctgccatgtccccatattgatgataatggactgaacctctgaacctgttagccatccccattgaaatgttcttttgtccttattttgccttggtcacctttctgttcacaacagtaaaatctatgacagcaattcttaattataaagcttgatgaaaggctgagctacaggagatgttgctctaaacagacacatgtatgaaagtagctgatcaaaggaatgaaatttctcatgactgggaaacattagggatagaaacaattaagaggtcagatcagagatgcataaaggaaacaaaattgaaagatcaataccaagacaatataattgaaaaatccccaaggtacaactttgttttggtaggaccttttccctcaagaatttgagaagttgctgtttcatgcgaaaacttgccatcatttatctgccttcatatgctgccattcgaacagggcagcacgtcttctgccttaacttgaacttgacaaacgctgaactctctaaacgaagccgactgaaggagcgaacacgcagactttttaattctgaggtgatttttcctctcagaagtccaacgtcacttaatgtcacgcccgtgagcgaaggcggcaggacgacgaaggccagtccaggcctttgctccttgcctaacagtcgcgccgttcccaagagggacccctagcgcggtgggagccagcgagctcagcctttaagggagcgctgaagacccagctcgctttactcggaggagtggaggcgcaaagcaccgctgacgcgcttcctcgaggccccgcccactcggctccacagcccgctagaggcctggaggaggcggagccaaggaggagcatgcgcacgcgccctcgcaagccggccttctaagggggaacgagcgatctcgcgagggttgagagcgggtagcgtaggtatctgtcctggttggctggagaagagaatcaactctcggagagaaggcgccgggtggcctctgagaaccttcccttttcctttccctttccctcggccctccgcctcctcagagtcagcccgccttccctgacctccgtgaccccactggccccgcccactcccgtcgacgtgattcccgccgtgaggtaaacgccagtgaggcagagtcccgcggaagaggacggcgaggcgagcggcgcggctgggccggctcgggtcggtggcggagccctcgcgcgtgagagcttccgggcacgtctcgctcctccggcggcccggacgccagtgtcgcggaggcccaagctgcttccctcggcgccgcgcctgcccgtggccgcggcgggtgacgcagccggaacatgttgtccgctgtggagcctccgccgctcccgcctcccgagagcgcgccttccaagccctcggcgcccggcgggagcagcaacggcaacaaaggcggccccgagggctgcgggctcgtgccccggccccgcggacaccgagatggaggaagtatttgataatggatcacctggaaagcaaaaagaaatccaagaaccagatcctacatatgaagaaaaaatgcaaactgaccgagcaaatagatttgagtatttattaaagcagacagagctgttcgctcatttcattcagcctgctgctcagaagactccaacctcacccttgaagatgaaaccagggcgcccacgggtaaaaaaggatgaaaaacagaatttgctttcagttggagattaccaacactgtagaacagagcaagaggaggataaagagctataaacagaaagttccaaagcaactaatgtttgtactcgatttgaagattcttcatcatatgtaaaatggggtaaactgagagattatcaggtgcgaggattgaattggctcatctctctgtatgagaatggcatcaatgggatccttgcagatgaaatgggtttgggaaagacacttcaaacaatttctcttcttggatacaggaaacactatagaaatattcctggtcctcatatggttttggttcccaagtctacattgcacaactggatgagtgaattcaagagatggataccaacacttaggtctgtttgcttgataggagatgaagagcaaagagctgtatttgtcagggatgttttattaccaggagagtaggatgtatgtgtcacatcttatgaaatgcttattaaagagaaagtctgtgttcaaaaaaattcagctggagatacttagttatagatgaagctcacaggataaaaaatgaaaaaatctaagttgtcagaaatagtgagagaattcaagactacaaatcggctgttgctaacagggacgcctcttcagaacaacctgcatgagctctggtcacttctaaactttttgttaccagatgtgtttaattcagctgatgactttgattcctggtttgatacaaataattgccttggggatcaaaagctagttgagaggcttcatatggttttgtgtccattcctccttcgtcgaattaaagctgatgttgaaaagagtttgcctccaaaaaaagaagtaaaaatctatgtgagtcttagcaaaatgcaaagacaatggtatactcggatattaataaagatatagacatgttaaactcagcaggaaagatggacaaaatgaggctattgaacattttgatgcagttgaggaaatgctgcaatcatccgtaactcttcgatggagctgaacctggtccactgtacacaacagatacgcatctagttaccaacagtggcaagatggtggtgttagacaagctactccctaaactgaaagaacaaggttcaagagtactaatctttagtcagatgacaagagtattagacattttggaagattattgcatgtggagaaattatgagtactgcaggttggatgaacagacaccccatgagagacaagactccatcaatgcatacaatgaaccaaatagcacaaagtttgtatttatgctaagcacacgtgctggtggtctgggcatcaatcttgcaactgctgatgtagtaattttatatgattcagattggaatcctcaagttgatcttcaggctatggactatgcccatagaattggacaaaggaagactgtccgagtgtttcgctttataaccgataacactgtggaagaaagaatagtggaacgtgctgagatgaaacttagactggattcgatagtaattcaacaagggaggcttgtagatcagaacctgaacaaaattgggaaagatgaaatgcttcaaatgattcgacgtggtgccacacatgtgtttgcttcaaaagaaagtgaaatcactgatgaggatattgatggtattttagaaagaggtgcaaagaagactgcagaaatgaatgaaaagctgtccaagatgggtgaaagttcacttagaaactttacgatggatacagagtccagtgtttataactttgaaggagaagactatagagaaaaacaaaagagtgcattcacagagtggattgaaccaccaaaaagagaaagaaaagccaactatgctgttgatgcatatttcagggaagctctccgtgttagtgagcctaaagcacccaaggcacctcgacctccaaaacaactaaatgttcaggatttccagttctttcctccaggtttatgtgaattactggaaaaagaaattctgtattacaggaaaactattgggtataaggtaccttggagtcctgatctacctaatgcagcacaggcatagaaagaacagctaaaaattgatgaagcagagaccctcaatgacgaggagttagaggaaaaagagaagcttctgacacaggggtttacaaattggaataagagagattttaaccagtttatcaaggctaatgagaagtggggtcgtgatgatattgaaaatatagccagagaagtagaaggaaaaactccagaagaagtcattgaatactcagctgtgttctgggaaagatgcaatgagcttcaggacatagagaagattatggctcagattgaaaggggagaggcaagaattcaaagaagaataagtatcaagaaagcactagatacaaagattggacggtacaaagcaccctttcatcagctaagaatatcatatggtactaacaaaggaaaaaactatactgaagaagaggatcattttctcatttgtatgctgcccaagcttggcttcgacaaggaaaatgtgtatgatgaattacgacaatgcatccgaaactcccctcagtttagatttgattggtttctcaagtccagaactgcgatggagctccagaggaggtgtaataccttaattactttgattgaaagaaaaaatatggaactagaagaaaaggagaaggcagagaaaaagaaaagaggaccaaaaccttccacacagaaacgtaagatggacggtgcccttgatggccgtggaagaaaaaagaagctgaaactatgaatgcatttttgtcttataatcactaactagtagttctttaatttacaggtcttcataagatgtgctggacagtgctcaactgttatgtcattcagacatcaggtccatctgcttactgagatagaaacatagtatgtagtttcacttttttttaaatgcaaccgctgtgctgaaatttttttatcattaacaattgaagtaataaaacaggcttcatttattaaaaagaaaagaatttgagaagtttaatcatgagaaaaagcaatgtcattgtaacagggggcacagactgggatcaaggtgacctgagccaccacagcttatttcagaaacattattgtaaatatttctttttgtaaaaagactgcagataaagctgatggaaataatatacattgttagagtgaaatcactccatacacaagcagaagatgaattaagaaaagttgctttagtgactgtgtgcattcatgacaggctaattatcagactaatcagcctagcataaatctgaattcaacatatgctgtcagtcttaagtttcttttaggttgagttcccagaatatgctttgaaccagttaaatatggactggatactgcatatctaggctcttaggtagatggaaggtttacatagtacagatattgtaagactcatttcttacatagccattttcctaaaaaaaaaaaaacccacaaagatagcagtatataattttcatttgtacctaagatttattattcaaattgttttgttttcctccatgttgggatgaccatatgtttgtaaaaaaaagactatattttgatgtaattcctaaccatttttgaacatctgttagaagactcagagtgaaatgtctatagggtgcaaatcgaacaacctgtccttgatcactatataaaaaaatgtccatatttcctcccttgaatattttgttccccaatctaggtagaactaaagcatccacactttgatcttccttactcttgagcttcatgtgtactgtaaattatatcttagttactctgagctgtggagcagagaatgacagaaaagccatccagacactgacccacctgggaatccatcccatatacagacatcaaacccagatactaatgtggatgccaagaagtgcttgctgagaggagcctgatatatctctctcctgagaggctctgccaaagcctgacaaatacagaggtggatgcttgaagccacccattggactgagcttgggttcctgatggagaagctagagacaagactcaaggagctgaaggggtttacaacccataggaagaacaacaatatcaaccaaccagaccctccagagcttaccaggactaaaccaccatccaaagagtacacatggaaggatccaaggctccatctgcctacgtagcagaggatggccttatcaggcatcaatgagaggagaggcccttggtcctgtgaaggctccataccccagtgtaggggaatgtcaaggtggggaggcaggagtcggtgtgtgtgggagcacctgtacagaagcacagggagggaggatgggatgggggcttccagaagggaaaaccaggaaaggggattacatgaaatataaataaataaaatatcagcatcaaccaacattagccactgtgaaaattctctggcaatcatttgctgttctgagaatgaaacatctatttagaattaagtatgaactaatacacttgaaaaaaatatatttgaagcataaaaatataattgaagcataaaaaatgtccaaagtagattccacaaacttgtgttccaatttgcacatatctctcctggcctaaatccttgtaaaaatacacacatacaccatacacacacacacacacacacacacacacacacacacacacacacacacacacacacttactcatgaatgcattcatttctgttaaggtttcttaaagcctatctgcagaatttctcttcagcatgaacttgttcaagtaacagataccaagcaacaaggcttcaagtcagaaaagtcaatccttcctcaagagtggcatcataatatttgaatagattgtttacccttatcagactcctttcttcagaatcaataatcttgtgtgactggatataagtgtgttacctaagaatatgagcaaattctttatagacatatattcccctcagtatgcatattttcagatgctcaaaactacagtaatatgcaaaatatctaagaggttcattatgcactaaagtttgtactcttgtgtaaaggtatcaggaggtacaattcaggtacaggttcagctctttattggacaagttaacaaaagcagtttagtcaaaaagaccaaagcccctgtcatcttcggactcctcgggctcttccttctttgcttccactttcttctcctcagctggggcggcagcagtggatggagcaggaccaccagaaggtgcagctccagcagctggagtgggcccagcagccccaacattgcagattaggctaccagtgttgacattggccagagcctttgcaaacgagccaggccagaaaggttcaatgctgacaccagctgctttaatgaaggcattgatcttaacttccgtgaccatcacctctttgtcttgcaggatgagggcagagtagatgcaggtgagcttggagacagacaccatgttgtggactgctgacatggtgctagtcgttggatgaagtgagggcctcaccccaacgtggcattagcaaactgaccacattaacaggtttgtctgtagacatcccaatggctatcttaggaagctgacagtgacctatgggaacctgtgctgccccatgcctatgtatgcttcacctgtgcagtgccttcctggctgtgttaaatcaccagtgctgtggactggactcagcccctcaactcgcaggggccccttaagtgtcgggagactcagggtcctggtacacaggcgtgaaggagtcagtggggtgacaaacagatgcaaacataaaagagtgttgatctgaatgtaatttctcaaaggaagcatcagacttatgatacagaagaaaataaggaagttaggtgacacatcacccaaggtacgttgaggttacccgatgtttaatgactctttacacaaaacagaagaatgcatacataaagactgacaggaactaagtaacataacaactgagacacagtcatctctatctaaggtcagctatattcctaaaagccagatgtgaggtcattatgttcccagggcaagtcctttcttgcccaagccatagttctaattctgatttattgtttagcccaccaccagccagctcttagtaaatatctaactatggtatgcttctgggctagtgaaagtatgtgctagggagttctgctctaggtaaccttctcatgaataatgcaatactctagctccttcttaaaccacatccctacctacttcctaaactattgtaaattcttgtatatgtaagtgattgggctattattctaagtgattttgtcggggactttcttctattaagtaatgtagtctgccatatataactataataagaactctaatcttactttgctaagctttcctgagatttctaactctatttagtagatgataatgcctgctttctttcactatctctttttcaatactggaggcaatctgtcttaatctgtagcattcttatgaaatcccaagtccagggctggctcaagtgctggctaggacattggtgaaggccaggaagcaaagttcaacctaatttaggtatttgacaaatcattccttggaggcactgataataaaacaatactgaaagaaagcacacagacccattcacctattaaccaagtttataggaacattatggtatgggatgccaaggctccaggagactaagtttccatgaaagtttttgactcaggacttttcccaagcttttgggcttgcttcacagatttcactgaagtggctatgatgcaccagcacctggatatgtaaggttctgtaaagaaaggctttccacgttcagtcttctgcctcaccagtcttgatttctgaacttataaatttgaccataagctacttgtgaagtaaaagatgtttaatggaacagaagaatgagggctggtgatgacttaaaagttaatagcaggggtgggtgtggggggtgggtgtgcaagggacatagctcagcggttaagagtgctgactgctcttccaaaaatcctgagttcaatcccagcaaccacatggtggctcaccaccatctgtaatgggatccaatgccctcttcaggtgtgtctgaagagagctacagtgtagtcaaatacataaatacaaaataaaaaaaaagttaagagcactggcctgctcttgcagaagactcaaaattgattccaagcatcaacatggtggctcccaaacatctgcagggacctgattctctctcctaacttctgagtgcaccagacactaagtggtgtacatatattcaggttggcaaaatgttcatacttgacaatagaccagagaaataaatttgaaaatggccagaaacataataaaaacaataatataataaatcttgaaaaataataaaggctgagaggggagtcatcccttcaggctcatttatgaagggggatacctgcagcagataccctcaacaaactccctggcacattttcttacatcacaccaagaaaacaatccagacttggccatgtgtcccctaagagtttgacattgggcatcagggacagaatgctcaataccacaaatgtgtctgcttcagagctctgtgaagtgagctcagtcagtgcttacctacacacacaccccatgagggatgggaacacaaagcagactgttctcaactttgaaatgtcatgtcttggagagctgcagccggagagcctggttcaaagggaacatacttagtaaagcttgtggtcttagacaaactcatctgtccttccacatacatgtatggagtactggtgtgtcccaagcactgaactagccagggcacttgggagagaaatggacaagatcaccattcctgatgacatgcagctgacatgctctctgaaatattttccccaccagggatggtatggtgagaccagaagccaaggacaggtggccattaggagcccaggagaagttggggcactgtcagttcactgagagtgagctactgccacctcacaagacatgtccaatcttgtcatcacagcagactcagtaccattgcaaaaacaacctcagcataagtctccagaataagccttgctcaatcccaaaataatctgaagtgtgagggaattgaataacaacttatgtaagtagacacatatttcccacagaatattaaacttaagaacatacattaacatttttaaaaattacatttattgttgggtatagtggctcatgtttttaatgccagcacgcaagaggcagaggcaggtggatttctgagttccaggccagcctggtccatagagttctaggacagccagagctaagtaataagatcctgtcttgaaaaaaaataatcaaaacaaaacaaaacaaaaataactgaatttttaaaaatctatttgtggagggggaacacagcttacaggaggccattctttccttcctcctgggatcagggatccagctggggagtaggtgcctttacccagcgaaccatcttgctgggtcaggaaaacatatttttaaacatgctacatatgattccacagtttacatggaaacagcagacattccatacaagactctgagtcaagcactgctttaatcctttggatgatgtttttattttgtttttattttaattatcattactgagggtggggcttggggtggagcttgcaacccacagccttatgcatgggatacaggtgctctactactgagcaaacatccccagtcttcaagagtgaatttaagctcttcaactcatatagacaaacaaatatgcccaagccttaggaagggcattggaattctgtttacagatgatgaaactgaggggtaaagctgaccttggtggtgtacgtctttaatcccagtgctcaggtggagggtgcagctttgagttcaaggccagcctggtatacagggtgaattcctggacagtcaggactacacagagaaatcatgtctcaaaaaacaaaacaaaaatacttcgtttttatttatgtgtaatgtttctttgcatataagtcagtgtaccatatgcgtgcctgggactcacagaggctgaaagagagcatcagttccctaggaactgcagtcatagttgatggtcatgagccactatgtgtgtacctgagaacgacctttggttccctgaagagcagccagtgctcttaaccaccaagccatctatccagatcctagttcttctctttaaaatgtggctggcaaaaagcatccttgcttcaagtggtggagaattaaatacaactttttatttctaaagcatttggaaaagtgcctggcctttcttcttgatgctaaggagcaaatgcagtattagctgtgaggtgggttctgatcactgcatactgtacacaactggtggtttgtaaatcaaagctgggggcagtgaccccagaatcctggaccacagtcattctttgcttcctttgtgtttcaagagagggtctcatgtagctcaggctggtcttcctcaaactgactatgtcacagaggatgtgcctgactctttaatccttcggcttccacctcacaaattctgaggggactaaaagcgtgtaccatctcaacatgtgacatgggtctgagctctgaatgcaaggtttgtggtaccaggctagcacattcccagcctgagttactactttccttttaaacatttttcttattttattgaaaacatattatttttttgtataagggtgttttcgcctacatgtgtatctgtgctccatcacatacatgcctggtgcccacagaggtcagaagaggacattgtacttcctggaattggagtttcagttctgatccaccatgtgagtcctgggaattcaaccctgctccacaagtgcagcagagtgtttttaattactgagctgcctccccaagcctctaaatcacttcttaatatgcaggaatgtatataaactggcaacatatccttggcaaccttactaaaactgtgatatagctctaaatgtcacacaggatgagcaatgataaatacttacaaagtttaaaaaaaaaaaaagaaaaagactggagcgggacacttagagctagcttcaaagcacaaggccctctcctgtcctctgcagctacccgcacttgtgtgtgtgtgtgtggcctgcgtactgtccgtaggtgtgtgggtctatttttgggtctcctattgaattccattaatccacctacttatttctttctataccagtaccatacaaatttttattactatttttctgccatacatctttaagttacagaaattgatagctccagattttctttttttgttgttcaagaatattttatctatcctgtggtttttgttttgtttgctgttccatacaacattgagaatatttctttcaagatctgtgaagatttgtgctaaatttttgataagaattgtactgaatgtctagattgctttttggtaagatggacatatacattatgttaatcctattgatacatgaacaagggagatctttgtcatgttctgatatcttcctgtttcttccttaagatactttaagttcttctcctacaggttttcacttgcttgtttagaggtaactgaaggtattttattttgtttgtggctaaagtggagggttctgtttccataacttctttttcaacccttttaatcaattgtgtgtagcagggctaaggctttctttaagtcaattgtgtatgcagacactttgctaaaatgtttatcaactgtaatttttggtagaattttttgtctcacttatacacattatcagaatatctgaatttcttcttttccaaattgtattcccttgatctcttaagctgctttattgcttgagctaatacttccagtactatatcaaagagatgaggggatagtggacagcctttccttgttcctgattttaatggaaatgcttaaaatttctctctatttagtttgattttgggtgatagattgctgaacattgcctatattttgtttgggtataccccttgcattctgtccctccaaacatatcctaaaagggggttgaattttccaaatacctttttggcatctggtgaaatatttatgtgggcttatctttcacttttttttttcctatggtgcattattgtgattgcttatcctggttgtcaacttgactaaacctggaatgcactaccatccataaatacaggaaatacctgtgatcaagatctgcggctttaagaaacaggcttctgccttacattgtgacataggatgagaacacttttattcagatcttgaggccatagaggccatgagatggttaggcctagttaaggttgtatatggctttaatttcaggagactaaggcaagcagaactctgagatcaaggccagcctggcacagatcaaattccaaagcaagtcatggttgtatacaccattaatgtagagcatcccttctgctggaggcctacataaagctgatgaaagaaggacgtctcactcttcttcacctgcttgcacttacttgccagcacatctgttggaacttacttcttcaggaatcctggttattcagaagaccaggcaagacatgtagcatcatgggactgcgctagattcttggacttcctgttcactgatttccattgtagggcttgttggactgtagactgcaagttattagtataaagtctcttaatatagagagatataccataacttctgtgactccagaaaaccatgagtaatacaattatgttggtatatttttaaaaaagattaacttatttattgtgtatggttttctgcctgcatatatgcctgagtaccacaagagggtgccagatcacattatagatggctctgagccaccatgagccaccatgtgtttcctgggaattgaactgatgatctctagaagagcagtcagttctcttacctctctgagccatctcttgagccgtgtggatttttatatattgaatcacccctgcattcctggaaatattggcattagttcttctttgacagtcggttagaattgtgcactaaaatcatctagcccaggacatttctcttttggttcagagacttttttttttttttttttttttttttttttttttttgagacaaggtttctctttatagccctggctgcctgccctggaactcactttgtagaccaggctagcctcaaactcagaaatccgccttcctctacctcctgagtgctgagattaaaggtgtgtgccaccacgcccggctggttcagagactattaatgactacttctattctgttaggggttataagataattcagatattttaccttttcttgattaagctttggtaattgttatatgtctagaaagtcatccatttccttcccaattttgtggagtatgggtttttcaagaaagacataattattttttaaacatcctcactgtccttagttatgactcttttgcaatttccaatatccttaaattggatactgtctctctgacttttagttagtttggctaagggtttgtgtaagttgttgattttttttccccaaagaatcagctcatggttttcttgattctttctgtttttcgttgtttctttctcactacttttttttgccttcattcgttttatcaattacttcatgtatttacattccaaatattggccgctcttcttagtcccatgaattcttcactacataagccctagcctttgcatctgaaagtgctcacccaccaatccacccactcctacctcatactacttgcatgatacatcactggggcatcaagtatgggaccctcttttttatttcttaatgtcatttgtcttatacattctgctttattttcattcctcctgatatcttcacattaggactgaccattcaggagatggtactaaggacttgtttcagtaaaactccaacaccaatagctaagcaaagaacacacaactcagttacaatatatataagctgcatgtcttgggcagatattccactacactattctattctccagcttttagaacccttgctatctgtggcttttcagggccatgtgttcttttccatctttcttccaccttttcttcctctaacttcctctgcctccttcatttcctcgtctccctcttctttttctgtctttgccctctctaaaatctccagccccacctttcccttctattgtccaatcacaagctctggcctttattcggccagttaaaatggagagaaggttcacatgaaattacatgagtatatagtccactgttcattggggcagcccctcttgaggaagcagaataagcattaaagtacaaacagcaccagggcaatccacattttgttcaatcccttttgttcaactaaaaggatcttttcacatataaattgagcacaacacttgaattatgaaattttacaagtaaaagtaccctaaacacccaggccacccatcgtctccatttagataaagcactaccatctatcctaacttaaaaggcttacaattctatacctgaattatctcctggttttagcttgtatctgaaaaccatcctctcaaatatatatcatgtcagtcaatgctaaacatcttgagttagctatgagagtacaacaagacttcagcagctgtaagatagaaatccaagcatgtcctaaatgttacctgaaaatataggaagcataaaacatagcttccaaaacccaaccaaactgtagacacagttgacaacctggacagtccctcattccttcaaaatggtggagcatcagtcttcagccttctggccaggatcatctgtcagaactttgtaaagcagaattttgaaggagtgcttagcctgtcttggcagatctattagttactcttccacatagtatgtccttttcctggacaggacttttgtctgtagatgaagtgaggcaattcttctctggtggctatttcgccacaactggagcaactccactgatatgcattttatgtttatacaaagaatggatgctgtcaggagcagatatgtctctagtcgagtgatctttaataatgaaattgccttaactgtagtattctgtggacttctgacgcctttgaaaactatctatctatgcaaagtatatctgaactgttaagccttgactgctctcaaccatttctgattgaaatatctcaaaaacaaaaactttatgattaactcaggactatgattctgttatctgacccttaacttgtattttcaatcatctaaaaatatttagtaatagcagacatagaaggacccagtctaagctttgtattcgtaaatgtgttgcatgggtacaaatcctatttaataacaataatattactcccaatttttacatcaatctatgaatttcataccattgaaaaccttaactctattgaaataaattctgtagaaatgtaagaaattataagttcaatgctacataaattataaagatttctatcactgtaagatatggccatgtaatgttttaagagtaaagttgacaacctattcttatttgtctaatattctaatttctatattactatatcccatctttatcttccctgtgacttttatttacctaagaaggaaggatagagaagaggaaaggaaaggtagaagtccctgagtctaagctctctagctccctccctgtctaaatctacaatatttgtaaaatattccttaaaatgataacatatctatgattcataaaataaccagaaccatccaccacaatataagatactgatacgatgatcttcttttgtctgcttatagctgaattgaggtgaaaaaaaatcccttctgtaggctgaagggaaaaaacaggaaaattggtttggtcaaaggaggactagttagtgtcatttgccttccaggcattatgtgctgagaaagttcatcgcttagatgaaatcttgactatggcagtctgaaaggctgaataggtgatctagatattcttgaaaagttttggaaacaactatttggaagaaacagcttcaatgtacttgaggtagaatcaaacaaggagacagaagggaaggtcgcataatctcaacatcctggagtgtgaatcttatcagtgctgtctttctcttctttcatcctgcactatacaaaacttacaagcaacatataattctggaaagacattcatatggagcatgcagggtgcacagactggttagttaagatcaataaaggaagacaactgcctttcttcagagattagtttgatcacatagtcaaactacaatatacatttccattcatgccatcttaaaggatggtatgtaaaaagtcatgagaattttgtacccagtaggggttattgggtgtgtatagacattttagtcaaagccagttccagagctgtctctatatacagagacataaacatcaccacgtatatagcacctagcttgttgattgtgttagtctccctttccttctccatagccaaggtattcaggaggtcttcctttgacatgtctcatttttatcaacttgaaaggaacccatagcttttcttttcctatggaaatataaggataacccctccacttgtataatacatttgttattttccattctgatttcatactatccttaatataaacaggctggtttagtttagtagttctttccacaatcgaatgactttcagcatcggtaatgttttcttcattagcatttaaaaacttaggttaataaagcattatataatcaattttggagatttttgttgcccccttttgcctgttaaatatcccctttagagttttcttagacatctccacaatcgattgtcatgtagggttatatgatattcttgttatgtattttatatataataacattttaaaaagctgcttcatcatactagagacgtatgctggaccattgtgtgttttgatttgtatgggtattcccagaatggctataacatctaacgaatgggtagttacagattcagccttttctgatgctgaggaagtttcccattgaaatccttaataagtgtcgatagtatgatgcacacatttcagtttaccaaactttgtaaaatggaatatatccatttgccaaaggacatttctttttgtacccttatgcttagttcctgaaggtaatggaatttgattgtataatgagcaagtaggacattgcctcacatttcccttggctctttctttaagacttgctgttaacatgatttgtttatggaattctaaagtctcttttattctttctatcaatagctggtcaatttcattatcaccttgtgacagagggcctggcaaacctgtatgtgatcttatgcgtaatttatatagtgaatgactcctatttcttatcaattgtggtagctgaaaaaatagtgaagtcaattcagattcatcctgaataagatcaacagtctgtattggaaaaacaaccctttctgcatattgagagtcagttactatattaagagactctagagaatctgacaacactgtgagtattgcacataattcagatatttgagctgatttataaggacattcagtgacctacatcttctgatttatatcctgcctttcctgatttattagtctcagcataacatgtaggggctccagataatggagtttcctttattttatgagggagaatccaagtagttctttttatgaaatgaaatcatttgcttttatggtatccgtcgctaatctctccaagaagttactgcatgttctttaccaagattcaccttgtacccctaaggaggcaatctctgcattagtaaaaggtaccactatttcaggtgggttcattccaactaattgtcaaagtctcatttttttctttttagtataaattcaaagaccttctccatgtagggatttcttactctgtttatgtgctaaaatcatccattctttttttttaattcatatgtttgtttgtttgtttgttttgttttatttttgagcctgtttccctgaatagttagtgctggctttccaggaactcactgtgtagatcaggctggcctctaactcagaaatctgcctgtttctgtgtcccaagtgctgggatcaaaggcatgtgccaccactgcccagcaaatattcattctaatttatcttcccactgcatgggaattccttgagtgaaatgagtagaagttaagataactaagatgcaggtcatctttggataaatactggttaattgtgtagatcccttgctccttgtgtcttctctaggccacgtggttttgctccatcttccttccacctccttttcttccatcttccactatctcctttgtttacttatctgcctctcctccttcccctctccttcctttctaaaacctccagccccacgttttccttccactgcccaatcacaggcttcagtctttattttaccaatttgagcaatttaaatggggagaagtttcacattaaatcaccagagtatatgattcacccctccttggggcagctccatttgaggaagcagaattagcatcaaaatacaaacaacaccagggcaatccacaacaaggactaccctacacaccacccatgacattcctccattgggccaaccatgtgggcacagaggcatggcctaactaccatggaagtccctcactaagcacaaaacaactgagaccaacatccactttcctccttccacattttttccctttcttattaatttacacctgtgtctcatctggccgttggtagacttccttcccacttaagggaaccccaaataaaatcccttaggttcttccttttcatcagtggcatgaatgttagtttctctgttctggaaaccttctggactgaggcaggaggtctatccccatgaattttgctctgagaacatttgagaccctgatacgtcgacgagggttttctttcaagccaagaaattcatggtgaattcgggtgacacagactgaactcaggcggtccctcaacccatgagagaatcaagatttcagtattcaggtgggcaaggagtcagtgttgagtgtcaatcagacaagaacacaagggagtgttgatctgaatgtaagttctcaaagtgagcatcagccttataatacagaagaaaaaaaggaagtgaggtgacacatcactcaaggtacattgaggttactcgattcttaatgactctttacacaaaacagaagaatttatacataaagactggcgggatctaggcaatgaaacaactgagacaaagtcagctctatctaagatcagctatattcttagaagccaggtgtgaagtctttatgctcccggggcaagggctttcatgtgcaagccatagttctatttctgatttattgtttatctcaccaccacccagctcttagtaaatacctagctatgttattcctctgggctagtgaaagtatgtgctagggaattctggtctagctaatgatctcatgaataatgcaatgctctagttcctccttaaaccacagtaggatcttcttcctaaaccattgtaaattcctgaatatgggagtgacttggctgttattctaagtgattttatggcggactttcttctattaagtaatgaaatctgccatacataactataataagaattctaaacttagtttgttaagcttgctctgaaatttctaactctgtatatcgtaaatagtaatgctttatttctttcaatatctctctttcaatactggagtcaattcgtctgtataggtcatagttactaaactccaagcccattgtaggctcaaggactgcctaggacattgatgaaggccaggaagcaaagttcaacctaattaagtatttgagaaatcattccttggaggtacctacaataaaacaatactgaaagaaagcacacagaaccattcaccaactattgcaaggtcaaatctgaaacaaatctgtttatgggacaacagaatagttccaggagacaagtttccttgaaacaatatgccttaggactgaggccaagcttttgggcctgtcatgcagtttttactggagtgggtgtggcattatggtatagttccctaccacctctttagttctgattctttttgacatcattactaatttaaattttttccaaagaggaagttgttgctactcacaatattgttagaaataggcaagtgtatatgtgtccataactgcctcttctccagccatcttagccttggcagactcattggatggtgatgagaagtagtgaaatcatttgaaggcatttgaatgcttggtgttaactgcaagtctcccacctccaccggatgcatggcatgaactttgtgccagggataattctgccttcccacacttaagaatccttcatcaaattcgcagcctactctggttggactccaacaatctcctgccttgcagctgcctctttaggcccacaggacctgacctgaggcttaaaaaggggaacacccacaattgtaaggactgctgtctatgcagggcctcattcccctgagtccaaatgtgatccttaacttacccaggtagaggctttgtttcacctaaacttcctcagctttgatgaccagggactaaaccctgtctataaacattgggctttcctacccaggaaaacccccttccattagtatagtggagtggtgccctaacatcataatgtcagtcacctgctcccttgctgacacagggctgatgatatgtttgtgtttttccccaggaatccacaacaccaggatgaatggcagtatgggatacccaaccatccagggaaaagtagaaaagggacaaaccctgctcctcctcagaactttttcgtgaggaggctgcacttgtaggagataagtctctacttgtctgtgatccctgtattcataccatttgctttatatgctattaagtacaaaatatttcccaggcctatgaacaaactgtcccatttcagtaaggaaacttgagctaacatagtcttaaatgattcagtactctcagaaaaagtatatccttgctcaatgagagcagggtgtccattcttgcttttgatatggggtttattggaaaagtttgggacaacttaaaaaggtttttcgacacatcctggatagtatcttatgctaaaatgggaataataataataataataataataataataataataataataagtattgcttaagtgtcttgtacaacacatctcttggcaatgctctatttgcataggtatgcttcaactactgatggttcttgagcatctagactaaggcctacccagagaggctattatagcttagctcatagaaattccccagggttctgtttaggttccctccttacaccctgagatgccctctgggatggctgtcctttcagggctggtagtcaatgaagggtaagaaactgtttggcagctcaacataagacacacatagtcaaccatatggaaggacatctgggatggggccaaaaaactctgactcctactgtgctatcaaaaattaaaataagccaggcaatggtgacacatgcctttaatctcagcacttgggaggcagaggtagtggatttctgagtttgaggacagcctgttccacagagtgagttctaggacagccagtgctatacagagaaacaatcttattttcaaataagatttattattcaaattgttcttttagtacatcttgaaatgataatatctttacaagaagaaagaagacaatatttattgttttaaagactaagctttttttgagcatctgtgagaaggctcagtgtaaaatatctgtaggatggaaaggtagaaacctgaccttaatcaatatataaaaaatttgcaggggctagaattatggctctgtgggtaagaacactgaatactcttcctgaggttatgagttcaatttccagccaccacatggtggttcacaaccatctgtaatggaatttggtgccctgttctggtgtgtctaaagagagctatagtgttctcatatacataaaataaataaatctttaacgaaatgttcaatgtagactgcacaaagttgtcttccaatctgcatatatcagttatgccaaaaatcactgtaaaaatatgagtgtgtgtgtctctctctctctcccttatattactaatggccaaaatcactgtattaataccatacaaacgtgcacgcacacacacataccataaaagtttctatttaatttttgctgttacagtatctaccatttctagataattcccttagaagtcactatttaaagatgcagttccaaaacataactaatgggaacatgaagaaacatgaagtatcaaataatattcacatagccatagcaagtgaggtatgttgtgagatatgcagttgattgctgattattctacttggttccatctctgattggtgagctatttaatgttttagatattctgttctattaaacatctgaacattaacattgttaaatatgttgacaaaacggtaaatgttagggttacatctaccattggacatgtactcaggaggctgacacatgaaaataaagagttcaaatgtagccttgcctaatgattgacatccaaatcaggctggatagcaagcatcatctctagggattttgtgaaaatctgaaaaacaaaaccaggaacaaccacacaacacccttcacaagcgccttacttggaaagtatgagtatacacagtctgatatttaaataaacagtggatgacagagatgatcagcatgcatgctatacattgggggcgggtatcactaagtgaaaatgcaaaagaagatgaccaggatccacagaaggaatataacaatggcctaataaagttttgtgaatggatttgcctcacatacattaaaatttaaaatcggcttcaaataattcaaaatacaagctcccacaactattaatggtcatgagagacaactatgatgtttagtcttcatcaaaaggtcacatgaatagtgtgtttctcttgtgtgagttctttcctacatttacttgtgaatgcattcattcctgtcaaggcatctagaagcttacttacagaaattttctttatcgtgaatttgtttatgtaacagaaacagtactgcatgagtcacaagggtaacagaaatcatttcttcatatttgttagaagaggcaggcaaaatcctggacatatcacaccaagcttcaggtgccatgtgagaggatttattggcagaagcagcccctgagaatggtgagaggtcagaagaagagaagggtctgtgcgaagagagaacactcttttattcagtgcacgagaatgggaagcatgtgaaagggaagtggtgccatgttgggtgccatggcaacagatgcagcagaagtgctgttgcctacagatgaggagtgtcctcacagagtctagaagatggctgtaaagacacttctcgctgtccacagatgcacctgatgcacattgcttgtatttgtaggatttctcttccatataaactcttttatgacatttttgtgatagtgacatgaaaaggctttactggattgattacttttatagggttgggcttcagtgtgaattcttttctttttgtagactctagagcccaggtttttttccatattgtgtcccagtctaatcttgtaggacatttgtctgagggaaatgcaaaggcagatacagattaacacattctcttttccttgggaatgtcggcataaaggaagcacaaatgttttatgtaaacttccattaatatgcagcattgataaaatgagtttcaataacaacaacaataaacagattccttaacagaggtggaatgctcctcatgtgcaaaatttaatatttgtaacccttgtgactcacgcagtactgttgcaaaatcatgttttgcacattagtaacactcacgaccctagtttgagaggctgaagtatgctcatgtcattgtggacactttcagaacaattacccttatgtacattgatgcaaaatactcaataaaatactcaaatactgaatccagaaaacatcactaagaatctatccaaaatgatgaagattgttttttcatccaatatatcttgaagagtttccattccctctactcttctcagttcctgtccacttttcatttgttctggatcaaaccccttttatgtctctcaataggaaaacaaacaaacaaacaaacaaacaatgaaacaaaaaaatccatagactcactaattgacaaatctgcccccaaaaaaccaaggtaaaagttatatttcaaaagaactggtgcaggcattagtatttgtacattagaaattctagtctcaaatttctggtatatatttggacaattttgtgtgaagcattttgctgggagttgataaagtatatgataaagtatattttctatgggtcgttataagttaagatatcaaaaagctaaaatttcaaaggggtaagaaattttttggctcagctctgagttcattagtcagaatgaaagactatgattgatgtttactggttagatgacataaatgtgggcgtctctgcaaacactagttctggtagagtaacaatccatgagacaaaaaagaaatctagttctataccgctctgtaattatttccgcactggttgtgggtgtgttgtgggttatagccaatgaaattcctacagcattcagagacaatctttcccagtgcctgtgttaacatctgaagtaaaaagtctcctggtactcagaagtcaagataaactacaaagccccatgggacaattaaccacacacaagataatgactgggaagaacactggagggagcctgcctctgctcagatgagaagcagaagagaaatgagtggaaggcaggctttgtatagggtttagttgtaggtgatggattttcaggattggaaatatctgcggttggagattgctggtattttatgttctgagcttgagcaaactcagggatttgtgagttgttaaaaccagtaagtatgctatccattctccctgtagacaatgttgagtgtaactttagattctgaccccagggtggctaattttaggaataaataagcacagtataattttggaaagaaatttcttggtaataattgtctcaatcctctgtgcacagtgaagatgaaagtgtgactacctcaaaagtcttttgcaaagtctatgtgagtctttcttaaagttggattctaaaactaaagggcctagaggaggatcaagcatacggtgtagaggacaccaagctacaagatacatgtcacatctcttgcaaggctggtttgtattgcctgagaaacaatgatcaagggaagattgtctgggacaactttatagtttgggactttcaggtgttttgtggcaccacatctagcacagctcaccataccacttactacatccattccctcacttctggtcagaaaaaaagtgtacttcttttccactgaagagagaactctgtggttttatattcctggctaccttagagcttatttttgaccacaagtttcttttgctctctacagaaaaaaatatgttttatggatgtttatagttttaggatgttaatgttgtgttaatgtaaatagaaaaacagtcaaatatttttttaagatttatttatttattatatgtaagtacactgtagctgtcttcagacactccagaaaagggcgtcagatcttgttacagatggttgtgagccaccatgtggttgctgggatttgaactctggaccttcggaagaacagtcaggtgctcttacccactgagccatctcaccagcccagtcaaatatttttaaagaatataaattatgttgttctgacccatccagcaggtccagttattcgagggtctccagggaaccttctcctaagaaccaaatggggggagagaaaagaaggacacccagtgcgaggaacccttctgaataacatcaatgtgtcactgtattagcaaggttcaaggcttaaatgcacaagcaaaaagtggaagtacttctcagcaggaggaatggggcagcagaaatttttcttttggcgactaaacgggggaagcaggaacttggtgatatcagggtacatcttgaggtcaggacatcctgcactgacttgaggctggaacaatctgtggttgttctctgagcggtgcgttggtggcccgcttttgacccccttttcttctgggggaagaggtccaattcagagatcaggacaattgtgttgtcttaatagctcccaacattgttcagatatacaaggtgtgattacattgcttgactctatagacatcaaacatgcaagtgctgctggcataatcccagcaatcagaacactggggcagatgtattattcttcatttggggtcagactattctaaatcaaagtgactttccatcctgtggtctccaatttcctcttttggcctttctgaactctctacatgggttgaagttaattttctaaacttttatgcaggtgtgtctgtgtatttttaaatggttactgctatattggtagagaactaagcaggatcttgatattgtcatttctatggcccattaccaggcttacgtttgtaaatacttgtctccacacctgctgagatatttgaatggcatatttctatgcccattggtaatccacagaattctggagatgtctcacacctgatcgcttgtaagaaaaaatgctaacatccaattcctgggacaagaattggagggtagaatttcttgatggaaaaagtgatgtagggaatagaaagcaggtggaagtgatttatgagagacagagaagagaacagataaatgggaacaggggcagagaggtaaagagcaagatacgcataaagtcataggcttgaatagtctgaaatttgaatgatcattggtaaactgctccaatgaaaggcctatgctttaaattatatagaaacctccttctcataatttataacactggtgtatccaccagtactcacactacactcatgtacatatgcaatgtgcatatatatatatatatatatatatatatatatatatatatatacacatatgtatatatacacacatatatatacatatgtatatatatacatatgtatatatgtgtgtgtatatatgtatatatataaatgcatatatatacatatatatatatataaaacttttcacaagggtgctttgggtatttaagtcaaattagatattgattggttattcacaataaattcatgacatcattgacttagcatattttggaggaaggacaaattttagatcaatgtctttttggttggttctatatatacatttcactttttgtagatagcaaagcccttcccataaccagtactctggaacataaaagccaatgtgcttggaggcacattcttgacctcttcacacatagtgagttgtgtaagtctgctccttagcaatgaagacttattgtcagtttgtaaaaagcaacacctttgttgtcaatgccatgcagtgtttgcttatttttatgaaaccattttgtagaacagctcagttgataaaacccaatggaaaagacaagatcaactggaactccatctctgtcagaattcagagacttcattagaatcaccttcatacacttataagctggttctttaaaaaaaaattccaaatatcgtactaagaatacagccagccgaagtccatggagtcttgtaccatggtgcttttctacgcattggcaggaccacaagtgtggcaatgcagtgtacaaaagttcttaccttctaatagatggtgatttttcttggaccttacaaccatagttagtgcgacttgaagaaatttaagatttaaaactgcagttctactgtgtatacaactttatggtttagctttttttttttcaaagaacaatgtaaaaacaaacattattttccttgtatttcaatcaacttttataacctaatgtgatgccttggtgcaatgataatttattgatacaatggtaatttatgtactttttccaagcatgtccagaaactgcctgagtgtcatttgctgaaagcatgaaatgcagaggcttagcataaccttccaaaatgaatataccattatgtgtactgattgataaacggtaatgtctataatcacttggatccagttacctcatcctttttaaaactctgttaaagatttctgtatactataccattccttctccatgtaatggggttttcttgatgttcctgaaaatattgcaaaggtctttcttaagaccggcaatggtgatacaaaagccaacagacatacatacagagtacacagatagacacaaacacggagacagaaggcagacacacaggaagagagagatacacaaggcagtattcagcaagttacagatttaaattaactgaatagacacacaggttggaaggctcagataagagaaagtatcgaattcaactttggactcacagttagttaaattacctctgagggaaagactattgattctttccttaactcagatgcattattaatcaccagtgtgtttaatgtattcacatatgcagaatcaattaacttttgatgtaattttttttttgcataagcacaatatgagaaaatataaaactcaccacaatgtgtaacaagtagccctgcattgtgaaaggtgtccatgggctcagaaccctgttctctaaagaaagaccatcaggtctgggcttgtgcttctgagctctcacttccatgctggcctagaatccattttaacctctcacagtcattactacaggttttgaacctcagaggtcacaagagaatcctagaactcattacttttgtgaaaagagttcacttccagccatattctctaaggcaacttgggtaattctggagtctcctttccccagcatatgaagatatgcatgggtgtacttagagtattatagagcacaatcagggaatcttctatgaacaaatggctaaacagtgcagtatgtattgtaggactctttctatattttcccttccttccttccttccttccttccttccttccttccttccttccttccttcctaccttccttccttccttctttcctttctttattctttctttcttttgccaaaaatctagacactttttcaaaggaatttttcttaattgcctcaccctccaagcagtaaataatattgtgcctaaacctaacatcactttaattcatcattttctttgactaaggtatccagctcctctaccttttgtccaagtctaataatctgtgtctcacacgttctctatgagttattattattcgccttactgcattttcttttcaggctcttttccttgtttatttctaagcacatattgaacaaaatttttatatcctatgttgtcctcctttccttcaggcttttgctattattctcttgcccacgaataattttgttcctgtcctctatcaattgacatatgtggcttacatactttgatctcttttatcatgactctggattttctattctttacctaggatatcatgtaaattgctctctttataagatacatacatagttgatagtttgagccaaagacattttatcttagttttactttgttttgggtattgagcaccagaattcagagggattgcttaattgtgtgcatttttagcccacaatgtgagaagttaggcaggatccgttgtatctgaagggttcagaacccaggtgcagtgtcctactacattcagttctggtctagtctggcagcaaccttgtgggaagctgagcagagtaggtcctgggaagttgtgtttccaaaacagagttggaggagtggttcctgatggggagggtgggcctcctgcatgattagataagattaagaaaaagacaaaataaaaacaaagaatcaatcaatcaaaaaaatcaatcaatgaattaagtaagtaagtaagcaagcaagcaagcaaaaatccaaaccaacaatattgccctgaagaactgggaagctaattaattaaaaagtcctgaaggaggtgtgcttaggagaatggcaggaagctactgagtattgggcgggtccagaaggagtggctctgaggaaccaggagaaagtgacaggaagttccaccattccagcattctcgatgtatctcggctgcctcgtggccaggaagtcatggagggaaactagtgcctagtgtttgcagaacctgaaaacttctttaagctacacttgctgtgctggcctcctaggacattcagcagctggtcctgtcaccttccaggtcagaggagctgttgggctgggaaacgggtaggagtggggcaggcgtatggagcaggggtacattttctgttgccactcttacaattctgttgtggatatcttaccattatcaggaagtttgagttcctgtgaattgagtttatggtgatgttttaattgatttttatggttgccagaatatttttctaaaacaaccctgtagatccttggccctctctggactttgtataccaggagggttgtctttgcaaaggccttaataaagctcctcgaattcaaattcattcatgctttcttttttttttttttttttttgagatcagatttatttattatatgtaagtacactgtagctgtcttcagacacaccagaagagggcatcagatctcttacgggtggttgtgagccaccatgtggttgctgggatttgaacttcagaccttctgctgagcagtcgggtgctcttacccactgaggatctcaccagccctcattcatgctttcttaactcccctgttcctccatttgccatttcatttccctttctccagggaactgaataggcatctccagagaactttgtaggtttttgtcatatggggaccagtgcagatttgatcgaattagaaaatattcctcataaagcaccatcatatggctgtaaatattaacattaataagcaaagttatagtctccgttagctgaacacagaggtatatgcatactttgatgtaaatatatcattgagaaatgtgtctatatatgctttgatattaatgtcacactgtagtggctattcctggttgtcaacttgactatatttggaatgaactacaatccagaattggaaggctcaccagtgacccttatctggaggcttggagatccttatctggatcttgttttgaagatcttgagccatagtggctatggattccagaagattgaatctccgagtttaaggaacacacctttaatctgggctacgcctttcatctgggattaaaggtgtggtggaacacacctttaatctgggctacaccttctgctggagacaatataaggacattggaagaagggagtctagctcttgctccttcacctgcttgctgcgtgagactgagtaactgctagatccttggacttccattcacagctgcgactgaatcattgttgggaattgggctgccgactgtagagtcatcaataaattcctttactatctagagactatccataagttctgtgactctagagaacccttactaatacacacaccttaggtttgaataaaacgtgaagacaggattgcagcaaggtacttgtgaggagaaatttccttaaggaaatgaggacaacataggacatgaaaattgaattcaataggtggttataaatacaaaaaaagaaaaaagaaagaaagaaagaagaccctgaaaagaaaatgcagtcaggtgaataataatcattcatagagaatgtgtgtgagacagattatcagacttgaagatatatagtaggttctgttaaccctgagtgtcaccagagaaaaaccaattccaccatgtgggccagctttatcaaataatacatcgcgaccaagagatatactttggtcacatgttacaggcattttataggccattatagtttcctatgagcctttattattttcctaagacatgcaaccttcagcacttcaagaagatacctggttcttgggctggtggtgaggttaatttttggcattttagtctgagggagaaagcattcagagataactggttgggtccagacagaggcaggcaggtgggggaggggaattgaggatgtgatgatggatagaggggcaggtcaagagataaccagcatccaagaaagcaactatccaactatgacttcattgatatgttaacagataccccaggtagccattcttcctgactttctttgaatttttccaaggttcagcccagcatgctgtgtggtgatgatttcaggagtagatattttaataagtggaaaattgagtatggattttttgttttgttttggttttggttttttcggtacagggtttttctgtgtagctctggctgtcctggaactcactttgtagaccaggttggcctcgaactcagaaatccatctgcctctgcctctgcctcccaaatgctgggattaaaggcgtgtgccaccactgcctggcttttactttggattaagacaaaattagtcagcatcttttgaataattttgattgcttacttactggattactgtctggattctggatcagaataattttcttagtctattacccgtgctcgaacggccaggaagaacgcaacaaaccggaatcttctgcggcaaaagctttattgcttacatcttcaggagcaagagagagaatggcaaaaccctgtcccttttaaggagaattatcctccgcctaggacgtgtcgctccctgattggctgcagcccattggctgagttgtcgtcatggggaaggcagagcacatgtagtggagaactacccttggcacatgcgcagattatttgtttaccactcagaacacaggatgtcagcgccatcttgtaacggcgaatgtgagggcggctccccacattagtcttcctcctcctcttctgtgttgtttggaaaaaaactctatatgtgtgttaactgtgtgactgactctcacatctttagggtaaactggactactcggagaaaaataggcattctcatgatatcttctctttactacatgtttatccttttctcgggtattgacatctttcatttttgttccatgaacagttccatgttcattctaaacaatattttcccattttcgggtctccatatgctcagtcaaatctccataactgtaaatcaacactaagagcactggatagttaaggtcaagtagactctcacaaaggatccaggtatgttagaggtactgaacaatgggtggagtggggcttacctgttagtagaaagagaacatatatttgattttgccagattctatttccttaatgattctggaaaagaataatattagatgtgatgatatggatttaccatggaaggcagtgctgtcagctgtcacttgatgtcagtatttaattaattttgatcctgggaaattgctgttgcccattgaaatcaaagtttcttttatccggattgaaagcagcatcaggctatgggtgtgacaagggcaatttatacataaagcaaatgtccccagtagattccctcctagggcctgtgaccttgcttactggatttttaggcagattttcactgtaatctatgaatttttttttcctgtggagttgaaatagaaaacctgttacccacagtcttgctagtatcataaaaatttccatgcctggtctgactgattcagattgcagcaagtaggttgcaacctgagtatagactctgatgactctgattcctgcccccaatttccctagcagtttttgtcactatggaagttaccgccagggtgaccaagatgtctgctgagagtgaatggtctgatatgaggtggttttctccagaaggtctacttgctttctgaatcacctattctgtacactctaaatgttttcctgtccttgacctgtgttcttattgatgttctgtgttgcattaatccccattagagtggaataattatttttgaccttctctgtactggttggtttagttttgagtctgtttgccttatttctgaggtatgtttcttctcttctatccttgagagcttttatactgagcagtgtctacttttaaccacagggctgtataagtaagtttcattctcctgttgtcaatgtaatttggaaggattcctgcctacatctattaacctaggcctagtcataaaatctactctccatacaacattatgtaggcctagtgtgttttcagcccttgaaatttgctgcttttcgagacaggatttctcagtgtagccctgactgtcctggaactcactctgtagaccaggctggcctcgaactcagaaatccatctgcctctgcctcccaagtgctgggattaaaagcatgtgacaccatgcctggcaagctccccctttcttattccttctcaatgcttaactagctgattcgatttggtttttccagctcaaactcctctccgatctgagttcttctctcagacaccgaattgttccacttggccttaaattaactgtagaaatcttttctcatcttctggctccttctctttctcctgctcattctgtctttacctgttcctagcatgttctctcttcagtctgattctgtaaaactctcagaacccaggtgcagtgtcctagtacatccagctctggtctagtctggcagcaacattgtggggaagctgtgcagagtaggtccagagaagttgtgtgaaaggcagcctgcaacagagttggaggagtggttcctgctggggagggtaggcttcatgcatgattagataagtttaagaaaaagacaaaataaaaacaaagaatcaaccaaccaatcaatgaattaagtaagcaagcaattaaaaatccaaaacaataaaaattgctatgaagaactgggaagctaattaattaaaaggtcctgcagtaggtgggcttagaagaattgcaggaagctgctgaatattgggcgggtccagaaggaggggctttgaggagccagacagaaatgacaggaagtcccgccttttcagcattctccttgtaccttggctgcctcgtggtcaggaagtcatggagggagactagtgcctagtatttgcagaacctgaaaacttccttaagctgcagttgctgtgctggcctcctaggacattcagcagctggtcctgtcgccttccaggtcagaggagctgttgggctgggaaatgggcaggagcagggcaggcttgtggagcaggggtgcattttctgtcgctactctcacaattctgttgtggttatcttaccattgtcaggaagtttgagatcctgtgatttgggttcatggtgatgttttaatcaattttatggttgccagaatatttttctaaagtatcctcgtagaaccttggctgcatctggagtttgcataccaagaggtttgtctttgcaaaagcgtttataaagctcctgtaattcaaattccttcatgctttcttaactcccctgttcctccatttgccatttcatttccctttctccagggaactgagtaggcatcctgagagagctttgtagatatttgtcatatggggaattggtgaagatttgattgaattagaaaattatgttataaagcactatcatatggctgtaaatattaacattaagctaacaacgttatagtctccgttagtttcacactgaggtatatgtagtctttgatgtaaatacagcattcagagatgcgtcttcatagtcttagttattaatgttacaccttagctttcattgaagcatgaagacaggattgcagcaatgtacaactgaggagaagatatatagtaggttctgttaaccctgagtgtcgtcagagaaaaagcaattctatgatgttggaaagctttttaaaatattacatcttgaccaagagatggactttggtcacttcctactgccggttttatatgccctgttttctgtgaggctttattattttcctaagacatgcaacctgcagagctgcaagaagatacctggttcttgggctggtggtgaggttaatttttggcatttcagcattagggagaaaacattcagagttatctctttgggtccagactgaaccagttcatcaggtggggggaagggaattgaagatgagaaggagaatagaggtcaggccaagagttaaccaggagccaagaaagcaccatcccaatccctatcttcattgatatgttaatagttaccccagttagcctttcctcctgaattctttgaatacttccaaggttcagccctgcatgatgtgagaggaagaatctaggccaagctatttttataaatagaaaacttactatggattaggacataaatagacagtacctttgaaataattatgattgctcactttcttaagaaaaatgactccttgtttcatgaaaagcactttgcccatacacattcatggtttcttgagtgtggcactctggacttcttgcaggtgtggtaatgcttagaccctgcgttcacggcttttttttcagtgatctcttgttgaagaagttcaatggtttggatcctgcgtgtcacaatagttttcttacattcttccttgttcctcagtgtttctgggaaaaggactctgtgtaaaatgtgtgactgactctagggtaaactgaaatcctcagggaaaaagagacattctcatgatatcttctctttccttcatgtttatccttttgcctggtgttggtgtctttcatttttgttacatgaaaagttccaggttctgtttgaatgatattttcccattttcgggtctccattttctcagccaaatctgcataaatataaatcaaacctaagagccctaatatggtaaaggccaaggagactctatgaagcatccaagtgtgttagaggctttgaacaaggggtggggtggggctcacctgccagtacaaagaggacatgaattggttttgccagcttctatttcattaatgattctgaaagatttcactaagaatattagacatgatgatatggatttcccatgttaggcagtgctgtcagcagtcacttcatgtcaatatttaattaattttgatgctgggaaattgctgttgcccattgaaatcaaagtttcttttacccagactgaaatcagcatcagttaatgtgtttgaaaagggccatttacacatgaagcagatgtcagtcctggattccctcccagggcctgtgaccttccttattggattttagccagattctctgtttagtctatgtatgtttctcctgaggagccggcctcagcttgaacaggaaagccttttgttacccacagatagccttgccactatgatactggcggccatgccttgcctggcagattgagattgtagcacacaggatacaaatctgggtatggccattgataactctgcctcctgccccagtttgcaaagcagtttctggacactgaatgctaccatcagagagtccatccacaatatttgttgacagagtggatggtctgatctgagttgttcttctccagaagatgcacttgctttctgaatcacgtcttcggtccagtctacacgagtttaagtccttgaattgtgttcacactgatgcagtttgttgaatttggccttattatattgtggatttcaacaaaagcttgctgacaggaggctgatatagctgtctcctgagaggctctattagtgcctgacaaatacagaagtgggtgctcacagtcatccattggacagtgcacagggtccccaatgaaagagctagtgaaattacccaaagagctgaaggggattacagccccatagtaggaacaaaaatatgaactaaccagtatatctagagctccttgagactaaaccaccaaccaaagtaaacatgtggtgcgactcgtggctctagctacatatgtagctgatgatggcctactcagttatcaatgggaggagaggtccttggtcctgtgaaaattctatgccagagtaaaggggaacaccagggctaggaagccggagagggtaggttggttgcggggggggcacttgcgtaggggatttttggagaggaaattaggaaagtggttaacatttgaaatataaatgaagaaaatatcaaataaaaaatgaaaaaaaaaggatggaataatcacttttctggactgtttggtttagtttcaagtctctttccatttgttttctgaggtgtgtttcttctcttcttacattctagaaagcttttatagtgagtggtattagattttccacaggacagtaaaactaacctttattctcctattatgattattgtctgggaggcttactgcctctgctaattaccatggcctagtcctgtaagcctctagcctctaaataatcttatgtagtcctagagtgttttcagcctctgagatttcctgctgattaagttccccctttcttgtttgttcctttcaattcctttttaaaaaaaaaaattatttttttggtttttctgacagggtttctctgtgtagagtcgtggctgccctggaactcactctgcagaccaggttggcctcgaactcagaaaagtgctgggattaaaggcatgcaccaccactacccagcctcatttcaactcttaactgtctggttcaactcagctgttcaggctcaaactactctcccagctgactcattcagcctggttctcacactgaattgctctgcttggccttaaattaactgtagcaatctttttttaaatcttctggctccttctctttctcctcctcattctgtctttacctgtgcctagcatgttctctcttcagcctgagtctgtaaaactctcccagtaaaactgtttccttctccctctctgtggctctactctctcaactgtactgtactgctgcccatgcactctactgtattcctttaccattctcttcttcctgtactgtctttctctcccttaagtagcttccccttcctctctcacctcaggaatgttgggcatatcctgttctctaagatctttctctgatatttcacattttctgccattcaattagacaacactttcaaacatgtgcacctccttctacttagtaaatgtactttcgttgtttgggattaaagcaaatcctaaaggcttgcttgtattccaaccacagtgatgaaagctgtgtgccttgtgctgaaccacaccctaagtcagaacaggcttgaatatccctacacaatagtttagtttggcagaatttcttcctgaactgaaaaccaagattcacaaataatagtcttcattatgtagatagctgtgctatctattctgacttctaccaagagtttcattgtgaacttctttgatgattggtcaatgaaaatctttttttgcgagactgtattccttagactttgcaatctagaaggtttgcgggcattatgagtggcagaaatatggttcctattgtctccattccttgtatgggaaagagctttactatgtagtacatgaggaatatttcctagttttcttatattcattcattcttcacaaaaaaatgtcttatttccaaagttctcatgaaaattttatgtcttattatttttgtgcgtattttcattagattattttctatgtaggtttttgagtaaaaaggtgtctaaacttatatcacacactatgttcaaatatatgttttaaactgtcaatacttgtagccacttttctgaatttaacattacagttgccagttattttctctcagggcttgaaaaatatgattccatgctctcctgattttaagctatggataaatatttagtactactgtatgctaatatattatcacctcttttgatggtaagggctagggcaagacagctggaaagagataaacattgttacagcacttagatgtgacaatagacagatacagatgggagtgcaggaatccaatatctgagagactttcctcgggaatgtgaggctagaatgctatggtcttctagtactcaagagtgccaatgtttgaacactgcatgttgctatttgagtttatctactttaaaacagatgtgatgaaacaagtgatagtaaactttgactggaaggctcaagcctgtggaattgtgtctattcagaatcaggtgtgtatttgaggaaatgtcagttgcaagatttaaagtcgaagccctagtgttcatattgacttcatggtggaagtaggtaaacccatgggtttttcttcccattctagaatgagctcttgttcagtctccatgaaatggaagatgtgcttttcctgttatacaattagacaaaacaattgcaggacacacatttattttatgtatttcttacttttgaatttaaagtacaacatctgtcactggagcaggaatttatggtctgttgctggtagaaatgacaacaatattcagcctgcatgtttccggtaagaatcataaagtgacatactttgaaaaatgtcctcattattccctaaaaatttatgtattcctatgcccattttttattacacacttgatgctgtctacaaatgcccagggcatcaagttttacatagtgtaaatttatgacagtaatgtatttttccctgcatctctaatttctgttttatagaaattcctgttgtcagtaaattttccatcacatgaattagagattatattcatttcatgcatattactattgttagaatattcacagaaaaacattctggtagagaatttgcattatctgatttctttggtattgagactgctggcatattgatggggccaccctcctcctcagctgcttctggcttttccccaattcaaccacaggggtccttggcttccatcccttggttgcatgctagaatctgcatctgactcagttacttgctagacttcttagagggcagccatgccaggctcctgtcataccacagtatcagtatcagtgtcatggccctgtgcctccccttccttgatctgaatcctaatttgggcctgtccatggacctcctttctctcatgttcttctcaagttttgtccctgcagttccttcaaataggaacaattctggatcaaagattatgcgtataggacagcaactccacttgatacctgtccttccactggaggtggactctacaagttccacctcaccactgtagagcactttatccaaggtctctccctctgagtcctgggagtctctcacctcctaggtctttggaacctgtgagatgaaactctgtagcctacctcctgaggctgtctatttccatttttttctactggtcctcagggtctcagtcctccccccaatccctcacaatacctgatcatgtttccccttcccctatctgtccctgctcccttcatattaatattttaacaattaggaatgatccctatgtatgataaaaatattttgtatccatggagcccagagctggagactattatgtgttcattgtaatgtgagaaaagaagatttatcctatcaatgaagtatctagatataacttttatgaggaggcaccctaattgtgaaggaatttataatacatgaaaatgctgttatccagcatcccatcaaccaagaaatctgctccagaaggaaaatgaattgtatcagattccaccattttcttaatgtaaggaataagcatgagactcagatcttaatcctcaccactgattagtcatgttcccgtactatagaatagttcatggttattaaacaagaatcattcatgactaatataaatagggttatatgttacatgtttagagatggatgaaatttgaagagaagttgttgctcctgcaaaggaacaggattagactgttagcatcacatcacgttccataaccacctagagttccagtttgtgggaatctgacctcctcttctgatgtccactgagagaaagcatgcaagcgtggcacactcatacacatacaggacgaacattcataaataagactaaacaaaataaaataaaatgaacaatttaatattaaaattgtctaaaagcagtctagaagaatagtatgacatgcttctgcatgtgtatgggaaggtctttccacaaggcataaggaattgaagaattgtttagcctaatcagttaagagtccatgtgttagctcataatggatctgcttgttggaagcttgtagagaaagcaggaagcagatctaagagaggatatagtcacagggacaagcttaagaggatgttgtttggtgctataaggtcctgaacactaatttctctctggcactcagtagctggattgacctatacgtccaacaatgatttagcattcacatgaagttttaagcagatttttatgagataaattgtaacattctaccttttaaatagcccaggtaagtttcaattgataaatcacctcacaccaagttttgcatgcaagtaaagcagaaacaagtccatcttgaaggaggagtaagttagaaagctacacttttcttctcaacagtgtgcattagacactgatatgaatggttataagtaaatatgatgacaagtttatcatattgaagaaatccatgatatttgccatttagattgactcattgcatgatgtggttttctgtagaaaagtacaacacacttaataaatacatgtactgtttctgcaggtcaaatgaaataaggtgaattctaaacatgttctatgaggtagaaatgctcccagcaattttcagataggctttaagcattctgattgctctgtctatgttgcatcatgtggtttatatcagtaagaattttctatagatgttgatgggatactgtgctgaagaatcctattcaaaagcataaaggaatatcccatttaatgactttgctcttttattttggagttataaggctctcctactccatgtttttccccttcctgtagctatggttcatgtaggttgagattctgaaaagcaatcatggtggacagatgcagagaacctaccttaggtgggaaagggtcctaaggagctaatgggagtggtgagagaatgacttgttattaatgatggatgcaagctgacagctctgtactctgtggagacaagtctctaaatagctttttgcagatgaaacctactttgcatgagctacttccttaggaattatgaatgattacaaacatttactccaggttctctcttgattattctgagtcagcattttaaaaccttagaacctttactcctagttacaaaagaaaacaaaacaaaacgaaaaaaaaaaaacagaagtacatttgttttgtttgtttgctttgttttgttcttaagtgtagcagctcctatgtatgttgcttgcatgcactttctggacatagagattattttattattactcttttcttttctctttcttcctttcttccttccttcctgtcttccttccttccctcctttcatttttttccatactctagatttattgccctccctgtccatcctctaactattccacatcccacacttcctgcccacctctctgtctccatatcccttcctcctccccaccttctaaacacactggaacctccaatctctccaggggttagatgcatgctccctgattgaacccagatccagcattcttccactgcatatgtgataggggcctcttatcagcaggtgcatgcttcctggttgatgatcgagtgtctgagaggtcttgggggttcaggttaattgagactgctggtcctcctacagggggcccttcttcctcagcttcttccagctttcccctacctcaaccacaggggtcaggatcttctgtccatatgttgggtacaaacatctgtatccaactgctcttgggtgtttcagaagtcagtcatgatagtctttgtgattgctccatagcgtcaggtataatgttaggcctaggggcctcaccttgaaaggtgacagggttggggggaatcataatctgatattgggtgggggaagaggactgaagccctctgggcccgcagaaagaatggaaacaggcaactttgggcctctttagcaactttgggatcctactttgggcctgttattggaccttcttttcctcaggctcttctccatttccatcactgtaattctttcagacaggaacaattatgggtcagaattttgactgtgggatggcaaccccatccctcactcaatgccctgtttctctgttggaggtgggctccaaaagttctttctcactactgtagagcatttaatctagggtccctccttttgggttccttgagtatctcacctcccaggtctctagtacattctggagggtcccccatctcctatttcccaaggttgcctgtttccatttattattctcacctcagggcttcagttctcttcccccacccaatatcagattatgattctccccaaccctgtcacctttttctcccatgtcagtccctccctccctcctcactttggccctttatcttgttgacctgtttgagttctgtgggctgtatcttgggttttctggacttttttatgactaatatacacttattagtgaatatatgccatggatgtccttttgggtctgagttacctctctcaggatgataatgtctagttccatccatttgcataaaaaacttaggatgtcctcattcttaatagctgagtaatattccattgtgtaaatgaaccacagtttctgtatccattttttgtcatgggacatatgggttgtttccagcttctggctatcacagataaggccattatgaatatagtggaacacatgcccctgtgacattagttgcaatttattgaacatttacattatgtatgtatgtatgtatgtatgcatgcatgcatgcatgcatgtatgagcccaccactttgctgtaggttcttaggaacattcggtattcttgcagaagacctaaatttgtttataagcacctatgtcaggtgactcaaaactacccgtaactcttaactccaagagatcccatacacacacacacacacacacacacacacacacacacacacacacacatatatttagggaagtcctagttttacagaactgaagactgaaactgctaaaagcctgctaaagaggggtaagatcaaagtttactaatatctatttagtttcatgagcctggggtttagttagttttacatccctgaagattttatagtataatgtctttcttaagagattgcctttttttttagagaaacacccttgtttttgttttgttttgttttgttttatacttatttatttgtatgtgtctttggagatattgggtatattcccaagaatggtattgcggggacttcagatctatttatttccaattttctgaggaaactccacattgatttccagagtggttgtagaggtttgcaatcccaccagcaatggaggagtgttcctctttctccgcatcctctccaacatgtgttgtcacctgaggttttgatcttagctattctgtttgctgtaaggtgtcattgtgatttgcatttgtcttatcactaaggactttgaacatttctttaagttggttttcagccattggggtgtctttagttgtgaattctcagtttagtcatacacaccattttttgattgggttgtttggttttttggtggttatcttcttaagttcttaatatattttggctattagccctctattggatatggagttagtgatttttttttcccaatctgtaggttgttgatttgccttattgactatgttgtttgccttaaagaagctctctaatttcaggaggtcccatttaccaactcttttttggtttgcttgtttttgttttttaagacagggtttctctgtatagccctggctgtcctggaactcactttgtagaccaggctggcctcgaattcagaaatccgcctgtctctgcctcccaagtgctgggattaaaggcatacaccaccaccgctccgctcaattcttgatcttagagcatgagacattcgagttctgtttaggaaatatcccctggtgcctaatgagttcaaggctttttcccactttctcttcttttaggttgtgtgtatttgattttatgttcaggtccttgattaacttggacttgggctttgtgcaaggtgacaaatatgggtctatttccatttttctacatacagacagccaaattagactagcaccatttattgaagatgcttccttttttccattgtatatttttggcttctttgtcaaaaatcacgtgtgtgtaagtatgtggttttatttctggttcttcaattccatttcattgatcaacttgtctgcctgtgtaccaataccatgctgtttttatcactatagctgtgaagacagaattagactgtgtttcctttcaggaatagcaaatgccatttacccctgagtcatctcttctttccagggatttacacttctggtacacttttatgatagagcctgaatataatcctgagttctgttttataaaaattgagtgaagaatcctaaatgatacttatatgcccaaccgctaaccatgttagagtggggggctctctgggacttttggcatagcatttgaaatgtaaattaagaaaatacctaatttaaaacaataaaataaaataaaaaaagaaaagaataggaatgaagtcaaagaaccttagatgattccttttttgtgtaatctataatcatgttagatcaatgagctcaaataataaagagaagaatattgctgaagtcaaaagtttcatattttcagttgtgccagtaatagattcatgagtaataatatatccataaaaatgaagttttagtatgatttttatacatcttaatgtggttatttccattataaaaatcattttactttatcacttttttcacatatgtcatttagttatacatgtatgtctaaccattctgcagggaatccactgtgtaagttatgaaattattatctgtattgattttgtcatatagtcaaaaacattatattatattaatgatacctattgctaactttttatttatatcattattctcaaattaattcttcattaaataatcatttaactcttcttcatgtaaaattcttataaaatcatatcacaaagtatttgattctatgtcttgtttgtaattttgtttgtatacactgactttatacttcccaactctaccatagaaagaaacgtatttttttaagtcattcttgtatttggtgttctaactctctttctttctcctagaaaggatgctccattgtatataggtcttacaatccaaactgagcatcttagactacttgttgacacccaacttcagacaagagagatacagggttcctatctgagcaaaactgacagttgtagaatttggaagcacagttttactcaccatcactttactatctgtaaactagatgtaacactggaattgttctttttatcaaaaaagtgttcataaacatatattcctggatgtagtcctcaaatatatacattacagtgtctaaattatgctgtgagtctgagtccattaactcatctaccttttactgagagaagagaacacaacatgactatgataattttagatgataccatttcttaaaatggcctcatagttctcatgacataacatacttcctgttcttgattaggtttcagaatatgacaggaattctctctctgaaaggcaaccttaaatccaaccagaatatgttttactgtaatttatttttgtctgttgctttcataaaacaccatgttcaaggaaactaatagaagaaaaagactactttgcgtaatgcttccagaggatagccatcaaccatggcagggaagactgatagaacacagccatgttgttgaagtagaaaggtgaaaaatcacatcctcaaccccagtcactaaagaggaagagagaattaagatggcttggatctatctattcttttttctcatagccaacccccagtgtcatactttattcagcaatgttccaacaactaaattcctcaaaacattgtgacccactgaggatccaattttaaaagataaaagtattatccagtaggagattgattctttcatacctatataatcagccttctaatatccttgtgctttttaaattgattttgatatcaatgtagaaaataaagctctaatttcttgtatgggtttcctgttcgtttgtttgtttgtaaaacagggtcccatactctagtcctgactttcacatgtcctgatatagagaccagaatggcttttaggtcacatccctgagagctaggatgaaagacctttcattgacgagctgatttttatttatttatttatttatttatttatttatttatttattttggctgaatgctgcatcttcatatattggccactgagttaccaccaggcttaacagagttcatttcttgtttcatttcagagtgagcattccttagatttttatatctttggataaggtgttcacgtcctgcatatgtataattattctcttacccacttgtaggaattctctggaatttcattaagtttgtttctgccttcttgaattcctgtgcttgttccctctttatgacatttgtccacattgaatggtgttcagattatgttttgacttttgtctcttgagtttgtttcataattcattttgtcatgagaattggtattggtttagtgatttaggttagggaaattttattaacattgtcaaattgctttagctacagcctctcaattttcttttgctgtgtgtcatttaggtcaggtgacagggatttccatatgaggtgttgtgaataaactttgagaatctagggtggtgggaggaactaggttacagttacagtctaaatatatcattacttactttcatgactgcactttgtcaagattcctggtatcattttgcttttaatgtttataagtgtgtgtgtgtgtgtgtgtgtgtgtgtgtgtgtgtgtgtctgtgtctgtgtgtgtgtgtgtgtgtgtgtgtgtctgtgtgtgtgtctgtgtgtgtgtctgtgtgtgtgtctgtgtgtgtgtgtgtgtgtgtgtgtctgtatgtgtctgtgtgagcgtgtgtgtgtggtttagcattgtctgtaatggtgttgtatttatttcatctttgaatcattcagaccttgatgtgaaatttcaagaagaattcaaaatttgttcttcactggaccctgggagaaggacaacaacaagaatgagtgtgtgtctggtaaatacaccacaggtcagtgtcctttccacatttctttttttaaaaaaatctctttttattcaagtcatccagaagttttaatctctatatgttgaatgttatctaaagggatttttttctatgctctatattttctcttgtaataatgagaatttaattttttccctttcatgcatataatgactttatattttaacttgatttttatattgtgagaatatataattcccttggactagagatctgcatgtctcaaataggatctattacaatgatgctcagagaacagattgatggatattttctatgttgaataagttctgtccttttgtattagtgtgaggtgaggtctcttgtgccacatgaattgcatttcagggatggtcaggtttctgaacagaagcttgtgaatgagggtatagaaataagtataaattcacatcactaaagaagatatgaaagagtagaatttctagaatgtaaaattataagagatccactgtcttgaatcctaatagtaaatgtattattagctccctagggtcacagatgatggaaggaaaatatctttcttttaccattagtgtgattgtgagctgatacagatttcaatattctgacaacacttttttcacacctcatgtcacacagtaatcacagttgactcctgaaatctatttgtctcaagagagatactgtccctgtggaaaattcacaatatatagatatttatccctccttttggtttcagaaataattttaagtcctgttttcttcgcctttgtatttcatcacatgaactatattagtaagatttttctagagaggatagctatggtgctgtgaataaaccattaattttcaaaaagaaatgaatttcctttattattttttgtctttttctttagaagggaaaggcttgaatcagtctatgctaatcctcttcagccaagctgtgcattacatagtgaaaaatgaagggttgtggcaatgttcctatttttcattacaatactattttctttaagtccataagtgtttatctgaaggtttttacgtacactgaatgatacattatgcccctaaaaccatgagaacagcaccaaaccgtggggactgaattcagacataatagtgagctgcaatatatttagagagaattagattagtttttaaagtagaaacagcacgtacctttcccctttagtcatttgttcatggcacaggttttgcatttttgaggcatatttgcaataaagacagtatattgtctgtatattataatttttgataaacaaaagaagaatgatagatcacacttctctatgaaaagtgtaattatgatatacatatggtcaaattctgaagaaaaaagttataattagaagactgaaattttcagttaggttaatacaatgaggaataatttattaaattttaatgaatatttagtataattctccctcaatttaaaaacacagtttgttcaaaaattattttacttcattggaatgcattgccacatatgatatttgcttatacatgcatatctaatcattttatagtgaaagaccataaggtattaatgaaattgttattaagcatatttatttatgtctccacaggagctaattaagagtcaaagatgtggctctgcagttaaggtctcttcttcttgcagtattcagattcagttttctgtacctgcctggggacttcttttccttccagaactcttttttttgagaatatgttttaccattgcctgcatttctcatatgaacagagctacgtgccagcaaaaataacatttcatatgaaattaaagtcaataaacattattttaaaattataaatgatctggaaatattacataggacgcaagaaaccatccaggaaagagaatgagaggaaatgtgaagcctgaatgagtttcagtactgctgaccccccatatcaacattttaacaattaggaatgatccctttgtatgataaaaatattttgtatctgtggaacacagagatggagactcttatgtgttcattgtaatgtgggaaaagatttatcctatcaatgctgtatttaggtattaacttttctgaggaggcaccgtaattgtgaaggaatttatgatacatgaaaatgctgttgtccagcatcccatcaaacaagaaatctgctccagaaggaaaatgaattatatcagattccaccattttttaaaatactttatttatttattatatgtaagtgcactgtagatgtcttcagacactccagaagagggcatcagatttcgtatggatggttgtgagcctccatgtggttaaataattttaaagctctctaaaactgtttatttctattttatggttttgaatacattgtcgtaaaataatttccaaaagcatttgattttctgtgtcatatggaacgttcagtggatgccctgatgttgcagttttattgtgtttaaagaaaaaaacttagtcgttttgtcaatccattatttctgcattttgttttctacctgtttcttctagaacatgtgcagcattgaacttaggcctcagattgtcaaatggacatgttgtaatacaaatgtgagacacagctgcacataagactaagctagtgtccatatttgaacaaagtggacattgtaaaatttgaaagcatattttttatcataacttgactatctctaatgggacactgggattcagtttgatatcaacccatatttcataaaggtacattactggatttagacatcaaaagtacatgttatattctataaatgtttactgcttttgaaattatatcatgcattctcagtgaaaaagaaatataaggaagtctattagtagtttaaaaaatttctttgaataaagttaatgtttatttttcttcgatatatgttgcttaaatttgcctgaatgtatgcatgtgtgctatgtattcctcctgtcagtagtgttcagaagagatcattggattttaaagaactgggtttaacaatctactgtttagtgccatgtgggtgctgggaatcaaatttggtaataaatgacattaaaagacagtatacagggctggagatatggctcagcggttaagagcactgactgctcttccgaaggtcctgagttcaaattctggcaaccacatagtgggtcacaactatctgtaatgaaatctaatgccctcttctggcatgtccaaagacaattacagtgtgcttagatataatgataaataaatctttaaaaaaagacagtatacaatccaaactgcacaccaaaatttttgaaaagaatgatgatagcaaatctttcatttgctgtgaacgtctatgtaaatcacagaaaattcttgaagatgagagcctttctcttctcttctcttctcttctcttctcttctcttctcttctcttctcttctcttctcttctcttctcttttcttttctttgtatttatttagagagcctttctaaatgcgagcattataataagtcattctgtagattgtcagtggaagagcagccattcgtatcttcagacacatctcaataacactttcagaaaacatttatccttcaatattttccttcctcatctgcatcaaaaaaggaaatctttttgttgttgttgttttgggtttttttgttttgttttgtttttctgagacagggtttctctgtgcagccctggctatcctatcctggaactcactctgtagaccaggctggccttgcactcagaaatctgcctgcctctgcctcccaagtgctgagattaaaggcgtttgccaccacacacagcaaaaaaaggatatctttttttttttaaagatttatttattattatatgtaagtacactgttgctgtcttcagacacaccagaaaagggagtcagatcatgttacagatggttgtaagccaccatgtggttgctgggatttgaactctggaccttcggaagagcagtcgggtgctcttacctactgagccatctcaccagcccccaaaaaaggatatcttaattacttctttttttaagtagaaaaacatttttgtccagtatcaagtaggtagttttccattacagggtctgttaactttcaaggacgtggccttggacttctcactggaggaatgggaatgtctcagttttgctcagaggtcattgtacatggatgtgatgttggagaattacaacaatctgttgtttgtgggtaagaatgaacttcttgttgaattccttttactttctttgagtgttcctactatgtgcttatgtaaatgctctgagatatccagagactcctgaatgagggaaattctagttaaaatcataactttttcattgtgtttcctttacatttctctgctttcttttgaaaagtaaccaatgctatattctctgaggtcactccttatctcttatctagcttcagtgaacttaaaaaagttcaagaaaaaatttaaatatccagaacaagaaattatatttctgtacatataatagttgcaattataaaaatcttactattgcattaaaatgtatccttatttatgaatgtaacaatatacaaggtttcaagtggatatagagctgttggtttgggcaattttttttctttatttaactttttgacatttgatctctgtgtttagatctgggacaacataatctttaccctagcattttggatgttgaaacaaatctatttagtgatttccctgacactatgggctatatcataaatttatacctgagcaaaattatatcagattcagtgtcactctgaatcaaattgtaatcataaaattagagatattttgtttagagttctactttcgggaaattcactacagatggatcatttatttgtccagcttatgcaaagtacaattttcttttttattggtctttttttttttacatgtcaaatgttatgccccttctccattccctgtctgtaagctctatatcccacccctccccctgtttttttgatgatgctcccaccaccaatccatctactcccacctcatgcccctaggattctcctatgcggggatactgaaccttcacagtaccaagggactcccctcctgttgatgccacataaggcaatcctctggtatatataaagctagagccatttgtacttccatgtgtactctttattttgtgatttgacccttgagagctttgtgggtcttgatattgttgttcctcctacacagttgcaaagcccttcagcttcttcaggccttcccttaactccttcattgtggtccccttgctcagttcaatggttggctgcaaggatctgcatctctttgggccagtctctggatagccttcccttcagcctgtttttcattcttttttgttttcttttttttattaggtaatttcttcatttacatttgcaatgttatcccgaaagtcccccatatcctccccacctcactcccctacccacccactcccacttcttggtcctggtgttcccctgtactgaggcatataaagtttgcatgaccaaggggcctctcttcccaatgatggccaactaggccatcttctgctacagatgtagctagagacacgagacacgagtggtactggctagttcatattgttgttccacctatagggttgcagatccctttagctccttgggtactttctctagctcctccattgggtgccctgtgatccatccaatagctgactgtgagcatccacttctgtgtttgctaggcctcaacatagtctcacaagagacagctatatcagggtcctttcagcaaaatcttgctagtatatgcaatggtgtcagtgtttggagactgattatgggatggatccccagatatgacagtctcagctccaaactttgtctctgtaactccttccatgggagtttttttcccaattctaagaaggggcaaagtgtccatactttggtcttcgttcttcttgagtgtcatgtgtttcacaaattgtatgatatatcttgggtattctaagtttctgggctaatatccacttatcagtgagtacacatcatgtcacttcttttggagcaattctgggttattatatttgaggtggtatgatgtctaatttgaaaataacatttagcagggtattatcatttccagtcatttgatatagatcatatttgaggttcttctgaggatacatgtaatgattcacagagagagagagagagagagagagagagagagagagagagagagagagagagaaacctttcttgagagtacgaatccataagctcactgattattgagtcccttactccttatataagtaattcatgtcacctctaattgccccccccttttttttcagaaaatcattgcatacgtggaaagaatgggaaggtattggatcaagacagccagtacattgtccatgaacacatgaatattcaagagaagtcttctaaatgggacaagcttagcaatgtcattcttgaatccctccagtgtacaccttacaaaactaatcacagctctgatgctcttcaattctcgaaccaaaaaagacttaagcccaggaacactaaagaagtttgcaaatacaatgactctgtaaacagtttaagtttgttttctaccattagtctcaatcaaggaattaacatgcagaagaaaaaacacaaccgaaatgcagaattagacaatatttttgtttctaaacataaagtcatggtgaaaaaagacaatattgcagggaacccttacaaatgtagtgaatttcacaaatatcttacccagagagaaaacctacaaagtcagcagagaatttatcatggaaagaaaccttacaaaagtagtaaaagtgacaaatgctttacccatcagatccatcttagtattcatcagggaattcatacagaagagataatttacaaatgtagtgaatgtgacaaatgttttaaaaacaaattcaatcttactatgcatcagagaattcatacaggagagaaaccttacaaatgcagtgaatgtggcaaatgctttactgaaaaaagcagtctgagaattcatcagagaattcatacaggagagaaaccttacaaatgcagtgaatgtgacaaatgctttaccaaacaatccaatcttagtattcatcagagaattcatacaggagagaaaccttacaaatgcagtgaatgtgacaaatgctttacccaacaatcctgtcttagtattcatcagagaattcatacaggagagaaaccttacaaatgcagtgaatgtggcaaatgctttactgaaaaaagcagtctgagaattcatcagagaattcatacaggagagaaaacttacaaatgcagtgaatgtgacaaatgctttacccgaaaattccatcttggtattcatcagagaattcatacaggagagaaaccttacaaatgcagtgaatgtgacaaatgctttacccaacaatccaatcttactattcatcagagaattcatacaggagagaaaccttacaaatgccctgaatgtggcaaatgctttactgaaaaaagcagtctgagaattcatcagagaattcatacaggagagaaaccttacaaatgcagtgaatgtggcaaatgctttactgaaaaaagcagtctgagaattcatcagagaattcatacaggagagaaaccttacaaatgcaatgaatgtggcaaatgctttactgaaaaaagcagtctgagaattcatcagagaattcatacaggagagaaaccttacaaatgcagtgaatgtggcaaatgctttactgtaaaaagcagtctgagaattcatcagagaattcatacaggagagaaaccttacaaatgcagtgaatgtgacaaatgctttaccaaacaatccaatcttagtattcatcagagaattcatacaggagagaaaccttacaaatgcagtgaatgtgaaaaatgcttttcccgaaaattacatcttggtattcatcagagaattcatacaggagagagaccttacaaatgcagtgaatgtgaaaaatgcttttcccgaaaattccatcttggtattcatcagagaattcatacaggaaagaaaccttacaaatagattgtatgtgacaaatacaatactcacaatgtcagtcttagaaatcatcagttatttcatacagtagagaatctttataaatgaagtaaatgaggcaattctttaccaagatatattatctcaaaattcattagagaatacttagagaagacaaacttttcaaatatattgtaggtatgaatcctttccttttggcctatttcctagactgtaacagtgaatacttacaggctagaaacttaactcatgcattgtatgaagaaatatctttgacttcatttcaggtcagagagaacatctaagaactttttagggtaaagtatttctgttggggaaaatggtgtattcttgacaacacttgaggctccacactagagaattagtatgattatgaaaatcttgtgaaaatattcatgcaatgttcaaatcttaggtaatgtcaactatttatgctgtgagaaactctgaaaatgtgaaatgtagaaagcttttcatgacacctttttacttgttcatcctcaaacgttaccagatgaagacaagttgggaagtcagaagatagtattttataacactttaatcgagaaagaaataatccatttcaaaaggaaactatttaaggtctttaatacaaccctcaaaataggtaataaaactggtagcattttgtatatttttattgtcctgtaactaactccaataaaactgaaagattcaacaaatttgctttggttgtttccaatttgcagttgggatactcagatgaatatatgttgcatcttcccaggaaatgcctcacataaaacatagactgaagtcatgaacatttttgcaaacctgtatcataaagttaatagtggtgatttttaactggtggataacaatacctttgggatgtaacgaccctgtcacagtggttgcttaacagcataggaaaacacatatttccaattgtcttaaaattaagaaatcattcattgaagtgtagggtagtctgcccaccctaaaataatttgaattcaatgtcagtatttagcattaaaaagttaaaaatactgttttacatatggtgctttgtgttaactaaaataagtaagattcagttcaatgttccaggcaagtattactaggctaagataaaaagaaacagaaaatacgtagaagctttcagagcctcagcaacaagtctgctctctcttgagttcaaggaagtatgaaagaaaaatctacaaaaaataaatgaaaacatggctacatagatttcaaggatagctatccagactttgctgtgtctctgcatgattctgaagtcattaattcccatttattgaacaaaagtcctataagtctcagaaaaatgctgaccgttgggctggtgagatggctcagtggttaagagcaccgactgttcttctgaaagtcctaagttcaaatcccagcaaccacatggtggctcacaaccgcctgtaatgagatctgatgccctcttctggtgtgtcagaagacaactacagtatacttatgtatagtaaataaatctttgaaaaaaatctttttaaaaaaaatgctgactgttgacacatattacaagacattgtggtgtctggtcctgttgtgccttaatattccactctaccgtaaggaatgaaatagatttccattcttttcttaaatcatctacagaatgctaatattttgcacatctcagaatatacattctgaacaaaaactcaacaactcactactaaggtattatcttcatcttaatttcatgtatgagttcattcatacaaatatcatgaatctgtaaatcttagatgaggtgcatactcatgcactgtttagaaatccaaccatcctggagatacattgggaagtactgaaagaagtacttttactccgagttcaatatgatattagaatatttatcctaaattcaagaagtttcagtaaattaggatctaagaaaaaaatcaaatggtacaatgaacaaatctatatcactcatatattttccttgactttaaaaaaataacaaggaaattgttcagcttgtgtcaaaataatgaatgataacatttcattggtctcaatattggaatttgatgaaacaggacctcctcattagtagaatctaagtatgagaagaagcaatagtggcccttcatttcaaatgatcataggtattttctgccaatagcttcatcagggatgttgaaacttacataccaggcaaatgaaaaataagtggcttgagtagctcttaccagtctggaaattgcaaccagttggacagtctctcttgattctcattgcacatgttcagtggatttaggactcaccgcttaataatgactgagagattattacccaaatctgaagtaacttccaggttccaggtggaaaaatttctagaagtacacaatgaagacacatcttaccttgtacccctcacacaatattcattctatagccatttatacacacacttcttgtctatggtaccgcaagcatatggtgatgattgacaaaataagtccaggtagactcactgtttgagttatgtggaagacagcatgtgtagattgataaagatgcaagtccttggttcaggataattaaccatatcatgtttgaagaacatggagactaaagctcactggatttagaacattaactatttgtggaagagcattgtaaaatgtttaacaagagccacactataggagcctgatgggcatttctagaagaacttccagtggctagattttaagtaacccactaggtctatgtcagtaccttccagggaaaggaaacttctcttcagctttaggacaactgatgggacagcctgaggatgggaaacacatggagtaggtggaaagagttattccttggttgaaagtaattttattacaggagaactcagaagacggactgagggcctgaaggaagagagtgggatcagcagcccatccttgtcagtaggagtctggagctgcatgttgtggaactaggactagagaacactgcctgggttctcacagccatgtaaaaattcccttcctctttagttgtccccaagttaagtcttgtggaaattttcagtcaccagagcagtggcaggaactgcaaacaagaagacttggacactccaaggtcaaagaagctgctaggctagtggaaagacaggcactggaccatgattgaaaccccttactctgctgctcataagaacactgatcctcaaatcctagtgtgcatttcataactgtgttgttaaattgctgaccatgtaagtgtaacttttcctgatttttttattcatcttattgttgtctggatacttacataataatttctgagacgatgggcttgttggttgcaaacatggttatatttctcttggagcaggtttaaaattggtacaattcatatccatccattgtttgtaacgctgctattttacgactgtgctagtcaagatctttgccattggagattatgcatccactgggaggtttaaatattagtcccataaggaccactggatatgtcattgaaccttaagcaatatttagcactttttaaagttttagctgtctttagatttatcatactataaacatttattttttatttttattttttatttttccaattttttagtaggtatgttcttcattaacatttctaatgctatcctgaaaatcccctataccctaccccgctgctaccctaccctcccactcgcactttttggccttggatttcccctgcactgggtcatataaagtttgcaagaccaagggtcctctcttcccaatgatggccaactaggccatcttctgctacagatgcagctagagacacgggctctgggggtaatggttagttcatattgttgttccacctatagagttgcagaccccttcagatccttaggtacttttactagctcctccattgagggccctgtgttccatccaattgctgactgtgaccatccacttttgtgtttgccaggcactggcataggctcataagagaaagctatatctgggtcctttcagcaaaatcttgctggtgtatacaatggtgtctgtgtttggttgctgattatggaatggatccccaggttcagcagtctctggatggtccttccttttgtcttagctccaaactttgtctctgtaactccttccatgggtgttttttcccaattcgaagaaggggcgaagtatctacacgttggtctttgttcttcttgtgtttcatgtgttttgcaaattgtatcttgggtattctaagtttctggctaatatccacttagcagtgactacacatcatgtgagttcttttgtgattaggttacctcactctggatgataccctccagatccatccatttgcctaggaatttcataaattcatcgtttcttattgctgagtagtacttcattgtataaatgtaccaacttttctgtattcattcctctgttgagggacatctgggttctttccagcttctggctattaaaaataagggtgctatgaacatagtggaaaatgtgttcttattaccagttagaacatcttctggatatatgcccaggagaggtattactggatcctccggtagtactatgtccaattttccgaggaactgccagattgatttccagagtggttgtacaagcttgcaattcctccaacaatggatgagtgttcctctttttccaccctctccagcatctgctgtcacctgaatttttgatcttagccattctgactggtgtaaagtggaatctcagggttgttttgatttgcatttctctgatgattatggatgttgaacatgtttctaggtgcttctcagccattcaatattcctcaattgagaattgtttgtttagctctctgtcccattttttaatggggttatttgactttctggagtcctccttcttgattcctttatatatgttggatattagtcccctatctgatttaggaatggtaaagatcctttcccagtctgttggtgacctttttgtcttatttacagtgtcttttgccttacagaagctttgcaattttatgaggtcccgtttgtcaattcatgatcttacagcacaagcggttatagttggtcatgagacactgtgtgtacctatatacaaacttttgtcccctgaagagcagccagtgctcttaaccaccaatccatctctccagctcctagttcctctctttaaaatgtggctggcaaaaagcattcttgcttcaagtggtggagggttaaataaaaacttttatttataaagcatttggaaaagtgcctggtgtctcttcgtgatgctcaggagcaactgcattattagctgtaaggtgggttctgagcgccacagactgcacacagctggcgctttgtaaattaaggctggggtcagtgaccccagaatcctggaccacagtcattttttgcctccttgtgtttcaagagagggtctcatgtagctcaggctggttttcctcaaagtgactatgttacagaggatgagcctgactgtttcatccttctgcttccacctcacaaatgctgaggggactaaaagtgtgtgcctcctcaacgtgtgacatgggtctgagctctgaatgcaaggtttgtggtaccaggctagcacagtttcagcctgagtcactactctccttttagaggtttattcttaatttattcaaaacattttattttatgtataagggtgttttcacttacatgtgtgtttgtgccctaccgcatgcatgcctggtgcccaccgaggttagaagaggacattgtacttcctggaactagagtttcagttctgatccaccatgtgagtcctgggaattcaatctggtcctccacaagggcagcagagtgtttttaattactgagctgcctccccaagcctctaaatcacttcttaaaatgcaggaatgtatataaactcactggcagcatatccttggcaatctcactaaaactatgatgtagctctaaatgtcacacagaaggagcaatgaaaagtacgtacaaaaaaaaaaaaaaaagactggagcgggacacttagagctagcttcaaagcacaaggccctctcctggcctctgcaggtacctgtacttgtgtatgtgtgtgtgtgtgtgtgtatttgtggcatgtacacatttgtatgcatatacatatgtgtgtggtatgtttgtgtgcatttacatgtgtatgtgcagtgtgtacagtgtatgtttgcatgtgtattagcagtgtggtgtgcatgtgtgcatgtatgtttctgtgtgtaggtatattatgtgcagcatgtgtgtgtgtatgcgtacatgcgtgtatgtgtccctgtgtatataacaaaggtaaccaaaaaatcttttttaaaaattagttaggctggagatatggctcagtgggtgggagcactgacagttctgcaagaggttctgagttcaagttcagcaaccgaatggtggctcacaaccatttgtattgggatctgatatcctcttatggtgtatctgaagagagtgacagtgcacacagatacataaaataaataaatctttaaaaagctgagtcaaaataaatcctatctcaaaaataaaaagttgttttggctctattggtaaagaacctgacaaagcctgactgcctgaggtttggatcctcagaacctacataaaaggctggacccaggctggagggttggcccactggttaagagcacctgtttctcctgcagagaacctgggtcaactctctgcactcgcatgactgttcacaacgggggatatgatggccttttctgacctcctaacaaacctgcacacgtacaggtaaaacacattcataaactttaaaaaacaaaagaaaaaggaaaaagaaaaaagaaagaaaaatttgaaacctggacacagacacatgcgcacgcgtgtgtgtgtgtgtgtgtgtgtgtgtgatctgagtgtttgctctcactctgggactgagaaagcacagccctccagcagtcagggcagatctgattggcaaacaccactaaatgtcagcaatgtaatcaccacatgatcaaaatcgatgacactgttctaaagggtttttctcttcaaagacatagggtgcaagtttataaaataactcatgtcaaacatttaataactttattaagaaggctgaggcaagaggatgacaagtttgatgccagctaccattaacatagcaaaaactttctcttaaaaaacaagggtctgaggatatgactcagtggttagagcaccggctgatttaccagaggacctgggtttggttcctagcacccacaaggtcatgcacatttccacggaatctggtgccctcttctggtctctgtgagtacagcatgcacatggtgcacaggcacatgcaggcaaaacacccatacacacaaaaaagaaaataaaaagtaaattcgttaaattgggcatggtgatacatgtctgtaaaaataaatacagattgacaatgtgttcagcatgcaatgtatacttcttaaataacacaacaccatacatgattttaaaccacagaatgagagactggagagacagctcaatgtttaagaacacttgctgctttgcaaaggaccttggttcgacttccagtatccacacagctccggctccaagagatgtgatgctcttctgacctctgtggacaccagacattcacatggtgcacatatgcaaaataaaactataaaaaatatttagctaagtaaaatgtaaagattggggaaaaaaggaaatctaggcaaaaagttattaccccacaaagactgctcaatgtttcttaagcctcttcaggggaatggaaggaactaagaattgccggagtgatgtgaaacaggcatttgaataaacggacataagtgaacatgcagagccttggttcccaagcctaccacaccactctatcctgagcagtgttcatgtagtccatgtgtgctcagtctctgctgcgtgtgtctagacagtatctgcctatctgcacaaggcacagcacataatgatgcaattaggtttagcatttctccctttgaccagaaacatggctgtactggttagttttgtgtcaacttgacacagctggagttatcacagagaaaggaccttcagttgaagaaatgcctccatgagatccaactgtaaggcattttctcaattagtgatcaagggggaaaggccccttgtgggtgggaccatctctggactggcagtcttgggttctataagagagcaggctgagcaagccagaggaggcaagctagtaaggaacatccctccatggcctctgcatcagcccctgcttcctgacctgcttgagttccagacctgacttcctttggtgatgaacagcagcatggaagtgtaagccgaataaaccctttcctccccaacttgcttcttggtcatgatgtttgtgcaggaatagagaccctgactaagacaaattggtaccagcagagtggggtattcctgtgacaacctgaccatgttttggggaggactgtgggaggactttggaactttgggcttgaagatccatctgttgttaagagctctgttggatgttgtgtaggaacttggaagataatgttgagaacactgcagaagatggaggtctggtttgtgaaatttcagagggaaaattaaagactcttttcagggccattgctgttttgattgtgaagattctgtagttctggttagctggggctgaagaatcagctgtgattaacaagataccagaactactgaagcaaaaactttgcattactgggactattgatgctggttagctggagctaagaaattagcagtgattaagaagagaccagcatcattgaggtgacatcttctgggaagtgttttctgaaagcacaaagaggctgtgttccagagatggccaaggttgtactcctgctgcagcgggacttggtaatatgtaagggtcacccagatggtactggttttgaaggcatgaagcggccacgcaaagcagctgaggcttggcactgtgaaaggccatggaaggccattggtgaaggtgtagcctcagttgcaattgaaggcccaggactgaaggggtcacgcagtgttttggagatgccagtaccatgagatgaccaccaagagcagcagcagcagtggagtacaggcatctggagcctagaggacgacgcctgtgctacaaagggcatggctggagaactgacccaagcccttggaggagcccagaagatcgtgagttggatcccagacattggacagttggagattgatttttttgcttttgattgtgactgtgccctgatattttccctcttgaaggaagaaactgttttagtggagcccacagttaagagacttttaattgtaaaaagactttgaattttaaaagagatggatattttaaagagattgaaattttaagaatatgtaaagactatgggacttttaaagttgtttggatcttgggatgagtaagaatgtaagggttgaggcttactagtgatttgtttgtgtgtcaagttgacaaggggtcaattgtactgtttagttttgtgtcaacttgatacagctggagttatcacagagaaaggaccttcagttgaagaaatgcctccatgagatccaactgtaaggcatttttcaattagtgattaagggggaaaggccccttgtgggtgggaccatctctggactggcagtcttgggttctataagagagcaggctgagcaagccagaggaggcaagctagtaaggaacatccctccatgcatcagctcctgcttcctgacctgcttgagttccagacctgacttcctttggtgatgaacagcagcatggaagtgtaagctgaataaaccctttcctccccaacttgcttcttggtcatgatgtttgtgcaggaatagagaccctgactaagacaatggctgactgtcagctacctcaactactacaagaagaacatgtggtgtctggagccacaacagctctaggctaccagaacacttcctgagaagtcctttcatccagccagacttaagttgctccctctccaggccaggcttgtgtacagtgcacagcttggccttcgtacctgcaaaccacagcagtgaaactttatccagtacaatggtgtgtgtgtggtggtggtggtggtgggaggtccaccagcaccatgttatcattctcggtggttatcccgtggtaggtgggctctagccatggcttgtgcttgttaactgcattgggagaaaaagggaaaaaaacagtaagattcagatcactgcttcagtgttctgctgtctttgaagatgatcatgtgttatctggcttctgcgcaagtgaacacacttacaggaaagcaaagccaggcacataaatggaggagagcaaagagactgatcatctgaaaagggcaaactgtggtttgattatgggagtgccccatgtaaaatctaacccagatcatgaagacagaaattgactcgttccctccacaagacactcctgggacatgagctctgacagagcagcctcaggagggacagcactctcacccttagtccccacaggggcagcatggggtgacacaatagcagggatgactgtgggcattgacagaatctggtaaagctcacagcagcaagggccggtcttcatcaaagggttcatggaacaaaaggcacctcaactatgccatgggagatgggcaactcatccactgctgagaccccaatatattttatatgaaccacactaagaaggaagctgtgacaactcagggaattagcccgaggcaaactgctcacaaacaatgaagtctcagacacatctcaccatgctctagttttagggttctctctgtctctgtctgtttgtctctatccctttctctgtgtgtgtctctgtctttctgtctctttctctctgtctctctctgtgtttctgtctctgtctctctccctctctctctttaaggtaaaaaccctagtctggcttcaaatttaaacttcctgcttctgcctcccaaactgctgggatcacagctgcataccactgaatcctactacaatcactcattttacaaggcaaactattaatttgttttgaaactaatagcaacatttgatacaaccttgtatcaatgctttgttttactaataaaattacaagcataataaaataaaactgaattttattccaacatttgagtccatgagactcttagtttaacatgatgtcactttgatttttccagaaccacagggatataaaaatagtaagcatagtgaagtgtggggcacctgcactgtcctaacacagaatgggaaggcccactgtaatagaaaggctacagctgaaaatggttaagaaatttcagaggagaaaataactttatggtgattcatttcaccaccactctgggattccaattttgtaattcacagtttctcaattgtgcctttaagctggcagtataaggagagagatcaccatttccagaggctgaacttttcaataattaatgaatgatatttttaatatttcatcacattcagtttacattattgtcttagtcagggtttctattcctgcacaaacatcatgaccaagaagcagttggggaggaaagggtttattcagcttaaattcccacattgatgttcatcactgaaagaagtcaggactggaactcaagcaggtcagggagcagcagctgatgcagaagccatggagggatgttctttgctggcttgctcagcctgctctcttaatagaaccaagactaccagcccagagatgatcccacccacaaggggcctgaaacccttgatcactaattgagaaaatgccccacaactggatctcatggagacatttcctcaactgaagctcctttctctgtgataactccagctgtgtcaagttgacaccaaactagccagtacaattatgaaacatttatagaaacaagtgactgatatttctgtaaccatcctctctctaaccaccagaagattatgggctgaaagtcaaggaccccattggccatctcaaagccctagggcctcactccactgcatgccagaacatcaaagccagctacattcctaacagcaaacctagcgatcacacctgttagagtgtgggttttctggggttactctcaggcaaaaatgatctttgtgactacagttcttaatgactagaaacttgaatttagaatctatgaatgccaggcggcagtggtacatgccttaatcccaatagttgtagcctggtctacagagcaagttcactcaagaaaaccttgtctcagaaaaaaacaaacaaacaaacaaaacaatcagtaagaacagtgaacctcagggttaacttcaaacaagaaagtttatcccagcccatcctaattttgtgagctgaagaaggctgttcttctgcccaagtcacatgaccaagagattctgccaggttattttcagatccactatgtgccacagagtccctgacaccaatcactcacgacatgtcttccttcttctgctgctttataccttttatgtgtagaaatccattggctgaaataaagaaattcacatatgcttcctatatcagaacacctatgctggccatactgtaagttttgaccagctgtaatgcatttcgactataagtgaacctataaaatgcaagactgaatcttggtccatcaaaaggctctgaagtcctgggatagcgccaccaggtggcagcaggtgcttgtgtgtgcatgcttgaaattatgctttgattaaaaaataacctctagcccaacccctggctactaaaggagtatcagcagcccgagttgagatgctaagggtagaaaagtaccagcgaatatgttctaaattcctatttaggcatagtgtcacatgcacacagtcttctggaaactcaggaggcaagaggatcacaagttccagggtagcaagggcttggaagtgagactagtcaaaaataagtgagtacatgtaaagtctctagctgactctttctttccccaaatacactggaacagggcaggggctggagagtcagctcagcggttaggagcatttgctgttcttgcagagtacctaggtttagttctcagcacccacatggtggctcatcctctgcgtgggcaccaggcatacacatggtgtgcagaatgcatgcaggcaacacacacacacacacacacagacacaaacacaaatatatatatccaaaaaaaacacagctgaacactaaaacaggttggtataatttggagagcgagtgtccccttaaggcctggacgctctaacttgctcaacagcctgtggtaccattgtgaagtggcagaaccttcaggagttgggactagatggtaatttgggcatgtggtctggaacagaatggttgccccactccctctgtgtcctcagggtttcctctctgcatcccaacccccgtgtgtgaggggtcacttcagatatcctgctgatgtatcagttatttacagtacgtttcataacaaacagtaaaattacagttatgagggagcaactaaagttttagggctgtaagtcaccaaaccatgaggaactgtattaaagggtgacagtattaagattgaaaaccacagccctagaaggtcaacagcctccaggacatgccccaggcagtgatatactcagcaagacccagaaacaagtgacaatggactgcagaccacaactttgaacctatatgccagtgctcttttccttatttagggtgattttctcacacaattttcacagcaacagaaagctgacagaagtggggctggagagatggcttagcagttaagagcactgactgttcttccaaatgtactgagttcaaatcccagcaaccacatgatggctcacaactgtccataacaagatctaactctctcttctcgagtgtctgaagacagctacagtatacttacatataatgaataaataaatcttttttaaaaattaaaaaaaaataaagagagctgacagaaggatgtctgcagagatccaaactggaaaggcccactcttggggctggagatggctcagccataaggttcaagtattgcttttgcagagaacccaagtttggtttgaagcattttctgtcccaacacatacccacatacaaaaacacacagagacatagtttaaaataataaaaagcaaacctttataaagaagagacattctcaggccaacacagtttagcagatagaagcacttgctgccaagcctgacagcctgagtctcagctcaggaacccacagtgaaagaggggaccaaccccagcaagctatcctttgacctccacatgcccactggggtgcgtactcccacgcacttgcacacacgcacattaataataaccttaagtataaaatgtaaaaatgaaaaagagactgggctggagagatagctcagcagttaagagcactgactgctcttccagaggtcctgatgtcaattccattatctgtaatgggatatgatgccctcttctcgagtgtctgaagacagcaagagtgtactcatatatatatatatatatatatatatatatatatatatatatatatataaatataatttgggtagaacccaaacatcaactctaaatgcactccaaaccacgtgagctctgctcatcagtgcctctgtcaccagtgtggtagtgagcctgcagcccagtgaggaccaacacacagaggcagctgccaacacaaacgtgcctgctccaatgccaaggtaaagcagaacaaagcatgatctctccctccagagaagcactggctgtgggtttgtggctagcctgatctgaccgtgagctccaggccagccagaatggcacagtgaattctgggattaaaggcaaatactgccacaccagaactaaaacattagaaaaagcaggaggtcagaagaaacatgagccctggagtaggaatggatggggtagtggcagcattctgctcagcctggtggaactgcatggagtagggtgtgcagggaagggtgccagctcttttccttctttttctttctgcagaggtggtttggtacccggggtttcatggatggtaggcagtgctgggagtgagtgatgaggtggttactgaggtaaccaccacagacctgagggctggcagccctaagacacatataaataaaaaataataaacattaagaagacttaagccaggtgttactcatgatgatattttaaatccatgtatttatgcatggctcatgtaatactttttgaataaacaaatgtagagatggttggtaatgtcacctgagatctctaatactggaaggagggagatagctcagtaggtaatgccattgctgtacaagtgaaagacccacaacgtgaggactcccccatgttctgactcaggataggtgacaccccaaatcactcatgagaaacgttcttgatgcaaactgcaagaggtatattagaaaggcaaaacccacaaacacctggcaaaaactgcaaacacttggcagcctggaacaatggggcaagttctactccctgccattaataaggcctcttttggacacagttctagttcttaaataatttttcactctctctcaggatcttgcaatccccactctttctagtaaatagttctaatcttagaactagacacagttttctaacacacatggaaaagcagaagcataatacgagggcctttccactgaatctcaaggttttctgtgcggtggtgtctaatgtagagcgaatctctatcttggaagcagtgtggggctttcacgtctcctttcagagcagcatttacaattagctcctagcagggcttctcaagccacactagacttctaactacaggtgcagggctccaaagaccaattgatcctgtctgttttttctctttcaccaaattatccccagatagtcggagagtactgctttttcaaacccgtttcctcagggtacaaagcacctatgagaattactttcgcttctctagattttcacataggtctaaacacatacacaaaaacacacaaacagccggtcgtggtggcgcatgcctttaatcccagcacttgggaggcagaggcaggcggatttctgagttcgaggccagcctggtctacaaagtgagttccaggacagccagggctatatagagaaaccctgtctcgaaaaaccaaaaaaaaaaaaaaaaaaaaaagagagagagagagagagagagagagaaaccctgtctcaaaaaacaaacaaacaaacaaaaaaccacacacacacacacacaaccacaaaaaagaaaccaacagatctagatacccgcgacccttttgtgtcctccacaaatagaccagcttcaacaacagaactcggtccctctgaccgatctccggaaactaccagacagccctggctctccccacttcccagggcatcccccagggtggcagcctgtagtcctcctagcaagtctacagaccacagtcctccggtccttaaggcccgagaggacagctgcaaacagaaagcaggcatttcagaaaacaccatcatctacaaacacaaagacatctttgtccacttccactgggacaaccaaaaccagagaaatgacccagagggtctctgaatcagatgggtggttcacgacaagagggtaacaatttcactaccgaccaacagatgggacgaaggtccctacatatgggacaaaggtccctacagatgggccctacagatgggacaaaggtccctacagatgggacaaaggtctctacatatggggcatcccccagggcaatttttaaaaccaaactcaggtggatccaaaatcaggctgattagtataaagtcaggcagtgccgtgattcagaaacaaaggatgatacacaaacaaagcaacacaaaaagcacagaaaacagaaaacaaacactcagaacagagacaccgaccagcacaaacacattccagaggggatccccatatctccaagtcgattctctggtgtgagggatggtcgtgtttcccagcccatgcaccaaatgaaagacccacaacgtgaggaccccccacacacacattctgactcaggataggtgacaccccaaatcattcacaagaaatggtcttgatgcaaactgcaagaggtttattagaaaggcaaacctgcaaacgcctggaatcctggaacaatggggcaagttctactccctgccattagtgaggtttattttggacacagatctaggggcttaaataatttttcactctctctcaggatctttcacaagcacaaggatctggggaaaatagctatgtatggtggggtgcacctgccccccccagtacactgggaatccatggagcttattgactaactaactgaattgtctccagattcagagaaggaccctgtcacataaggaggagagtgatagggaaaggcatctgacatcagcatctggcctccctcaaccacacatagttgcaggtgtgcacaagctacacacagaggtgggtgatctcaagtgctcaagtgaatgtattgcagataatggccatggtgttggccactgagtgtattgggaataatgccagacatgggcattattcattatttctaggataaagcctaaatgatctaagtattaacatgagaagctcatggaagtctaaggctcacctaaaaagcctgcataggggttggtgagatggctcagcggttaaaagcactgactgctcttccgaaggtcctgagttcaaatcccagcaaccacatggtggctcacaaccatccataaggaaatctgacaccctcttctggagtgtctgaagacagctacagtgtacttacatgtaataaataaataaatctttaaaaaaaaaagcctgcatagatcatgagagggtttagagactctatagggactaagcttagcataagcccagtctggagtccagacacatggggcatggtctgtgccagacaaacacatcaccagtcttggacaggttgatgtaacttttcatgacccacctttacaatgatcttgctctcctttaaaaataaggttaatttcaacaagatgtttacattatgatggaatccattcattaaggcagaggaggcaagttcatggcaggaggtggtgggaaggagacttgcctctcagggaagcttccagactcccaactttcactactctgcttggtaaaaaaaaaaaaaaagatccccccccccaaaaaatttcatccaaatttgcctggatctgagttttaacacacagataagtttgtctaaacacacttgaaggccactcaaaggaaatgaatggcttatttccttctccagtgccatgaagtcatctctgctactgggtgactcctggggagaggtgaacaatgtctagacagcccagagagagtaccaccaacagaacaaagacaccctcccacccaggtctgactcagtggaccaaggagtctggggggttacttggcagagcacagtgactcaaaagaagcttcagcatagaaaaccccaccccagggcaaagtgtaggctatcaggcgcctaaaagatggcactggcctccggtacaccgtcgtggtaaacaatgctattgctactgagcaggcgctagcccgaatctggcgccaacccctcccgagcgggtgcatacaaatcaaagtgccggcagactgaccaatcccaggaggactcgtagctctccccagtgctggggtgtatataagcagtcctccctgggtttccagagttcccgtagcatcgaggtgttcctgaaataaaaaaggctgttgagaagaatccgaccgtgttgcgttttttcttgctggacgaggtgagcacaacaggcaagtgaggattcctaaaggctacatgcctggagctctcttctggacttgcaggggcaacttgaaggctagttggttggatctggaattaactatgaaacaagcctctgtgtgggtctatagaggtgtttctacggtggatgaagattcccagaggagacagaagttcaaggaaaataccctgctatttgtttgcctaccttcattccttgctggtaattgtgcctgtctcatttctttgagaagcccagtttttcagcctttcaatatgggctgaagcccagagactctccaggaatgcccaaggccttcaacaccagattggaactgctaaggcatccagcatcatggatagaggaaccactgggtccatatcatggaagtcaattcaacgtgtcttccttatcatatgtactctgtctcagatcctctcctaaagaaccctgactaacacatgtgttattgtgtgaactcctggagggcgggtgttcttgtctctgtctcccatgtagggagctggtatgactgactggaacctccatctctgaacttctctgaagctcccttctggagcaacaaatgccactatccttgaatcagacaagacagtatgacatgacagagtagacagctgccctttaagatgcaattttagctactgcagaaggaacacaacttcacttcccacagctcccatacctacacctcccacaccaaaacctcccacaacttctactcctatatctcccatgtctttaccacccacacctccacctcccacaccttgatgaccgcctacagtcactttggtcccagagcaagaggtctggttccatttgcaaatctgacctgcttgcagaggtgctctccaccttagtgtccccagactggaaatgctggtgacagctactctaaccccctctctgaaaaatgagaaggtggtactcagagtccctgctcctgggttacagcctcctcctccacctcttgctcctcccccttctctacctcctcctcttcctcatgtttctctgtcctccttttaaatcaaaagagatggatgactgacaagaagcaaatgagtcagacataaggaagtagaaaaagagaatgatgttgccaacttatcattcagaggtgctctctgagacggagaataagagcaacctcatcaatcacacagtggatgcccttgcaggtgatctgtggtgtcagccattgcatgagcaattggaccaggagcctatggctacctgctagctaccacagaggaaggaggctgtgtagacacaataaaaggcgacaattagcccagaggttagagaggacactgaacctgctttcttacacaggttggactccctgtgagacctacttgggccagactcaaaacaggaaagagatgaggccaggaggtgctcagtgtggaacctgtacccctttgccacactgagggtgggaaggaaacatgagctcatctgactggatggagtcctaggaagctgtatctcagccatggctctgcaaggagagtgcatcctacatggatggatataagattgggagagcatgtgagacatttttcccctcatatttttatttctttttttctttttttttttttcctttttttctttttttggtttttggtttttggtttttcaagacaaggtttctctgtatagccctggctgtcctggaactcactctgtagaccaggctggcctcaaactcagaaatccgcctgcctctgcctccggagtgctgggattaaaggcttgtgccactacacccggttctcccatctttcttaactcccctggttctctttttgctatttcatttccctttctccaggggactgaataggcatcccaagagagcattttagatattagtcatatgaggaaccattgcagatttgattgaattagaacacgtaggttataaagcaccatcatatgactgtaaatattaacatttactgaataaagttacactctccattaattttacactgagatatatgcaggctttgatgtaaatacaccattcagaatatgtctggtaggtgccacggcaacagatgcaggggcagtgctgttgcctacaaatgaacagtgtcctcactgggtctagaagatggctgtaaagacacttctagctgtccacagatgcacctgatgcacattgcttgtatttgtaggatttctcttccatataaactcttttatgacatttttgtgatagtgacatgaaaaggctttactggattgattacttttatagggttgggcttcggggtgaattcttttctttttgtagactctagagacctgtttttttttttttccatattgtgtcacagtctaatcttgtaggacatttgtctgagggaaatgcaaaggcagatacagattaacacattctcttttccttggaaatatcgacctaaaggaagcacagatgttttgtgcaaacttccattaatatgcagcattgataaaatgagtttcaataacaaaaatgacaataaacagactccttagcagaggtggaatgctcctcatgtgcaaaatttaatatttgtaacccttgtgactcacacagtactgttgcaaaatcatgttttgcacattagtaatactcatgatcctagtttgagagtctgaagtatgctcatgtcattgtggacactttcagaacctttatgtacattgatgcaaaatactcaataaaatactcaaatactgaatccaaaaaacatcacaaagaatctatccaaaatgatgaagatttttttctcatccaatatatcttgaggagtttccattccctctattcttctcagttcctgtccactttttctcccttctggatctaacccctttctgtctctcagtaggaaaacaaacaagcaaacaaacaaacaaaatccatagactcactaattgacaaatctgcccccaaaaagctaaagtaaacgttataatatatttcaaaagaactggtgcaggcattagtatttgtacatcacaaattctagtctcaaatttctggtctatatttgggcaattttgtgtgaagcattttgctggatgttgataaagcatattttctatgggtcattataagtgaagatatcaaaaagctaaaatttcaaaggggaagaaattttttggctcagctctgagttcattagtcagaatgaaagactatgattgatgtttactggttagatgatataaatgtggacgtctctgcaaacactagttctggtagagtaacaatccatgagccaaaaaagaaatctagttcaataccactctgtaattatttcagcactggttgtgggtgtgttgtgggttatagccaatgaaattcctacagcactcagagaaaatctttcccagtgcctgtgttaacatctgaagtaaaaagtctcctggtactcagaagtcaagataaactacaaagccccgtgggtcaattaacaacacacaagataatgactgggaagaacactggagggaggctgcctctgctcaggtgagaagcagaagagaaatgagtgggaggcaggctttgtatagggtttagttgtgggtgatggattttcaggatttgaaatatctgtggttggagattgctggtattttatgtcctgagcttgagcaaactcagggatttctgagtagttaaaaccagtaagtatgttatccattctctctgtagacaatgttgagtgtaactttagattctgaccccagggtcagaattattttaggaataattaagcacagtataattttggaaagaaatttcttggtaataattgtctcaatcctctgtgcacagtgaagatgaaagtgtgactacctcaaaagtcttttgcaaagtctatgtgagtctttcttaaagttggattctaaaactaaagggcctagaggaggatcaagcatacagtgtagaggacaccaagctacaagatacatgtcacatctcttgcaaggctggtttgtattgcctgagaaacaattttcaagggaagattgggaatttttgtttgtttgtttgtttgtttttcgagacagggtttctctgtgtagcctggccatccaggaactcactttgtagaccaggccagcctcaaactcagaaatctgcctgcctctgcctcccaagtgctaggattaaaggcgaacttcaccactgcccagcacgggaaaattttatagtctgggactttcaggtgttttgtggcactacatctagcacagctcaccataccacttactacatccattccctcacttctggtcagaaaaaagtatacttctctttcactgaacagaaactctgtggttttatattcctggttaccttagaggttatttttgaccacaaggtccttttgctctctacagaaaaaaatatattttatggatgtttctagttcttagaattttaatgttgtgttagtgtaaatagaaagacagtcaaatatttttaaagaatataaattatgttgttcagatatacaaagtgtgattacgttgcttgactctatagacatcaaacatgcaagtgctgctggcataatcccagcaatcagaacactggggcaggtgtattattcttcatttgaggtcagactattctaattcaaagtgactttccaccctgtggtctccaatttcctcttttggcctttctgaactcttcacatgggctgaagttaattttctaaacttttatgcaggtgtgtctgtgtatttttaactttttattgctatattagtagagaactaagttctagcaggatcttgatattgtcatttctatggcatatcaccagccttacatttataaatacttgtctccacacctgctgagatatttgaatggcaggcagctctctatgcctagaggtaatccacagaattctggagatgtctcacacctgattgcttgaaagaaaaaaacctaacatccaattcctgggataagaattggagggtggaatttctggatggaaaaagtgatgtagggaagagaaagcaggtggaagagattaagtgggagaaagagaagagaacagataaatgggaacaggggcagagaggtaaagagcaagctacacatgaggtcataggcttgaatagtctgaaatttaaatgatcggtggtagacttcttcagtgaaaggcttacggtttaaactgtataaaaacctccttctcattatttataacactggtgtgtccacaagtactcccactacactcacatccatatgcaatatgcatatatatatatatatatacatatatatatatatacatatatatgcacacacatatatatgcacaaacacacatacacacacatatatatgtaaaacttttcacaagggtgctttgggtatttaagtcaaattagatattgattggttattcacaataaattcaagacatcattgacctagcatatttttgaggaaggacaaattttagatcaatgtctttttggttggttctgtgtatgtatttcactttttgtagcttgcaaagcccttcccataacgaggactgtggaacgtaagagccaatgttcttggaggcaccagcttgacctctttatacacagtgagttgtgcaagtctgctcgttagcaatgaagacttattgtcagtttgtaaaaagcaacaccttttgttgtcggtgccctgccgtgttcgtttatttttatgaaaccactttgtagaacaactcagttgataaaacacagtggaaaagacaagatcaactggaactccatctctttcagaattcagagacttaattataatcaccttcatacacttataagctggttcttttaaaaaaaatccaaacatcttactaagaatacagccagccgaactccatggagttttgtaccatggggctttcctatgcattggcagaaccacaagtgtggcaatgcagtatacaaaagttcttaccttctaatagatggtgacttttcttggaccttacaaccagagttaatgcaacttgaagaaatttaagatttaaaactgcagtcctactgtgtattcaaatttatggtttagctttctttttcaaagaacaatgtaaaaacaaacattatttttttccttgtatttctcttgtgatcaacttttaaaacctaacgtgatgcattggtacaataataatttattgatacaatggtaatttatgtactttttcaagtcatgtccagaactgcctgagtgtcatttgttgaaagcatgaaatgcagaggctcagtgcaaccttctaaaatgaatatactattatgtgtactgattgataaacagtgatgtctgtaaatgcttgttgtcttgatcacttggagccagttacctcatcctttttaaaactctgttaaagatttctgtatactataccattccttccccatgtaatggggttttcttggtgttcccaaaaatattgcaaaggtctttcttaagaccagcaatggagatacaaaagccaacagacatacatacagagtacacagatagacacaaacagggagacagaaggcagacacatgtagagagagatgcacaaggcagtattcagcatgttacagatttaaattaactgaatagacacgcaggatggaaggctcagataagagaaagtagagaattcaactttggactcacacttagttaaattaactaagtttaatatgttcacatatgcagaatcaattaacttgtgacctaattttcctatcttttttttttttgcataaacacaatatgggaaaatataaaactcaccacaatgggtaacaagtagccctgcattctgaaaggtgtccatgggctcagaaccctgttctgtaaagaaagaccatcagatctgggcttgtgcttctgagctctcactaccatgatggcctagaatccattttaactctcaccgtcatcacaacaggatttgaacctcagaggtcacaagagaatcctggaactcattactttcattaaaagagttgacttcatgccatattctctaaggtgacttgggtaattcttgagtctccttaccccagcttatgaagatatgcatggatgtacatagagtattatagagcacaatcagggaatcttctatgaacaaatggctaaacagtgcagtatgtattgtaggtctctttctgttttcttccttccttccttccttccttccttccttccttccttccttccttccttccttccttccttccttctgaaggaagatgaaattgtgtaacttgtttaggagcccacagccgggatcggggactgggaacaaagcagaacagccccaggcaggccaaggcggggctgttgttaaagcattcctaagaacagcttgactgtatgaaaaggtattcaaggacaaatggggctatattatctaagctaacaccatctggttggattcacccctcaatccggagacaggcaaggccatccacaccatctggccggagctggccggagcttcctgtctcttcattacctcttggcgccaagtaaagtcacataaatcaactggttgttagataagtcccaagcccaccggaacagctctaatgccccctttttctgctgacatgtaatctttctgttaatgaatcaatcccgtgccttttgccaaaattccttgtattcccaaccttttgcgtctttaaaagcccctaggctccgagtctgggggtcgactcccctgcctcctgtgcgaggtacgtgtcgacccagagctctgccaaataaacctcatgcgtcttgcaacaagagagaattcttgtgttcttgggtgttccctgttcctggattagagcggggtccctaaatttggggtcctacacttccttccttccttccttccttccttccttccttccttccttccttccttctttcctttctttattctttctttcttttgccaaaaatctagacactttttcaaaggaatttttcttaattgcctcaccctccaagcagtaaataatattgtgcctaaacctaacatcactttaattcatcattttctttgactaaggtatccagctcctctaccttttgtccaagtctaataatctgtgtctcacacgttctctatgagttattattattcgccttactgcattttcttttcaggctcttttccttgtttatttctaagcacatattgaacaaaatttttatatcctatgttgtcctcctttccttcaggcttttgctattattctcttgcccacgaataattttgttcctgtcctctatcaattgacatatgtggcttacatactttgatctcttttatcatgactctggattttctattctttacctaggatatcatgtaaattgctctctttataagatacatacatagttgatagtttgagccaaagacattttatcttagttttactttgttttgggtattgagcaccagaattcagagggattgcttaattgtgtgcatttttagcccaggagtctatactcccaatgtgagaagttaggcaggatccattgtatctgaaggattcagaacccaggtgcagtccctactacattcagttctggtctagtctggcagcaaccttgtaggaagctgagcagagtaggtcctgagaagttgtgtttccacaacagagttggaggagtggttcctgatggggagggtgagcctcctgcttcattagataagtttaagaaaaagataaaataaaaacaaagaatcagggctggtgagatggctcagtgggtaagagcacccgactgctcttccgagggtctggagttcaaatcccagcaaccacatggtggctcacaaccatctgtaacaagatctgacgccctcttctggagtgtctgaagacagctacagtgtacttacatataataaataaataaatcaaaaaaaaacaaaacaaaaaaaaaacaaagaatcaatcagtcaatcaaaaaatcaatcaataaattaaatatgcaagcaagcaaggaagcaaaaatccaaaccaacaaaaattgctctaaagaactgggaagctaattaagtaaaaagtcctgaagtaggtgggcttagatgaatggcaggaagctggtgagtattgggcgggtccagtaggagtggctctgaggaaccaagaggaagtgactggaagttccgccatcccatcattctcgatgtatctcggctgcctcgtggtcaggaagccatggaaggagactagtgcctagtatttgcggaacctgaaaacttccttaagctgcagttgctgtgctggcctcctaggacattcagcagctggtcctgttgccttccaggtcagaggagttgttgggctgggaaacaggtaggagcagggcaggcatgtggagcaggggtgcgttttctgttgctactcttacaattctgttatggatatcttaccattatcaggaagtttgagttcccgtgaattgagtttatgttttaattgattttatggttgccagaatatttttctaaaacaacccagtagatccttgaccctctctggagtttgaataccggaagggaaaggggaaggggaaggggaaggggaccctgaaaagaaaatgcagtcaggtgaataataatcattcatagagaatgtgtgtgagacagattatcagacttgaagatatatagtaggttctgttaaccctgagtgtccccagagaaaaaccaatttctccatgtggaccagctttatcaaataatacatcctgaccaagagatagactttggtcacatgctacaggcattttataggccattgtagtttcctatgaggctttattattttcctaagacatgcaacctgcagcacttcaagaagatacctggttcttgtgctggtggtgaggttaatttttggcattttactctgagggagaaggaatgaagagatatctggttgggtccagactgaaccgggccatcatgtggtgggaggggaattgaggatgtgatggaggatagaggggcaggtcaagagatcaccagcagccaagaaagtacctatccaactatgacttcattgatatgttaacaggtacccctggtagccattcttcctgaatttctttgaatttttccaaggttcagcccaccatgctgtgcggtgatgatttcaggagtagatattttaataagtggaaatttttctatggatttttttttgtttgtttgtatttggtttttgttttttttttgagacagggtttctctgtgtagccctgattgtcctggaactcaccaggctggcctcgaactcagaaatccgcctacctctgcctcccaagtgctgggattaaaggagtgcactaccggcttttactatggattaagacaaaattagacagcatcttttgaataattttgaacacttacttactgaattactgtctggattctggatcagaataattttcttccagtcttctgtcctcctcttctgtattgcttggaaaaagactctatgtgtgttaactgtgtgactgactctcacatctttagggtaaactgaaatactcagaaaaataggcattctcttgataacttctcttcatgtttatccttttctcgggtattgacatctttcatttttgttccatgaacagtttcatgttcattctaaacaatatttacccattttcaggtctccatatgctcagtcaactctccataactgtaaatcaacactaagagcactagaaggttaaaggtcaaggagactctcacaaaggatccaggtatgttagaggtattgaacaatgggtggagttgggctcacctgtgagtagaaagaggacatgaatttgattttcccagattctatttccttaatgattctggaaaagaataatattagaagtgatgatatggatttaccatggaaggaagtgctgtcagctgttacttgatgtcaatatttaattaattttgatcctgggaaattgctgttgctcattgaaatcaaagtttcttttatccagattgaaagcaacatcaggctatggttgttataagggcaatttatacataaagcaaatgtcagcagtagattccctcctagggcctgtgaccttacttatcgtattttttaggcagattttcactgtaatctatggatttttgtttcctgtggagcttgaaagagaaaacctgttacccacagatattcttgccagtatcataaaaatttccattttggcagattcagattggagcaagcaggttacaaacctgaatatagacattgataactctgcttcctgccccaatttgcctagcaatttttttcactatggaagttcccaccggggtgtctaagatgtctgttgagagtgaatggtctgatatgaggtggctttctccagaaggtctatttgctttctgaatcacctattctatccactctaaatgttttcctgtccttgacctgtgttcttaattgatgttctgtgttgcattaatccccattagagtagaataattatttttgaccttctctgtactggttgctttagttttgaatctgtttgccttatttctgaggtatgtttcttctcttctatccttgagagcttttatactgagcagtgtctactttttaccccagggctctataagtaagtttcattctcctattgtcactgtaatttgggaggattcctgcctacatcttttaacttaggcctagtgatgtaagcttctactctccatacagtattatctaggcctggtgtgttttcaacctctgaaatttgctgctgagtaagccccccccccctttcttattccttctcaatgcttatctggctgattcaattcggtttttccagctcaaactcctctccgagctgagttcttctctcagacactgaattgttccacttggccttaaattaactgtagaaatcttttctcatcttctggctccttctctttctcctgctcattctatctttacctgttcctagcatgttctctcttcagtctgactctgtaaaactctcagaacccaggtgcagtgtcctagtacatccagctctggtctagtctggcagcaacattgtggggaagctgtgcagagaaattccagagaagttgtgtgaaactgcaacagagttggaggagtggttccccaacagagttggggagggtgggcttcatgcatgattaaataagtttaagaaaaagacaaaattaaaacgaagaatcaaccaatcaatcaatgaattaagtaagcaagcaattaaaaatccaaaacaataaaaattgctgtgaagagctgggaagctaattaattaaaaggtcctgaagtaggtgggcttagaagaattgcaggaagctgctgaatattgggcgggtccagaaggaggggctctgaggaaccaggcagaaatgacaggaagttctgccttttcagcattctccttgtaccttggctgccttgtggtcaggatgtcctggaggaagactagtgcctagtatttgcagaacctgaaaatttccttgctggcctcctaggacattcagcagctggtcctgttgccttccaggtcagaggagctgttgtactaggaaatgggcaggagcagggcaggcacgtggagcaggggtgcattttctgtcgctactctcacaatctgttgtggatatcttaccattgtcaggaagtttgagatcctgtgattttggttcatgatgatgttttaatcaattttatggttgccagaatatttttctaaagtatccttgtagatccttggctgcatctggagtttgtataccgggaggtttgtctttgcaaaagcctttataaagcaactgtaattcaaattcgttcctgctttcttaactcccctgttccttcatttgccatttcatttccctttctccagggaactgagtaggcatcctgagagagccttgtagatatttgtcatatggggaattggtgaagatttgattgaattagaaaatttacgttataaagcaccatcatatggctgtatatattcacattaacctaacaaagttatagtctccgttagtttcacactgagttatatgtagtcattgatgtaaatacagcatccagagatgtgtcttcatagtcttagttattaatgttacaccttaggtttcattgaagcatgaaaacaggtttgcagcaatgaacaactaaggagaagatatatagtaggttctgttaacccttaatgtcgtcagagaaaaaaaaattctacaatgttggaaagctttttaaaatattacatcttgaccaagagatagactttggtcacttcctacagctggttttatatgcccttgtcattttctgtgaggccttattattttcctaagacatgcaacctgcagagctgcaagaagatacctggttcttgggcttgtggtggggttaatttttggtatttcagcatgagggagaaagcattcagagttatctctttgggtccagactgaaccagttcattagatggggggaagggaattgaagatgagaaggagaatagaggtcaagccaagagttaaccaggagccaagaaagcaccatcccaatccctgtcttcattgatatgttaatagttaccccagttagcctttcctcctgaattcttctaatcctccaaggttctgcccagcatgctgtgaaaggatgactctaggctaagatatttttataaatagaaaacttactatggattaggacaaaattaaacagcacctttgaaataattatgattgctcactttcttaagaaaaatgactccttgtttcatgaaaagcactttgcccatacacattcatggtttgttgagtgctgcactgtggagttcttgcaggtgtggtaatgcttagaccctgcattcagggtttttttcagcaatctcttgttggagaagttcaacagtttggatcctgcgtgtcacaatagttttcttacattcttccttgtttctcagtgattctgggaaaaggactctctgtgtgttaactgtgtgactgactcaagagtaaactgaaatcctcagggaaaaagagacattctcatgacatcttctctttccttcatgtttatcctttcacctggtgttggcatctttcatttttgtcacatgaaaaggtccaggtttttttgaatgattttcccattttcaggtcttcattttctcagccaaatcttcataaatataaatcaaatctaagagccctagatggtaaaggccaaggagacactattgaaggatccaggtgtgttagcagctttgaaaaggggtggggtggggctcacctgccagtacaaagaggacatgaatttggttttgccagcttctgtttcattaatgattctgaaagatttcactaagaatattagatgtgatgatatggatttcccatggtaggtagtgctgtcagctgtcacttcatgtcaatatttaattaattttgatgctgggaaattgctgttgcccattgaaatcaaagtttcttttacccagactgaaaagcatcagttaatgtgtttgaaaagggccatttacacaggaagcaaatgtcagtcttggattcgctcccagggcctgtgaccttctttattggattttagccagaatctctgtttagtctatgtatgcttttcctgaggagctggcctcagcttgaacaggaaagccttttgttacccacagatagccttgccactatgatactggcggccatgccttgcctggcagattgaaattgtagcacacaggatacaaatctgggtatggccattgatagctctgcctcctgccccagtttgcatagcagtttctggactctgaatgctaccatcagagagtccatccacaatatttgttgacagagtggatggtctgatctgagttgttcttctccagaagatgcacttgctctctgaatcacatcttcggtccaatctacatgagtttaagtccttgaattgtgttcacactgatgcagtttgttgaatttggccttattttattgtggataccaacaagagcttgctgacaggaggctgatataactgtctcctgagaggctctataagtgcctgacaaatacagaagtgggtgctcacagtcatccattggacagtgcacagggtccccagtgaaagagctagagaaattacccaaagagctgaaggggattacagccccatagtaggaacaaaaatatgaactaaccagtatacctagagctccttgagactaaaccaacaaccaacgaaaacacatggtgggactcatggctctagctacatatgtaggtgatgatggcctagtctgtcatcaatgagaggagaggcccttcgtcctgtgaaggttctatgccagaataaaacaccagggccaggaagccagagagggtgggttggttagcaggggtggggcaataggataggggatttttggagaggaaagtaggaaagtggttaacatttgaaatgtaaatgaagaaattatcaaataaaaattgaaaaaaaaaaggatggaataatctctttcctgccttgtctggaccgtttggtttagtttcaagtctctttccatttgttttctgaggtgtgtttcttctctttttacattctagaaagcttttatagtgagtggtattagattttgcacaggactgtaaaactaacctttattctactattataattattgtctgggaggctgactgcctctgtctaattatcatggcctagtcctgtaagcctctagcctctaaataatcttatgtagtcctagagtgttttcagcctctgagatttcctgctgattaaactccccctttcttgtttgtttatttcaactccttttttaaaaatattttatttttttggttttcctgacacggtttctctgtgtagagttctggctgccctggaactcactctgcagaccaggttggcctggaactgagaaaagtgctgggattaaaggcatgcaccaccactgcccagcctcatttcaactcttacctggatggttcaactcagctgttcaggctcaaactactctcccagctgactcattcagcctggttctcagacactgaattgctctgcttggccttaaattaactgtagcaatctttttttaaatcttctggctccttctctttctcctgctcattctgtctttacctgtgcctagcacaggaaatcaatatttccctcgtcaattctcattcattttctgacattccatggtacttgataatctgctttttctcattgtcaatccatacttctgaggccagggcgttgaaagagatcatacatatacctgttaaatgccaagagaaatatctgacatgagagaaatataaggtcaaagaaatacataagaagcactgaatatttgctgatatcatgtgtccctgtgtctctgaatctcgccggcaagaacacacacacaggacaaactcggatccttctgcagcaaagctttaatgcatctcgagagatagatgatcagcttctggggaggaggagacccagagcacaggaaactcggtccttttatagaccacgaagagcggttggagatgtgccttgccctgattggctgctcaccatcaacccagatgatgccacgggacaggcagggcacaaggaatggaaaaataccccagcacatgcgcagactacttgtttaccagttagaacaccgaatgtcagcactatcttgtaatggtgactgcaagggcggctcctcacaatcatggtcatgacaactttcttcagcaatagtatctccatgttcagaatgaattcttatgtttttatttatgcataaacatatgtatgtatgtgtgcatatatgtgtatgtatgtgtattggtatgtatgccaggagaccattatcacacattctttctttcatgttaacctttaagagtggtggctagagatgaaatctgtaacagctaggctccgaagagtgtcattgcattcatatttattactgattgggaacctgagaactgcctggaacaatgccacaatgcagatacatgcttgttgaggatgatgttccaacggtgatattatttaacagatttgatataaggagggaatccttccaagggcataccctcaaatgattcattttatctctgtgcatatatattctccctggcagccatcagtgagtttctaccatgtcttctccttgattttgtatgtcaatatattttatgaaatatgctctcaacatgaaatataatcatagtaacactattcataaaattgcatatgaatttatatacaagtcaaatgtcatttttacactaaagacacttaacttgattatttttaattaaatttataaaattttttccacaccccatcccatcccttctcccctccctccaagaggatgtctgcatgccccaccatcccaccaggcctccccaatactaggtgcatcttctttcactgaggtcagaccaggtagtcatccactgtttatttgtcatggtcttcatgtcagctgctgtatgctgcctggttgttggccctttttctgagagatcttgggggcgggggtcccgttcagttgagactgctggtatatggatggggccaccctcctcctcagctccttctggctttcccccaaatcaaccataggggtcattggcttccatccattggctaagtgctagaatctgcatctgactcagctgtttgttggacctcttagagggcagccatgctagcctcctgtctacaagcacaacacagtatgagtaacagtgtcactgctctttgtctcccctggatatggatcctaatttgggtttgtccatggacctcctttctctcatgtgcttcttcagttttgtccttggagatccttcaaacaggaacaattgcaactccatcactccacttgaagctggacagcactttatccaaagtctctccctttgagtcctgggagtctctcacctcctaggtctttggaacatgtgagatggacctccatagcctacttgctgaggctgtctatttccattttttctactggtcctcagggcttcagtcctccccctatccctcataatgtctgatcatgtttccccttcccttctctgtccctactcccactcaggtccctccctccttcttcacccatgactgctttcttctctctcccaagtgggattgagacatcctcacttggaaccttgaacttattaaccctctttcgtcatttacattttattatatactttttttggctgatatccttttattagtgtgtacatactatgcatgtcctttctgagtttgagttacctcactcaggatggaatttcctagttcaatccattttcctccaaacctcttgatgtcattgttcttaatagatgaataatattccattgtgtaaatgaaccatatttcagtatcgattcttccattgtggggcatatgggttgtttccagctcctggctatcacaaataaggccactctgaacatagtggaacacaagcccctgtgtcatggtggggcatcttttgtgtatatgcccaagagtgtagctgggttttaaggtatatctatttccaattttcttaggaatctccagattgatttccagaatggttgaccagtttgcaattccacaagcaatggaggagtggtcctctttctccacatcctggccagcaagtgctgtcacctgagtttttgatcttagccattctgattggtggaaggtggaatctcagtgttgctttgatttatatttttcggatcactaaagactttgaacatttcttttgaagtttctcagccttccacagttgcttcattgtgaattctctgtttaggtattgtactggctagttttgtgtcaacttgacacaacttgagttatcacagagaaaggagcttcagttgaggaaatttctccatgagatccaactgtaaggcattttctcaattagtgatcaagggggaaaggcccttgtggttgggaccatctcagggctggtagtcttggttctataagaaagcaggctgagcaagccaggggaggcaagccagtacagaacatccctccatggcctctgcatcagctcctgctccctgacctgcttgagttccagtcctgacttcctttggtgatgaacagcagtatggaagtgtaagccaaataaaccctttcctccccaacttgcttcttggtcatgatgtttgtgcaggaatagaaaccctgactaagacaaattggtaccagcagagtggggtattcctgtgacaacctgaccatgttttggggaggactgtggaaggactttggaactttgggcttgaagatccatccgttgttaagagctctgtcggatgttgtgtaggagcttggaagatactgttgagaacactgcagaagatggaggtctggtttgtgaaatttcagagggaaaattaaagactcttttcagggccattgctgttttgaatgtgaagattctgtagttctggttagctggggctgaagaatcagttgtgattaacaagataccagaactactaaagcaaaaactttgcatactgggactattgatgctggttagctggagctaagaaattagtggtgattaagaagagaccagcatcattgaggtgacatcttctgggaagtgttttctgaaagcacaaagaggctgtgttccagagatggccaaggttgtactcctgctgcagcaggacttggtaatatgtaagggtcacccaggtggtactggttttgaaggcatgaaggggtcacgcaaagcagctgaggctcggcactgtgagaggccatggaaggccattggtgaaggtgcagcctcagttgcaattgaaggcccaggattgaaggggtcatgcagtgttttggagatgccagtaccatgagatgaccaccaagagcagcagcagcagtggagtacaggcatctggagcctagaggatgacgtgtgtgctacaaagggcctggctggagaagtgacccaagcccttggaggagcccagaagatcgtgagttggatcccagacattggacggttggagattgacttttgcttttgattgtgactgtgtcctgatattttccctcttgaagaaagaaactgttttagtggagcccacagttaagagacttttaattgtaaaaagactttggattttaaaagagatggatattttaaagagattgaaaatttaagaatatgtaaagactgtgggacttttaaagttatttagaatggggatgaataagattgtaagggttgaggcttagtagtgatgtttttgtgtgtcaagttgacaaggggtcaattgtactggctagttttgtgtcaacttgacacagctggagttatcacagagaaaggagcttcagttgaggaaatgcctccatgagatccaactgtaaggcattttctcaattagtgatcaagggggaaaggcccttgtgggtgggaccatctcagggctggtagtcttggttctataagaaagcgggctgagcaagccaggggaggcaagctagtacagaacatccctccatggcctctgcatcagctcctgctccctgacctgcttgagttccagtcctgacttccttggtgatgaacagcagtatggaagtgtaagccaaataaaccctttcctccccaacttgcttcttggtcatgatgtttgtgcaggaatagaaaccctgactaagacaggtatctaccccattttttgattgggttgtttggtttcttggtgtttaggttcttgagtcctgtacatattttggatattagccttctatcaagtgtggggatacagaagatttttttccccaatttgtaggttgccactttgtcctatttactatgtcctttgccttacaaaactatctagtttcatgaggtcccatttttccattcctgatcatagagcctgaggcattagaattctttctaggaaattttttcactgtgacattaagtttgggactctttttctactttatcttctattttattgattctatcttgttttatgttaaggtccttgatccacctggacttgtgctttgtgcacgtttatacaaatgtatctattttcagttttccacatacagactgccagttagaccaacatcaggtattgaagattttgtcttttatccattatatatttttggcttctttgtcaaagatcaattgtctgtaagtttgtggtttaattactaggccttcaattgtattccattgatcaatctgtctgtctctgtatcagtacatgcagtttttatcactattgctctgaagtaacctgtaacgtttacaaaaagaaatgaagtccactgttttttaaacatagcagctcctatgtagtttgcttgggtgtgctttctggttgctaaatctagatatagaggctagttttaagtgagaaattacctttctgttttttcagttccttcacagactaagtttggctgtcctggaaatatctctctggatagatcttgtacacttaggtgtgtcttgctctgtctcctgaatcctggtgttaaagatgtgtcccatgatacctggatctaacattttcctcattagaatttgatctgttccaggcttttcttggactttgaaaactgccttcattttcaaactcaaaccagaatcttaagtgggtcaaattttgtctgagatcatcactctctcacttcctggtactcctttattcctcacaccatgagccttgtttttaaaccatgcctttccctttactgactcattagtgtagctacctctgtaattttaggtacttcgagccccttatacaaatcatattgcatgtttatattttggatagttgagaaatgttgggcagtgagtgcagggaatttaaagggaatcccatgtcccaccagagctccagtgctctgggcaagtggacagcactctctatgaggcccaggtgggtgtctggccgtgggaagctatggatttccagtcattaggggtagagagggagcagtttgtggtctctgggcctcacagaggccacagacaacaggtcctctgtcatggacatcccagatgtcactctatgttgtgaaagagctgagaacaaagtgagggccctgggggtaactgggtcatcccaagggctgaagggagaagggagcaggggtataaggcactcaagtgtttcccaggatgtgagagtctttagtctggtctggtgactggaaacactgagaggctttgctgctggaggtgatacgtggctctttagagtcagccctattccaatcattgaagaacagctggtcttaatgagtggagagatggtccctggttttaaggtgtttattgtaaaaagaggaagaggaaggagtagggaagtagaagccagccatgaccatgtggagagagggaggagaggatagggaggaggagagctagagatgagaataagagatttaagagcttaagagagagaggaggggccaaacagccccttttatactgggctgggttacctatctagttgttgcaacataactgtggggaggagcataccttgctattgtcaggtaactatgagggtggagtttagccagaatgccagggacttgggacattgtcaatatgacagatagtcacaggattattgagttgtggggctccgtgttgtcagacacctgtgtctgggaacatagctcactgttctatcccttgtagagttttctactgggtctccaaagtaagctttgctcaattagaacacaggctgcctttcacagtcccacagagaaaagctctaaagaatagcttttattttaaattatataatcttcaactcatgttttcatagttctttcccaaggccatagcattaccattttcctgagaaataacagacacattgttgcttcatggaatcttactgtttctggttatgtagacataaaccttggctgggagaacattccctaagaacataggcagggaggacaagccttatgcctacaggagccatctgaacctgagaaatcacacatactgttgaacctactccattcgatttctatgacagaccttgcagacagacttttatttatttttttaaacttttatttaactataggtgtgttcttctgtatatttttctatgtcctgcatgcctatatgagaccagtggagcccagaagtcatcacaaaatgcatcacacaggagtcagacaaaaatcataccttgttttgtgtgtagaaagaattagtctgtgtttcttttcatgaacagcaagtgccctttacctctgagtcatctctccagcccagaggtttacatttctgctacagtttttttttaaatttatttattcattatatgttcgtacactttagctgtcttcagacactccagaagagggagtcagatctcgttacggatggttgtgagccaccatgtggttgctgggatttgaactctagacctttggaagagcagtcgggtgctcttacacactgagccatctcaccagcccctctgctacagttttatgatagaacctgaatataaccctgagttctattttttgttaaaaaatgaaggaagaatcagaaatgatagtaatctgtgccacccataatcatgttagatgaatgagctcaaataataaagataagaatagtgatcaagtcaaagaatcataaatggttctgatccttgcagtctataatcatgttagatgagtgagcttaaataataaatcaaagaatatttctggagtcaaaagactcagactttaagttggacagtcatagatttatgaacaataatgtatccataattaatgacaaattagtataattcttatacaacttaaaacgttcctttccattataaaaaaacactctacattatcattgtgttgtcacataacccatttatttacaaatatacttctaactattctgaaggtaaacctgtgtggaatttatgaaattattatctgttttgattttgtcatgtattagaaaatggcacatgatattaatgctatgaaatgttttttttttttctgagacagggttttctgtgtagccctggctgtcctgtaactcactctgtagaacaggctggcctccaactcagaaatccgcatgcctctgcctcctgagtgttgggattaaaggtgcgagccaccacaaccggcttaatttttctatttattttactaaatatcctcaaattaattgttcaatacatatttcaattcttcatgaaaatatgcttatggaattggatcacaaggtattttattctatgtcttgcttctaatggtggttttatactctgattttacagtttttatctgcttagatacaaagaaaattatttcttttaagtaatccttgaatttttactccctactctatttcattggtctagaaaggatacagcattgtatataggccttaggatctcaactgagcattttagactagagtctagctgttgacacccaactgcatacaggatagatacagggtccacatttgatcaaagctgacagttgtagatttttttagtcaccatcatttataatctgagatgtgatactgtgatcaatattgttattaaaaactgttcttaaagatatctataaagtgttcttaaagatattcctgcatccagacctcacatgtatactttattatgtctcagtatttgctgactgtgaggccattatgtcacctaccccttcctaaaacaagaagacacaatatacactatgatgattttagatgatatcatttcttaaaatggcctcataattcttatgacctaacgtatattctgttcttgattagcttccagaatatgacatgattttttttcctctgaaagggaaccttaaatccaatcataatatgtttttctatattttcgtctgatgctttcctaaagcaccatgatcaaggaaagtaatagaagaaaaagaccactttgggtaatgcttccagaggataactatccaccatggtaaggaggcctgacagcaaataaccatgtttttgaaatagatagctgagagatcacatcctcacctccagtcactaaggaggaaaagagaactaaggtggctttggtctactgtttttctcagagcctactaccagtttcattctttattcagtaaggttccacagctaaatgttttaaaacattgtgaccaactggggttccaacttcaaaagtgagacatattcattcagaactatatcggcagtcttctaacattctttcacattttagccagttttgatatcaacatagtaaatataactttaatttctcgtttgggtttcctgtttggtttggttttttgtttgtttgtttgtttgtgagacagaatctcactctgcagacttaactctcatgtatcctgatatagatacaggaatggcttctagttcacataaatttacctgcctgagcacccacagtgctaagatgaaagaccttcccccactgtattatgcttgaatcaaacatttatcttttaatatttctgctaacatgcaacaagaattttgttcatttgtgtcatctaggacttacttgattgagctagctccttcagcttccattggaacattgatatttgtgttctgcatgctctatctttttgaattggccctccattgagttaccatccggcttagagttcatttctcatttcattcagattgaggattccttagatgtttatatgtctggatgcaatgtcaacatcctgcattatcaaaattatttccttagccacttgcaggggttctcttgtatttcattcagttagttcctgtcctctttgagttcctgtgcttgtttcctctttatgtccgttgacctcattgaatggtgttcaaattgtactttttgttctgtctcttgagtttgtttcatcattcttcttgtcatgagcaatggtattgcatttgtgatttggggtaggtaaattctatcaccattgtcaaattgttttagttccagcctctcagtttccttttgctgtgtggcattaggtcagttggcagggatatccatatgagatgttatgtttaatcattgaaaatctgagatggtggacaggaacttggttacagcttcttactaagtccagttctgttctatgcaggtagcaaacatgcattgttgtagagcaggccttgaacatcctggcagctatttggaagactgcttgagcctgagtgggaagaatagttctgggtgtgctgtgtaaaattggtttgttgaatttcctagtctgcgtagagttagagatgaaacataacctcaagcacagacattttgggttgtgcttgtagagtctctttgccctcaaagtcttgagggacttaaaaaagaatctctcctgaggaacgtcgaggatcctcaagctctgcctctgtctccagagtgtagcgaatcaaatcctgagtctctatgcccagttttgtattcattaccaggattccttatcaaactttgttcatatgtgcatgctgtgtatgaattaattttgtgttagatggcgtacagtgaaattctgaaaatataaaaaacacttcatgggaaagcgtgagccagaaggacactgggcaactctgttctttgcagaggaaaatcaactaaatgtgggcaaaaagatcctaagaagctgagaggcaaaatgtcctcatatgcattctttttgcaaaccttttgggtgtagcacaagaagaagcacctggatgcttcttcaacttttcagagttctctaagaagtgctcagagaggtgggagaccatgactgctaaagaaaaggggaaatttgaagatatggggaaggctgacaaggctcgctatgaaagagaaatgaaaacctacatctcccccaaggggagaccaaaaagaagttcaaggaccccaaagcacccaacaggcctccttcagccttcttcttgttccattctgagtactgcctcaaaatcaaaggtgagtatcctggcttatccatttgtgatgttgcaaagagactaagagagatgtggaacaacacttcagtgtgtgacaagcagccgtacaagaagaaggctgccaaactgaaggagaagtgtgagaaggatattgctgcctacagagctaaaggaaaacctgatgcagtgaaaatgggggtggtcaaggctgaaaagagcaagaaaaagaaggaagaggaagatgaggaggatgaagaggaagatgaggtggaggaggaggaagaggaagaagagttagatgaagaagaagatgatgatgaataagttggttttagcagttttattttcttgtctataaagcatttaaccccctgtatacaactcactccttttaaggaaaaaaattgaaatgtaaggctgtgtaagatttgtttttaaacggtacagtgtctttttttgtatagttaacacactaccgaatgtgtctttagatagccctgtcctggtggtattttcaatagccactaaccttgcctggtacagtctgggggttgtaaattgacatggaaatttaaagcattttatggttggtgcacagcacgtattagttatatatgggttcagtagtttgggttttttttcttttggttttatttttgtgtttaattttttttttatcttcagttgtgtctgatgcagtttatacaaagataactgttgttctgttaactgattaccactctgtaattaaaaaaccttgcggctgttttgttgacattctgaatgcttttaagtaaatacatttttttttattagtattgttgtccttttcataggtctgatagttttcttcccgaggggcagctagtcttttgcttttgcccattttgggtcacatggattattacagtgtgtatcttttcatctagttagctggaagaaagctttgatccacagaccctgctattgtggtaggggtaacattttcatccatagttgaagaatctcctaaatcatcaccagttggataagagatattatataacctacttggcaaagcaaggagtggtcaattctgtcacaccgtgggattattagaatcaagcaatctgaaagtttgtccttgaacactaatagaaaagtatgttctaatccttacaggagcactctcctttaactgccattactgtgtatattttgcagtttcccctactaaagaagacctgagaatttatcctcaacagtacaagcttaaaatacaagactgtcgtactatttgttgaccttagtcccagcgaaggctatcacaagaatgctggctgtaatgcctttgcccatctatctaaatacagattgctcaggaaacttgactgtttaaaggtgtttttaattagttgagtcagcttttaaaattatgccacatttaatatgaagggtacattttcctatattgtggtttgtccctttataaatcagatataagggaagaggataaactttgcataatagtagcagtggcccaatccaattgctttttctttataaaatccaaactcattaattaatcatgtttaatctgcaacattttggcagtttgtgggttgttttttgagattatcattctcttaaagtgccagtgttttaaaatagcgttcttgtaattttatgtgcttttgtgatggagtgcttttatataattctgacttgggttgtttacatttgcatttgttaatgtaatttgaggaggaatactgaacatgagtcctggatgatactaataaactaataattacagaggtttaaaaaaaggaacatttcaaggaagctatggtgtttttcttaatgtgtatccttttagaagttgttagactcctttcattgttgttccatgattaattcagaaactgagcagggtaaaatattatcaccattaacttaaagattctctatgcctctgagatttgagtgatctctgattagaagtgggtctcatgatatccaacctaaaatgctacctaaatatcagtcttaattgtatcactcttaggaaagtgtttctagtattctcaatcttttctttttatctactgagaacagtactatgttagaaattcaggtcctttctgaagattgtcaatcatatgtgtgtgtgtgtgtgtgtgtgtgtgtgtgtgtgtgtgtgtatacatatatatatatatatttacagtgattcaggattttaaatcataaattcttcaatgtcaaagaatttgacaagaacaaagattctgcttgtttattaatgcaatcataccatcattgaaaaggttaaatgaaatatcttccttttctattgtatctgttttctttgtgtttttcaaatgtttgtagctagttgttttctttcatgtttttttgttgttttcttgttcttttatgaatatgagtgttagtctgcattcctgtctgtgaatcacacatgtgcagggtatgcagagtatggaagaaggcattgaatactctggcatgagagctgccatttgtgtgttgttatgagactccagtcacctggaagaaaacacagtgctcctaaacagtaatccttactccatcccctgtaggtagattagaaatatattaagttcaattgagaagactgtgaacctttgtcttgttatgctatctgtttgtttttggacattttcttcttcctgaactgaaaaccaggattcacaaatagtgcagttcattacatacatatatgtttcattgaatctgatttgtagtagggattttatagtgaagtttttagaggatgctgaatgaagtaatgatatttctgagattttattccttgggatttgtaatctataagatgtttcttgcattgtgggttttatattatatttcacattgttctctctattctttatatatatagctttcctgtgttgtacttgagttctattacattcatttattccacataagaattttcttatttcctgtgcgctcatagaaaatttatatctacttcttttgtgcatattttcatatatttattatctaagttggttcttcactttaaaacttgtcttaatttactacattcacgtgttccttaaacacagtcaatatgagtagccactttttcagaaagtaacactagagtttgcaggcattttcattcagggcttgaaaaatgtcattccctactctactgattttaatcaatgaataagcatttattagtactgtatggcatcacaatgtagcccattttggtgataaggaataggacaagacaactggaataagatgcacattgtttcagcacttagatgtgacactatctgggtacatctgggagttgcagaaccaaatttatagagacattcctcaggaacactagatgagtgttgggaacaaaataaaaaggggggggccctgcggaagaatggaaggaaaaagatgcccacaccccaccagagtttccctattctctggtcagtcaggtgtaggaggactgctatctaccctattcactcatccctgggtgggtattcctctctcccactcttcagggggtggtcaaggggaaggcctacctggggacgcccccccccccagctactttgctaaagccagcagggttgtgggagagagggaaaagggaagaatttctcaacactgtccacagtgcccagcggaactttaaggagcagagactctatggtttaagagctttattagagaaatgcagggggaaagagagaagggagagggagagagagagaattggaggggagggaggagaaggatagtagaggagaggagagagcaaagatagagagagaagacaaagagaaagggaaaagaagagagaagtgagaggttagaggacaaaggagtgagagagagcaaggtgggggctgagcatacctttttatggtcttcactgttgctaggtaactggggaggagtttagcctgaaggtcagaagcttgggccattgcttacttgactactgaccatgcttctcttgtgggggctgtgggaggttgtgccttatgcaggggcctgagttccaggagcatgagggaacgcctactgtgtcatgtaggtgaattatgaccaccggggttcagacctcagctcaactggagaccagcctgcaattccccacagatgagaaggttatggccttgtctgaccaatacatatagctatttgacctttgtctactttaaaaatatttgatatagcaagtgatagtaagccaggcggtggtggtgcatgcctttaatcccagcacttgggaggcagaggcaggcggatttctgagttcaaggccagccaggtctacagagtgaattccaggatagccagggctatacagagaaaccttgtctccaaaacaacaacaacaaaaacaaaaagcaagtgatagtaaattaactggaaggctaaaaagtgcagacttatgcctattcagaaaaaggtgtgtattggaggaaatgtcagtttcaagttttaaagtagaagctgtattttttctggtgacttcatggaggaagcatgtaaaaccatgggtgcactggtagacatacactgtcagacagacagtttggtatttcagaacacaggataagcatgtagggagagcgatcgactccttacgtctagcagacaagagaggtcttttattagtttttatgttacagcagcatatccaagacctttttagacactaaggggtcttctgatatctcagattattctttaggaatgtataaaaccaagtgatattttcttgtattttcagtagcttattaagtgtattatcagattggagtgttctctttaaatatttgtatttcttgagttgaagaattatgttccttgtaatttgagaaaatgtaccttctctgtatccttatttgacacattgaaaatattccaggtcttaatttgctctttgtaagcactactgtactgtgaaaaggtattgtggtggctttgcacatccttgtctctctctagaaaaaaggagtagaatgatgacagctgtctttatcttttgtagtgagaggtgtaggatgttggctattatcttccttagactgaggaatattccttttgttctcaaaatacccagagctttcacagtgatcccctgtgatatttttccctaggctttttgtaactatatcatggttatgagccctctctcactgtacatacattgtgctgtgacttgttttgtttgtgcctgttgaaatagtctttcatctctggcatgaaattaagtagagtttcctttctgcatccacagaaaaagtctttgtttaatgtactttggtgcactttgttacttttttcactgtacatattttatggtcatttttttgggaatacaaataaagtcatttttttgtgaggagtctacaacatacccctttttctgttttctgcaatatactttatgcaatattattttggtgttttctaaagcaacttgcgaattcagtggtacatctatttagttcttatgcagtctttgaagaaacacttgggacccgagtaggctttttcttattacatagcctagtgttatgacctagaaagtttacttgtttctaagaaatcattattttcctcatcaattctcattaattggcctccactagccctttgtctttgactctagtccagaaatattagttttcagtaataaccctgagtatcagtactttacaacaggtatccatgtgctctgtgtttgtgcctgatgactcctgaaattagaaatcatcctcagattgtactcatactctttatcagtcaaaatgtatcatgtcggtagaaacattggcaagagccctggtattactttgctttatttgttttttaatgtggtttagcattgtctctaatggcatttcatttatttcattgttcaatccttgatgtgaaatttaagaagaacttgaatgtttgctcctcaccaagaatctgggagaagaacaactaaaagaatgagtgcttctctggaaaacactgcacaggtcagtatcctgtcttcatttcttttttaaatcccttttatattcaaaacattcaaaagttctatcatatgtatgtgtaatattacctaggaggattattttctatgctcttcattttcctttgtgatgatgaaaatataacaatttggtttctcatgtatacaatagctttatattttatttattttatatttatggtatgtatactatgaagacatgtaattcccatagaactgtaggtgtcaaagagcatctattggaagtgatgcctcaaaaatatattgatgactatttcctatgtttgataaggttatatatatccttttatattagtatggaggaagtaaggtttcttgtcacacataaattgcacttcagggatattcaggtttccagacacaaggctatgaatgtggatatggaaatatatagaaactcatatcagtaagcaacacatatcagagtagaatttgtaatagagtaaaattatatgaggcccactgtcttgaatcctaataataagtgtatcagctccctagaagcacagatgatggaagggaattgtctctcattttgtctttgatgtgattattagctgatgcagatttcagtattctgacaattctttttaacattttaagtcacacagtactcattgaagtgttgacacctgcaatatgacttgagagatactattcccgagatacatactcaatgtagacatgcttattttcctttcatttttgtttcagtctttagaagtagtgtaggccctgtggttttcacctttgtattttatcacatgaaatatatttgtaacatttatctaaagaggatagccttggtactgtgcataatccatcaattttcaagcataaattaatatccttcctattttctgtctccttttttttagaaggaagacagtttgatatagcctatgttattcctcttcagccaagcaatgcattacatagggaaagctgaagggttgtggcaatgtttctatttttttattgcaatactattttctttaggtatatatgtgctcatctgaatgtttttatgtgtatagaattacacattatgcccctaaaacattgagttcagcgccaaaccttggagactgaagtcaggcacaatagtgagctgcaatatactttgagagaattaaattcggtttctatgcagaaacagcaagcacctttacatgttagtaatttttttttcatgccccaggtttacaattttaggctcatttgtaaaatagacagtatataacctgtgtattttagtttttgataaacaaaggaagaaatagaaatcatgcttttctatgcaagctacaactctgatacacaaatggttaaattctgatgaaaagaaagttaagattagaagattaaaaatttcaattaagatgataccatgaggaataaattattaaatattcatggagagttagaataattcttcatcaatttgaaaacacagtttgagcaaagaaaatgattgtagttcattggaatgcattgccacctatgacatttgcttacacacccataactaatcattcttcagtgaaaggccatatggcagttatgaaattgttatgttgtgtattgctcatgccaacttacataaaatgttcaggaattttaatgctcacaaatactggttttcttactttatggttttggaaatgttttcctaaaatatcttcccaaagcattggttctgtgttatacagaacgttcaatgctctgatgttgcagttttatgttttttaacaccaaaactctgacattcaatccatccattaattctgcatttcatattctacctgtttgctctagagaggatgtagcattttgcataggcatcagattgtcaaataaatatattataataccgtcatggaagacacagctgcacacaggactcagctcgtgtccatatttgagaaagatggacactgtaaaattttaaagcatattttttctcattataattgatgatttatgattcttttttatatcagtccatatttcataaatattcattattgcatcttgacatcaaatgtacatcttatatgtgtttactgtttttgagatggttatatcatgcattctcagagaaatagaaatctaaacaagtctgagtattttagagtgtatctgttaataaagttaaactttatttttcttcagtatatgttggttacatgtgcctgaatgtatgcatttgtggtatgtatttctcctgcctgtagtgttaagtagagatcattggattttaaagaactggatttaacaatccattgtgtagtgccatgttggtgctgggaaacaaattccataatagaggccttgaaaagatattatacaatccaaactgcacacaaaacttttgtaaatggtgatggtggcaaatcttttttttttaaagatttacttactcattttatgtatttgagtacactgtagctgtacaggtggttgttaaccatcatgtggttgctgggaattaaaatcaggacctctgcttgctccagctctgctccctctggcccaagaatttctttattcttatacataagtacactgtagctgtcttcagacaccagaagagggtgtcagatatcattacagatggttgttagccaccatgtggttgctggtatttacactcaggaccttctgaagagctcttaactgttgagccatcactttagcccaatggtggcaaatctttcatttgctgcttaaggtctcagtaaatcaaagaaaattggttaagacaagagcctttctgaatgtaagcattatagtaaatcattgtataggttgtctatggaagagcagcaattcatgtcttgaaacacaactccataaactttaagaaaatatcattcaatattcttgcctcatttatatcacgaggtgtatcttaattagttctctttaacataataaatcatttttgtctagtaacacctaggtagtttttcattacagtgtctattaaccttcaaggacgtgtttttggacttctcatcggaggaatgggaatgtctcaattttgctcagaggacattgtacatggatgtgatgttggagaattacaacaatctgttgtttgtgggtaagaatgtactttttgttgaattacggatactttttttaaattttcctaatttgtataaactctctgaaatacttagagacctcaaatgagggaaataatgcttaaattcataacttttcctttacatttctctgattactttggaaagataaccagtgctatattctctgagatctctctttcctacttatctagcttcagtcaagacttttaatttcaaaaaaatttaaacattcagaataaggaattttatttctgtacatataataattggagtatttcttcttaccattgctttaaaagtctcttatttatgattttagaaagtggacaagggctggtgagatggctcagtgggtaagagcacccgactgttcttccgaaggtccagagttcaaatcccagcaaccacatggtggctcacagccatctgtaacaagatctgacgccctcttctggagtgtctgaagacagctacagtgtacttacatataataaataaaaataaatcttaaaaaaaaaaaaaaaaaaaaaaaaagaaagtggacaagattcaagtggacacagtgccgttggtttggagggttttttattaagtgtttgacatttggtctctgtttttttctggggcaacctgatctttatcctatattttggatgttgaaacaaaactatttaatgatttctcatgacagtttcagttacatcataaatttatacctgaccaaagctatacaatgtcactctaaatccaattgtaattttaaaattagagctatattgttcagagatctactttctgacatttcactacagatcaatcacttagaagttctagattctacaaagtagaatattcttttttttcttttctaaattggttattttaattattatatttcaaataatatagaactttccagttccccctccacaaaccccttattctattccccctaccccatgcttctatgagggtacttccccacccacccacatctgcttcactgctctaggtttcttctctgctggggcattgaggcttcataggtctaagtgcctctcttccaattgatgaaagttaagacagtgctcttttacctaaacagctggagtcattggtccctccatgtgtgtactctggttggtggtttagtccttgggagctctggggtatctggtttgttgatgtttttctttttatgaggttgtaaacacctttagctccttcagtccttcccataactttactttggggtctctgtgcatagtcagatcgttgcctgcaagcatctgcatctgtattggtcaggctctgcagaaactctcaggagaaactatatcaggttcctgaaaacaagcactttatggcatcagcaataatatcagtgtttggtgtgtgcagatggaatggatgcccaggtttggcagtctctggatggactttccttcagtttctgctccactctttgtccctgtagataaagggacactctttatttcctttagataggagcaattctgggttaaccttttttatatgggttggtggtacaatcttagaaggctattatcacttttgccatttgatatagatcagatttgaggtacttctgaggatccatgcaatgattaaaaaaaggaaaaacctctcttgagagtatgaatacatagaacagtgattattggatcatacttactcctcatataagtaatccctgttatccctaattccccctttttttcagaaaatcactgcatatgtggaaactatgagaaggagaaggtcgtggaacaagacacacagcacattttcaatgagcatgggcatatccaagagaagtcttttaaatgtaatgagtctagcaatataattcatgaatcctccgaaagtacacctcataaaactaaccacagagatgccactctccaatcctcaaacctaaaaagacataaaactgggaccactaaacaagtttgcacatataaagactgtgtaaactgtttaaaggggtcttctatcattagtctcaatcaaggaacccacgtagagaagaaagaacacaacagaaataaaaatcttgatgaggttttggtttctaaacataaacccattgtgagacaaaacaatagtgagatgaacacttacacttgtggtgaatttgacaaatgctttactcagagtgacaatcttcaaagtcagcagagaatttatccaggaaagaaatcttacaaatatagtgaaagtgacaaatgctttacccaaccttcccatcttagtattcatcatacaattcattcaggagagaaaccttacaaatgtagtgaatgcgacaaatgctttactgacaaatgcactctgagaaagcatcagagaattcatacaggagagaaaccttacaaatgtaatgaatgtgacaaatgctttactgacaaaggcagtctgagagttcatcagagaattcatacaggagagaaaccttacaaatgcagtgagtgtgacaaatgctttacccaaacatcccatcttagtattcatcgtagaattcattcaggagagaaaccttacaaatgtagtgaatgcgacaaatgctttactgacaaaggcagtctgagagttcatcagagaattcatacaggagagaaaccgtaccaatgcagtgagtgtgacaaatgctttactgacaaaagcagtcttagagttcatcatagaattcatgcaggagagaaaccttacaaatgtagtgaatgcgacaaatgctttactgacaaaggctatctgagagttcatcatagaattcatgcaggagagaaatcttacaaatgtagtgaatgtgacaaatgctttactcacaaaggctctctgagagttcatcatagaattcatgcaggagagaaaccttataaatgcagtgaatgtgacaaatgctttacccgaaaatcacatcttagtattcatcagagaattcatacaggagagaaactgtacaaatgcagtgaatgtgacaaatgctttacccaacaatgccatcttagtattcatcagaaaattcattcaggagagaaccttacaaatgcaatgaatgtgacaaatgctttactgacaaacacagtctgagaaggcatcagataattcatacaggagagaaaccttacaaatgtaatgaatgtgacaaatcctttactgaaaatggctgtctgagaattcatcagagaattcatacaggagagaaaccttacaaatgtagtgaatgtgacaaatgctttactaaaaaatccagtttgaggattcatcagagatttcatacaggagagaaaccttacaaatgtagtgaatgtgacaaatgttttattcaaaaatgcagtctgataattcatcagagaattcatacaggagagaaaccttacaaatgtagtgaatgtgacaaagctttactgagaaagtcagatggcatcagagaactcatacaggggagaattcttacagatgtattgaatgtgacaaatgttttgcccagaaatcctatcttgtttttaatcacagaaatcatacattaaagaagccttacaaatgtagtcaatgtgacaaatgattttcccacaaacttagtctgagaatgcatcagagaattcatacagtagagaaaatttacaaaaatgcagtgaatgtgataaatgctttactaataaaggcagactgagaattaatcagataatttatacatttaaaaaaaaaccttacaagtattttgtatgtgataaatgcagtacccacaacatcagtctgacaaatcaacaaatatttcaaacagtagagcaacattataaatgaaatgaatgagataatcctttaacaagaaatatcatcttaaaattcactggagaattcttccaaaagggaaacttttcaaatacattgatggtttgaatcctttattttggcctatctcttagaatgtaacagataatttatacaggcaagaatcttaacaaatataatatatgctgaaatatctttgacttcatttcagtgcagaaaaaatatgtaaaatatttttttatgggaaaaaaagttctcctggggaaatgtggcatatgttttacacgggtaatattcttttcaacagttagtgctctaaactagagaattatgaatctgaaaacttttgaaaaccttcatgcaatgttcaaatcttagataatgtcaactattatgctggcagtaactctgaatatatgataatgaagaaacattttcattaaacttttacttgttcaccctcaaatattatatgatgaagtcaggtgtgaaagccagaagaatatgatgttgtgcaacaattcatggagatagaaatgatccattccaaaaggaaactaaataaagagtgtactatcgccttcaaaatgtctaataaaactggcagcattttgtatatttaattcaaatgaagaaattgacacagattgtacttgatagtgtatttgacaaactgagccaccaagactgcatgttcttaatcctataatatgcctacagatgtgaagtgtgctttgagtatccagtattcattattcttatcacgtcaatgtgacaaatgatttattggtttcacgtttcaggatagtgactgactatgagtcccttatgctctgtcaacatctccttcctcattgccctgtaaataaagctgaatattttaacaaggttgacttggctgttttcagtttgcacttataattagatgaataaatgttgcatcatcgctggaactatttctcataaagtatttgctgaagtcatgaatattttctgtaaacctgtaacttaaacttaatatttgtgattgtcagctggtcaataacaaccttgacccacatacgaataatatgaattgtatataagtgtttagcattagaaaatttagcaacagtgtattagagatgatgatttgtgttaactaaaacagggatgattctatgcaatattccaggcttactgctcaattagtactagtttattaaaacaaacacacaatcaaacaaagacaacaacaaaaaacaaaaccaaacaacaacaaaacaggaaacagaaaacatgtaaaggcatttagaacctcaacagtaagtctggtctctctctctctctctctctctctctctctctctctctctctctctctctctctctctcttttgactcaagggaatatgagataaaatactaccaaaaataaatgaaaatatagcttcatagttttcagggatatccatcctaactgtgctatgtccctgcacaactccaaagctctctccagggacaggtataacaagtccttatggtgtcctgtcctattgttcctcatacttcactctgaaccttcatactccactctacctcaaggactgactaagatttccattcttgtcctaaatcatttagggaatgctcacattttacacaccttagaatgtacattttggagaaaaatacaactcactattaaggtattaatctcctttttatttcatatctgagtttatccatacaaatagcatgaatctgtaaatcttaaaagaagtaccctttgtatggtagatgaggtaaaatctcatgcacagtttagaaatccaaacatccaggaaatacatatggaaatactgaaaaaagatgaaaaatatttatgccaagcaaaagcattttattagaatatttatagtaaattcaggaagactcagaaaattaggatctaagaaaatgttatatgttaaaatgaacaaatctatttacacattttccttgatataaaaaaaataaggacaaatttcaacttgtgagaaacttagtgataacattatgttattctcagtagtggaaattgttgaacaaatctattatcactatacatttttccttgatttaaaaaaataaggaaaattctcaacttttgagaaacttagtgataactaatatgttattcttagtattggaaattgttgacctcttccttagtaggatcaaactactaatagacactttagaggcccttgttttcaaatgatcattagtattttctatcaagtgctgcatcatggatgctgatgctcacacaccaggcaatttaaatttaggcttctgaaataacccttaacagtcaggaaattacaaccacctggacagtctctggatattccagtttcttatgttgcatgattctaggccccactgcctgatgacttagagatcattatcccaagtcttcagatatttccagtgtcagtgaaaagttccaaattgtgcacagcaaatacacaacttaccttttgcccctcacacaatatgattgtcttcattctataaacatttatacacctgcttcttgtctatggtacaacaagaatatggtgagggtgtacaacatagattcaggtagactcactgttagaattatgtggaaggtatcatgtgcagattgaaaaagatgaaagtcattggcttagggaaattaataatatcatgtttgaagaccaagaaaacaggctcaccaaatttggaaacattcactatttgtggatgaacattgtaagatacacaattagagccacactacagaagactaatgaacattcccagaagatcttccagtggctacaattttagtaacccagcaggactagggcagtaccttgcatggaaagaaaatatctctttagcagcaagacaactggtgggagaacatggggatgggaaacattaggagtaggtaggaagactcatttcttgattgaaactgcttttttagcaggaggattcctaagagaaactgagggcctgaaggaagtggagtgggatcagaatcccctccttgtcaggagtctgcaagctgcaaggtgtggaactaggagtagagcacgctgccatgggtctcacaacaatggaaaaattcccttcatctgcactgttgccagtttaggccttaggaatctttttcagtcactagagcagtggcaggaactgtaaccaagaagtcatggaaactcccaggtcaaaggaattgctaggctagtgggcagaaaggaattgtaccaagattgagacgactttctctgctgctcataagaactctgaccctcaaattctactgggcatttcttaactgtgttggtaaattactgactatgtatgtttgacttgtcctgatattttttattgtgaggatatttccagagtaatttctaagaggatgaacttgtcttttttttttttcattttttatcatggttatatttccctggttgttggaacaaagcttgtattattcacatctatccatggtttctaactcttctattttatcactttcctagtcaagattattggagattatggagattatgcatccccatgatgtctttaaatattattctcttaaagactgtttgaattttgattgaatctcaagcaatattttagcatttttttttaaattttacatgtctttaagttgtggttgtataaatatggcttaaacagcaaaacactcctggacttcagctcaatggttgactctacgtatctgcaacagtgtcaataagctcctgatagagtctgtcagaggacagtcatgtcaggctctttctgagcacaacatggcttcagtaatagtgtcaaggttttgttttgttttttttttttttttttttttttctgcccataggatggattgatcaaggcagtggatggcattttcttcagtctctgctccacttttgtcactacatatcattagatatgaacaattctgggtccaagttttgaagatggtcagatgcccccatgactcaaatgggggccatgcactctgctggagatattctatttaggttctgtctacccactcttggacatttcggctaaggtcattcccaatgaggtttgggagacttccacatccatcttgtctgggactttctagatatttgccctgctcttcattcccacacggttgtatgtttctattaatactcctggccctctggccttctctcctgtctccccatatacctgatcctgccaccgattgtccctgattctccctgttttatccacatccctcccttcttctgcctcctgggattattttgtttctcctactatgtgggttgaagtatccacaatttggcattccttctaattaaattttatgtgatctgtgagttgtgtataatggtattctgatctttttgcgaaataactacttatcaatgaggacataacatgtatgtcctttcgagcctgggttcctaactcaggatgacattttctagttctctccatttgcctgcaaatttcatgatgtcctcagttttaatagatgagcagtattccattgtgttattgaaccacattttttctacatccattccttggttgaagaacatctggattgtttccggcttctagctaatacaaatatggcagctatggacatagtggagcatgtgtccttatgttattgtgtatcttcttttgtgtatatgcccagtagtggaatatctgggtcttcatgtagaattatttccaattttctgaggtactgccagattgatttccagagtggttgtaccagtttgcaatcccaccagcaagaatggagtgtaactctttctccacacccttgtcaccatgtgttgtcacttgagttcttgatctttgcaattctaattggtgtatggtagaatctcggggtcatctgatcttactagaaaagcatatacgcaacaacactgcagcaatctagaagagacagatgatattctagatagatatattgtgtccagttaaatcaagatgaggtaaactatctaaacagtccagaaacccctaaggcattggactctgctgccctcagaactaggacacacctataaccatgacagtgaccccttctgtgaggtcagagaggccaagcctcactctgtttaggaaagctcaaagggtgtccaggcacacaggtgccttttggactggtatcaaattgattgaaattttggcctctaacctgtcccttcaccaccattaaacacagcttgtagtaggatttcccagaaagcagcatttcaggaagtttccctcccgggcctcatcgtgatagtcgatgacttctgagaatgtcactaaagaaacaactgatatgatcctacacacacacacacacacacacacacacacacacacacacacacacagattcattcacaaatacattaacagccataaatataaatatgttaagtagatgaagaagggatgtgatatcaatgtctgtggccatgcaggaaagggcctgtgagttgaaaataaagatttctaggaaggttcacatgtttaaaagaaaacacagagaaggtcctgggaaagcacttccttatgaacctgtgtaacatatgttccctgaaataatggcatagggggcaatgtaagtagttgatcacttatgagcgtgagttttgggtcttaaaagcaggtactgacttgacagtttcttccagaggcctcccttcctggcacatgtatggtgtcttctccctgagtctatatatagcataccattcggcaggcacccttgtatttactgctgttctggcttaacagaactcctgttgtgttaaacaaggaacacctcaagaacttcacagagcccttgtcactgccattcgggtccttgctcctgttctttcctgcatgcctttatacctgaaggcacatgtactcccatatatacactcccagaccatgcacactaacatacaatttaaatataattatgtatagtgtgcagggttatgtagagtgctgaaataatatgccctgtttgtgggacaatgggctatacacagacagtctggtctccagtcaagctgaggtctgaactctgggacccggtggtgataattcacctacatgagacggaaggagttctctcatgtctcctggaactctggctcctgtcaaagttaccgtcccctcagcccccacagaagcatggttagtagtcatataggcaatgtcccaagcttctgaccttcaggctagactcctccctagttacctagcaacagaaaagataacagcataccataaaaagggctgtttgacccctcctcactctctcacctctcttgatcttaatccccctactctcctccctcctttcctctctctctctcttactctctagactttcttctctatctccctttcccctttgtctcctcttggccatggccggtctctctctcttttaccttctatcctttctccctgcctttctataataaagctcttaaaccatagagtgtctctgctcatcaaggtccactgcacagactctcacctgtgtgggaatctctctccctcagccctcactcccataaccccagggctacagggtgtcactctgggaccccctgttgggggctgtcccttgtccaccccctattgagtggggtcagtggcttagattcccacctggggctgagtggaaagtgtctggcagccctcccatgtctgcctgcccagagcataggtggaactctggctgggtgtgggctatcttctctccctcctcttccccagcctcccttttagttcccacacctgttgaatacctgctttcagtcatgctggagacaacccctggacatacaagacaagattattactgtgaagaagcaaagtcccttcagaagcccagacagtaggactctgcaccatctcctacctgccctggacacaatgggctgccatagctgatagttgtccatggtttagggcacaacagcagagcttcatcctgcactagtctggaggctggagtcttttcatttggtacaagctgggtgtgaccattccctaggcttattctctggtgagttgtaggtgttgtctccctgagtacttgtttggcaagttctttagcatgtgcatatgcacacacacacacacacacacaccctgctgatacttactgcaacagtttctactgctttagcacaggccctgctaaaggtcacttcaaggaccacattaggcttcatatacttcctcactcctatctcccagtatagcacaatgaggtttagtcaggacttcatcacggggatctgtatatatttctcccaacatacagcccaacaaacctgcagtttcttccagatcccagtccatccctgagctccctcacaccaacacaacagcctttaaccatggcaacaggctatatgaggtaacagagactgaccacacctctctccagcttcttcccatgtgcctagatgtaacatgaggaacgaccgtgctttctctcttaacataaagtaccctgacttgtgtaactacaactggtgagttatagttgttgtctccctgagtacttgtttggcaagttctttagcatgtgcatatgcacacacacacacacacacacacacacacacctttctgatacttacagcaactgtttatacatacttgtagcaagatatgtggcatcattccatgtcctcctcatgcactttcacacatatggatgtggacctgcagacatgagcacaaacataagaacatatacaacacacctacaaaatgaaaacatgtatttgagtatagaatgagaagggaaggtgctgtcatggcatttcccatgatactggcatggctgtttgactcatattgtggtagctctctgagtacacatgcaaagattgctactgccagggactgaagtcaccagggaagatcagacaccagtgtcagggatgctctgcctccttccctggacaagctatgtgtgatggtcaaatgtgggcgtggcaaaagcactgttccctccttcctggcctaggctgggggctcaagtcctggtccatatatatatatatatatatgtgtgtgtgtgtgtgtgtgtgtatatatatatatattgtatcatgggggactttcttccttgcaaatatttccctaacccataggaagggtgccaccctatatcctgcatcaggatatgtcgagaagtaggtgaagattcattggtaagtctcaagcctaaatcttttaatagatctcttccccataaagaaatggggagctccagcacgtaaggctgaatttcccctgaatggccctcagcatctttccatttcagactccgtgcattcatatccggagcttttgcataccctaggcctcgaagcttctgattagaattttgcactggccatccctggggccaatccttctgtgctatgatgctgcgatcagctccagtatctaggagccctaggatggcttggccatccaccttcaactccagaactggacgctggtccatctggagagagagacatgtcaggtctacgcccgaggcaccaaaccctccttttcctctttgtttaccagcggaggggaagagcccatgaaggctaggtaaaagtacaatttgagctactcgatccccaggggagatggacacaatacctcgtggtgatgagaccataaccttaactaccccttgataatcagggtcaataactcctggatggacaatgagcccacgtaaagcagacaaggagtggccaaataacaatcctaccgtgtctttttgtagaggacctttaaaatctgtctcaatcacctgtgtgcccatctggggagttaatacgagtctggtggtggaatggaggtccaatcctgctgaaccttcagtggctctccgcggttgtggggatgtctcaatgttggccaggtctcctcttccccctggaaattgtccactgccccatatatttgcgggccctggaagcgagggccccgctgcccgttttttgaccacacactttcatttccaggagtaagaggctggccatggatgtttctgactgatctgcattcactagcccagtggttccctttcctacactttggacacaaagggactctagggggggcgagtcccgcttcccctagagccacttcctttttcaggacaattcttcctcaagtgtccctgcttgccacacctaaagcaagctctgagaggcacatccctctttctcttttgcaactgcatgacagctgcagcaagaccagcattggtcaatggcccatatatcagaacaaacaaaaccaaaactatcagacctacctacaaagggtcaatgggagaaaaaagcataactatatagcgaggatctattgatcactacactgaggttatcataattccttaatctatcccaaaaccgtgaaccttaacttgtcccaaagccgggaactttaacttgtcccaaagccgggaacctatcgttaccttgtgccggcttcctggcaactttatgcttgcctctattttatccgaggtccttcccaaactcctggggtcacaagtttcactcaccgtgaacttaccctgccggcaaccactgactgctgaaagttctgaactcggtgggggagtcggttccccctacaggccaccaattgtcgcttctgctctcgaccacaagaacgacaggaccaccagtcagtccttctaacagcagtttattcagtcctgtttcttcttgtttatatctcccccaaccctgggcctctcactcttttatactctcagttcccatccacacacagcaggccacgccacctcaccaggcatgcagcttcagctaatcagggcagcaaggggcatatctccatcaaaatggattcaccagtatcctggtacatctgcgcagctctcaagatgtttgtggcttatatgaggaagtcaggtgcaagtcatactacttagctgcagtccctgacgcctttgggactgccaccacacccgctcctcacagagggggactactggagagatggcacagcagttaagagcactgattgctcttccaaagatcctgagttcaattcccagcaactacatggtggctcacaaccatctgtagtggaatccaatgccctcttctggtgtgtctgaagacagctacagagtatccacatacattaaataaataagtaaataaataaataaacaaataaataaatctttcaaaagagagaaagagacagagacagaggaggtaggggacattgaaaaaacaagaccctgtaaactaacaatgtctgcacacatatgaactcacagaaactgaggcagcatgcacagggcctgcagaggtctgtaccagattgggtcctagagctgaaaagaaagtgaacacatgaccccattcctaagccactactagcaacctccagtggataaccactttaaaatgaaagtttgttttttttccccaagggaatctcaccggggaaacaaactactctttaagagtaatctgcatgcccaggagtaaatgaccaacagaaaaaaaattcaaaggcatctttggaggttccttgtctcataaagttgtattggagactttccatgtttcttctctaggtccttttatgcatatattatgacttccagtttagtgtttttatgggattcctgagtatgtgatgtgtgtatatctatttcttgtgctatgccttttcttggtctctttttttttttttttttttttggcttgtttgttttaccctattcttatccattagtcttgttttctcattaaaataatacaatacaatacaatacagtacagtacagtacagtacaatacaatgcagtacaatgcagtacaatgcagtacaatgttattaccctttagatgactgttatctgttaaaagacaaaaaggaatatggatgtgaagggagatggggagaaactgggaggagtagaggaaggagaaattataatcatgatatattatgtaagaaaaatgtatttttaataaaaggagaaaatgattagtatactgtctagtttttattgtcaagttgacataggctatggtcaacttggaagtatgaatataaattgagaatttgcctatacagattggcttgtggcatatgtggggcattgtctttattgctggttgacataggaggcccaggcccaccatttgaagtactatgacctgggttttataaaagggtagctcagcaggcctaggagcaatccagcaagcagcattcctcggtggcgtctgcttcaaactcctaccttaaggtctggccttggcttccctcagtgatagactggaatctgtcagatggagtaaaccctttcatctccaagatgcaacagaaactcgacgagagcctgtcgcctctctgtctgtctctctgtctctgtctgtctctgtctctctctctgtccctctctgtttctctctgtctctctgtctgtctgtctctctaaggctgtctgtctgtctgtctgtctctctctcatcaatccaaggaatcctagacatgacgattaatttcatataaactattataggaacaaccatttcttcatctgattattttttttctgggcaagaaactgctgctatatacaagacaccatgtttggcttaatttcaacactgcagctgaaaggcaatgcctgggccagaagacggggatttaagaaaggatttctgctttcttgattgctttcttccctcaaatgaacatatttgcaatctatgtatgagaacatgactcaaaagtagaataggacaggatcatgattgggacaactggagtggccaacccatcccttcctcattgccccacttcagttcctgccatgagtcttacacaaagaccctaggccagcagtttgctggtgccctgcttctcaggacctcttgcttcgttctctaaagctcacatctataaactgacaacaaactcctttttgaactcttcttcctgtgaacaagagctcctgaaaagactgacggagcctggatgtggtggcagacccttttaaactgagtattcgggaagcaaaggcaagaggatctctgagtttgatgccagctccatctatagaacccgttccaggaaagccagggttacacagagaattcctgtctcaaaaaaaacaacactcccagccccctccaaaaaaaggatgattgcttacagaaaggggttgacatatcagaactccaatactctggagagataggaatgctacaggactagaggactagaggctaactaatttgtctacctgggccaggtttgcacaaggcccagaccttcaggtacagaatttagtattaaatacatagtaacagaccaaacctcaagagagagcaggagagctgattctgccccttgccagctgcagcacggggtgagctggccagggcagtgctggagagctcaccctggtggtgtgggtgcaggagagctggcaggctgactaactcagctatcccctaggttcagatccagggctttgagttgggccactccaacatctacctcacctctgaactgctggagcttgtgaaagggctggtcctgtagatcaaagctgtagcttacacaatgagatgttttctgtgctgtatttattattattattattattttattttatttaagggaggaggttgcaagggtagaaagcagatatgaagagatgagatgagtggaattggggtacatgatgaaattcacaaagaatcaacaaaaagtttttaaaaacaataataatatatttggaaatgttaaatgtttcataaaccttaaaatgcttattgttttaaaataataacatttttaaaaactttaaaaaaaagaagtgggagaaaagaaaaaataacatttgttgggtcaagatttcattaagctataaaagttaatgtcatatacataaaattgatcaggatttccttccaaaacagaagctaaatatacatactatttcatctcatatatatatatatatatatatatatatatatatatatatatataataacataaaattcatattatttcttcaaaatactcttgtttattttttaagtctaagtttgtttaatgaatgctacaacgttgagccagaggattctccctcccatctgtctatgcttttgaccattatacgcagctatcttgcttgaggacattgtggcagttttgcataattcataaattgttttgatggttatcccagtggtgacttatcttatttcttttttttttaagatttacttatgtattatatgtaagtacactgtagctgtctttggacactccaaaagagggtatcagatctcattatggatggttgtgagccaccatgtggttgctgggatttgaactcaggatctttggaagagcagttagagcgcttaactgttgagccatctcaccagccacccttattgtttctttaacgttctaagtcactttcctacatataatataaaaagaataattgagtaggccacactattcttagtataaaactgttaagtgtatttatgtttgtatgtatgtgtttttgtttgcttgtttgtttgtttttgtactgggccatctataaattaatagatttacatgtttactgaagatctctattttgtttccttttcacaatgaggattataggaaatgtaatacaaacaaataataatgttgaaaattttttctttctttttttgtggttttgatttttttttttttttttgagatagtttctgggactctgccttctgggtgctgtaattagaaaccatgcaccatggctgaccacccagctattaaatgtctattatgtatgaatatatatatggttatatgttttattgttgttttcataatacatgtcgacataaaagccagagtactcgtcttaaagggaccatatcttaaagggagatgattaatatgagtttttatttttatttttttttgcaatttggtcaacaaatattgagtactgtgcccttgcctcgtagctctatgtcaaaatatggctctatgtcaaaatacatgataaacaaaacagcaatcggccttgggcaaggagtttctaaaacagctccgctgcatggttctattttgccggtttttttttttttaatccacctattgattttgaggattatattctagcctaaggaatcgatttagacccaaatagttggttctgatctaacgacagcaaagtctaggcgccactggggcactgttgtatctcctaacagctaatcccaaataaagactccaggtgtttgggtccaagctgactccctcccccctccctcccccccccaccccccaccccccatggtaaacttcctaaggttgactggggtccttggatggagaacctccaaacgaatggacagcatatccaccagagggtgctgtgaggacaggtctgtggtgggaggggagctcgcccagtgaccctcaaacccaggtaggctttattagttggtttttctttcttcttcatgtttccttcctacccgctaaaaccgtcgttacccctccccccactcagggtctcgttttgaagatagtgattcgactttcgccgcgactacagcagagctgtgttccagaggaagtgttatctctgtcgcggctggagacgtcctgtccctggaccgcccggggcgcaggcggtgggtgggtggggacctccgaggccgcagctcgccgttgcgccgcaggggccgcgaaagggttaacccggcggggggggggggtgcgagaggagggagggggcgcgggccgcgcgtgcgctctgccgccctccattgtctccacagcggcgaggagcgccggcgaacgcagcccgggacggagcagggcggcgcggctggctggcggggccggcggcggctggagccggagcacgacgccacgcgaccgcggcttccagagctccgcctggctaccccaccgccgcgagccctcccgaagcctggaggagtgagggccgccggcgcgggctgtggagtcctgagacgggggacgcgaacggcgcggcgcctccctcccttcgctgcggctccttaggctcctgagcccggggggcggcctgtggcgcgaggcgccggctctggaccccgcttcttcggacctgggctccggagcctcgctggcggatgctctacctctgcacatcgcacccaggtggttcagctcgcacctaatatgagtttttaaataaaacattttcaaatctgcttttagggtaagatatacatactcccactgtactggtctagatgctatctctttgatccttatcccacttctggcctgtattgcttgaggatatacattaacttgtcccatatttcttgaggacctacattaactttaagagatggttgcaccttctgtaggatatgatcttcctgtgcactcccttgaaatactaaactctattccaaagattaaaaggatgatttatgcctgtgctttcgtatacatatcacatatatggcaatagacatatgaatatgaacgctttgaagatgtttatgtgattttcttactacttctgcctctttaaagtcaaacgaatgcgcttttcaagaactatgtaagagataactctaaataactttttaaattattatttaagaacctactttaaggcttatacagatattttagagtttacagatgattaatatattgcaacataatgatatatttttaaaaattagttatccttgttattagcttaaaaatgaataattaagtcaaactctatcctgatctggatgtcttatcatattttgttacctcttaagtacaataaaagtaaatgctgtttctaacaacaaaactccatgtcctcttacactgcataatggcttaaattttaacacatacttaatttaaatttggtcacaaaactactaatgtattttaactacttataacagatatctaaaacactatgttttatgtgttttagataaagcctcttggtcttccatttttaattaactcattaaaattgttttctaaatttcatgataacaagaagaatgaagtatattgtaaaaaattatttaaactggatatatttgttaataagttaaaaataataaagagtttctggtttccatctgctcctggagctgaccctgtgccacagctctccaaacccaaattcctctgggagaaagctggtcttccaggagtgctgacacacctgagagcacaggtaagaccaccacttctgctcaaatacccagcccaagaggaccctcctagagccctcaggacacaggaaccaagaagcagcctgggaccagatccttctagaatctatctgcactcggagctgaccttgtgccacagctctccatacccaaatcccaccataagagaactggtctcccaagagtgctgacacacaggcttacaggagggacaagccacagtcagagacagaaagaccagaaaacaccacagaaaaccagatggcaagaggcaggcacaagaatataagcaacagaaaccaaggctacttggcatcattagaacccagttctcccactacagcaagccttggataccccaacacacaggaaaagcaagactctgtttaaaatcacatctcatgatgatgataaaggaatttaagaagaacataaataactctcttaaagaaatacaggagaactcggataaacagctagaaacccttcaagaggaaacataaaaatcccttaaggaattacaggaaaatacaaccaaacaagcaaaggattgaacaaactcatccagattctaaaaatggaagtagaaacaataaagaaatcacaaaggaagacaaacttggagacaaaaaacctaggaaagagatcaggagtcatagatgcaagcatcaccaatagaataaaagagatagaagagagagactctcaggtgcagaagataccacagaaaacatggacacaacagtcagagacaatgcaaaaagcaaaaagctcctaaccaaaggaaaacaaaacaaaaacaaaaaaacaaacaaacaaacaaaaaaccccaggaaatacaggatataatgagaagaccaatgttagggataataggtatagaagagagtgaagattcccaacataaaggggcagtaaatatcttcaacaacattatagaagaaaatttccataacttaaagaaagagatacccatgaacatacaagaagtctacagaactccaaataggttggaccagaaaagaaattcctcctggcacttgatagtcaaaacacaaaatgcacaaaacaaagaaagaatattaaaagcagtaagggaacaaggtcaaataacatataaaggcagacctatcagaattgcaccagacttctcaccagactatgaaactagaagatcctgggccaatgtcatacaaacgctaagagaacaacaatgccagcccaggctactatagccaccaaaaatctcaattatcatagatggagaaaccaagatactccaagacaaaaccaaatttacataatatctctccacaaatccagccctacaacaggtaaaagatgaaaaactccaacacaagaagggaaactctaccctagaaatagcaagaaagtaatctttcaacaaacccaaaagaagttaaccatacaaacataattctacctctatcaacaaaaacaactggtagcaacaatcaccactccttaatatctcttaacatcaatgactccattccccaataaaaagactcagactggttactcctccagagagccaaataaccctattttttaaaaaatggggaatagaactaaacagagaattctcaactgaggaaacatgaatggctgagaagcacctaaagaaatgttcaacatcagtaatcatcaggcttatgtaaatcaaaacaactcacctcacaccagtcagaatggctaagatgaaaaactcaagtgacagcagatgcaggcgaggatgtggagaaagaggaacactcctccgttgctgctgggattgcaagctggtacaaccactctggatatcagtctggaagttcctcagaaaattggacatagtgctacctgaggacccagctataccactcatgggcatatattcagaatatgctccaaggtttaataaggacacatgctctactatgttcatagcagccatatttataataaccagcagctgaaaacaacctagatgtccctaaacagaggaatggatacaaaaaatatggtccatttatacaatggagtactactcagctatgaaaagcaatgtcttcacagaattaacaggcaaatggatagatctagaaaatataatcctgagtgaggtaactcagtcacaaaagaacacacatggtatctactcactgataagtggatattaggcaaagattgtggaatacctatgatacaactcacatgaagttcaagaggagggaagaccaaagagtggatgcttcagtcctatttagaagaaggaacaatataatcaagggacatagagagtgggaagaacttgggaggaagagaagagagggagggggaaagaggtgaagaatcaagtatgggaggagatggagaagatgtacagagggtcaggaaattgaacagaagtatgtagcaatggggagtggggaactggggtttagcaactagaaagttccagatgccagggaagcaagagcctcccaaaaccccaagggaatgattttaggtgaaataccccacaaaggagagggagaacctgtaggtcgaaaccatatccagaggttaggcaagccccccccacccccccacccccccggttgagtgatggggccacccacctatctgcaaaattttaatccagaattgctcctgtctaaaggaaatacaggcacaaagagcagaacagagactaaaggaaaggccatccagaggcggccccacctggggatccatcccacatgcagacaacaaacccagacactattgctgatgccaagaagagcttgctgacaggagcctgatacaacaatctcctgagaggctctgccagatcatgaccaatagagatgcggatgcttgcagtcaaccatcgaactgaacacagggaccccaatggaggagttagggaaaggactgaaggagctgaagggactttatctgacatcaatgtgaggggaggcccttggtcctgtgatggcttgatgccctagggtagaggaatgctagggtggtgaggtgggatgggggtggggcaccctcataggagaaaggttggggtggggataggggagtttcagcggggaaaccaggaaaggggataacatttgaaatgtaaacaaataaaatatccaataaaaaaaaagaaaaaagaaaagtcttttctaagcatgtcataagataaaggtggaacactccatgaaaaattagggacaatttgaaaaccttggagaaatgccctataacaattcatagcaaaagtgtcaatttcttctatatataagaaaatcaatagggaaaaatcgatataaagaaaacccagtacaaagtactatggtaaagataaaataaacaatacatttccgcttatcattaccagtaacacagggaataaaactgaaatattaagaattaaatatccattttctatgttaaaaaaatatagaggttgtaaaatttaatttaatccaaaaccctaagataaagttaatgcttgattttttgcattcatattcttaaatattaatttgttcttagtaatatttaccaaaaacaaaagaactttaaaaactgttattttatccttttactaaatggtcatttaaaacctgtgtctcaagttagcttttcttatccaaattatacagaagacatcagtctaaaagtctagtagcaatattcacaatgttttataacttaagtagtgatgtttcttgatttaattagtatctaagctgtcctataatacaactagctaagattaaaaagttaaacaatttgtatcttactaataagaaagggggaaggataatgctatactgacttctcccaaagtgcttttctaaccatctaaatatgttagttcatatattacaaataattataaatacaggggaaatataaagtcaatctggttacaaagtttggttttagacatgtttcctttttgaccttcactccattttatcaaactgtgttgttgatttcttaatttaggtatagtcatcttagctcacacgttatgtcaggtacagagagtataaaaaataattcaggtgcggatcctgaacgaatggattgatatgatccaggattttgtttcttaatggcctttaccagctattctctctcctgaagatgctgtcctgcccactattcagcctcatctacatcaggtcctatgaatgagcttcctagttgtgagggaacttacgatatttaataagtaacatgtggaattgctcctgaccaaaatgtgatgtttgtagacaagggaattgtgaatgacaactcctgaggacctgacatctacatcaggtcctatgaatgagcttcctagttgtgagggaacttacgatatttaataagtaacatgtggcattgctcctgaccaaaatgtgatgctttgtagacaagggaattgtgaatgacaactcctgagaggaggctgtgtctgagcagaccgatttgatctgcaataccatggagagagtggaatggtgcaggctaattaccttgtcttgggctagttttagcgagccctcctcccagtagccataccttacctacctctgtgtcagaactaacattctgtgactaatagataaaaaccttttgaaatttactaacttagcagactgctagcttctaccaaccccaaagctacaaatgtcatccaactaaatttgccttgattttgcctttctttgttctgtaaaactgtgaaattgcttccacattgggacatagagttgggtaacttcaatctgtgttcctggacaatggtcacttgaaatggcttcagaataaactgtcctcttatttcctttaagatgagagctgtggtgtttttgctttaccattttctcattatctgtgaatttcatttttttaattgaagagataagaactcaggggccactgacttagtggaagttttgtgtgaccatgggtgtctgagaccttaaatcctgaattaaagtccatctgaggaaagcttgcttctatcaaactcaaagtgtatctatccacttttctgaatcagcagcaagcttcagccttttcctacctcaacatgagatcctgggggagattccatttccttgataaccatttcttcaatagtctggtattgaagatacctagaataggacatgtgtttctctgtagaagatctttgcttcttccaggactgccacattgctgcatgctcccagacaaaaagctctttctttctttctttctttctttctttctttctttctttctttctttctttctttctttctttctttctttctttctttctctctctctctctctctctctctctctctctctctctctctctctctctctttttctcttctcttttcttctcttctcttctcttctcttctcttctcttctcttctcttctcttctctctcttctcttctcttcttttttagatcattcgagacagggtttctctgtgtagtcctggctgtcctggaactcactctgcagaccaagctggcctcaaactcagaaatatgcctgtctctgtcacccaagtgctgggattaaaggtgtgggccaccactgcccatctaggtttttttcttccttccttccttccttccttccttccttccttccttccttccttccttccttccttcctttctttcttcctctctctctttctttctttctttctttctttctttctttctttctttctttctttctctttctttctttctttcttttttctttctttctttctttctttctttctttctttctttctttctttctttctttctttctttctttttaaatatatttttacttattgattctgtgtgcatatgtattggtgtgcacacaccataatgcacgagtggagtcagaggacaacttgcgagagtcaaatctttttccaccatctgggttctaggtatggaactttagtcatgtagcatgaaccttgaaccttggacaaagtccactgagccatctcatcagtgccccatcttttaaaataaatattttaattaatttatttatttggtatgtgtgtgtgtgtgtgtgtgtgtgtgtgttagagcacatgcacacatctgtgcttgcaccatccatgggttgcggtcagaacaaaacttttaggaggtctccctttacatagcttgaggcagggtctctcttgtttcttatttatttatttatttatttatttgtttatttattttttattacgtattttcctcaatgacatttccaatgctatcccaaaagtcccccataccctcccccccacttccctacccacccattctcattttttttggccctggcattcccctgtactggggcatataaagtttgtgtgtccaatgggcctctctttccagtgatggccaactaggccatcttttgatacatatgtccagaaaatcaaataaccccattaaaaaatggggctcagaattgaacaaagaattctcacccgaggaatactgaatggcagagaagcacctgaaaaaatgttcaacatccttaattatcagggaaatgcaaatcaaaacaaccctgagattccacctcacaccagtcagaatggctaagatcaaaaatttaggtgacagcagatgctggtgaggatgtggagaaagaggaacactcctccactgttggtgggattgcaagcttgtacaactactctggaaatcagactggtggttccttagaaaattggacatagtactaccagaggatccagcaatacctcttctgggcatatatccagaagatgtctcaactggtatgaaggacacatgctccactatgtccatagcagccttatttataatagccagaagctggaaagaacccagatgcccctcaacagaggaatggatacagaaaatgtggtacatttacacaatggagtactactcagctattaaaaagaatgaatttatgaaattcctaggcaaatggatggacctggagggcatcatcctgagtgaggtaacccaatcacaaaggaactcacacaacatgtactcactgataagtggatactagcccaaaacttagtatacccaagatataagatacaatttgccaaatgcatgaaactctagaagaatgaagaccaaagtgtggacaatgtgccccttcttagaattgggaacaaaacacccatggaaggagttacagagacaaagtttggagctgcgacaaaaggatggaccatctagagactgccttatctagggatccaccccataatcagcttccaaacgctgacaccactgcatacactagcaagatttgctgaaaggacccagatatagctgtctcttgtgagactaggcaggggcctagcaaacacataagtggatgctcacagtcagctattggatggatcacagggcccccaatggaggagctagagaaagtatccaaggaactaaagagatcttgtttcttcttatatacaatgcttgatttgtattaaacttgtctgaaaggtttggggtttggaatgtaagggggtcactgagggagactgtccttgggatggataacagacttatttgaagaattattaattacatgggtaggaagacaaaacagcagcatggcaggagttctgagcaagctccttgccccagtgtcataggaagacacacacacacaacatgggtgggttctatgagagttcaggatcatgaagcagaactggagtcccttataggtctcagtgggagggaaaggtctcatgtcatatgcttaatgagtcatcctcagtgtgagccaagctgtccttgattcccaggtcacaagggaggtggccctgcattctggagaaggattgcatgactctgagaatgctgaaggggaaaagaacatctagttgaggtggatccattatacccgtagccctctgatgtcctaggagtctggtaaccttggggaagtgtgaatgacacttgccattctcctgagagctgggcacctgggaagtctgctacaggattggagaattagagagtcattgacagctgtggctgtaaggaggaagcttctgcctgtaaacacaatcagcttatacttataaagctagcattgtctccatgcagaagggacgctctttgatgcccagccagtgcgttcccttcagctcacttggaacttagtggtttgtgtaaggatatactgttagatcccagcctctgcagactcctctcacagatactgacagtcaggcttctggtactttgtgtgtctcttgctaacaggttcacctgggaagtgcaactacaccaaagacttgtcacagtttgtcctccaccccttcctctgcttcctgcctgggaatctgagagcctgactgtaaactcttgttgtgaaccccacttcctaaaaatgtatgggaagagactacctcttctgcgtgtagggctcttattctctgtagaaacttccccatgaggtcactagtgtttgagacccaaactcttctgagagcccctggcattctgctgctcctgtctgtgtgttcacggcatgaataactctcataataaactcctcagtccccagtcatcgatctgtgtcccctggaatcaccaacctcaaatccaaaacctatcagtttgtggacttggtggggagaagtgtacagaggcggtaggatttggtcataaagacgacatagtattaaagctgaccacagagacttggttaaggctttttaactgcattgaacattttttcctttgctttggattatgtatagttttgatgctgtaaccaggaatgcctggcaggaagaggatactttaaagacacttgtgcctgcccttttggctgtcagactattgaaacaatagccccaaagaaattacaatttacccaagaatctctcatgctgggagaaagaaaaagctgagaggaagccaggaagacatttcagcttgacaaagaattatccccttgagcaagatttacaacttctcagatgacccaccagaaagcttggatctcagacagcagtgattggccagaccattaggaacctgaagcttgaggatggctggggttggggggggggggcgggggcgggacgggggggggagtagcggggtgtgtgtatgtgtgtgtgtgtgtgtgtgtgtgtgtgtgtgtgtgtgtgtgtgtgtgtgtgtgtgtgtgtgtggtgtcccctccatccgtctgtggatttctttgccctcctttccacggtatgattgattctcctttgcttttttacgttaggtttttaaatatagactttctaagaacgaatagctgaccgtcagtgccaaggctctggccctaactgtgatagcaatgcgaggccagattaagcagcttcgtgttgtagtgaatgacctttggctttctgtaccgccgctataaaacattctgtttattctctgaaaagaaaccgttatctctttcctcccaccacagtctgaggtatgtaagtaacttcagacatttcagaattctgtcatcacagtttaggaaaggacagtgtggcatcgcacattacacatacagcccgcctttcctctttaaatccccggtgggccttgcactgaaacctaactctggttttgctttggtttttgttcacttccttttcaaatgtatcttcttcctgctgacttttttttttttttttaaaggaagcgcctgcgaaaggagaacccccttccataggactaagagacaggaaatttacgcggggatgggtgcggggactgggaagcactgctcaaataggtttactctctcggttctgaaatacagttgctgttaaggctggagatgctgctgcccagagcacaagatataaaaagatctctctgtctggatttcctcttttccagtctccttgccagcaactccagaaaaaaacttcaaagctgataagaggggttaggttgtcttgagttggaacccacatttctttcttgattcaggataaccagctaacagatattcactactgtcgtcctgaaattaattgaggatattcattaatttcctggaagctagatttttggaaagtcttgattttgcttgtctcttgaggcaaaatttatcaactttggggattgataaatcttctgtcttctgaaagagtagtaaactcagggctccaagatatgctaatcataaaacagatagcgacattccttcatccacccacccacttcctgggttcaaagagtgttcattcaaagaaagtcaccctgaccattgctggaacccactatgcaaaggtgctattgctaggggctcttagattgttagtggctcttagaaactgtcttgagagataacctgacacttgtgactttgtacttccttgtgactcttaactggtatttttggtattttccaacaacgtccttcccacctccttgagttgtggttccttcctttaaatacccccttactcagctactcagggcgccacggtcctctacccttgcgtggtgtatgaccgtgggcccgagagcgctcttgaataaaaatcctcttgcaatttgcagcaagaccgtttctcgttggtgattttgggatgtcgcctctcctgagtcagaacgtgggggagtcctcacgttgtgggtctttcacttcctcgtcttctccctgctttttctcaactcccctgcaagcgagagtggacacactcttagggtggcttttgtggcagacatggatcctagctgagctctttctccagtgtacagcattgctgcatctcactgaggcctgaacagttctccttttaacacctcatcacacatagctgaggaactcaaacgacctacctcttagctcttctcccagacctgtcttgtttttatatcttcatgctaaatggaggattgtttttgtttttgttttgtttgttttgttttgttttgttttgttttgacttgtgccttgacaaatgtgcgattagatctatactttctacactgtactatgtgaatgagtcactggaggatcttattaacatataggatgagagtatgggggtttaagagtagtcagaatgtgttgcatgcatgcatgtaatcagcaaagaatgtatttaactagttaaagaaataagaacaagaactggagatgtaactcagtagttggtcacttgcctaacatatttaaggctctgagttcattcacagtgccacaaggaactggaaattaagagccctgctattaccctgagattctatttttttaattagtttattttgttttaaagacatggtctcactgtgtagccttggttggtctccaactggctatgtagaccaggctggcctcaaacttgatctgcctgtcctcacctcttgatgctaggattaaagtcatgcaccactgcatttgccttagaatttttaaattttatcaggggttgaaatcaaattcaaattgtgataggctagccagtatcctacctctaagctgtatccctagccctcagattctgccttttaacaacctacaagtttgtattccagccgtgagtaagaaacaagtgcttgcgtaactctctagagattttgctgtttaagaatgggctggaaggcacagacaggactggatttggctgagcgcgtgattaaagagctgaggaaaacaaaatcaaacaacatccctgccctggttgtctttcattctgatgtgttgtctttaaatttagaagtttctctcaaggagttcctagatgctgtaagccaggttagggtgtaggtgtctcctttactgtatgttcgttcatctttgagcaaagcctttctttcttctccacacatcacacatttagttagcagcccattctgcttttatgtcacaacaccagagaggagtggtgagaacagaagctacatgctcagaagtctgaaatgtcttctgttagatcttttacagcagaggtttaccaagcatccatgacgtaggcagaggtactctttactctccaggtcagtccggctatgactctggcactctttttggcactggtgatagaagacagaaccagaaatccctacttgttggaacttataataaagaagaggaaaataaatgtatgaaacagtgtataaaagttattcagggaggcaaaaaggaggtttaacaacaaagtgttatggacagctatttgaaggcagtctgaagagacagagagagaggcaggcagtggagaaaagcatgggtgaagcagaagaccagtgtagatggagtaatcactttatggttcccacagctgggcatttgtagtcaatagttattgctgggttaaggcgacagcttacactgcagtttaatggcaccctccacaggcccattcactgttctatgaagtcagctctttcatcataataggggtatgtagtgaattttgggaacatgtgggtatctccaaacctcagatgccgtatatatatgcctgtcgtgagaagcaacattatgtcaaatacatgacaataaccttgttcttagttgcaaggaagtgatgtgcagtgtgatgctagataaagtattctttagtgtcatgaaaataatgcagagggtctgcaggccagacaattaaacttccaccatgagtgtgagattatccttggaaggattaagttgatcttccttggattggaaaagtgtacatttattgaagctagggggacacctggtcatcctgggtaattgtttcacaacaattgcttagcattggctttgtttgttggtagactggagacactgcaagagcgataggcagagcaccctgagaaaggtgaaaagcatgctttaagtgcaactgtgttatccttgtatgctgccagagccaatttgtgacatggaaccactgatggactctgagaaagcctggagaaaaatgttatgggcattcccagagtcagttatcttagccatctgatattttaaaatctccataatggtgtgcttcagtggacatacaaatatccttatattctgtgtcagttgtcagattttcagttaggaaatatttgttaggttagtgactgcatactgggtactagatgctatgttgtctatattaaaaatcttagtcttgtgctgccttggagattggcatttcaatctgattgaggctgtaatgatctagcaatctactttgtttttgtttcctctaaggagatgacttaaataggaattaggggaaggttttggctatcctctctatttttggaattaatctctgcacttctcttagggacacagtacaggctgagcatcccttgatccaaaatagttggggccataagtgattcagacttgagaatgtgtgcatgtattccttaaagtcttatgtcagacccaaatctaagtgcaaaacgtgttcacacttccttattcacatacactttgcagtacagtctgcaggtaactgtacctgcatttttactgtgatgtgtcacagaaggccacttgtacaatattcaacattttattactccaaatgtttcagactatggaatacttcagttttgggacttttggatttggggttcatacttgcattgtttctgtgttcttgggagtagaagggcatgttcaagagaaccccgtttaatgctcgctcccatcacagctgccactctgcaaggcctgcaacctacatactcctctgcaaggctcagtctttgaatagttcaggtcaggtggacaattttagaggccatatctaataacccctgtaagtgtggactctttccttgaccaagagtcgcccagagtagatctcgttggggcagcattatccaaagtgtatttctagaccagcactaattgacaaacttatggtgattattactgggtattaattgcaaatccacagacattatcctaatcctattaaatcagaatcctggagagcggtttcttaaatcagtattttccttatggctctgtgaggggtggtgctgctgtacttgaaccagggttgtgaggatgtcttcctactgacctacaccctgctgatgagctaatataccctgagaattgacatttactaaggctcaccacatgtaactattgataaatacttgtttctatcagtagttctcaaccaggatcaattgtgcttcttatgtaagattcttaaataaaacacactttttaaacataataattataatctaagactcaggttccatttgtatctgtttataatcccctccccgccatgcaagcaatcctaattaaatacaatgggacacatatacaccacacacgcgtgcacgcacacacacacacatacacacaaaaataaccagaagggggaagacaaaatttagtggagagtgggagtaaaggaggataatgaggagaaagataaaaaagtatattttatatgtgtgtgtgttcaaaattgaaaaataaaaagaatcactatagaaaaataaaaacgaaaaacttccaatatatgctcctcagagggctctcagcctctgcatggacttagtgctgagtattgggcgtaaggcatgctttggccccctaagtttctgcttccctgtgtatgtcatgaagatctcagtcccatgattattgtgctcttgccatagagtacaacaacgggtcagagaagtctggttacctctcatccctctagcttaccctggaaattgtaccacattctctctaacagtgaagctgtacctgctggcctttgaggtcactgctgtcgccctgaggttagggtatccatttccatgtcaatcacacctaccattctgtctgacctacagagttcttcagatctaagtcatctattattatgtcttctttgtgtctggctcaccaaagcatttattagatgtgagccatagctaccagttttaaaatatgtatgtatgtatgtatgtgtgtgtgtgtatgtatgtatgtatgtatgtatgtatgtatgtatgtatgtatgtatatatgtgtctgtccaagtgtatgcattcttattgtaagtacacacatttgtctacatacatgaaggccagaagagagagtcaacatacccacctttattaccctgtgcctacttctttgagccagggcctctgcctgaatgtgaaactcatttccttggtaggatggatgcaatccccagtcattctcttgtctctggcccgtctcagagtgggggttacaggcatacatgagacgtccaacttgtaacatagatgctacaattcaaactctgactttcatgattacacagcaagcactcttaacagctaagccagttctctagttccagtctattcatttttaaacatttatttggttaggggttcatgcaatgatactatagagcgtgtgtagaggtcagagaacaacttggagaagttgattctccccttccaccatatgggtcctagtgattgatctttggtcgttgtgcttaacagcaagtgtctttagcttctatgccacctgctgactctcatcagtgaatttttaatgtactgatggaagtattatcccagagagtcaagttgaagatggacatgccccatcccctagctgaacataatgggcccattatttctgtaaatgttgctatcttttgtcaaaattttcttagagattttctgatttttcaattgcagactctagaatgttattagctatccttttcaaactgttactgccaccttcattattccaccaacatgctatattctaaatccttggggtctaattccttgggaattgtgctctcatcaatgactttgatttaatttctttgggtgattgggattctaaggctggccttaaacttgctgtttgctgttcatctgactcagcctccttagtggtgggattacagatacgagaggccatacttagctttgatgattacaacccccaggagccacacatccccagctcttcctaagtggacagctcctaaagcagcatggttttaggatgagatcgctccctctggaggaggccaagttactgtctctgatcgttagtccagatatctatctattgctgcctacaaaaccatctcacatttaagtcagcaatttattactaatctctttgtttgagtagagtgggtttgaaagagaacccaaggacaagactagagagctgatggaatttgaggggatttttgaagagtgttgttgtaaaagagttcagagcaatagaacaattggaaggaaatgtgggattaagagaaggactgaaaaaactgaaaataaaaaaaaagagagaacgactggagatggggtaaataaataccagcatgtttatgctgtgccaagtgatccggaagacttcatatttataagatgacacagaggagaaagaggaaagggctgtcactgagcaaggaaagaaatggaatttgatacaaagcagctgctctggtctttacttagaaaggtagactgctcctctcattacaataaggtgggcactgccagtaatctcaaagttcccctttgcttcaattttctcagtaaagcaggaaatgatattatcactcgagaatgatacacacatgtgcatggggggagggcgaatatgattgggagaatgaatgaatgaatgaatgaatgaatgaatcagatgactattgaaatagaaaaataaggacaatgacaggagtggtgtgacacatagcaagaatttctctttctccctcttccccctccctccccccccagagagagagagagagagagagactgcaaaaggctgaggctagccaccatacagtatcagctggataccaatgagacatcagaattcttgaccctgaatttaaaatcagatgagtcattattttttatgttttccccagtttcatgcaggatggaaaaaaaatagagaagttagagttagtgggttttgtctagagtctgcctaggtaaaagagggagtttaggtgctctcagaggtgtgaatacaacaaaagattgtggactttcagcaggcgtgggaacatgagaactaaagaagaccacataggatgcagcacagtgagggagtggtgtgcagcttcttgaggggtctcgaggaagaattgggttactaatggtgacttgaaagggagagaaattggggtggcaacccccaagacattacctgggagaactttgcagaagcagggaagagtgttgggaaggtcatctgtgtactgagttactgagatctgagacaaaaggcatgctggacagtgtcaaagatggcagtggtggtgagactccgatagtgacaacgtttaaggatgtggaattcaaagctgaggttcagtgaggactgttagatggtccaatttggaatgttaatagtttgtgttactttcccctctaggaataagcaatatcagaatgtgaatgtcctaatgcttttaggaaaacttgtttgtgtaaagatgtttcatgctttaatcaccagagggtgccagagtcaagcaaatgatttttcttctcttcatatgtgtatacaatataggttgagtatatacatactctactgggcccccctccagccccttgagaactcacccccagcacattttcccctcaacttcatgaaataaacacacacatacacacaagcgcacaaacacacacttctgaaacaaatatccaataagtgctgcttgtatgtatttgggtacttttagttttcatctgtagctgagataatcttcaagtagtggaaggaggcactatttatattggagaggggaagtgtgtaagtgagaatttgccacataaactaggacatgtgttcttctctccatacaaatctccaacttcttatatttttgtttgtgaacctagtctttagtggctcggccatctcttcggctccaaagctctaattcctataattaaaatgaaaacaggagaaagtggacaaactggccttcaccttgatggtggggaaaccctctcctctttactccacctccctaactatctttactgcacacttcatgtttccctttgatataatgagacaatgtttcaaataagagaattgttgcattcagaaaagtaggtagggcttccaaaactagcctgaagtattctttaaattctaacagctttggtttttgtcttctatggcaattcttctgaacttgtcttagttttagataagccttccatgctaagtacattaaaacccatatgtccagacccctttggagtggtggggggtgagggagggtcctgcctggcacttctgtaggtcagaggacaactctaaggtatagattctcctccttccaccttgtgagatccacagatcaaactcagattgcaagtcctgtgattgtttgcctctactggctgagttatctcaagactcgaaaatgatttttctatttaagtatttctattaaattttttatcttttaattagccaaaacattctcattctctttctgtgtctctattcctctgtctgtctctgactgtctgtctctgtctgtctgtctgtctgtctctgtctctctctctctctgtctctctctctcgcctgaataaggagaaagcaagctaggcatcagcacccatctctttctgcttcctggatgcagatgcagtgtgaactgcggtcaaatgtcccggctgccagaattgcctctctatagtgcaatatgccctcaagctcagagacaaataaaccctttcttcctagtttcctttgttaaagtattttttcaccatataagagaagtagctaatacatattttttatttcaagcagaggatatttagtttgtatgtgatttaacattttaaacatttgaagaccttcacacggtgtcacttatgagcagtgtttagattttcagaacagacatgtttcagaaataaaggacttatcaccaaggcagaaacgcaggcaaccctttcagtcttcttaaaacccaggcaaaaaggcatgtataattagtgaaaatagcaaataccagaagttactgttttgcccttaagttatctgtggcaaagctgtactgctatattctctcatcttctccttctccctctcctcctctaccttccccactctcctgcccccactgcatgagaacacttgccatttgcttgagtaaactagctttgcttacacttttactttatttttattttcactttattttattatgcaagaacactatggtactggaaacacaaataccctgtggcccacagtctttccacagaattggtcagtatgtgtatcatttgtttctttccacatccttaattttgctctttcttttctgtaaggtctgcctttatttgttacttgacctttttcccttacaagttttaatattctttctttgttttatgcatttgatgttttaattattatgtgacaggaggaacttcttttctggtccaatctatttggagttctgtaggcttcttgtatgttcatcggcatctctttctttaggttagaaaacttttcttctataattttattgaagatacttattggctcttttagttgggaatcttccctctcttctatacttattatccttaggtttagtcttctcattgtgtcctggatttcctggatgttttgggttaggagctgtttgcattttgcattgtctctgactgttgtgtcaatgttttctatggtatcttctgcacctgagattctctcttctatctcttgcattctgttggtgatgcttgcatctatgacacctgatctctttcctaggttttctaactccagggttgtctcccctttgtgctttctttatttttctattttcatttttagatcctggatggttttgttcatttccttcgtgtgtttggttgtgtttttctgtaattctttaagggatttttgtgtttcctctttaagggcttctagctgtttacccatgttctcctgtatttctttaagggagttatctatgtccttcttaaagtcctctctccccatcatgagaagtaattttagatcagaatcttgcctttccagtgtgatggtgtatccaggactagctatggagggagaattgggttctaatgatgccgagtaactttggtttctgttgcttatactttgagatttttaaattgactccagactctttaaaataaaggtttagctcaaagaacagaaaagaaaacaatgtctgttttcttctgcagctttgataggttaaatttgtagctacgcttgtttcaccaatcgtatttaaatttggtagagtggaggagtttgtatagaagtaagtttgataacaagtcccaagttgttgcagtatgtgcccgttaaatgcaaaatatgattgcaagttccatgaaatcaggaagataagttgggcttgaacgatgctggtgggtcactgaaggtgggcttagctttctcacggttgctgcctccttggccagaagctctttgctttttcctgaggcacagccagtagcagggacacaaaaggaaatgtccaaagagtccctggagttcccttttcttcagctcgcactggcaggaaacccgaaaaccttctcacttctctaaagtataattaccaaagacatttcaatttgatttttttaaaaatcatttaaaagtcttcacaaaacaccagcagggtacaatgtttgacttcaccaacatgtacattttcccaatggctatctgaattcatgactctcaaacgctttatttggtaaagtcaagattctaatcttaaagattaaatgatatttatgccaattatatttctagttatagtttcttttctctcttcaaacagaagagaccaaactttcagccactcttcctaaatgcacactgattccaatccagttgctgttaaaaataactaaaaatataagtaacacatacacacacactaattttaaaaactacacctcttctgcttgcaaaaagataatattatcttttgcttatgttcagcagtctcatcattcctcccctacaatgttcatggggacccagagtctgctaagaatattctttcctcacagctgactatagagttccaagtctacaaccagcctatatacctaaggttaaaagattatcatgaaacaaaaattggaaagcttgtaaaatccagagagtcagaatgtctgatgtgagattgtgtttactacatgttatagcagtggttatcaacctgttggtcacgacctctttgggggcaatcctttcacagatgttgcctaaagccatcataaaacacagatatgtacattattacagttcataacagtagcaaaattgcagttatgaagaagcaacaaaaacaattttatggttagagatcaccacagccatattgaagaactgcaacattaggaggggtaagaactactgttcgagatatatgccaaggtctttgaaacagggcttacttaggaaaatggcctcagacaaacctactctgctaattttttccctacactctaaggtactaacatttttaaacataaaatcaagccttttctagtactcaaataactgatataaggtaagcaaatcgaaggcatatcagtgtagtgccacacacctctaatgtccatctttaagaagtagaggcagaaacatcaggttattcattggcagcctgagccaaagacaatctcaaaataaatgactaaattagttaatcaataaaaactaaaataaataaattataaatatggttaatctaagttctcagtgtcctacactagtatagcatatgctaccattcctggatagaagtgaatggttactcacttcagatagagagctaatgacagaacaaactgaagatgtcaccaaaatttaacttggtaaaccactgacttttactgaggttgcttacagaaatatggatgaggggttacttacagggcagaaatgactcaaagacaaccatttctccaaaatatcatccctcatgtaatctggaaaattctagtatactgtataacctaaaggtaggtcagtatgtcagagagtatcctttcctgttatatcccttggtctcagcctcttccagatggctcagtttatatgagagtcttttaagcagcttgattggtctctgtgtctctcaggtggcctggctggtctgtgagtgtctctcagcagttttcagtgcttctatatgcttcaagagggtgggaccttgtgtgtctagttagtttcagggacttcctgaaacctattgtttatgtcctgggcttaatgagctttcctgcaggatggaaggttttgacctaccttgagaatatctgtgtcttaatgagggtcctaagattgaagttcctatgattaatcctaaatcttcctagaatgaaaagtgcttctccatttcagaaactgtatgttaccactgagacttttgacagctggcttagaagctgactgagctagtatggcttttcttactctaacctcaacttgtgcttatgagcagtgcaatagtgttaggtttatggtacatgccacctaagtgtgattgctggccaaagactacaatttattctccattagttattattaaagtctcattttcccccatgagaaaataaattctactgttattttgtgtaaatgttgaccatccccaacagatttatcatttatttgggaaaccagagtctttttcagaattttcatgtgcaaattctgaaaacatcaaagcttttggttgattctttctgaaaccctcaaccctgccaacaccgctttaacatttatggtcctctaagggtcttaggcccagagactatatgaacaatctctagctcctaaagggcaagaaagcactgttaacattctagagtttctctgaacttctagacctggttgataaagattctagttaccgcgcacaaaggaaaatccagagaagcagtgagaaattgtattctggggcttaggcacctctgcatccatttgcttatgtgcatcattacactaaatgtaaggattccagccagagttctggaagtttagggataccacagtctgactccaagacatggcctctgaataggcatctgcacaagctggttcagccatggcgctgggagcaaatgtgcagaatgcatggctgatatgtccaggcttcctcttctccagaaatcattttatctagggagccagaaagccccatggaagacctgaagcacaggcaggtatcctccacctgtccctgacaagcatccccaccacatttctgtttgaaactctcatctagttttttctgtactttgtggcaccaaagtgcatggaaactcacctcctagaatctaaatggctgatacttcttggtatttcatgtgacaaacaccaccttcttcctggccaaagaacagacattgtgagccagtgttaagccttccatctttgatctccttccttgttttgtagtcttgcccagtgaccgtattgcacaacttttgtacataaatgttatctgattcttagtcagtccttgagagtctgggagaggtgtctaggactttaccttaagtagagttggtgttataagactgagatttcctcgctgaagggaagataggtgtaagggaagtggaaggcatgtgcaggacctgtgatactttggtgatttgcagaggatgggtggagtcactagtgcatctggtgtctgttcattgcttagggcagtcctccagtcacagcaatgggtagagctgacaagaaggagttgaggtgggaatctaagtttcccagatatggatgggacaagggtactaggcagcggtggatagagttagtggttcaaattgaacctccctgtgatagggaggcagaaagggacttaggaagataggctgggcatgtgttccttggcaggtcacaggaatgggaagagctgctggtgtgattctagtaacattcctggaaagaagcagttctcaggtggtggggatgggtgtaactggtatcatgagtctggtgtctagctagataatgtaccaggctcccacagaatggaggagtggagctgatggggttcatggatttagtgtagggggtgtgtgggtgccttgtctagggatgggcaagagctctgagacagggagacctttaattccaggacaatctgtgctgtttagggaagtctattaaaaaaaaaaaaaaaaacaaagcaaggcaaagttgatcaacaaaagtgcaattatattacatatattaaataggtgacgtataaaagaaaactgggtgggtgtatattgtctgatatagtcttctccttggcatgagtgccaggtctgcctcaatatggctctttacatacagacgtgcaagtgctgtgccagcctctttgccatccagcctgtggcacagactgatttctgcctcccagaacacacatggcaagcctatggaagtcagaaaactgatgggggttggttttctcctttcactgtgaggctcccagggattaaactcagatctacaggcttggcagcaagcacctttacccactgagctatttcatcagcctgtttttatgtctttgatccagtgcctcgcgtaccctggctgacctcaaacttgttatataactcaaggtgaccttgagctcttgatttttctgcctctgtccaccaaggtttatgctatcacactgagtttatgcggagctggcagttgaactcatgctgggcaagttctataccatatgagctacaccctagcctgccctagttttaaatgctaatttttattctcaataaagcagaaaaacacttattttgatgtctaaatcaattcctgataaggtgttgattaatcagaagtactttgtccttgatatacttacaaatcaatctacgtaaaaggcaggctgagcctcacaaagcaagtccagaaagtgatttaagtatacttgggctaattaggttcatggtttccaactggtcataactaaggtcataggaaattaaggttgaatcagagtggtaattagttggtttcatgtggtacactcctaagagacactcatgttctctacacaatctcttccaggtaacagtaaaaaagagtagacatgattggtaatgacaaatacttgtatcatctgtttctccctaggaaaaatgtccttggtaccaggaaatgtcatagttccccaatatctcaaacactggtagttggaattattattaactgaaaccatccagaaggtgattattctttgctaggagatctatgcaagcacagaacttctaaatagttatgttgtgcttcataaaacagcagtataatggggcaggagagagtaccacggtggcctagccaaggtgtttccctgaggaatcaccaccatgtgacaggcctagtataaaaggaagtttattgggtgaagggaaggggactggaaaatgggaagaggcagagaaaggaggggggacagagtaggacagaaagagaacagaaagaagagaggaagaagctggccagggacacacggagaagagagagaaatggatatgagagctggagtagcctagcagttcagttcttatacttggcccccacctagaaggcaactatgcaagctgttgctaggtagttattgggcagagcctagaggaattgccaacaagttattttcacaaaatacttggagatgaataatttgataggatagaaagtttgaataattttttagtcacctccacagtagtaaaacccaaaggagtattcaaactcagaagtctttgagctgatcacacactatctcaactctgtagtttctgtataaaccaaaaaaaaaaaaaaaatccctttgtgttagtacactatttttttttaaaaaatgttattttttaaattatttttagctgggctcacgcctttaatcccagtacttgggaggtagaggcaggcagatttctgagttcaaggccagcctggtctacagagtgagttccaggacagccagagctacacagagaaaccctacctcgggaaaaaaaatttttttttaaatcatgtgtctgtatggatatgtactagtgtacatgtgtgtccacaatggtcaaaggcatcagaccccttggatctggagttagagatgcttgcaaacgtcctaatgtgggtgctggaaaccaaactaggctactttgcaagagctctaagtatactctttattcagctagggtattgcaaaataactgtaaatcttttaattgtggttaaggccaactaataaaggtaactgtgatacttttcaataaagtgttatcatgtaaggatcactatgtagctcaggctggtcctaaactcagggattggcttacctctgcctcctctgccaacctctggtggaattaaaatgtgtgccactatgcctggtttatatgagaatttctgtataaagagatccttttaggatataaaaaggcaggttattttcacctaagaatttgagaccagtctgggaaggatagcaagttatattgtaatcaataacataaagtatcttaaagtccgtatggactgtcagaacctatatcacccaccatcactgttcctcttcttcatttattcatttattcaaagtattcaagtattttgtgaaaataacttgttggcaattcctctagcccctgcccaataactacctagactcaggagctgactacgcccccaaacattcatcttagaaattatttaaacagaaaaacaaacaaacaaagaaacaacaacaacaaaaaccatgagcatctgtgccaagatttagctacaattttccaccattcagcatcatttactcttttgtggttaggaatcatcattatgttttggcaaacaaaacgaaaggaagaaagaaagaaagaaagaaagaaagaaagaaagaaagaaagaaagaaagaaagaaagaaagaaagaaagaaagaaagaaagaaagaaagaaagaaaaagaaaggaaggaaggaaggaaggaaggaaggaaggaaggaaggaaggaagggaaggaaggaaggaaggaaggaaagaaagaaagaaagaaagaaagaaagaaagaaagaaagaaagaaagaaagaaagaaagaaagaaagaaagaaagaaaggaaggaaggaagaaagaaagaaagaagtagagaaagagaaaattggtgggtcattttaggtagaaagtcccctagagccttctacctctctttctagattttgaatttactttcaccttatgatgaaaatgaagtctgaaaacagcttctgtcattgacaggtcaggttttgctgcccaattcaagtaaatagcatgctttgtgtgcactcttctccagctttggttgtgttggcagtacttaaggtacttaagcctcatttgatctgtgcagtactatctccatgtctccttaaggtctactcttaattctgctctcatcattcctttctaacttaccattacagactccagataaatcactcattttttcttttatttttaactaactaactaacttatttatttatttgtttgtttgtttgtttattattacactccataatttatcccccccccatcccatacctcctccccaccccctgtctccatgtggatgtctccacccctccatgccacctgacctctaaactccctggggcctccagtctcttaagggttaggtgcatcatctctgaatgaacacagaactggcagtcttctgctgaatgtgtcttggtggatatatgcttcctgtttagtggactagtgtttgagagatctggagggtccaaattaattgatcctgctggtcctcctacagggtcacactcctcctcagcttctttcagtctttccctaaatcaacaacagggatcaggtgcttctgttcactggttgggtgcaactatcatcctctgattctttcagctgcttcttggatcttctggagtgcagttattcgaggtccctctttttgagtgttccacagtctcagtaatagtgtcaggccttgggacttgcccttgagctagatccctctttgggtctgtcacaggaccttcttttttttttttttttcctcaggctcctctccattattaaccctgtcattctttcatacaggaacaattacaggtcagagttataactgagggatgcacccgcttcctcatttgatgccctgtcttcctgctggaggtgggctctgtaagtccccgccccccactgtccacttttcctcccaggtccctcccttactcccccccttgtggttgctttcttctctcccaagtgtgactgagacttcctcacttggccacttcagcttgttgacctttttgagttctgtggagtgtaacatggaaattctgtactttttttttctaatgtccacttattagtgagtacataccatgcatgtcattttaggtctaaggtacctcactcaggatgatattttctggttccatccatttgcctgcagaaatcaggatatcctcattcttaatagctgagtagtattccattgtgtaaatgaatgacactttctgtatccattcttctgtcaggggacatctaggttgttttaaggttctggctatcatacaaaaggccattataaacatagtggaacacaggcccctgtgatatggtggggcatcttttgggtatatgcccaagattggtgtagctgagtcttcaggtggatctatttccaattttctgaggaagccccagattgatttccagagtggttgtaccaattttcaattccactagcaatggaggagggtcttctttctcgacatcctctccaacatgtgttgttaacttaagttttgatcttagtcattctgattggtgtaaggtggaatcttagggtcattttgatttgcatttctctgatcactaaggactttgaaaatttccttaggtgcttctcagccattcgagattcctcagttgtgaaaactctgtttagttctataccccaatttttgattgggttgtttgtttttttggtgattaacttcttgaagtatttatatattttgaatcttagctctctatttatgtagggttaatgaaaaaaatttccaatctgtagttggccgatttgtcttactgactattccctttgccttacagaagctttccagttttatgagatcccttttatcaattcttgatattagagcttgagctattggacttctgtttaggaaatttacccctgtgccaataaattcaaggatctttcccacattcttatgtattattttcaatgtatctgtttttatgctgtggtcttgataaacttggacttgagctttatgcaaggtggcaaatattggtctatttttattcttctacatacagacagccagttagaccagcactatttattgaagatgctttcctttttccattgtaatttttggcatctttgtcaaaaatcaagtgtccataagtgtgtggttttatttctgggtcttcaattctattccattgatcaacatgcctgtctctgtaacaataccatggagtttttttttatcactattgctctgaagtaaagcttgatgtcagggatggtgattgctcaagctgtctcacccaagaggaatagaaggcaggaaatagtcaaactcagggcagaaatcaaccaaagagaaacaaagaaaacaatgcaaagaatcagaaaaccaaaagctggtactttgaaagaatcaacaagattgataaatccctagccaaactatctaaacaggcccatactgcacaaggaaatagaagaagttattaaaatcctcccaccccagaggcagtatccaaattaccaaaatcagaaatgaaaagggagacataacagaaatggaggcaattcaaaaaaaaatcttcagatcctattataaaagcctatactcaccaaaactagaaaatctagatgaaatgggtggtgttctagacagatgacacataccaaagttaaatcaagggcaggtaaactatctaaacaggcccatactgcacaaggaaatacaagtcattaaaatcctcccaccccaaaaaagcccagggttagatggattcagtacaaaattctattagaccttcaaagaagacctgataccaattttctcaaactatttcataaatcagaaagagaaggaacactacctaactcattttatgaagccacaattactctgacacgtaaaccacacaaggacctaactaaaaaagagaactttataacaatcttgcttatgattatcaatgcaaaaatactcaataaaattcttgcaactgaatccaagaacatatcaaaaccatcattcaacatgatcatgtaggcttcatcccagggatgcaaggttgtttcaatatacgaaaatccatcaatgtaatccactatgtaaacaaactcaaagaaaaaaaatcacattatcatctccttatatgcagaaaaagcatttgacaaaatacaataccccttcatgttaaaagtatgggagatatcaggaattcaaggcccatacctaaacagagtaaaagcaatttactgtaaaccaacagccaatatcaaattaaatagagacatacttgaagcaaacccactgaaattggggataagatatagatgtccactctccccatacctattcaatatagtatttgacgtgttagctagaataataacacaacaaaaagagatcaagagaatacaaattgacaaagaagaaataaggttatcactaatggcatatgatatgatagtatacataagcgaccccaacatttatatcagagaactcccccagctgataactcacttcagcaaagtggctgtgtataaaattaactcaaataaatcagtagccttcctttatacaaatgataaacagactgagaaagaaattaggggaacaactcctttcacaatagctacaaataatataaattatcttgcagaaactctaaccaaacaaatgaaagacctgtatgacagtaacttcaagtctctcaagaaagaaattgaaggttctatgccctagtataggggaataccagggccaggaatgggagtgggtgggttggggagcagggggagggggaaagggataggggattttcgcagggggaactaggaaaggagataacatttaaaatgtaaataaagaaaatatctaataaaaaagaataaatacaaaaaaggagaaagaaattgaagaatatctcagaaaattgagagatctctgatgttcatggattggcagaattaacatagtaaaaatggctatcctaccaaaggcaatctatagattcaatgtaatccccatcaaaatcctaacacattccttcaaatgtatggaaagagcagttctcaaaatcatttggaaaggtgaaaaatccagaatggcaaaaacgattcttaacaataaatcattcaaatgtaaccattaggatttacttttgagaatggacacatgccattgatatttgtcacttagtataaattttctgatagttccatacattttcttgccaattttctcatttcagttttctttgtagctaaatacaattccacttggaagtgcattactttttcataagccatgtttcatttgatagatcccaattctggctggtcattgcacctcctttccctcactctcttctctatttttgtctcttctgttcttttacagaaactactttgggtcagaatctttgactgttggatggcaatcccgtctgtccacttgatgctgtctttttactggagatggactatttgagtttcctctacccattgtacagtatttcatctaaggtctctccctttgatttttgagattctctcacctccaaggtcttcagaataccctagaggctcctttctggctacaggagatggcctcttaagaaatcatatccccaaagaagtgagtcacagctaaagtcacctccactgattcttgggggccttccttatactaggtctctgtctcatcctgaacatgccccacacctcctcaccatagtcagttgcagatttccattcattttcatggacatctggccatctcttctgtctttccgaacacctgattatgaattgccctccccaacccctctccatcccagcacccttcctccatcttcctcttatgactattttattcctccttctaagtgagattcaaacttcttcccttggtcattccttcttgtttagtttctttggttttatggaatgtaacatcttacctgtattttttggctaatatccacttttaagtgagtacatgtcatccatgttgtttttggactaagttacctcactcaggatgatattctcaagttacatccatttacctgcaaaattcgtgatgtcttggtattaatagctgaatagaattccattgtgtagatgtaccacattctccttatctactcttcagtgagagacatctttccagtttctgcctattatgaataaggcttctatgaacatagtgtagcaagtgttttgtgggatattggagcatcatttgggtatatgctcattagtggtatagctgggtctttaggtagaacttcttccgtttttctgcgaacacacacacacacacacacacacacacaatttatttttccaagtggttgaataagtttcactgccaccagcaatgaaagagttgttccccttgctccacatcctcagcagcatattctaacttttttttatcttagcaattctgatgggtgtaagatggagcctgaaaaggacttgcttttgacaaaaatgtcaaacccaaacaatggaaaaagaaagtatcttcaaaaaatggtgctgacttaattgaatgtcagcatgtagaagaatgtaaatagatacatatctgccaccatgcacaaaattcaaatccaaggggatcaaagaccttaatataaagctggatacactaagtctaatggaaaagaacgtggggaataatcttgaactcatgggtataggagacaactttctgaacagaacaccaatggctcaggttgtaagacaaactattaataagtgggaacctttgaagctgaaaggcttctgtaaggcaaatatattgtaaataagacaaaacaacagataacagaatgggaaaagaccttcaccaaccctacatatgacagtgggctactatccaaaatatataaagtacccgagaagtcagccaccaacaaaccaaataatcaattttaaaaatgtgatacagagctaaacagaattctcaacagaggtacaacagtgcacccacgaggaagacccagctctgctgtgctcatgccattgagattacgtcacttgcaagccccatatgcagggacagctctactgtgctgtgagatgcagggcctgctgtctcagctgctaggaaggtgaggatcacaatcagctctgctgctctcatgactcccttgaagccaactcatctgcccccagctagtatcaagggacagtctcctgccaccttctgatccaccttccctttatctgcccagttatcagctctcctttattttacaaatttaggtggggagctggtttacaagaaatcacctgagtcagactcattccttgttcacaaatcacaggagaatggaattaacatcaaatataattagctctggggctattcataacatttcctcctttctgtccaattaaaagactattttatctcagatataattgaacataactattattattttgtaatttataaagtactagagacctaacacccagtccatcatctttgttaattaaacagaacctctgtcatgtatctttacttaaaagacttataattctacatctgcatatatcttggctttatattgaatgccatcttaaaaccatcctctcagaactgttcctctcaaagaaaaaaacctgggttggctaggagactacgcagtttttcaaccccatcagaaatccaagaatgactgatattaactgaaaatataaagaaagcctaacacagcttccaaaacttagccaatttacagagatcacggatcacttggacagtcccttacttcaacatgttggagcactggtattcagcttattgccccggggtcatctgacagacttagagaaacagaaatattttttaatattttttattagatattttccccattttcatttccaatgctatctcaaaagtcccccataccctccccccgagaaacagaaatattaaggagtagcttactaaggggacccacttagccaactcaggtagcttactagaaagctcacttgaggagtggatctggattaaggggccggaggcgggtcctgggcactaacggtttcgaccccgcaccccgccctccgcgccgcacccgagtggcccccagtcgagcgggcccccacttctcggcccgacccagacccttctgcgcctcccttggcctttgtccggctccaggaggccggccccgcgccccctggcagccgccggtgcccgagcacgcatcagcctcctggctacatacgcgagctcggggaatctgtggcctccgtgacccctctccccagcccgccttgttgtggagcccggcggggcggcgactgccagggccgggtttgcggcgctcaggagaggccccggctccgccccgggcctgcacagggggagagcggagcggtcagcagccgggtcgggtcggggcccctcccgagaggagagtgaagcggcagcggcggcagaaaagatggaagaactgcatagcctggacccacgaaggcaggaattactagaggccaggttcactggagttggtgtaagtaagggaccactcaacagtgtgtcttccaaccagagtttgtgcagcgtggggtccttgagtgataaagaagtagagactcctgagaaaaagcagaatgacctgcgaaatcggaaaaggaaagctgagccatatgacactagcaagggaaaggcacttctagggggacataaacttagtgattcctttgagtttgctgggggaagcgggccaggaaccagccctggcagaagtgttccaccagatgcatgatcctcacggcaacattccttatccaatcccttaccgcttcgagtagaaccgcctctgtatggtttagatggcagtgcagcaaaggaggcctcagaagagcagtctgctctgcccaccctcatgtcagtgatgttagcaaaactgcgacttgacacagagcagttggcaccacagggagctggcctctgcttcactttcatctctgctcaacaaaacagtccttcttctatgggttccagtgtttgaaagtgacctgtgattgtggaagctgcaatgaggatactgtctttttgttgttgttttgttgttctttgtttgtttgtttggtttttttttgtttgtttgtttctttgggttttttttgtttttttgagacagggtttctctgtatagccctggctgtcctggaattcactttgtagaccaggctggccttggactcataaattcccctgcctctgcctcccaagtgctgggattgaaggcgtgggccaccattcccagcggtgataatgtcttttctccatcacatgtttattagtgcgtgaagtgttcagaggattggcacaccatcacagagcatagattactattgcatccatacacctttgacatctctggcctatggagaccctttgagaatggatctggcctatatgcatctatgtttccctgccttcagaggtctgattcttgggatttttgtgactcacccagcaccttccatctggaaagccagtaagcactctctcatctacattctgcccatttctctcatcttctctttccttggcttcataatattcacaggccattcaaactcagttatttttatcgtgaggcaaaccatgttcataggttcatagactgggatttttttccctaaacttttggccaagtagatcttggttctggatttcagagtggttttgttttttgtttttgttttttgttttttgttgttgtagttttgttttgttttttgagacagggtttctctttatagccctggctatcttggaccttactttgtagaccaggctggcctcaaactcagaaatccgcctgcctctgcctcccaagtgctgggattaaaggcgtgtgccaccatgcccggctgagtctttctttaaagttggattctgaaactaaagagcctagaggaggatcaagcatactgtgtaaacgacaccaagctgtaaggtacatgtcctatatcccccaagtatggtttgtactgatggagaaacaatgatctaggatgattgtctgggacaatttaatagtctgggacttccaggtgtggtctgccactacaatctaccacaggtcaccaaactgcttactacatccattcttttacttctggtttaaaaaaaaagtgtacttctcttgcactgaagagaaaacgctgtggttttacatccctggttaacttagagcttattcttgaccataatttccttttgccctctacagaaaaaatatattttatggttgtttctggttcgtaggatgttaatgttgtgttagtgtaaatggaaagacagtcaaaagatgttttctagaatataaattatgttgtggagatatacaaagtgtgattacattgcttgactctatagacataaaacttgcaagtgctgctggcataatcccagcaatcagaacattgtggcaggtgtattcctcttcatttgaggtcagactactctacatcaaagtgacattccaacctgtggtccccaatttcctcttctggcctgcttggattctccacatgtatggaggtgaatttcctaaccttttcagtgggtgtgtctgtattttcaaatttttattggcagagaactagcaggatcttgatattgtcatttctatggcccttcaccagctttacatttgtaaatactcctcccacccctgctgagatacttgaatggcaagcagctctctaagccttgaggcaatccagagaagttctggtgatgttttacacctgattgcttctaagaaaaaaacctgacatccaattcctgggacaagaattggagggtggaatttctggatattaaaagagatgtagagaggagaatgcagatgtaggagatttagtgggagacagagaagataacagatagatgagaacgacgcaggagagaggttaagaggtatctatgtatgaggtcataggcttgaattgtcttaattctaaatgatagctgggagactgctccaatgaaagttttatgctttacactatatagaaacctttttaactatttataacactggtgtgtccacaaacactcccagtatactcatgtccacacacacttgtgtatatagatatataacatttaaccagagtgcttttggtatttaagtcaaattagacattgattggttattcccagtaaattcatgacatcattgccctaagcctattttgctggaaggaaaaattatagatcaacgtctattttggttggttctgtgtatatatttcaccttgtgtacgtttcaaagcaccttccataaggaggacactggaacataagagtcaatgttcttggcaccagtttgaccttttcatatacagtgttttgtgtcagccctgtctttagcaatgacgacttaatgtcagtttgtgaaaagcaaccccttttgttgtcagtggccagcattctttggatatttttatgaaaccactttggctagcaactttcttgatgtaacacagtggaaaagacaagatcaactggaactccatctctttcagaattcagagatttcatttgaaacaccttcatacacttataagctggtactttaaaaaaaatttttttttgttttgttttgtgaacatcttactaagactacatccagcaggactccatggagtcttgctccatggtgctttcctatgcattggcagaactgtacgtgtgacaatgtattatataaaacatcttaacttgtaatagatggggaattttcctggacctcacaaccagaattaaggaaacttgaagaaatttaagatttaaagctgtgatcctactgtttattcaacttgagggtttagtacacttttcaaagaacaacgtaaaaactaacattattctcctttgacttctcttgatatcaacttttaaaacctaacttgatgcatagatacaatggtaatttatgtactttttcaagtcctgctcagaaactgcatgagtgtcacttgatgaaagcatgaaatacagaggcttaaaacatagttcaaaaatgcatatacagttatgggtattggttgataaaagtcatgtttataaatgtctgttgtcttgaccacttgaccacttggagccagttacctaatcctttataaaatattactattcactatcccattctttccccatgtgatggatcccttgatgttctagaagcactccaaagctctctctcaaggccagtcagagagatacaaatagacaacagattacacagacaccaacatggagacaaaaggcagacagaaagggagagctatacaagcagccttcaggaagttacagatttaaactaactgaacagatacacagaggatggaagcacagggaacatgaagtagagaattcaactttgtactcacactcagttaaatgcctctgaggaaaaggctttcatttctttccttaactcaacacagatgcattattaatcactagtatgtttaatctattcacatatgaggaatcaattagcttgtgacttttttttagcataagtacaatatgggaaaaactaaaattcaccccaatgggaaacaagtagccctgtcatctgaaaggtgtccatgggcacagaaccctgttctttaaagtcagacccccaggtttgggtttgtgcttctgagctctcacctccatgctgagctagaatccattttaacctctcataatcatcacaacaggttttgaacctaagaggtcacatgagaattctggaactcattataatcatgaaaacagttgacttcctagcaatagtctaatgagacttgggtaaatctcggttctcctttcccccacttatactgacatgcatgggtgtcagagtgttacagggaacaatctaaccatgtatgaacaaacagtgcagtatgtattgtaattttgttcctgttttctttctttctttctttctttctttctttctttctttctttctttctttctttctttctttctttctttctttctttctttctctctctctctctctctctctctctctctctctctctcttctctctctctctccctctctctctttctctctctttcttccttcttacttcctttccttactttttttttttttttgacaaagatcaggacagtttttcgaaggagtttctctttattgcctcatccttcaagcagtaaataatattgtgccttgacctaacatcattttaattcaccattttctttgattgaggcatccacctcctctactttttctttaagtctgataatctgtctcccacaggttctctatgtatcaattttatttgcctcagtgcattttctcttcaggatttttctttttttagcatttctaaccacctattgaactcaattttaatattttatattgtccttatttccttcaggcatctggtattattttcttacccaagattcattttgttcctgtctgagtggattcacatggtttacaaactttaatgcccttgatcatgactgtgggttttcaattctttgtcttgggtatcacataaattgtgctccttattggatacctctatggtttgtggtttgagccaaggacattttatctacgtttttgtttgttttgggtatctgttctgagcatcagagttcaaagggactgcttaattttttgcatttatagcccagaaggctacacgcacaatatgagaagttagacaggatccattgtatctgaagggttcagaacccaggtgcagtgtcctactacatccagctctggtctagtctggcagcaactttgtgaagaagctgtgcagagtaggtcctggggagttgtgtggaaggcaacagagttggaggagtggttcctgatggggagtgtgggattcctgcacgattagatgagtttaagaaaaagaaaaattaaaagcaaaggaacaagcaagcaagcaaggaagcaagcaagcaaaaatccaaaaaaacaaaaattgctgtgaagaagtgggaagctaattaattaaaaggtacataagtaggtgggcttagaagaattccaggaagctgttgaattttgggcgggtccagaaggcggggttaggcagaatgagggaaaattccgcggtttaacctttcttcttgcatctctgctgcctcatggtcaggaagtcctggcgggagactagtgcctagtatttgcggtgcctgaaaactttcttaaggagcagttgttttgctggcctcctaggacatattggagctggtcctgtcatcttccaggtcagaggagctgttggactgggaaacgggcaggagcttggcaggcctgtggagcaggggtgcattttctgccgccattctcacaattcagtgtttgcggaccggaaaacttccttaagctgcagttgctcctcctaggacactgagcagctggtcctgtcacctttcaggtcagaggagctgttggactggggaacgggcaggagctgagcaggggcgtggagcaggggttcattttctgccgcaactctcataattctgttgtggatatcttaccattgtcaagaagtttgagatcctgtgaattgggttcatgattggtttaatcaattttatggttgccagaatatttttctaaaatatcctcggagatccttggctgcatctggagttggtataccgggaggtttgcctttgcaaaagcctttataaaactcctgtaattcaaattcgttcatgctttcttaactcccctgttcctccatttgccatttaatttccctttctccagggaactgagtaggcatcccgagagagctttgtaagtatttgtcatatagggaccagtgcagatttgattgaattcgaaaatattcgttataaagtatctttgaaagacccaaaacgtgaggactctcccacgttctgactcaggagaggagacattccaaatcacttgcaagaaagggtcttgatgcaaattgtaagaggacttttatttcaagagaactctcaggtccacattcatataccatgcagggctagaggactgtggtgtgcagagtagctgggtaagggggtatttaaaggaagaaaccataagtcaaggggatggggagggcgttgttggaaaataccaaaagtaccagttaagtggaaagtcaagacagttgtctatgagtctcagtaacaatagcacatttgcacagtgagttcctggagtggtcagggtgggtcaaggtgactttctttgccagaatatttttctaaaatatcctcggagatccttggctgcatctggagtttgtatacctggaggtttgcctttgcaaaagcctttataaagctcctgtaattcaatttctgttttatggttagcataccttgggggcattgagtcacaaagatcttattattaagcctgtccctaaaggcctactttttgtttttatgtttcactttttaattgtcatgtcgctgtacatattaatattaacctagcaaagttataatctctgttagtttaacactgaggtatatgcagtctttgatgtaaatacagcattgagaaatgtgtcttcataggctcagttattaatgttacacgttaggtttgaataaaacatgaagacaggattgcagcaaggtacagctgaggagaagatacatagtaggttctgtcaacccagagtgtcgccagagaaaaactaattgtaccatgtgggcaagttttataaaataatacatcctgaccaagagatggatttggtcacatgctacaggcagtttaataggccactgtagtttcccgtgaggctttattattttcctaagacatgcaacttgcagcaatgcacaaagatacctggttcttgtgctggtggtgcagttaatttttggcttttcagtctgagggagaaagcattcagagatatctggctggttccaaactgcaccaggccatcaggtggggggaggggaattgaggatgagatggaggacagaggggcaggccaagagataaacaggagccaagaaaacacctacccaactatgactttattgatatgttaacagacaccccagttagccattcctcctgaatttctttgattccttccaaggttctgcccagcatgctgtgagagaatgatttcaggcaaagatattttaataagtggaaaacttactatggattaagacaaaattaaacagcacctttggaatgattatggttgctcacttacagaagaaaaatgactccttacttcatgaaaagcccatgcacattcatggtttgttgagttctgcactgtggacttcttgcaggtgtgggaatgcttagaccctgaacttagggctttttttcacagacctcgtgttggtgaagtctaactgtctggattgtgtggatcagaataattttcttccagtcttcccctgcttttcttccttgttacttggaaaaaggactctgtatgtgtgttaactgtgtgactgacttacacatctctagggtaaactgaaatactcagagaaaaagagacattttcataatttcttctctttccctcatgtttatccttttatcatgtattgacatctctcatttgtgttccatgaaaagttccaggttcagtctgaataatattttcccatttacaggtattcatatgctcagccaaatgtgcataactgtaaatcaacactaagggcacctgatggttaaggtcaaggagattctcgcgaaggatccaggtatgttagaggtattgaacaaggggtggagtggggctcacctgtgagtagaaagaggacatgaatttgattttgccagattctatttccttaatgattctggaaaagaataatagatatgatgatgtggatttcccgtggtaggcagtgctgtcactccactcgacacttgatgttaatattaaattaattttgattctgggaaatcactgttgcccattgtaattaaagtttcttttacccagattgaaagcatcatcaggctatggttgtgacaagggcaatttatacataaagcaaatgtcagcagtagattccctcctagggcctgtgaccttccttatgaattttcaggcagattttcactgtaacctatgtatttttttttcttgtggagcttgaaccagaaaaccttctgttacccacagatagtcttgccactgtcataaaaatttccatgccttgtctggcagattcagattgtagcaagcagcttgcaaacctgagtatgatatggattagctctgcttcctgccccaattttcctagcagtttttgtcactatggaagttcccaccatggtatgtaagatgtctgctgagagtgaatggtctgatatgaggtggttttctccagaaggtctacttgctttctgaatcacctattctgtccactctaaatgttttcctgtccttgacctgtgttcttattgatgttctgtgttgcattagtccccattagagtggaataattattgttgaccttctctgtactgtttgctttagttttgagtctgtcttatttctgaggtatgtttcttctcttatattcttgagagcttttatactgagcagtgtctactttttaccacagggctgtataagtaagtttcattctcctattgtcactgtaatttgggaggattcctgcctgcatctattaacctaggcctagtcatgtaagcttctactctacatacagtattatctaggcctggtgtgttttcagcctctgaaatttgctgctgaataagcccccaccttttcttattccttctcaatgcttacctggctgattcaattctgtttttccagctcacactcctctcccagctgagttcttctctcagacactgaattgttctactaggccttaaattaactgtcgaaatcttttgtaatcctctggctctttctcattctcctgctcattctgtctttgcccatgcctagcatgttctatcttcaatctgactctgtaaaactctcccagtaaaactgtgtccttctccctctctgtggatctactctctcaactgtactgtactgcagcccatgcactctactgtattcctttattattctcttctttgtgtaatgtctttctctgtctcaagtagcttctctttcctctctcattacagcaaagttgggcatatcctattctgtcagatctttctctaatattccatattttctgtcattcaattagacattgctttcaaacacaggtgtgttcttctacatataaactgtacctttgttattttggattaaagtgaatactaaggtcttgcctgtactaaaaccagagcgattaatgttgtgtcttgggctgaactgcaccctaagtcacaacaggttcaagtatcgctacacagtgtgatgtcagtttacttctgtacaattttttccttctgaaatgaaaaccaagatccacatatactattcttcaatatgttgatacctatttcattttttctgacttctacttgggattttattataatgttctttgaagatcggtcgatgatattctgttccttgtgagattgtattccttaggatttttaatctggaagattttgctggcagtttaggtggtaaagtatgtttactttgttctcaattccttgtgtgggatagagctttattgtgttgtatatgagaaatacttactacttctcctgtgtttattcattcttagcaagaaatttcttatttcttatgaccttatgaaaaatgtatgcgttattttgtgcatactttcatcaattcattttctaagtagtttttttgtttgtttgtttgttttctttttgtggtttttgtgtggttttacgagacagggtttctttgtgcagtcctgactatcctggaactcacttcatagaccaggctggcctcaaactcagaaatccacttgcctctgcctcccaagtgctggaattaaaggcatgctccaccactgcccagctctaaccaggtttttgactaaaaaacatgtcctaatgaattactacattcaaatttactttatgtactgtgaatactagtagccacttactttggattgctagttattttctctcagggtttgaaaaatattatttcattcactcttgcttttaacctatgtataactatttattactactgtatgctacttttatgtcaccacactaatggtaagggacaggacaagacaaaaggaaaagagatgtacattgttatagcacttagatgtgacaaaagccagatacatctaggagtagaggaagccaatctgtaatagccttccctagggaatgctaagcttgtatgctatgttattcttctacttaagaatcccagtgtctgaacacactacccattactattatagtttgtccactttcaaaatattgggatgaaacaagtgatagtaaaaattgaccacaaggctgataaggacagaattaaatctcttcagagtcaggtatatacttgaagaaatgccagtgtcaagttttaaagtcaaagtcctactgttcttattgacttcttggtggatgtaataccatgggttattctttccatcttagaatgagctcttgttcagtctccataagatgaaaaatgtacttttcatgttatacacacagacaaaaacaattccatgatatatattcattccatgtatttactgttattgaaactaaagcctaacttacatcaattgtgcaggaatttaagattgttgctgaaatgttgacaacaatactcaccctttatgtcacaggcaagattcataaagtgacatgctttgtaaaaatgtcctgattattccctgaatatttatgcattcctttgcccagtttttctagcccatttgatgttgtcttcaaatgcctgggtcatagagatttacatatcataaatttatgacagcattatatttttccctatatctacatttccgttctacagaaagtcctcttaccactcaatttcccatcacatgagttagggattatcctcatttctttcatgcatattacagctgttagaatatttacagagaaacattctggtagagtatttgtactatccattttctttgctaattgaggtatttcaaagctcctaaagttttctttaatttgtgctatttaaatctcctggtgctagcattttcaggtgaatggcctttgtagaaaattagtgtggaggctttgcacatccttgtctctctctgcttagtagaataggaggatgacagatgtctttggtttttgtagtgataagtttaggatgatggctactatgtttataagactcagtcatgttctttctttctttcttttttttaagatttgtttcttttatgtatgtaagtacactgtcactgtcttcagacacaccagaagaggacatcggatcccattaaagatggtttcctgggaattgaactcaggacctctgagtgatgttctttctcttccacattcttcagagctttcatagtgatccactgtgatatttttctctcaggcctttcttagatatactgacatggttgagagtcttctctcactgattgtatgtactttgtgccttgagttatttggtttgtgcttcttgaaacagtcttgcatctatggcatgaaatcaagttgagttcattttctatatccattagagagaatttttttattattttattcatgcatatttttatggtcatttgcttttgcatcccggtacagacagctttgtgtgatgactgcaccacattccctactttctgtattctgcaatgttctctgtgcaagatgattgagggattttctaaagaaatttgtgaatttggtgctacatctatttagtctcagacagtgttaaaagataccctgcaggccttgatttccatacttgcttattgttgggcctagtgttaagacatagaaagttttcttgttcacttgttcctaggatatcattttttcccctgttagttctcattaattgtgtatgactttttatggtactccatcatctgctacttcccagtttcaatataaactaatgaggcaggggcatcaaaagagaccacctgtatacctgctaaaagctaagagaaatatttgacatgagagaactataaggtcaatgtaatacaaaaacatgctgaatatttgcttataccatggtcatgacaactttgtgtagtaatagtatcttgatgttcagaaagagttcttatgtttttattcatgaacaaatatgtttgtgtgtgtgtatgtatatatgtatatgtggatatatatatatgcattagtatttatttcaggagaccctgtcatacattcttactttattttttttccttttccttggtttttttgagatagacattcttactttcatttggaactacaacatagttaccatgtagaatctttgtctatattccaagacaatagggcacatatagtacatagatacactgtatctgcctgcgagaatgaaatggaatcttatcatagggttaggtgtggtattctagtaatgaaacactattcaactcgaggcatcattcatggtaggcactagccatttgtctttgactctagacccaggaagatatgttctcaataacaaccctgataatagtgttttacagcctggatgcatatgctcactgtttatgccaggtgcccattgaagtcagaaagagtcctcggattatattcatatttcttactacactaaatatgtcactccatgctctcatgtctgtagaagtgttgacaagattccttgtatcattttgctttttattgcatttcatgtggtttatcattgtccattacattgttgtagtaatttcatttttttatttgcaaaccctgttgtgaaactgcaagaagagttccaatatttgaaactggg

SEQ ID NO: 227 - DNA, 473967 bp, Mus musculus
gcttgaaagaaaaaaacctaacatccaattcctgggataagaattggagggtggaatttctggatggaaaaagtgatgtagggaagagaaagcaggtggaagagattaagtgggagaaagagaagagaacagataaatgggaacaggggcagagaggtaaagagcaagctacacatgaggtcataggcttgaatagtctgaaatttaaatgatcggtggtagactgcttcagtgaaaggcttatggtttaaactatataaaaacctccttctcattatttataacactggtgtgtccacaagtactcccactacactcacatccatatgcaatatgcatatatatatacatatatatatatatacatatatatgcacacacatatatatgcacaaacacacatacacacacatatatatgtaaaacttttcacaagggtgctttgggtatttaagtcaaattagatattgattggttattcacaataaattcatgacatcattgacctagcatattttggaggaaggacaaattttagatcaatgtctttttggttggttctgtgtatgtatttcactttttgtagcttgcaaagcccttcccataacgaggactgtggaacgtaggagccaatgttcttggaggcaccagcttgacctctttatacacagtgagttgtgcaagtctgctcgttagcaatgaagacttattgtcagtttgtaaaaagcaacaccttttgttgtcggtgccctgcagtgttcgtttatttttatgaaaccactttgtagaacaactcagttgataaaacacagtggaaaagacaagatcaactggaactccatctctttcagaattcagagacttaattataatcaccttcatacacttataagctggttctttaaaaaaaaaaaaatccaaacatcttactaagaatacagccagccgaactccatggagttttgtaccatggggctttcctatgcattggcagaaccacaagtgtggcaatgcagtatacaaaagttcttaccttctaatagatggtgacttttcttggaccttacaaccagagttaatgcaacttgaagaaatttaaaatttaaaactgcagtcctactgtgtattcaaatttatggtttagctttctttttcaaagaacaatgtaaaaacaaacattattctttccttgtatttctcttgtgatcaacttttaaaacctaacgtgatgcattggtacaataataatttattgatacaatggtaatttatgtactttttcaagtcatgtccagaactgcctgagtgtcatttgttgaaagcatgaaatgcagaggctcagtgcaaccttctaaaatgaatatactattatgtgtactgattgataaacagtgatgtctgtaaatgcttgttgtcttgatcacttggagccagttacctcatcctttttaaaactctgttaaagatttctgtatactataccattccttctccatgtaatggggttttcttggtgttcccaaaaatattgcaaaggtctttcttaagaccagcaatggagatacaaaagccaacagacatacatacagagtacacagatagacacaaacagggagacagaaggcagacacacatgtagagagagatgcacaaggcagtattcagcatgttacagatttaaattaactgaatagacacgcaggatggaaggctcagataagagaaagtagagaattcaactttggactcacacttagttaaattaactaagtttaatatgttcacatatgcacaatcaattaacttgtgacctaattttcctattttttttttgcataaacacaatatgggaaaatataaaactcaccacaatgggtaacaagtagccctgcattcttaaaggtgtccgtgggctcagaaccctgttctgtaaagaaagaccatcaggtctgggcttgtgcttctgagctctcacttccatgctggcctagaatccattttaactctcaccgtcatcacaacaggatttgaacctcagaggtcacaagagaatcctggaactcattactttcattaaaagagttgacttcatgccatattctctaaggtgacttgggtaattctcgagtctcctttccccagcttatgaagatatgcatggatgtacatagagtattatagagcacaatcagggaatcttctatgaacaaatggctaaacagtgcagtatgtattgtaggtctctgttttcttccttccttccttccttccttccttccttccttccttccttccttccttccttccttccttccttccttccttccttccttctttccttccttccttccttctttcctttctttattctttctttcttttgccaaaaatctagacactttttcaaaggaatttttcttaattgcctcaccctccaagcagtaaataatattgtgcctaaacctaacatcactttaattcatcattttctttgactaaggtatccagctcctctaccttttgtccaagtctaataatctgtgtctcacacgttctctatgagttattattattcgccttactgcattttcttttcaggctcttttccttgtttatttctaagcacatattgaacaaaatttttatatcctatgttgtcctcctttccttcaggcttttgctattattctcttgcccacgaatcattttgttcctgtcctctatcaattgacatatgtggcttacacactttgatctcttttatcatgactctggattttctattctttacctaggatatcatgtaaattgctctctttataagatacatacatagttgatagtttgagccaaagacatttaatcttagttttactttgttttgggtattgagcaccagaattcagagggattgcttaattgtgtgcatttttagcccaggagtctagactcccaatgtgagaagttaggcaggatccattgtatctgaaggattcagaacccaggtgcagtgtcctactacattcagttctggtctagtctggcagcaaccttgtaggaagctgagcagagtaggtcctgagaagttgtgtttccacaacagagttggaggagtggttcctgatggggagggtgggcctcctgcttcattagataagtttaagaaaaagacaaaataaaaacaaagaatcagggctggtgagatggctcagtgggtaagagcacccgactgctcttccgaaggtctggagttcaaatcccagcaaccacatggtggctcacaaccatctgtaacaagatctgactccctcttctggagtgtctgaagacagctacagtgtacttacatataataaataaataaataaacaaaaaaaaaacaaagaatcaatcagtcaatcaaaaaatcaatcaataaattaaatatgcaagcaagcaaggaagcaaaaatccaaaccaacaaaaattgctctgaagaactgggaagctaattaagtaaaaagtcctgaagtaggggggcttagatgaatggcaggaagctggtgagtattgggcgggtccagaaggagtggctctgaggaaccaagaggaagtgactggaagttccgccatcccatcattttcgatgtatctcggctgcctcgtggtcaggaagccatggaaggagactagtgcctagtatttgcggaacctgaaaacttccttaagctgcagttgctgtgctggcctcctaggacattcagcagctggtcctgtcgccttccaggtcagaggagttgttgggctgagaaacgggtaggagcagggcaggcatgtggagcaggggtgcgttttctgttgctactcttacaattctgttatggatatcttaccattatcaggaagtttgagttcctgtgaattgagtttatgttttaattgattttatggttgccagaatatttttctaaaacaacccagtagatccttggccctctctggatccttggctctttctggaataccggaagggaaaggggaaggggaaggggaccctgaaaagaaaatgcagtcaggtgaataataatcattcatagagaatgtgtgtgagacagattatcagacttgaagatatatagtaggttctgttaaccctgagtgtccccagagaaaaaccaatttctccatgtggaccagctttatcaaataatacatcctgaccaagagatagactttggtcacatgctacaggcattttataggccattgtagtttcctatgaggctttattattttcctaagacatgcaacctgcagcacttcaagaagatacctggttcttgtgctggtggtgaggttaatttttggcattttactctgaggttgaaggaatgaagagatatctggttgggtccagactgaaccgggccatcatgtggtgggaggggaattgaggatgtgatggaggatagaggggcaggtcaagagatcaccagcagccaagaaagtacctatccaactatgacttcattgatatgttaacaggtacccctggtagccattcttcctgaatttctttgaatttttccaaggttcagcccaccatgctgtgcggtgatgatttcaggagtagatattttaataagtggaaatttttctatggattttttttgtttgtttgtgtttggtttttgttttttttgagacagggtttctctgtttagccctggttgtcctggaactcaccaggctggcctcgaattcagaaatccgcctacctctgcctcccaagtgctgggattaaaggagtgcactaccggcttttactatggattaagacaaaattagacagcatcttttgaataattttgaacacttacttactgaattactgtctggattctggatcagaataattttcttccagtcttctgtcctcctcttctgtattgcttggaaaaagactctatgtgtgttaactgtgtgactgactctcacatctttagggtaaactgaaatactcagaaaaataggcattctcttgataacttctcttcatgtttatccttttctcgggtattgacatctttcatttttgttccatgaacagtttcatgttcattctaaacaatatttacccattttcaggtctccatatgctcagtcaactctccgtaactgtaaatcaacactaagagcactagaaggttaaaggtcaaggagactctcacaaaggatacaggtatgttagaggtattgaacaatgggtggagttgggctcacctgtgagtagaaagaggacatgaatttgattttcccagattctatttccttaatgattctggaaaagaataatattagaagtgatgatatggatttaccatggaaggaagtgctgtcagctgtcacttgatgtcaatatttaattaattttgatcctgggaaattgctgttgctcattgaaatcaaagtttcttttatccagattgaaagcaacatcaggctatggttgttataagggcaatttatacataaagcaaatgtcagcagtagattccctcctagggcctgtgaccttacttatcgtattttttaggcagattttcactgtaatctatggatttttgtttcctgtggagcttgaaagagaaaacctgttacccacagatattcttgccagtatcataaaaatttccattttggcagattcagattggagcaagcagattgcaaacctgagtatagacattgataactctgcttcctgccccaatttgcctagcaatttttttcactatggaagttcccaccggggtgtctaagatgtctgttgagagtgaatggtctgatatgaggtggctttctccagaaggtctatttgctttctgaatcacctattctatccactctaaatgttttcctgtccttgacctgtgttcttaattgatgttctgtgttgcattaatccccattagagtagaataattatttttgaccttctctgtactggttgctttagttttgaatctgtttgccttatttctgaggtatgtttcttctcttctatccttgagagctttcatactgagcagtgtctactttttgccacagggctgtataagtaagtttcattctcctattgtcagcataatttgggaggattcctgcctacatctattaacctaggcctagtcatgtaagcttctactctccatacagtattatctaggcctgttgtgttttcagcttctgaaatttgctgctgaataagccccccctccccccaccttcttattccttctcaatgcttacctggctgattcaattcagtttttccagctcaaactcctctctgagctgagttcttctctcagacactgaatttttccacttggccttaaattaactgtagaaatcttttctcatcttctggctccttctctttctcctgctcattctgtctttacctgttcctagcatgttctctcttcagtctgattctgtaaaactctcagaacccacgtgcagtgtcctagtacatccagctctggtctagtatggcagcaacattgtggggaagctgtgcagagaaattccagagaagttgtgtgaaactgcaacagagttggaggagtggttccccaacagagttggggagggtgggcttcatgcatgattaaataagtttaagaaaaagacaaaattaaaacgaagaatcaaccaatcaatcaatgaattaagtaagcaagcaattaaaaatccaaaacaataaaaattgctgtgaagagctgggaagctaattaattaaaaggtcctgaagtaggtgggcttagaagaattgcaggaagctgctgaatattgggcgggtccagaaggaggggctctgaggacccaggcagaaatgacaggaagttctgccttttcagcattctccttgtaccttggctgccttgtggtcaggatgtcctggaggaagactagtgcctagtatttgcagaacctgaaaatttccttgctggcctcctaggacattcagcagctggtcctgttgccttccaggtcagaggagctgttgtactaggaaatgggcaggagcagggcaggcacgtggagcaggggtgcattttctgtcgctactctcacaatctgttgtggatatcttaccattgtcaggaagtttgagatcctgtgattttggttcatgatgatgttttaatcaattttatggttgccagaatatttttctaaagtatccttgtagatccttggctgcatctggagtttgtataccaggaggtttgtctttgcaaaagcctttataaagcaactgtaattaaaattcgttcctgctttcttaactcccctgttccttcatttgccatttcatttccctttctccagggaactgagtaggcatcctgagagagctttgtagatatttgtcatatggggaattggtgaagatttgattgaattagaaaatttacgttataaagcaccatcatatggctgtatatattcacattaacctaacaaagttatagtctccgttagtttcacactgagttatatgtagtcattgatgtaaatacagcatccagagatgtggcttcatagtcttagttattaatgttacaccttaggtttcattgaagcatgaaaacaggtttgcagcaatgaacaactaacgagaagatatatagtaggttctgttaacccttaatgtcgtcagagaaaaaaaattctacaatgttggaaagctttttaaaatattacatcttgaccaagagatagactttggtcacttcctacagctggttttatatgcccttgtcattttctgtgaggccttattattttcctaagacatgcaacctgcagagctgcaagaagatacctggttcttgggcttgtggtggggttaacttttggtatttcagcataagggagaaagcattcagagttatctctttgggtccagactgaaccagttcattagatggggggaagggaattgaagatgagaaggagaatagaggtcaggccaagagttaaccaggagccaagaaagcaccatcccaatccctgtcttcattggtatgttaatagttaccccagttagcctttcctcctgaattcttctaatcctccaaggttctgcccagcatgctgtgaaaggatgactctaggctaagatatttttataaatagaaaacttactatggattaggacaaaattaaacagcacctttgaaataattatgattgctcactttcttaagaaaaatgactccttgtttcatgaaaagcactttgcccatacacattcatggtttgttgagtgctgcactgtggacttcttgcaggtgtggtaatgcttagaccctgcattcagggtttttttcagcaatctcttgttggagaagttcaacagtttggatcctgcgtgtcacaatagttttcttacattcttccttgtttctcagtgattctgggaaaaggactctctgtgtgttaactgtgtgactgactcaagagtaaactgaaatcctcagggaaaaagagacattctcatgacatcttctctttccttcatgtttatcctttcacctggtgttggcatctttcatttttgtcacatgaaaaggtccaggtttttttgaatgattttcccattttcaggtcttcattttctcagccaaatctgcataaatataaatcaaatctaagagccctagatggtaaaggctaaggagactctattgaaggatccaggtgtgttagcagctttgaaaaggggtggggtggggctcacctgccagtacagagaggacatgaatttggttttgcctgcttctgtttcattaatgattctgaaagatttcactaagaatattagatgtgatgatatggatttcccatggtaggtagtgctgtcagctgtcacttcatgtcaatatttaattaattttgatgctgggaaattgctgttgcccattgaaatcaaagtttcttttacccagactgaaaacagcatcagttaatgtgtttgaaaagggccatttacacaggaagcaaatgtcagtcttggattcgctcccagggcctgtgaccttctttattggattttagccagaatctctgtttagtctatgtatgcttttcctgaggagctggcctcagcttgaacaggaaagccttttgttacccacagatagccttgccactatgatactggcggccatgccttgcctggcagattgaaattgtagcacacaggatacaaatctgggtatggccattgatagctctgcctcctgccccagtttgcatagcagtttctggactctgaatgctaccatcagagagtccatctacaatatttgttgacagagtggatggtctgatctgagttgttcttctccagaagatgcacttgctctctgaatcacatcttcggtccagtctacacgagtttaagtccttgaattgtgttcacactgatgcagtttgttgaatttggccttattttattgtggataccaacaagagcttgctgacaggaggctgatataactgtctcctgagaggctctataagtgcctgacaaatacagaagtgggtgctcacagtcatccattggacagtgcacagggtccccagtgaaagagctagagaaattacccaaagagctgaaggggattacagccccatagtaggaacaaaaatatgaactaaccggtatacctagagctccttgagactaaaccaacaaccaacgaaaacacatggtgggactcatggctctagctacatatgtaggtgatgatggcctagtctgtcatcaatgagaggagaggcccttcgtcttgtgaaagttctatgccagaataaaacaccagggccaggaagccagagagggtgggttggttagcaggggtggggcaataggataggggatttttggagaggaaagtaggaaagtggttaacatttgaaatgcaaatgaagaaattatcaaataaaaattgaaaaaaaaaaggatggaataatctctttcctgccttgtctggaccgtttggtttagtttcaagtctctttccatttgttttctgaggtgtgtttcttctctttttacattctagaaagcttttatagtgagtggtattagattttccacaggactgtaaaactaacctttattctcctattataattattgtctgggaggctgactgcctctgtctaattatcatggcctagtcctgtaagcctctagcctctaaataatcttatttagtcctagagtgttttcagcctctgagatttcctgctgattaaactccccctttcttgtttgtttatttcaactccttttttaaaaatattttatttttttggttttcctgacatggtttctctgtgtagagttctggctgccctggaactcactctgcagaccaggttggcctggaactgagaaaagtgctgggattaaaggcatgcaccaccactgcccagcctcatttcaactcttacctggatggttcatttcagctgttcaggctcaaactactttccaagctgactcattcagcctggttctcagacactaaattgctctgcttggccttaaattaactgtagcaatctttttttaaatcttctggctccttctctttctcctgctcattctgtctttgcccgtgcctagcatgttccctcttcaatctgactctgtaaaactctcccagtaaaactgtgtccttctccctctctgtggctctactctctcaagtgtactgtactgctgcccatgcactctactgtattcctttaccattctcttcttcctgtactgtctttctctttcttaagtagcttcccccttcctctctcacctcaggagtgttgggcatatcctgttctctaagatctttctctgatatttcacattttctgctattcaattagacaacactttcaaacatgtgcacctccttctacttagtaaatgtactttcgttgtttgggattaaagcaaatcctaaaggcttgcttgtattcaaccacagtgaggaaagctgtgtgccttgtgctgaaccacaccctaagtcagaacaggcttgaatatccctacacaataatttagtttggcagaatttcttcctgaactgtaaaccaagattcacaaataatagtcttcattatgtagatagctgtgctatctattctgccttctaccaacattttcattgtgaacttctttgatgattggtcaatgaaaatctgttgtaaatgaggaaaatacctaataaaaaatgaaaaaaaaaaaaaaagaaaatctgttctttgcgagactgtattccttagcatttgcaatctaggtttgcgggcattgtaagtggcaaaaatatggttcctattgtctccattctttgtatgagagagagctttactatgtaggacatgaggaatatttcctacttttcttatattcattcattcttcacaaaaaagatgtgttattcccgacgttctcatgaaaattttatgtcttattcttttgtgcatatttttattagattattttctatgtaggtttttgagtaaaaaggtgtctaaacttatatatactaagttcaaatatatgttttacactgtcaatacttgtagccacttttctgaatttaacattacagttgccagttattttctctcaggacttgaaaaatatgattccatgctctcctgattttaagctatggataaatatttagtactactgtatgctaatataatatcacctcttttgatggtaagggctaggacaagacatctggaaagagataaacattgttacagcacttagatgtgacaataggcagatacaccagagagtacaggaatccaatatctgagagactttcctagggaatgctaggctacaatgctatggccttctagtactcaagagtcccaatgtttgcacactgcatgttgctatttgagtttatctactgtaaaacagatgtgatgaaacaagtgatagtaaactttgactggaaggctcaagcgtttggaattgtgtctattctggatcaggtgtgtatttgaggaaatgtcagttgcaagatttaaagtcgaagccctagtgttcatattgacttcatggtggaagtaggtaaacccaagggttattcttcccattctagaatgagctcttgttcagtctccatgaaatggaagatgtgcttttcctattatacaattagacaaaacaatcccaggacacacatttattttatgtattacttacttttgaatttaaagtacaacatctgtcactggagcaggaatttatgatctgttgctggtagaaatgacgatactcaccctgtatgtcaaggtaagaatcataaagtgacatactttgaaaaatgtcttcagtactccctgaaaattcatgtattcctatgcccattttttattacactcttgatgctgtctacaaatgcccagggtttcaagttttgagtattgtaaatttatgacagcattgtatttttccctgcatcttcgatttctgttttacagaaattcctgttgtcagtaaattttctatctcatgaattagggattatattcatttctttcatgcatattacaattgttagaatattcacagagaaacattctgttagaggatcttcattatctggtttctttggtgttgcagatattacaaagctcctagagttcactttaatctgtgatctctaaatcccctagtgcttgtgttttcaggtgaatggccttcgcacatgacggtgccccagagtgcttggcaagtaacatctcttctttccctgtcccatcccttgttattcatgttttcatcctatccttgtgtttcatgtatgttcttaggaaggttttgaatgggtatccatgctgttgtatattcataattccatgttccatggtatatgacagcatggatttccataactccacttcctccttcttttacagtgttgccttttccccactgctggctttttattcagctctctctgaattggcagtttccctctacaattcatgtttgtttgacttaggctgaaagcaccaacaatttaaatgtatttctgtatttctacatataacagtgtgtcagttaaaattcacttttgggcctgtgatatttagagtgacttttgaccagcttccagtgctatgtctgtatttcctttgtaggctgacctcaattcaaagcagtaaagtttctttacccacttgtcactactacactggtcgacatacattgtcagacaggatggtattacagcacaagggtcagcatctagggagaaccattaatgacaccttacacccatcagcctacagagccccttttagcagtttgtatgcaaaaccagtatatccaagatcctttagacactgaatggtcttctgacttctcagattattctttaggaatgtataaaaccaagtcatatttttcttgtatttttctgtagcttattaaatatattatcagattgaattattctctggggatattgccagctcttgagttgaagtattatgtttcttgtaatgtgagaatatgtgccttccttgtatccttatttgaacattaaaatattctaagtcttacttgctctttgcaagcattgctgcactgagataagttagtgtggaggctttgcacatccttgtctgtcttctgagtagagtagaatgatgacagctgtcttcagtgtgtgtagtgataggtttacgatgttggctattatcctcattagactcagtaatgttccttctgttccacattcttcagagctttcatagtgatccactgtgacattttgccctaggcctttcatagatatattgatatatatctatcagtgagctttctcccactgatgatacatagtttatgccttgagttgtttggtttgtacttgctaaaacagttttgaatctctgtcatgaaatcaagttgagtttactttctgcatctattagagagaaactttttaaaagttgccctgtagcatccatacttttattattttctgtgtgcatgttttcgtggtcatttgcttttggacccaggtaaggtcagctttgtgtgatggctgtaccatattcccctactttctgtgttctgcactgttttctgggcaaattttttgtgggatttttcagaagaaatttgtgaatttggtgcagcatttgattattcctgagaaactgttagtgtgtatatgcccaagagtggtgtagctgggttttaaggtatatctatttccaattttcttaggaatctccagattgatttccagaatggttgaccagtttgcaattccacaagcaatggaggagtggtcctctttctccacatcctggccagcatgtgctgtcacctgagtttttgatcttagccattctgattggcgtaaggtggaatctcagtgttgctttgatttatatttttctgatcactaaagactttgaacatttcttttgaagtttctcagcagtccacagttgcttcattgtgaattctctgtttaggtattgtactggctagttttgtgtcaacttgacacagctggagttatcacagagaaaggagcttcagttgaggaaatgcctccatgagatccaactgtaaggcattttctcaattagtgatcaagggggaaaggcccttgtgggtgggaccatctcagggctggtagtcttggttctataagaaagcgggctgagcaagccaggggaggcaagccagtacagaacatccctccatggcctctgcatcagctcctgctccctgacctgcttgagttccagtcctgacttcctttggtgatgaacagcagtatggaagtgtaagccaaataaaccctttcctccccaacttgcttcttggtcatgatgtttgtgcaggaatagaaaccctgactaagacaaattggtaccagcagagtggggtattcctgtgacaacctgaccatgttttggggaggactgtggaaggactttggaactttgggcttgaagatccatccgttgttaagagctctgtcggatgttgtgtaggagcttggaagataatgttgagaacactgcagaagatggaggtctggtttgtgaaatttcagagggaaaattaaagactcttttcagggccattgctgttttgaatgtgaagattctgtagttctggttagctggggctgaagaatcagttgtgattaacaagataccagaactactaaagcaaaaactttgcatactgggactattgatgctggttagctggagctaagaaattagtggtgattaagaagagaccagcatcattgaggtgacatcttctgggaagtgttttctgaaagcacaaagaggctgtgttccagagatggccaaggttgtactcctgctgcagcaggacttggtaatatgtaagggtcacccaggtggtactggttttgaaggcatgaaggggtcacgcaaagcagctgaggctcggcactgtgagaggccatggaaggccattggtgaaggtgcagcctcagttgcaattgaaggcccaggattgaaggggtcatgcagtgttttggagatgccagtaccatgagatgaccaccaagagcagcagcagcagtggagtacaggcatctggagcctagaggatgacgtgtgtgctacaaagggcctggctggagaagtgacccaagcccttggaggagcccagaagatcgtgagttggatcccagacattggacggttggagattgacttttgcttttgattgtgactgtgtcctgatattttccctcttgaagaaagaaactgttttagtggagcccacagttaagagacttttaattgtaaaaagactttggattttaaaagagatggatattttaaagagattgaaaatttaagaatatgtaaagactgtgggacttttaaagttatttagaatggggatgaataagattgtaagggttgaggcttagtagtgatgtttttgtgtgtcaagttgacaaggggtcaattgtactggctagttttgtgtcaacttgacacagctggagttatcacagagaaaggagcttcagttgaggaaatgcctccatgagatccaactgtaaggcattttctcaattagtgatcaagggggaaaggcccttgtgggtgggaccatctcagggctggtagtcttggttctataagaaagcgggctgagcaagccaggggaggcaagctagtacagaacatccctccatggcctctgcatcagctcctgctccctgacctgcttgagttccagtcctgacttccttggtgatgaacagcagtatggaagtgtaagccaaataaaccctttcctccccaacttgcttcttggtcatgatgtttgtgcaggaatagaaaccctgactaagacaggtatctaccccattttttgattgggttgtttggtttcttggtgtttaggttcttgagtcctgtacatattttggatattagccttctatcaagtgtggggatacagaagatttttttccccaatttgtaggttgccactttgtcctatttactatgtcctttgccttacaaaactatctagtttcatgaggtcccatttttccattcctgatcatagagcctgaggcattagaattctttctaggaaattttttcactgtgacattaagtttgggactctttttctactttatcttctattttattgattctatcttgttttatgttaaggtccttgatccacctggacttgtgctttgtgcacgtttatacaaatgtatctattttcagttttccacatacagactgccagttagaccaacatcaggtattgaagattttgtcttttatccattatatatttttggcttctttgtcaaagatcaattgtctgtaagtttgtggtttaattactaggccttcaattgtattccattgatcaatctgtctgtctctgtatcagtacatgcagtttttatcactattgctctgaagtaacctgtaacgtttacaaaaagaaatgaagtccactgttttttaaacatagcagctcctatgtagtttgcttgggtgtgctttctggttgctaaatctagatatagaggctagttttaagtgagaaattacctttctgttttttcagttccttcacagactaagtttggctgtcctggaaatatctctctggatagatcttgtacacttaggtgtgtcttgctctgtctcctgaatcctggtgttaaagatgtgtcccatgatacctggatctaacattttcctcattagaatttgatctgttccaggcttttcttggactttgaaaactgccttcattttcaaactcaaaccagaatcttaagtgggtcaaattttgtctgagatcatcactctctcacttcctggtactcctttattcctcacaccatgagccttgtttttaaaccatgcctttccctttactgactcattagtgtagctacctctgtaattttaggtacttcgagccccttatacaaatcatattgcatgtttatattttggatagttgagaaatgttgggcagtgagtgcagggaatttaaagggaatcccatgtcccaccagagctccagtgctctgggcaagtggacagcactctctatgaggcccaggtgggtgtctggccgtgggaagctatggatttccagtcattaggggtagagagggagcagtttgtggtctctgggcctcacagaggccacagacaacaggtcctctgtcatggacatcccagatgtcactctatgttgtgaaagagctgagaacaaagtgagggccctgggggtaactgggtcatcccaagggctgaagggagaagggagcaggggtataaggcactcaagtgtttcccaggatgtgagagtctttagtctggtctggtgactggaaacactgagaggctttgctgctggaggtgatacgtggctctttagagtcagccctattccaatcattgaagaacagctggtcttaatgagtggagagatggtccctggttttaaggtgtttattgtaaaaagaggaagaggaaggagtagggaagtagaagccagccatgaccatgtggagagagggaggagaggatagggaggaggagagctagagatgagaataagagatttaagagcttaagagagagaggaggggccaaacagccccttttatactgggctgggttacctatctagttgttgcaacataactgtggggaggagcataccttgctattgtcaggtaactatgagggtggagtttagccagaatgccagggacttgggacattgtcaatatgacagatagtcacaggattattgagttgtggggctccgtgttgtcagacacctgtgtctgggaacatagctcactgttctatcccttgtagagttttctactgggtctccaaagtaagctttgctcaattagaacacaggctgcctttcacagtcccacagagaaaagctctaaagaatagcttttattttaaattatataatcttcaactcatgttttcatagttctttcccaaggccatagcattaccattttcctgagaaataacagacacattgttgcttcatggaatcttactgtttctggttatgtagacataaaccttggctgggagaacattccctaagaacataggcagggaggacaagccttatgcctacaggagccatctgaacctgagaaatcacacatactgttgaacctactccattcgatttctatgacagaccttgcagacagacttttatttatttttttaaacttttatttaactataggtgtgttcttctgtatatttttctatgtcctgcatgcctatatgagaccagtggagcccagaagtcatcacaaaatgcatcacacaggagtcagacaaaaatcataccttgttttgtgtgtagaaagaattagtctgtgtttcttttcatgaacagcaagtgccctttacctctgagtcatctctccagcccagaggtttacatttctgctacagtttttttttaaatttatttattcattatatgttcgtacactttagctgtcttcagacactccagaagagggagtcagatctcgttacggatggttgtgagccaccatgtggttgctgggatttgaactctagacctttggaagagcagtcgggtgctcttacacactgagccatctcaccagcccctctgctacagttttatgatagaacctgaatataaccctgagttctattttttgttaaaaaatgaaggaagaatcagaaatgatagtaatctgtgccacccataatcatgttagatgaatgagctcaaataataaagataagaatagtgatcaagtcaaagaatcataaatggttctgatccttgcagtctataatcatgttagatgagtgagcttaaataataaatcaaagaatatttctggagtcaaaagactcagactttaagttggacagtcatagatttatgaacaataatgtatccataattaatgacaaattagtataattcttatacaacttaaaacgttcctttccattataaaaaaacactctacattatcattgtgttgtcacataacccatttatttacaaatatacttctaactattctgaaggtaaacctgtgtggaatttatgaaattattatctgttttgattttgtcatgtattagaaaatggcacatgatattaatgctatgaaatgttttttttttttctgagacagggttttctgtgtagccctggctgtcctgtaactcactctgtagaacaggctggcctccaactcagaaatccgcatgcctctgcctcctgagtattgggattaaaggtgcgagccaccacaaccggcttaatttttctatttattttactaaatatcctcaaattaattgttcaatacatatttcaattcttcatgaaaatatgcttatggaattggatcacaaggtattttattctatgtcttgcttctaatggtggttttatactctgattttacagtttttatttgcttagatacaaagaaaattatttcttttaagtaatccttgaatttttactccctactctatttctttggtctagaaaggatacagcattgtatataggccttaggatctcaactgagcattttagactagagtctagctgttgacacccaactgcatacaggatagatacagggtccacatttgatcaaagctgacagttgtagatttttttagccaccatcatttataatctgaaatgtgatactgtgatcaatattgttattaaaaactgttcttaaagatatctataaagtgttcttaaagatattcctgcatccagacctcacatgtatactttattatgtctcagtatttgctgactgtgaggccattatgtcacctactccttcctaaaacaagaagacataatatacactatgatgattttagatgatatcatttcttaaaatggcctcataattcttatgacctaacgtatattctgttcttgattagcttccagaatatgacatgatttgttttcctctgaaagggaaccttaaatccaatcataatatgtttttctatattttcgtctgatgcgttcctaaagcactatgatcaaggaaagtaatagaagaaaaagaccactttgggtaatgcttccagaggataactatccaccatggtaaggaggcctgacagcaaataaccatgtttttgaaatagacagctgagagatcacatcctcacctccagtcactaaggaggaaaagagagtcactaaggtggctttggtctactgtttttctcagagcctaccaccagtttcattctttattcagtaaggttccatagctaaatttttaaaaacattgtgaccaactggggttccaacttcaaaagtgagacatactcattcagaactatatcggcagtcttctaacattctttcacattttagccagttttgatatcaacatagtaaatataactttaatttctcgtttgggtttcctgtttggtttgttttttttgtttgtttgtttgtgagacagaatctcactctgcagacttaactctcatgtatcctgatatagatacaggaatggcttctagttcacataaatttgcctgcctgagcacccacagtgctaagatgaaagaccttcctccactgtattatgcttgaatcaaacatttatcttttaatatttctgctaacatgcaacaagaattttgttcatttgtgtcatctaggacttacttgattgagctagctccttcagcttccattggaacattgatgtttgtcttctgcatgctctatctttgtgaattggccctccattgagttaccatccggcttagagttcatttctcatttcattcagattgaggattccttagatgtctggatgcaatgtcaacatcctgcattatcaaaattatttccttagccacttgcaggggttctcttgtatttcattcagttagttcctgtcctctttgagttcctgtgcttgtttcctctttatgtccgttgacctcattgaatggtgttcaaattgtactttttgttctgtctcgaatttgtttcatcattcttcttgtcatgagcaatggtattgcatttttgatttggggtaggtaaattctatcaccattgtcaaattgttttagttccagcctctcagtttccttttgctgtgtggcattaggtcagttggcagggatatccatatgagatgttatgtttaatcattgaaaatctgagatggtggacaggaacttggttacagcttcttactaagtccagttctgttctatgcaggtagcaaacatgcattgttgtagagcaggcctcgaacatccgggcagctatttggaagtctgcttgagcctgagtgggaagaataggtctgggtgtgctgtgtaaaattggtttggtgaatttcctagtctgcacagagttagagatgaaacataacctcaagcacagacattttgggttgtgcttgtagagtctctttgccctcaaagtcttgagggacttaaaaaagaatctctcctgaggaacgtcgaggatcctcaagctctgcctctgtctccagagtgtagggaatcaaatcctgagtctctatgcccagttttgtattcattaccaggattccttatcaaactttgttcatatgtgcatgctgtgtatgaattaattttgtgttagatggcgtacagtgaaattctgaaaatataaaaaacacttcatgggaaagcgagagccagaaggacactgggcaactctgttctttgcagaggaaaatcaactaaatgtgggcaaaaaagatcctaagaagctgagaggcaaaatgtcctcatatgcattctttttgcaaaccttttgggtgtagcacaagaagaagcacctggatgcttcttcaacttttcagagttctctaagaagtgctcagagaggtgggagaccatgactgctaaagaaaaggggaaatttgaagatatggggaaggctgacaaggctcgttatgaaagagaaatgaaaacctacatctcccccatggggagaccaaaaagaagttcaaggaccccaatgcacccaacaggcctccttcagccttcttcttgttccattctgagtactgcctcaaaatcaaaggtgagtatcctggcttatccatttgtgatgttgcaaagagactaagagagatgtggaacaacactgcagtgtgtgacaagcagccatacaagaagaaggctgccaaactgaaggagaaatgtgagaaggatattgctgcctacagagctaaaggaaaacctgatgcagtgaaaatgggggtggtcaaggctgaaaagagcaagcaaaagaagaggaagatgaggaggatgaagaggaagatgaggtggaggaggaggaggaagaggaagaagagttagatgaagaagaagatgatgatgaataagttggttttagcagttttattttcttgtctataaagcatttaaccccctgtacacaactcactccttttaaggaaaaaaattgaaatgtaaggctgtgtaagatttgtttttaaacggtacagtgtctttttttgtgtagttaacacactaccgaatgtgtctttagatagccctgtcctggtggtattttcaatagccactaaccttgcctggtacagtctgggggttgtaaattgacatggaaatttaaagcattttatggttggtgcacagcacgtattagttatatatgggttcagtagtttgggtttttttttcttttggttttatttttgtgtttaatatttttttttatcttcagttgtgtctgatgcagtttatacaaagataactgttgttctggtaactgattaccactctgtaattaaaaaaacttgcggctgttttgttgacattctgaatgcttttaagtaaatacattttttttattagtattgttgtccttttcataggtctgaaagttttcttcccgaggggcagttttttgcttttgcccattttgggtcacatggattattacagtgtgtatcttttcatctagttagctggaagaaagctttggtccacagaccctgctattgtggtaggggtaacattttcatccatagttgaagaatctcctaaatcgtcaccagttggataagagatattatataacctacttggcaaagcaaggagtggtcaattctgtcacaccgtgggattattagaatcaagcaatctgaaagtttgtccttgaacactagtagaaaagtatgttctaatccttacaggagcactctcctttaactgccattactatgtatattttgcagtttcccctactaaagaagacctgagaatttatcctcaaaaaatacaagcttaaaatacgagaatttaaatacaagaatgtcgtactatttgttgaccttagtcccagcgaaggctatcacaagaatgctggctgtaatgcctttgcccatctatctaaatacagattgctcaggaaacttgactgtttaaaggtgtttttaattagttgagtcagcttttaaaattatgccacatttaatatgaagggtacattttcctatattgtggtttgtccctttataaatcagatataagggaagaggataaactttgcataatagtagcagtggcccaatccaattgctttttctttataaaatccaaactcattaattaatcatgtttaatctgcaacattttggcagtttgtgggttgttttttgagattatcattctcttaaagtgtcagtgttttaaaatagcattcttgtaattttatgtgcttttgtgatggagtgcttttatataattctgacttgggttgtttacatttgcatttgttaatgtaatttgaggaggaatactgaacatgagtcctggatgatactaataaactaataattacagaggtttaaaaaaaggaacatttcaaggaagctatggtgtttttcttaatgtgtgtccttttagaagttgttagactcctttcattgttgttccatgattaattcagaaactgagcagggtaaaatattatcaccattaacttaaagattctctatgcctctgagatttgagtgatctctgattagaagtgggtctcatgatatccaacctaaaatgctacctaaatatcagtcttaattgtatcactcttaggaaagtgtttctagtattctcaatcttttctttttatctactgagaacagtactatgttagaaattcaggtcctttctgaagattgtcaatcatatgtgtgtgtgtgtgtgtgtgtgtgtgtgtgtgtgtgtgtgtgtgtgtgtgtatttacagtgattcaggattttaaatcataaattcttcaatgtcaaagaatttgacaagaacaaagattctgcttgtttattaatgcaatcataccatcattgaaaaggttaaatgaaatatcttccttttctattgtatctgttttctttgtgtttttcaaatgtttgtagctagttgttttctttcatgtttttttttgttgttgttttcttgttcttttatgaatatgagtgttagtctgcattcctgtctgtgaatcacacatgtgcagggtatgcagagtatggaagaaggcattgaatactctggcatgagagctgccatttgtgtgttgttatgagactccagtcacctggaagaaaacacagtgctcctaaacattaatcctcactccatcccctgtaggtagattagaaatatattaagttcaattgagaagactgtgaacctttgtcttgttatgctatctgtttgtttttggacattttcttcttcctgaactgaaaaccaggattcacaaatagtgcagttcattacatacatatatgtttcattgaatctgatttgtagtagggattttatagtgaagtttttagaggatgctgaatgaagtaatgatatttctgagattttattccttgggatttgtaatctataagatgtttcttgcattgtgggttttatattatatttcacattgttctctctattctttatatatatagctttcctgtgttgtacttgagttctattacattcatttattccacataagaattttcttatttcctgtgcgctcatagaaaatttatatctacttcttttgtgcatattttcatatatttattatctaagttggttcttgacttaaaaacttgtcttaatttactacattcacgtgttccttaaacacagtcaatatgagtagccactttttcagaaagtaacactagagtttgcaggcattttcatttagggcttgaaaaatgtcattccctactctactcttgcgcgcgctcgactggccaggaagaacgacgctgcaacaggatccttctgcacacgtttattgggagagcttgattgtagaggcgaaaagacttcgagcccagaactggtgctgcttttataggcctaggaggggcgtgtctcacacccggattggttatgcactaagcctcatttgcatgttcctcatctgattggctaccctctctcagtaccttacagaacctcattatcatacctcatttgcatgtctcacatctgattggttatactctcagtaccttacagaacctcattatcatgcctgggccaggcagtgtctttgcaaaaaactttactgcatatgtacacattggttgtttgtccaatcttatgcgtggtggccagcagtagtcagtgccactctgcaacggcacatgtggcttcccacatctccccctgtttgttttaataaaatgaggctggactaggcctgtgcaattatgcccatccaccgtggctcctgttttaggtcgttcctctaatgtcacagccttacccgtcataggataaccctatcgccaccgggccccatgtcttaggttggactgtgcacgaggaaagttgcccgtctctggataccgcagtgctgtgtgacaataactgctaaatgacctagggcgaactctgcaaaagaggccagccaaaaaatgaattagtggggaaatcatgatcaccctattgatgagcaagggctgatcaatgatcgttgagtctctctcatctaatctcatgctgactaattcttgagcatagataaccaaatttcaggggaggagccgttttcaatagctaaaagtgcctgagttataatcaccttgtcatgttttttgttgagttctgaatttgcataccaatcagagcatgaacaccagtccacagcatatggcagcaccaaacaaaatcactcccacccattccttaaagtaagaaaaagcagaggtaagccaagaggtaaagtctccgagggtcactggttccactctggtcccattaaggttcaggatctgcatctgcagcctcatctgcaacctttccagctcctgcgaccagttccccttcaggtaatttgataggtctgtacttttaataaaagaattattaatgtacctattgggaataatgcacacatgcaaagtggatgccacacaactcatttgtatgacatccatcatctgttccatgtcatgttgtaaaatatccactctctgattcactaacattaaccctgaggtgatatgagaatccaccctttgcagggtaagcaatgcctcagacgttttttctgctatctgacttatagtgtcagcagtattaatttgatctgcccaattagagataatctttttcttaaaaaatatacagggtgtaaaaggtttatccacattatgcacaaagcataatgtataatttaaatgaaaactagtactcttatacacccgtggctcttgaggagtttgtcgtgcataaggcacatccaaaaaacattcctttgcaaaaaacaaaggctaggtagaagaattggaatgtaccggtaaaggtactggccatgatcttactatggcccataaaggtatacttatcctggtttcaatcatcaggagcaggagaatcatcttggggttcatcttgctctttcagggtccttgtcagtcgcgtcgggacccaaagtggattttcttcaccctgtggaaaaacacaaatagctccccgggacctgattaagataggatccaggccataccatttattatcaaggacatttttccatttgaccatttcattgggcgattgaggccattgtccatgcctttcagctggtgatcttctagcatcatctaattttagaaaattaagagtaaatattgcaagggatagagccatctttggcgtcatagcctctatttcccctttctgtttttgcaaatattgtttcagagtgcggtgggctctctcaatgatgccttggccctgtggattatagggcaatccagtaatatgttttacttgcatttgtttgcaaaattggctaaatttagaagaagtatatgcaggaccattatctgtctttaacactaggggcttgccccatgcagcccaagcctctaagcagtgagatatgacatgaactgccttttcccctgtcaagggagaggcatgtaggacaccagaactggtatcgatggatacatgtacataatatctactactataattctccaatccttaggtagagctgagagtagggggagtcctctttgtacaggacccataacttgcatttgtgcattaatggctcttaggtcatgtaacaatctccatttacctgacttcttctttacaacgaaaataggggtgttccagggtgattgagtgggttccacatgtcccaggtctaattgtttttgtcctaattctttagctgcttttaacttctcagagggtaaaggccactgaggcacccacaccgtgtcctccgtatgccatggaatgggcaaaggctcctcagtggcccctagaaaaaactcagccctttcttatctactttttctgtggctttaactggtgaaattctaccttgtaagttttttccaagacctagtccaggtatatatcccattcctttcatcatttccttgcttttcggagagtaatcattagtcaatataaagttcatggctgacaacacatctcttccccataagtttacaggtaaagggagtacataaggttgaaaaagccctgttcttccttctttatctttccattgtaaggattttgcacttatagttggggtagcctcatatcctaatccttgtaagctatgtgatgattgattaacaggccaagaagcgggccaccaattactggatataatgcttttatctgctcctgtatccattataccttgaaaggtttttccttctatttgtaattgtaaagtggaacgattatccaaatctaaaaatatgtaggccacattagttcctgtagaaccgagtcccttatctccttgggaatcctggctactagggaacatgttatgcaaactaggaagaatcagtaattgagcaatgcgatctccaggagaaatggctacaatacctcggggtgcagaacacataatcttaacttgtccctcataatctgagtctataactccaggatgtatcatcaatcctttcaaagcagaagaggacctacccaacagtaggcccactgtatcctttggtaagggacctctaaagtctgatgaaataggttggcaccccatttgaggtgtaagaattactctggaggtggcacagatgtccaatcctgctgaacccggagtggctctcctcagtctctgggtggcctcatggacactgtggtctgaaatgccccatacatttgggggccctggggacgggggcccctcaccccgttttttggctgttgcactttaaactgaggtattggccttccttttatatctctgactgatctacattcatttgcccaatgtcttcctttcccacattttgggcaagtacctggttctgttttttcaaatctattctttctaccctttgtacactgcttttgcatatgacctgtttgtccacaattatagcagcttatttcttttgcttgtgccatcaaaactgcggcagccagccctgcatttgaaagaggtcctcctatttctctacaggctttcatccatgcttgtagccctttccctttccatggtgtgatagcatttctgcattctttggtacattgctcataaactaattgttcaattaatggcattgcggcctcagcatcaccaaatatacgtcctgccgcttccatcatgcgagccacaaattcagagaacggctcattagttccctgaataatttttgtcaagttaccagatacctctcctcgattaggcaatgctttccaagctttcaccgctgcctgattaatttgatcatagacctgcactgggtatcctaattgattgtttgtccatataccctgacctgtaagcatttcaaagctccatgcttgttgccctgcagtagcattagcacgggcctgactcaaacacagatcatgccatatagacttccaatctagatactgtcccatcgtaagacatgcctttaccacactcatccaatcaaaaggagtcatggcattgtgagccaatctatcaatttgggactgagtaaatgaggcattaactccataggtccttactgactctgctagctcttttacttgtttatgcgatattggctcataatatcgctgttgagcatgatcctgaaaaacaggaaaagcctgacatattttttgcaaccctttaggagtgcaaaaagagtgaccattgccaattgctttcttatctgcataaggcggagtaggtgggggagcactgaaactcctccctattggaccagatctttctgcctcatactccgcagcagcctccttcaaatcttcctcctctcctgttgataattcggaatcctctgagctagacaattctaacgactcagagtcctcgagaggagggtaaattgacttaattttctgctttttactattttttatactattttttgtatctttacattttgggagttgacaattaaagccatgatataagatcaaggcaagaaagatagcaaccccagcaacaattatcagatctatttcgtaggagagcatgcctctcacattaatttctttctacttaccggtaccgccgttcctcagctgaagagttctgaatccactccggatccttctcagcagtctgttttgcaggaacacttcattaccaccgttccccagctgaagagttctgaatccacgctggatccttctcagcagtctgttttgcgggaacctttattaactgctccttccccgtgatgcagttctgaatcctccctgtagcagggggtcttcgctcgtgcctgaagatgtttcttgtcccgggttttcggcaccacttcttgcgcgcgctcgactggccaggaagaacgatgctgcaacaggatccttctgcacacgtttattgggagagcttgattgtagaggcgaaaagacttcgagcccagaactggtgctgcttttataggcctaggaggggcgtgtctcacacctggattggttatgcactaagcctcatttgcatgttcctcatctgattggctaccctctctcagtaccttacagaacctcattatcatacctcatttgcatgtctcacatctgattggttatactctcagtaccttacagaacctcattatcatgcctgggccaggcagtgtctttgcaaaaaactttactgcatatgtacacattggttgtttgtccaatcttatgcgtggtggccagcagtagtcagtgccactctgcaacggcacatgtggcttcccacactctactgattttaatcaatgaataagcatttattagtactgtatggcatcacaatgtagcccattttggtgataaggaataggacaagacaactggaataagatgcacattgtttcagcacttagatgtgacactatctgcgtacatctgggagttgcagaaccaaatttatagagacattcctcaggaacactagatgagtgttgggaacaaaataaaaaggggggggccctgcggaagaatggaaggaaaaagatgcccacaccccaccagagtttccctattctctggtcagtcaggtgtaggaggactgctatctaccctattcactcatccctgggtgggtattcctctatcacactcttcagggggtggtcaaggggaaggcctacctggggatgccccccccagctactttgctaaagccagcagggttgtgggagagagggaaaagggaagaatttctcaacactgtccacagtgcccagcggaactttaaggagcagagactctatggtttaagagctttattagagaaatgcagggggaaagagagaagggagagggagagagagagagagagagagagagagagaaaggaggggaggggaggggaggggaggggagggaggagaaggataggagaggagaggagagaactaagataaaggagagagaagacaaagagaaagggaaaagaagagagaagtgagaggttagaggacaaaggagtgagagagagcaaggtgggggctgagcatacctttttatggtcttcactgttgctaggtaactggggaggagtttagcctgaaggtcagaagcttgggccattgcttacttgactactgaccatgcttctcttgtaggggctgtgggaggttgtgccttatgcaggggcctgagctccaggagcatgagggaacgcctaccgtgtcatgtaggtgaattatgaccacctgggtttagacctcagctcgactggagaccagcctgcaattccccacagatgagaaggttatggccttgtctgactactacatatagctatttgacctttgtctactttaaaaatatttgatatagcaagtgatagtaagccaggcggtggtggtgcatgcctttaatcccagcacttgggaggcagaggcaggcggatttctgagttcaaggccagccaggtctacagagtgaattccaggatagccagggctatacagagaaaccttgtctccaaaacaacaacaacaacaacaacaacaaaaacaaaaagcaagtgatagtaaattaactggaaggctaaaaagtgcagagttatgcctattcagaaaaaggtgtgtattggaggaaatgtcagtttcaagttttaaagtagaagctgtattttttctggtgacttcatggaggaagcatgtaaaaccatgggtgcactggtagacatacactgtcagacagacagtttggtatttcagaacacaggataagcatgtagggagagcgatcgactccttacgtctagtagacaagagaggtcttttattagtttttatgttacagcagcatatccaagacctttttagacactaaggggtcttctgatatctcagattattctttaggaatgtataaaaccaagtgatattttcttgtattttcagtagcttattaagtgtattatcagattggagtgttctctttaaatatttgtagttcttgagttgaagaattatattccttgtaatttgagaaaatgtaccttctctgtatccttatttgacacattgaaaatattccaggtcttatttgctctttgtaagcactactgtactgtgaaaaggtattgtggtggctttgcacatccttgtctctctttagaaaaaaggagtagaatgatgacagctgtctttatcttttgtagtgagaggtgtaggatgttggctattatcttccttagactgaggaatattccttttgttctcaaaatacccagagctttcacagtgatcccctgtgatatttttccctaggctttttgtaactatatcatggttatgagccctctctcactgtacatacattgtgctgtgacttgttttgtttgtgcctgttgaaatagtctttcatctctggcatgaaattaagtagagtttcctttctgcatccacagaaaaagtctttgtttaatgtactttggtgcactttgttacttttttcattgtacatattttatggtcatttttttgggaatacaaataaagtcatttttttgtgaggagtctacaacatacccctttttctgttttctgcaatgtactttatgcaatattattttggtgttttctaaagcaacttgcgaattcagtggtacatctatttagttcttacgcagtctttgaagaaacacttgggacccgagtaggctttttcttattacatagcctagtgttatgacctagaaagtttacttgtttctaagaaatcattattttcctcatcaattctcattaattggcatccactagccctttgtctttgactctagtccagaaatattagttttcagtaataaccctgagtatcagtactttacagcaggtatccatgtgctctgtgtttgtgcctgatgactcctgaaattagaaatcatcctcagattgtactcatactctttatcagtcaaaatgtatcatgtcggtagaaatattggcaagagccctggtattactttgctttatttgttttttaatgtggtttagcattgtctctaatggcatttcatttatttcattgttcaatccttgatgtgaaatttaagaagaacttgaatgtttgctcctcaccaagaatctgggagaagaacaactaaaagaatgagtgcttctctggaaaacactgcacaggtcagtatcctgtcttcatttcttttttaaatcccttttatattcaaaacattcaaaagttctatcatatgtatgtgtaatattacctaggaggattattttctgtgctcttcattttcctttgtgatgatgaaaatataacaatttggtttctcatgtatacaatagctttatattttcactggtatgtatactatgaagacatgtaattcccatagaactgtaggtgtcaaagagcatctattggaagtgatgcctcaaaaatatattgatgactatttcctatgtttgataaggttatatatatccttttatattagtatggaggaagtaaggtttcttgtcacacataaattgcacttcagggatattcaggtttccagacacaaggctatgaatgtggatatggaaatatatagaaactcatatcagtaagcaacacacatatcagagtagaatttgtaatagagtaaaattatatgaggcccactgtcttgaatcctaataataagtgtatcagctccctagaagcacagatgatggaaggggattatctctcattttgtctttgatgtgattattagctgatgcagatttcagtattctgacaattctttttaacattttaagtcacacagtactcattgaagtgttgacacctgaaatatgacttgagagatactattcccgagatacatactcaatgtagacatgcttattttcctttcatttttgtttcagtctttagaagtagtgtaggccctgtggttttcacctttgtattttatcacatgaaatatatttgtaacatttatctaaagaggatagccttggtactgtgcataatccatcaattttcaagcataaatgaatatccttcctattttctgtctcctttttttttagaaggaagacagtttgatatagcctatgttattcctcttcagccaagcaatgcattacatagggaaagctgaagggttgtggcaatgtttctatttttttattgcaatactattttctttaggtatatatgtgctcatctgaatgtttttatgtgtatagaattacacattatgcccctaaaacattgagttcagcgccaaaccttggagactgaagtcaggcataatagtgagctgcaatatactttgagagaattaaattcggtttctatgcagaaacagcaagcaccttacatgttagtaatttttttttcatgccccaggtttacaattttaggctcatttgtaaaatagacagtatataacctgtgtattttagtttttgataaacaaaggaagaaatagaaatcatgcttttctatgcaagctacaactctgatacacaaatggttaaattctgatgaaaagaaagttaagattagaagattaaaaatttcaattaagatgataccatgaggaataaattattaaatattcatggagagttagaataattcttcatcaatttgaaaacacagtttgagcaaagaaaatgattgtagttcattggaatgcattgccacctatgacatttgcttacacacccataactaatcattcttcagtgaaaggccatatggcagttatgaaattgttatgttgtgtattgctcatgccaacttacataaaatgttcaggaattttaatgctcacaaatactggttttcttactttatggttttggaaatgttttcctaaaatatcttcccaaagcattggttctgtgttatacagaacgttcaatgctctgatgttgcagttttatgttttttaacaccaaaactatgacattcaatccatccattaattctgcatttcatattctacctgtttgctctagagaggatgtagcattttgcataggcatcagattgtcaaataaatatattataataccgtcatggaagacacagctgcacacaggactcagctcgtgtccatatttgagaaagatggacactgtaaaattttaaagcatattttttctcattataattgatgatttatgattcttttttatatcagtccatatttcataaatattcattattgcatcttgacatcaaatgtacatcttatatgtgtttactgtttttgagatggttatatcatgcattctcagagaaatagaaatctaaacaagtctgagtattttagagtgtatctgttaataaagttaaactttatttttcttcagtatatgttggttacatgtgcctgaatgtatgcatttgtggtatgtatttctcctgcctgtagtgttaagtagagatcattggattttaaagaactggatttaacaatccattgtgtagtgccatgttggtgctgggaaacaaatttcataatagaggccttgaaaagatattatacaaaccaaactgcacacaaaacttttgtaaatggtgatggtggcaaatcttttttttttttaagatttacttatttattttatgtatttgagtacactgtagctgtacaggtggttgttaaccatcatgtggttgctgggaattaaaatcaggacctctgcttgctccagctctgctccctctggcccaagaatttctttattcttatacataagtacactgtagctgtcttcagacaccagaagagggtgtcagatatcattacagatggttgtgagccaccatgtggttgctggtatttacactcaggaccttctgaagagctcttaactgttgagccatcactctagcccaatggtggcaaatctttcatttgctgcttaaggtctcagtaaatcaaagaaaattggttaagacaagagcctttctgaatgtaagcattatagtaaatcattgtataggttgtctatggaagagcagcaattcatgtcttgaaacacaactccataaactaagaaaatatcattcaatattcttgcctcatttatatcacgaggtgtatcttaattagttctctttaacataataaatcatttttgtctagtaacacctaggtagtttttcattacagtgtctattaaccttcaaggacgtgtttttggacttctcatcggaggaatgggaatgtctcaattttgctcagaggacattgtacatggatgtgatgttggagaattacaacaatctgttgtttgtgggtaagaacgtactttttgttgaattacggatactttttttaaattttcctaatttgtataaactctctgaaatacttagagacctcaaatgagggaaataatgcttaaattcataacttttcctttacatttctctgattactttggaaaggtaaccagtgctatattctctgagatctctcttccccacttatctagcttcagtcaagacttttaatttcaaaaaaatttaaacattcagaataaggaattgtatttctgtacatataataattggagtatttcttcttaccattgccttaaaagtctcttatttatgattttagaaagtggacaagattcaagtggacacagtgccgttggtttggagggttttttattaagtgtttgacatttggtctctgtttttttctggggcaacctgatctttatcctatattttggatgttgaaacaaaactatttaatgatttctcatgacagtttcagttacatcataaatttatacctgaccaaagctatacaatgtcactctaaatccaattgtaattttaaaattagagctatattgttcagagatctactttctgacatttcactacagatcaatcacttagaagttctagattctgcaaagtagaatattcttttttttcttttctaaattggttattttaattattatatttcaaatgatatagcactttccagtttcccctccacaaaccccttattctatcccccctaccccatgcttctatgagggtacttccccacccacccacatctgcttcactgctctaggtttcttctctgctggggcattgaggcttcataggtctaagtgcctctcttccaattgatgaaagataagacagtgctcttttacctaaacagctggagtcattggtccctccatgtgtgtactctggttggtggtttagtccttgggagctctggggtatctggtttgttgatgtttttctttttatgaggttgtaaacacctttagctccttcagtccttcccataactttactttggggtctctgtgcatagtcagatcgttgcctgcaagcatctgcatctgtattggtcaggctctgcagaaactctcaggagaaactatatcaggttcctgaaaacaagcactttatggcatcagcaataatatcagtgtttggtgtgtgcagatggaatggatgcccaggtttggcagtctctggatggactttccttcagtttctgctccactctttgtccctgtagataaagggacactctttatttcctttagataggagcaattccgggttaaccttttttatatgggttggtggtacaatcttagaaggctattatcacttttgccatttgatatagatcagatttgaggtacttctgaggatccatgcaatgattaaaaaaaggaaaacctctcttgagaatatgaatacatagaacagtgattattggatcatacttactcctcatataagtaatccctgttatccctaattcccccttttttcagaaaatcactgcatatgtggaaactatgagaaggagaaggtcttggaacaagacacacagcacattgtcaatgagcatgggcataaccgaaagaagtcttctaaatgtaatgagcttagaaatgtgatccatgaatcctccgaaagtacaccttataacactaaccacagagatgccactctccaatcctcaaacctaaaaagacataaaactgggaccactaaaggagtttgcacatataaagactgtgtaaactgtttaaaggggtcttctatcattagtctcaatcaaggaacccacatagagaagaaagaacacaacagaaataaaaatcttgatgaggttttggtttctagacaaaacaatagtgaaatgaacacttacacttgtggtgaatttgacaaatgctttactcagagtgacaatcttcaaagtcagcagagaatttatccaggaaagaaatcttacaaatatagtgaaagtgacaaatgctttacccaaacttcccatcttagtattcatcatacaattcattcaggagagaaaccttacaaatgtagtgaatgcgacaaatgctttactgacaaatgcactctgagaaagcatcagagaattcatacaggagagaaaccttacaaatgtagtgaatgcgacaaatgctttactgacaaatgcactctgagaaagcatcagagaattcatacaggagagaaaccttataaatgtaatgaatgtgacaaatgctttactgacaaaggcagtctgagagttcatcagagaattcatacaggagagaaaccttacaaatgcagtgagtgtgacaaatgctttacccaaccatcccatcttagtattcatcgtagaattcattcaggagagaaaccttacaaatgtagtgaatgcgacaaatgctttactgacaaatgcactctgagaaagcatcagagaattcatacaggagagaaaccttacaaatgtagtgaatgcgacaaatgctttactgagaaattcactctgagaaagcatcagagaattcatacaggagagaaaccttacaaatgtaatgaatgtgacaaatgctttactgacaaaggcagtctgagagttcatcagagaattcatacaggagagaaaccttacaaatgcagtgagtgtgacaaatgctttaccaaaccatcccatcttagtattcatcgtagaattcattcaggagagaaaccttacaaatgtagtgaatgcgacaaatgctttacccaaccatcccctctcagtattcatcgtagaattcattcaggagagaaaccttacaaatgtagtgaatgcgacaaatgctttactgacaaaggcagtctcagagttcatcagagaattcatataggagagaaaccgtacaaatgcagtgagtgtgacaaatgctttacccaaccatcccatcttagtattcattgtagaattcattcaggagagaaaccttacaaatgtagtgaatgtgacaaatgctttactcacaaaggctctctgagagttcatcatagaattcatgcaggagagaaaccttacaaatgtagtgaatgtgacaaatgttttactgagaaaaacggtctgagaaggcatcagagaattcatacaggagagaaaccttataaatgcagtgaatgtgacaaatgctttacccgaaaatcacatcttagtattcatcagagaattcatacaggagagaaactgtacaaatgcagtgaatgtgacaaatgctttacccaacaatgccatcttagtattcatcagaaaattcattcaggagagaaccttacaaatgcaatgaatgcgacaaatgctttagtgacaaacacagtctgagaaggcatcagagaattcatacaggagagacaccttacaaatgtaatgaatgtgacaaatgctttacctgaaaatcacatcttagtattcatcagataattcatacaggagagaaaccttacaaatgtaatgaatgtgacaaatcctttactgaaaatggctgtctgagaattcatcagagaattcatacaggagagaaaccttacaaatgtaatgaatgtgacaaatgctttacctgaaaatcacatcttagtattcatcagataattcatacaggagagaaaccttacaaatgtaatgaatgtgacaaatcctttactgaaaatgtctgtctgagaattcatcagagaattcatacaggagagaaaccttacaaatgtagtgaatgtgacaaagctttactgagaaagtcaatctgagaaggcatcagagaactcatacaggggagaattcttacaaatgtattgaatgtgacaaatgttttgcccagaaatcctatcttgtttttaatcacagaaatcatacattaaagaagccttacaaatgcagtcaatgtgacaaatgattttcccacaaacttagtctgagaatgcatcagagaattcatacagtagagaaaacttacaaaaatgcagtgaatgtgataaatgctttactaataaaggcagactgagaattaatcagataatttatacatttaaaaaaacccttacaagtattttgtatgtgataaatgcagtacccacaacatcagtctgacaaatcaacagatatttcaaacagtagagcaacattataaatgaaatgaatgagatagtcctttaacaagaaatatcatcttaaaattcactggagaattcttccaaaagggaaacttttcaaatacattgacggtttgaatcctttattttggcctatctcttagaatgtaatagataatttatacaggcaagaatcttaacaaatataatatatgctgaaatatctttgacttcatttcagtgcagaaaaaatatgtaaaaaaaatttttatgggaaaaatagttctcctggggaaatgtggcatatgttttacacgggtaatattcttttcaacagtcagtgctctaaactagagaattattatgaatctgaaaacttttgaaaaccttcatgcaatgttcaaatcttagataatgtcaactattatgctggcagtaactctgaatatatgatagtgaagaaacattttcattaaacttttacttgttcaccctcaaatattatatgatgaagtcaggtgtgaaagccagaagaatatgatgttgtgcaacaattcatggagatagaaatgatccattccaaaaggaaactaaataaagtgtactatcgccttcaaaatgtctaataaaactggcagcattttgtatatttaattcaaatgaagaaattgacacagattgtagttgatagtgtatttgacaaactgagccaccaagactgcatgttcttaatcctataatatgcctacagatgtgaagtgtgctttgagtatccagtattcattattcttatcacgtcaatgtgacaaatgatttattggtttcacgtttcaggatagtgactgactatgagtcccttatgctctgtcaacatctccttcctcattgccctgtaaataaagctgaatattttaacaaggttgacttggctgttttcagtttgcacttataattagatgaataaatgttgcatcatcgctggaactatttctcataaagtatttgctgaagtcatgaatattttctgtaaacctgtaacttaaacttaatatttgtgattttcagctggtcaataacaaccttgacccacatacgaataatatgaactgtatataagtgtttagcattagaaaatttagcaacagtgtattagagatgatgatttgtgttaactaaaacagggatgattctatgcaatattccaggcttactgctcgattagtactagtttattaaaacaaacacacaatcaaacaaagacaacaacaaaaaacaaaaccaaacaacaacaaaacaggaaacagaaaacatgtaaaggcatttagaacctcaacagtaagtctggtctctctctctctctctctctctctctctctctctctctctctctctctctttctctctctctcttgactcaagggaatatgagataaaatactaccaaaaataaatgaaaatatagcttcatagttttcagggatatccatcctaactgtgctatgtccctgtacaactccaaagctctctccagggacacgtataacaagtccttatggtgtcctgtcctattgttcctcatactccactctgaaccttcatactccactctacctcaaggactgactaagatttccattcttgtcctaaatcatttagggaatgctcacattttacacaccttagaatgtacattttggagaaaaatacaacaactcactattaaggtattaatctcctttttatttcatatctaagtttatccatacaaatagcatgaatctgtaaatcttaaaagaagtaccctttgtatggtagatgaggtaaaatctcatgcacagtttagaaatccaaacatccaagaaatacatttggaaatactgaaaaaagatgaaaaaatatttatgccaagcaaaagcattttattagaatatttatagtaaattcaggaagactcagaaaattaggatctaagaaaatgtcatatgttaaaatgaacaaatctatttacacattttccttgatataaaaaaaataaggacaaatttcaacttgtgagaaacttagtgataacatgttattctcagaagtggaaattgttgaacaaatctatatcactatacatttttccttgatttaaaaaaataaggaaaattctcaacttttgagaaacttagtgataactaatatgttattcttagtattggaaattgttgacctcttctttagtaggatcaaactactaatagacactttagaggcccttgttttcaaatgatcattagtattttctatcaagtgctgcatcatggatgctgatgctcacacaccaggcaatttaaatttaggcttctgaaatagcccttaacagtcaggaaattacaaccacctggacagtctctggatattccagtttcttatgttgcatgattctaggccccactgcctgatgacttagagatcattatcccaaatcttcagatatttccagtgtcagtgaaaagttccaaattgtgcacagcaaatacacaacttaccttttgcccctcacacaatatgattgtcttcattctataaacatttatacacctgcttcttgtctatggtacaacaagaatatggtgagggtgtacaacataggttcaggtagactcactgttggaattatgtggaaggcatcatgtgcagattgaaaaagatgaaagtcattggcttagggaaattaataatatcatgtttgaagaccaagaaaacaggctcaccaaatttggaaacattcactatttgtggatgagcattgtaagatacataattagagccacactacagaagactaatgaacagtcccagaagatcttccagtggctacaattttagtaacccagcaggactagggcagtaccttgcatggaaagaaaatatctctttagcaacaagacaactggtgggagaacatggggatgggaaacattaggagtaggtaggaagactcatttcttgattgaaactgcttttttagcaggaggattcctaagagaaactgaaggcctgaaggaagtggagtgggatcagaatcccctccttgtcaggagtctgcaagctgcaaggtgtggaactaggagtagagcacgctgccatgggtctcacaacaatggaaaaattcccttcatctgcactgttgccagtttaggccttaggaatctttttcagtcactagagcagtggcaggaactgcaaccaagaagtcatggaaactcccaggtcaaaggaattgctaggctagtgggcagaaaggaattgtaccacgattgagaccactttctctgctgctcataagaactctgaccctcaaattctactgggcatttcttaaccgtgttggtaaattactaactatgtatgtttgacttgtcctgatattttttattgtgaggatatttccagagtaatttctaagaggatgaacttgtcttttttttttttcattttttttatcatggttatatttccctggtggttggaacaaagcttgtattattcacatctatccatggtttctaactcttctattttatcactttcctagtcaagattattggatattatggagattatgcatccccatgatgtctttaaatattattctcttaaagactgtttgaatttatattgaatctcaagcgatattttagcatttttaaaaaattttacgtgtctttaagttgtggttgtataaatatggcttaaacagcaaaacactcctggacttcagctcaatggttgactctacatatctgcaacagtgtcaataagctcctgatagagtctgtcagaggacagtcatgtcaggctctttctgagcacaacatggcttcagtaatagtgtcaaggttttgttttgttttgttttgttttgttttgttttgttttgtttttctgcccataggatggattgatcaaggcagtggatggcattttcttcagtctctgctccacttttgtcactacatatcattagatatgaacaattctgggtccaagttttgaagatggtcagatgcccccatgactcaaatgggggccatgcactctgctggagatattctatttaggttctgtctacccactcttggacatttcggctaaggtcatccccgatgaggtttgggagacttccacatccatcttgtctgggactttctagatatttaccctgctcttcattcccacacggttgtatgtttctattaatactcctggccctctggccttctctcctgtctccccatatacctgatcctgccaccgattgtccctgattctccctcttttatccacatccctcccttcttctgcgtcctgggattattttgtttctccttctatgtggagttgaagtatccacaatttggcattccttctaattaaattttatgtgatctgtgagttgtgtataatggtattctgatctttttgccaaataactacttatcaatgaggacataacatgtatgtccttttgagcctgggttcctcactcaggatgacattttctagttctctccatttgcctgcaaatttcatgatgtcctcagttttaatagatgagcagtattccattgtgttattgaaccacattttttctacatccattccttggttgaagaacatctggattgtttccggcttctagctaatacaaatatggcagctatggacatagtggagcatgtgtccttatgttattgtgtatcttcttttgtgtatatgcccagtagtggaatatctgggtcttcatgtagaattatttccaattttctgaggtactgccagattgattttcagagtggttgtaccagtttgcaatcccaccagcaagagtggagtgtaactctttctccacacccttgtcaccatgtgttgtcacttgagttcttgatctttgcaattctaattggtgtatggtagaatctcagggtcatctgatcttactagaaaagcatatatgcaacaacactgcagcaatctagaagagacagatgacattctagatagatatattgtgtccagttaatcaagttgaggtaaacgatctaaacagtccagaaacccctaaggcattggactctgctgccctcagaactaggacacacccataaccatgacagtgaccccttctgtgaggtcacagaggccaagcctcactctgtttaggaaagctcaaagggtgtccacacacacaggtgccttttggactggtattaaattgattgaaattttggcctctaacctgtctcttcaccaccattaaacacagcttgtaataggatttcccagaaagcagcatttcaggaagtttccctcccgggcctcatcatgatagtcggtgacttctgagaatgtcactaacgaaacaactgatatgatcctacacacacacacacacacacacacacacacacacacacacacacacagattcacaaatacattaacagccataaatataaatatgttaagtagatgaagaagggatgtgatatcaatgtctgtggccatgcaggaaagggcctgtaagttgaaaaagatttctaggaaggttcacatgtttaaaagaaaacacagagaaggtcctgggaaagcacttctttatgaacctgtgtaacatatgttccccgaaataatggcatagaggacaatgtaagtatttgatcacttatgagcgtgagttttgagtcttaaaagcaggtactgacttgacagtttcttccagaggcctcccttcctggcacatgtatggtgtcttctccctgagtctatgtctagcatgccgttcggcaggcacccttgtatttactgctgctctggcttgacagaactcctgttgtgttaaacaaggaacacctcaagaacttcacagagcccctgtcactgccattcaggtccttgatcctgctctttcctgcatgcctttatacctgaaggcacatgtactcccgtatatacactcccagaccatgcacactaacatacaatttaaatataattatgtatagtgtgcagggttaggtagagtgctggaataatatgtcctgtttgtggggcaatgggctatacacagacagtctggtctccagtcaagctgaggtctgaactctaggacccggtggtgataattcacctacatgggacagaaggagttctctcatgtctcctggaactctggctcctgtcaaagttaccgtcccctcagccctcacaggagaagcatggttagtagtcatataggcaatgtcccaagcttctgaccttcaggctagactcctccccagttacctagcaacagtaaagataacagcataccataaaaagtgctgtttgacccctcctcactctctcactcctcttgctcttaatccccttactctcctccctcctttcctctctctttgtctctctccctcttactctctagactttcttctctatctccctttcccctttgtctcctcttggccatggccagtctctctctcttttaccttctatcctttctccctgcctttctataataaagctcttaaaccatagagtgtctctgctcatcaaggcccactgcacagactctcacctgtctgggaacctctctccctcagccctcactcccataaccccagggctacagggtgtcactccgggaccccctgttgggggctgtcccttgtccatcccccatttagtggggtcagtggcttagatgcccacctggggctgagtggaaagtgtctggcaaccctcccatgtctgcctgcccagagcataggtggaactctggctgggtgtgggctatcttctctccctcctcttccccagactcccttttagttcccacacctgttgagtacctgctttcagtcatgctggagacaaaccctggacatacaagacaagattattactgtgaagaagcaaagtcccttcagaagcccagacagtaggattctgcaccatctcctatctgccctggacacaatgggctgccatagctgatagttgtccatggcttagggcacaacaacagagcttcatcctgcactagtctggagcctggagtcttttcatgtggtacaagctgggtgtgaccattccctaggattattctctggtgagttgtaggtgttgtctccttgagtacctgtttggcaagttctttagcatgtgcatatgcacacacacacacacacacacacacacacacacacacacacacatacacacaccctgctgatacttactgaaacagtttctactgctttatcagaggccctgctaaaggtcacttcaaggaccacattaggcttcatacacttcctcactcctatctcccagtatagtacaatgaggtttagtcaggacttcatcccagggatctgtatatatttctgccaacatacagcccaacaaacctgcagttccttccagatcccagcccatccctgagctccctcacaccaacaccacagcctttaaccatggcaacaagctatatgaggtaacagaggctgaccacacctctctccagcttcttcccatgtgcctagatgtaacatgaggaacgacctggctttctctcttaacataaagtaccctgacttgtgtaactacaactggtgagttgtaggtgttgtctccctgagtacttgtttggcaagttctttagcatatgcacacacacacacacacacacacacacacacacacacacacacacacatctttctgatacttacagcaactgtttatacatacttgtagcaagatatgtggcatcattccatgtcctcctcatgcactttcacacatatggatgtggacctgcagacatgagcacaaacataagaacatatacaacacacctacaaaatgaaaacatgtatttgagtatagaatgcgaaggaaggtgctgtcatggcatttcccatgatactggcattgctgtttgactcatattgtggcagctctctgagtacacatgcaaagattgctactgccagggactgaagtcaccagggaagatcagacaccagtgtcagggatgctctgcctcattccctggacaagctatgtgtgatggtcaaatgtgggcgtggcaaaagcactgttccctccttcctggcctaggctgggggctcaagtcctggtccagatagatagatagatagattatatatatatatggcttctttccaaggcctctcctcctggtgagtgagggttcttcttcccacagtcttgagtggccattcccactgctgtgagacttctgatctgtttctagctctccttagtctcttgaagacagtcttagagctgtcttcaatcagaaacactttaagtccctctccctatttctgcctcccccgcttaagacctcagtgaagaagtgcctcgcactgagtgagctactcacgcgatgaatttcaggtagtccatcccagaaaacagcccaagccgaggcaggcacacgtgctcagtgtgaatcccagccctccttgctggactctgagttatcctcaggctaagcactctgctattactaaggcagggatttaccctgtgatgtcacagagggctcacctcatagcactctgagaatcacaagggtcatccagtgctcagtcatctcccagtttggtccatcctgttctctacacaactgtttcaagcatctttggaaacaattagctttgggaaagtagctgaaagtgtttctcagacacctccctgggaatcacctacaagcatcttctgtcagccctccatcttcccacattacctacatccttgagaggaggaacacagtggatagcactgcttcctcagctcaagtgtctgtcctcatcatctcagatcctctattgccatcatggtttattgctgctcctcagcccgcagggtgccatcatctggcctttttctttgactccaactgtaaccaacactgcataaatacatgcataatacatttaattaattttactcttattttaaactacccaatccacatttgttaaagaaaattacttatcttgtatactagagaaatggctcagtggctaaggtcactcgctgctcttgcaggggacctgagttttaaccacagcaaccacatggtatggctcacaaccatctgtaacagcatctgaacaggatgtaacaaacatctgaacaggagattcaatgctcttttttagccttcttgggtacttaagtgcacaagcccacattcaaatatatacatagacatataattttaaaaataagcagccagggagaagcacctgaaaaaatgttcagcatccttaatcatcagggaatgcaaatcaaaacaaccctgagattccacctcacaccagctagaatggctaagatcaaaaatttaggtgacagcagatgctggcgaggatgtggagaaagaggaacactcctctattgttggtggaattgcaagcttgtacaaccactctggaaatcagtctggtggttctcagaaaattggacatagtactaccggaggatcccgcaatacctctcctgggcatatatccagaagatgttccaaccgttaagaaggacacatgctcaactatgttcatagcagccttatttgtaatagccagaagctagaaagaacccagatgcccctcaacagaggaatggatacagaaaatgtggtacatttacacaatggagtactactcagctattaaaaagaatgaatttatgaaattcctagccaaatggatggacctggagggcatcatcctgagtgaggtaacccaatcacaaaagaactcacatgatatgtactcactgataagtggatattagcccagaaacttagactacccaagatacaagatacaatttgcaaaacacatgaaactcaagaagaatgaagaccaaagtgtgaacactttgctccttcttagaattgggaacaaaacacccatggaagaagttacagagacaaagaatggagctgagacgaaaggatggaccatctagaggctgccatacccggggatccatcccataatcagcccccaaacgctgacaccattgcacacactagcaagattttgctgaaaggaccctgatatagctgtctcttgcgaggctacgcaggggcctagcaaacacagaagtggatgctcacagtcagctattggatggatcagagggcccccaatggaggagctagagaaagtacccaaggagctaaaggggtctgcaaccctataggtggaacaacaatatgaactaaccagtacccccgccccccagagctcgtgtctccagctgcatatatatcagaagatgacgtagtcggccatcagtggaaagagaggcccattggtcttgcaaactttatatgcctcagtacaggggaacgccagggccaagaagtggaagtagtgggggaggggagtggggtgggagggtttggggacttttggggtagcattggaaatgtaaatgaagtaagtacctaattaaaataacaataaaaaaaattttaaatggctattatcagaaaacaaaaatatcaaatgtcagcaaaactgtaaaagcaaagttaaaacattgctacatgcctattcttggtggaaacttaaaatgttgttgtctctgaatgaaataaaaatagtcatagcagggcagtggtggcgcatgcctttaatcccagcacttgggaggcagaggtaggcagatttctgagttcaaggccaacctgttctacagagtgaattccaggacagccagggctacacagagaaccccagtcttgaaaaacaaaaacaaaaacaaaaaacaaaaacaaaacaacaacaacaaccaaaccaaaaccaaaaaaaaaaaaaaaaaagcagccaggagatggcagcacatacctttaatcccaaaattcgggagtcagaggcaagcagaccttttgagtttgaggacaacctggtatatgcagcaaatctcagaacagccaaggctacacagagaaaccctgttttgaagaaataaatcaataacaacaacaataataatttcaaaaagaaagtggtttatcttgccacttctctgttataagatcctagcaattgtaaagagctaaacaactagctataagaacagtatgaagactaactaatgcccaagacgtttacagttagcctaatactgccacagtgaattagagatcagcctgaaaagggacagtctcaggcagcataagaacctgaggctcctgggactctgagagccagccatgtctgtgcagctgaaaacacagggaaaccagaagactgaaatggtaggcagagttcagttctcttgttctaggttctttagactgtaaatgaaaagaaaattcagttcagaattaatccactggatagagatttctagactatattgtagaattatagaacttaagagaaaaaaacaaaacagtatggtaatttgaataggaatggcccccataaggctcaaatatttgaatgcttggtcattagggagtgccactacttaaagagattaggaggtatggccttgctggaggaagtgtgtcactaggggtggacattagggtttcagaagcccaagccaggcccagtgactctattttcccgatgcttgtggacctgaatatagaactctcatttttcctgtaccacaatgtctttgcacaggctaccatgcttcctagccatgatgacaatgaactaaacctctaaaactataagccagccacaattaaatgctttcctttttaagaattgttatgatagtggtgtttcttcacagcaatagaacactggctaagacacttaggaagattaaaattatagaaacgtcattgggtctccctaattattttttcctccctcctttctttttctctcttcccaactttccttagccatacctactctatccttcctcatctctctgctgttgtacctctcaatgaggtgtaggttaatccatgtgccgtctttcatgtattataggttagacttggtggtagagccctggactcatgccttcccaatatttctaccagaaaaaatagggggtcctattttcttggttcttattttaaccctccagagaatccatttgagcctggcttggatccagtgctcattgcatggtggggaaaagaacaagagaagtgagctgtagtcaagtcctactgctagggcagggggtggggaatctcccccagaacagaatacaattccagtgaaagtcagggaggcatgatggctatgagaaccctgaaagagccatgaacttagaagaggaaggcagattttagaagcattttgaacaacaaagaaaaaaatgtacataggaattgcacccatagatgctagaaagacgtgcctccagctatccccctatcatagaatataatacagttgccatcaatgattagaacagccctgccttccctgagggaagatggaagaaaagctaaaaggtagtatagaaagaaaagacagtattcctcctcacagaaagtgagttccaagattcatcaccccagaagtacacattctcttaggcagaaagtccttactgtgccaagaggatccctgtagagctccaaaagccactcactgtctgccttatagccatctactgatccatcttgagaacttctgtggccttagcaatgtgtgggaagagataccttgaaacaatctgtcttagtcagggtttctattcctggacaaaacatcatgaccaagaagcaagttggggaggaaagggtttattcagtttacactttgcatgttgctgttcatcaccaaaggatatcaggactggaactcaagcaggtcaggaagcaggagctgattcagaggccatggagggatgttctttactcgcttcccctggctcgctcagcctgctctcttatagaacccaagacatccagcccagagatggcaccacccacaaggggcctttcccccttgatcactaattgagaaaatgccccatagctggatctcatggaggcatttccttaactgaagttcctttctctgtgataactccagcttgtgtcaagatgacaaataaaaccagccagtacaaatggtatatctactagtaccagttttcataagccacaccacctgattttagattttattcatcttctgagtttcatttcccctcatacatttgtttttattcccaaatcatcaaaacgggtttgccttgagctcttcagggaaaacaggacagaaattaattaattgatgcttatgccagtcattgtctaaaatgttccttatgtatgatgacttcagttaatagctatttaagttaatttaaattctaagaaagaaatagtaaatatattagacactggtcagacatcattgcttcaaactctgtaaatagcttctgagttttcgtttgcaagtcaaagacacaaacctaaagacattcattttttttctgactaatttctttgcatttatgtaatgtttggcatattcatgctacacatgtctttgaagctaatgctattaaggaaatgctactaaatcaactataaagtaagaatttatcctctcatttatggatatttatttttttaattgtacagatttgttgatgctagacagtcttcttagttttaaactatctggagtcttaaatactatgtagtgtttctccaggaggtggagtgttagactagagaaagcaaagccatgggtgaagcctaatcttttcctttttttttctattttgagaaattttttatagaaaacataaaccacctaatgggctccctaattcttttaattgcatcaattcagcagaatccaattacactagacctcaagaggcaggtatattttactgattgcattaccataataatgatgccatagtgacaatggcgagcgtttataattcctctcattctaacatggcttatcaagccaagccgtacatgaagcctcctggcatctctgaaggagaaatcatgcacacaaacagcaaacaaagagctgcctctgaaagtctccacctcccaggagtcttctgcctcatggaaaagaatgtccttcctgactttggtaataagtcaagagccacatgaccacttccagcctgggaactggtcagattgctaatgtcctcccagggacaccaactcctgctttacacatctgtctctcaggtccctccctgctttaaaagccctggttggacctggccttgagagaagcatcctcttaagccctagtgctgggatcaaatttgctgagatcatttggagcatatggcacagacaactcttgatgcacactctggatctcaaaactgcgaggtacagaacagcagcctagtggggtagactcctcttcccaccctctatctactgttggttggctgcagtgctagtgtcctgaaaggtcacaatttaggtgacatcccagagctgggtctcagcagaagtctgctcaaagccatcaaggagcctaggagagtactgctcctgagatgcacagaatcatccgtccatcttcctcttcactcttcaaatgagaaagttaaagcctaggaaggctttgtgacttgttgacatcacacagatgttcagttgcaaaaatgaggatatccctaattactctcccacctgtcccttcttcacactggacatccagagctagtttttaggagactcctaatgatcatcataaagagaaaaagaagacaaagttctgcccatgactctagagaacggatgaggttgcttcagaatggtattgtagcaatcaaagcatagccctcagaggactgattgactggctggctagcttgctgacttcttgcatttttataacactctgaattggttttggggaaagcacctctttgccacacattttcacccttagaaatgcatgatcaagagatggacattctactatgaccctggccacctctggcctcatttaattaatataataattagaataagcattaatgaatttgcagcatgctggaagcatatttgagaaatcatggtgcatgtgaaggactaagaggagctcagccaaacacaggcgaggagaagggggagacagtctcatacctctcctgactctagaatgctgtccctctcctttctagccccaagtcttttgttctctcctgtcttgtccacctgtggctagctgcactgttcagtgagtgtttcctgcataagacaaacaccaggtcacatattcaagcagctgccttagcaacctcattgccaaccctatcacacacaaaggttctgctgactctcacctgttctgaaggacataaggttttcagctatgtggttccaggagctgttcatgttgagctcagatttctcagggcagtgagaaatagatcaaggcatgaagatacagagacctaggaggagcatctgatttcttttttgttgtcttcagagccaggcttcctcactccaacctgattggcttgacagtctatagtgcttcagtcaatggaattattcatctaacactccctcaagatgccctggtagtccaccagtgggagaagaggctcttgttcttgcgaacattatgtgccccagtacaggggaatgccagggccaggaagtgggagtgggtgggtggggagcagggcagggggggggtatagaggactttcaggtttgaaatgtaaatgaagaaaatatctatttaaaaaaatgctcccttaaagaacaaaagttctaaaggaagaactggagtacccatagtttcacacgcatgcatgcgtgcgcgcgcacacacacacacacacacacacacacacacatacacacatacactagcagaccaacattgttcagccaaagattcttttaataattcttatatgaacacccattaaattataagcccatttcccatggatcagagacagacagaaaagactgcagaaaaagaagaagacaggagtctagagatctggtggtaactcaagggctccaccaccaggaactgttttctttctgcctgctatgcccagcgaccaacactaaacaagcaggagttatcttcaactacgtagtaaatccaagcccaacctggggtacaagagacataaggtgctctccagtaagcagcacgcctccatggcctctacatcagctcctacttccaggttccagccctgcttgaggtcctgcttgagtcctgatggactatgttgtggacatacatctaagttgaaataagccccttcttccccaagttgcttatggcattggggttttatcacagcactggaaatcttaagtaaaacagtgcccgcagctgcctgggatgcctctatagtcagacttggcaatactagactttttaaataccaggggagtgaaaatctcactattccacatctgttatacaaaaccgtacaagaagagcttagcacaacgccttgggtactacagttgcttaacacctgctcttgtttttctctgctgataccacaacaccccattccctgtaaagacctctagaaccaggttctctaccagactaggtttatcataccttacacgataaaggcacagcagtctgagttcaaacgaaggacagaattcacatggccaggtaaacacagggtgtaaaaataaaaagggaactctggtaaaggagagtagaagatttagacaccccaaagctgagaaagcatagcccagggagaacagatgtggagggtttccaaatgctgaatgctagggataaaactttcttccttatgccacctgggcctggagagtaagttgccccaggacagagttactactagacaagattgcttgggtaagggaacgtttgctcagatttgaggttgcacagggtcttttatgaacttgaacttgaattcaacttcttactacactgtacaatgcatatttatagatttaaagccacatagtcttgtagtctgtacagagtggcatctgagtgactggctgaagcaaagggctcaaaggtgccacctcctggaaggatgctcccctgcatccctacatctactctgtcttctgaatgactagttttcttatcttgtgtctgataagaaaactagttccctttccttgttcagctgcctcattcctcaacccttcagaaccacatcattcttgctgatttctttaatgtcagagtgccttctcttcactccgcctccctcccacaggggctcctgtgattccctgagatctccatagatagttcaaaataatctcccacctcttccatacatcttcacagtccctcttgctgtgttcaggtcagcagagctagacagtgggtgtctctggggtcaccatctgtccaccatatctctgttctggggtaattccagcactgtctctgacatccatccatagccatgaagaaatctggtgtaacattgttccactgagaagttcttcatgcttggatagggacaccacggtcttgcggcaaaccatcagcaagaggtactgtgaagatgcacgtaagagctgccacttcccttctgtgctgccacagcatagcctcttcaccacttctgtgccagcccatctaccaccagcttccttcccagagcaggccgaagggtgagcgagcagagagggaaagaaagcagtgaagtagggggcatctcactcctggtggggagaagtgggaagagttctcttctctcccagcatgccttctgctggtcttcattgaagaatttcctcctacctcccagcttaactccgtgctgttaaaggtcaccatttgccacattttacctgttgtaaaccacttccctagcagagtagataatgtggactggaatgatctagtattgccctgagatgtctgtcccttttgttgtcgctattgttgtttgcttttaagactctcacactgtcatccaggctggtcttgaactcaccatgtatcctaaactgatctcaaactcacagcaatcctctgcttcagattctaggactccaggtataagccaccatgcctgactattttttaattactttattaatgaattaaaactagatatagttgtattatatctttagatatgtggttttcaacctccctaattttgcaatactttaatgcagctccttatcttgtggtgacccctaaccactaagttttcttgttgctacttcctagctgtaatcctactactgttatgaatcataatgtaaatatctggtatgcagaatatctgatatgccacaccaaagaggtcatgacccagaggctgagaatcactgcctagctaggtaaccattacttgactaaaccaaaacttttgagggagccattattgtttcaaagcagagggaataaatttcatttaaaaaatgtgaatcttagtacctttatccaagctactggcttcatagatattgatgataaatacaggggtttgtttagccttgagctcagtacaggtactatgaaatgactctcatgaaagccaagtccgtctagtctgaacccttagaaacagctgagaagaagagggggttccacggtgtgcattcagaaggtatcttgggactaacttcacttctatgaccatggctttgagaagagcactgtcaaacgtcaacatgattgttctgagcacctgtcacgtgctgggaatggtatagaccctttgtgaacatattattctctctctctctctctctctctctctctctctctctctctctctgtgtgtgtgtgtgtgtgtgtgtgtgtgtgtgtgtgtgtgtgtgtgtgtgtgtgtggccactctacatgcatgtggaggccaaacatcaaaaattgacatagatccctccatcactctccatctttttttttttttaaaggtagggtctctgttgaaggaaatatctaaaaagtagagccgacacgctcccaaggttgtgcctctgccctggcagcctggctggccatgcactggtgggcaaaggctgacctattttatctcctggagattctctggcctggcgctccgtaatgtctccacccagctcacaactgtcaggttgcgaccatgccaacctcgtgcttcacccccccccagcctttgtggtgcacatctggcaaaccgatgctttgccactgtacctctctctcttgaacccagctgagctcctgcctaaaagaaaatgcaacacagacttagttcagaaacaatggtaactcaatctccccagacactaaacactaaaatttgatatttttaaaggatgaacttatttgctctatagagcatgcatataaacattgttatattgtgatctatatatatccaaaaattgaatgataattatccggaaactgacaagtgattcaattatacatttactatagacagagaaaaagttcacaatatactgggaagttaaaagagggcagggcaggactggagagatggctcagtgaccaagagcactggctggttgttcagaggacccaggttcaattcccagtacccacatgacagctcacaatcctctgacttcatccctagtgtatctgatgccctcttcccacttctgtgggcactaaatgcacatggcacacagacatgcatgcaggcaaaacacccatacacataaaataaaataaaataaaataaaatactaaaaatagttggtttctactcatttttgaataaatgaaaaaatataattatcattaattgtcatcctatgctatttttccagaatgtttacattattatttttctgtgacagatatatatatatatatatagagagagagagagagacagagacagagagagagacagagagagacagagagacagagagagagttttatccagttttaaagcattagcaaaatataagaaaatttgagtgaaatccactctatgtatattaaatgaattttaattttttttaatcctgactttaaaaaaaatgaagcagttaatgggttttacaagggagtgctgcagttacccatgtatgccatgagagggcgtcaaaactggccactgatacttagctgcagaaatgatgtcgctagatcccaaggcatttctagcttaaaatgggcaaaagtttctctgaatagagtaagcgtttgttagtgatatattttaggacactttttcagtgtacaaaaatttaacagtaccatttccctaaggtgagattctcaaaatttctggaaatatgtacactaacacttaaccctgactgttcgatgatttaagttataggggaaggttccagacaaacagtaataaggaatgtctgtggtggccagttgtgaatggagcgtaccagtttgtagtgtagtgcaatcttcagacaagtctgaggttcccatgtgcccggggaggctgaacctgacatatgacccccctgtcccgcgaccctgagctagaatggaaggttcttccaaagaaagagtgtgtcaggctcagtatcccccattactaggagttgtctctggggtcatccttggtagattccagggagtttctctgcacttactttacacacacacacacacacacacacacacacacacacacacacacacacacacttccaagcatctctttcagtattttcccaatacagtgagttcccaagcagaaaagtccaggcatgctggaaatgccacggcacctcaaccccagtatctgaaatggaacttgtacccaacttgctccaaatgtctatatacaaaaatgtctgtgcctcccattcagaccttccagggaaacccgggcattacagaatgaggactaccacgcctgcctacttgttaattttgattattcatattgcattagtatcttttcctatttctatgaccaaatatctgataaacaacttttaaagaaaaaacatttttctcatattatgattattgctgttattctcacttataccttaaaaaatacagtctatcatttcagggaaagaaaggcacgttacatcacattacagccacagccagaagatgaatgctgctgctctgcccactttctcctttttgttcgacctggagccccagcccagggctgcccacactcaagctaggtcttctcttctcatttaacctatccagacaaacctaaacatgtgggcctgggtaccagaagttttccacagagacctctggccagtcctgctgcgagggttcctgtgaagggaagtgagtgcaggaagggagatgaagtctctgccttttcttccaggtcgttcagtaactctaagctggccatgcactgagtcttgtctggctgagcctacgagaagccaaaccagtgaggcctgtggaaggacctcagggagatcttcttcgggagagaagatctcttcccaagtgttacagctcttggaacaaaaaactcaagggacagaatagttctcgctcacctttaatttcctggatagaatttatatgctgttttggggtgattcaagcttagacagcaggtacctctcattgggttggactgagagtttgggggaaaccttacttgcatatgggaaggcttggtggtgctcctacatggctgatagccacacacctctcttgtgggggctgtggggagggtaacttcgataggagccgagggtccagaagacatgatcgaatgccttccgtcccatataggtaggaatcaccacacatcggttccccccagggttcaagacctatgctcgactggagaccaggctgtctatgtgcagtccattgctccacataaacatactttgtttccatgatgattctaaaaccaatcaggtagactatgaagattaaccattgtaataatactgtgtgccaatttacaacacattctagctgttaggtaactgattatttctcatttttacatttgatttcgttggtttgttggttgtgctagggatataacttagagtcccaacatgttagacaagagtcccagcactaggttacacccctatccttcatctttactatttttaaattgctccttactttataccactttctctgccacaagaggtatacacaaacatttaaatgcattattaagtaaatatacaaaatagtatattctaatttatatcttcagccccatgagacagtaatcaaaatgaacatagcatcaagtagtacttgccctcctggtacactccattttctatcatgctgattctgggcatgaatcagaaactacattgtggccttgatgtttcaaagtccaaccacttataacaccaacgctcatgttctgccctcaagcagcttgtccaccacttcaaacactattagtctcagagttaacaagaaaaacatcccagggcctcctgttcagttctgatgtctggctatgaaaacttcaaagaaatcccaaagtttgtggaacatgccagcaatgctagtacttccaagggagaggtagaaagctactgtgtttgaaggcagtctgggacccatactgaaacattgtacccaaaaataaaacaactgcaaagaacccaaaataataaaaaattagaaattttctatttaaataccttgatgaagacaccatgtagatgagaaacagggttcagaggcccctgagttgaaactgacctgaaagtctcctctctgaggactagctttcatgatgtcagaagtcatcatacaagcttccaaaggatggaggcaaccaattgtccttcccagccatgacacctatgaaccacataaacaaccagcataacatgataactgcaatggtgaagtagtgccacacatagcttggtggtagccaacagctctctaatttgatttaggacttgctcaacaaggaggccatgttggtgctggaaacttaactaacaccttagtgctagtaaagtcctggttaccagaggataatctatacaaccaaagatttactaaaccagcataatctctaataatttatgaacatttatttttaccctcattagagaaacttctctttgcaacatacagacactgccacattaaaacacaacctatcaaaaccccgagttgtggagccttgtctcattggatacacctacaaaatgttcccaatctgaaagtttaggaaacactacagaagaaaggtcagggagtttgctatgagattgtgtctcctagtaacatcagaatctacacctttaatctcatcaacatgactctccaaattggaaccaaaccaggatgacaagaacaaacatgccaaacaggatggagacaaaaaaagcccatgaggcttcaacactgagtgctacagtcaactggatacgatttatatacagtttagggggtgattcaggattcgataacaggtgagttgcaagttggggaggttgtcttttccaggcaagagcaccccaaatgctagtctggttctaaactgaaaacatatatacagatagcactctcgtgcgcgcgcgtgcgtgtgtgtgtgtgtgtgtgtgtgtgtgtgtgtgtatacacacacaaatagatagagagatgatataggaatagacatagatatgtatgtatgtgtacttacatgaatacagcaacaattggaaaacaaagaggctatgaatttgaagacaagtaggaagtagtatatgggagagtttggaggtagaaatagaaagggaaaatattataataaaattataacttcaaaacaaaacaacaacaacaaaccacttcaaagaaagcctagtttggtggtccatgcctgtaaaacacttaaaaagctaaaatagaaacttactgaatttgaagccatcctgggtcacataacaaaaacaaaaacagtacattttttaaaaatgtataggtctatttagtggaggtcaactctagagtttatccgtgttaggcaagtgctctaatccctgggctatactacaccccactcctacagggtttgctgtatttggtttagttagtttcagaatcagaatgtgatgtggccttgatggttgatcttcaacatatagagaaagaaaaaagggtcagctttgtttgtttttcttgattgagtcagcttgaagctgtgtgttaagataaaccactaatttcactgctttttgcttacttagcaaaaaagacctaggcctggtagctcacagacctgcttcagattcctaagtagcttgcaccacaatgccaggttatattggggattggggttgtttttttttaaatattggcaatgttttactttcctgtttggtgatttttttccctttagtgcaagtctgagatatctagcaatgaagcattgtgaaattccataaacttgcactgtgtttacagacctgattgccccaccgtgccattgcttctgatgttaacagagtttaaggtacaaacctgggccctagcaggcttaaaaaacaaggtttgcataccagtcctcagtataccaactacagatgcatgcactagtgaaaataagagaaaagagatttattcaactagacacattgggaagggaacaaattcaggagtccatacacacaccatatgaacgaataccttctagatcttgagatatacatacatgcatatattcatgcatgcatgcacacatacatacatacatacatacatacatacatacatacatacatacatattgcacacacacattcagttctgttattccacacatcattattccagctcccatgtctcctgcaaggtcatctgagataagctgtcagacctacgtgtcaccaatgtgaaatctctttctggttggcattattaagtagctagactgggattaggagcctgggaggttgttgaggagagacccctccccacaggctttggacccttccttctatttccctggtaaactagaaagataaacatcataaccagtcttccttaggcatcctagtcaaaagtgtggaatacctgtgactctaaatggagatgtaacattctgaagcgacccatgattcaaacataatgttcttccctccttaagagttaattcactgtcaagcatctggcatggagtcctctccacagaatatctgattcatgtgaagacatgcttgggaaaggggaggagtaattaccctctcaatgacataagtagttaccttcccttcctacagtcattacacagcttccctctgggcaacactgtccaggttatctaatatctgggtcaacatttcttttttttttctttttcctttttttttcttttgagtaactgtctttcagatattgtccaaaagcttaagtatgcttttccagagactctgggctctctctctctctctctctctctctctctctctctctctctctctctctgtctgtctctctctctctccatctcttgtatgtgtgcaagctctcgctctcatctcaacacccccttttattagaaatatactttgtctcatatatcctcaccaaagacattagagcgatggttctatgcaggcaccagctcaccctctccaagtttaatgagttgtgtaggtgttgtcttcagcaatagggcttgctgtcagtttgcagagagcaacctactgtcttggcaacacccagggttatttgggaatttctgtaggacccttttggctaacaactcaacaggatgtattcccagaactggaagcttcatttggtgtcaagacatggctagttgggactccttttccctcatcatttgggaatttttttaggatggccttcatatattttagaaacacactgaactgggttcgcatactgtccctcaaatgcctgccaattctagctgtctctcactggattcctttcctcaaccccatttcccctcctcaaaccccgtattcctctctgggtctatgattagcatttatttgatggctaatatttacatataagcaaatacataccatatttatctttctgggtctgagtaacttcactctgaatgacttttttcgagttctatccatttgcttacaaacttcatgatgtcattttttaatatacattattttattacaaatttaaacataaaaacaaaaaaatgcaacatcctaaaaaaatttttttttactggtaatacaaattcctatgaagtttttttttttgctagcataagaaattaaagaagccattaaatatttagaaacattcaacatcaaaagctttaaatctaactgtagttgtagcccctgaaaaagctacaaactcttcttaaaaagtattttctctacaaagaatctcatcagctatacaaaaatctgtacagtttttatactgaagctaatgttgagctgcacttgaatttcacattcttagcaaaataattgcctgagcaaatatactccacactttaggacagccacttattcttcatcctcctcttcctcctcttcatcttcctcctcttcctcctcttcttcctcctcctcatcttctggttcgttcttcttctttgagcctgttggcctaccaggacccttctttgctgcttcacttttgcccttggcacggtatgcagcaatatccttttcatacttctcctttagtttagctactttctgctcatacggttgtttatctttggcagattgctcagaccacatctcacccagtttcttcgcagtatctccaatagacaggcctgggtgttcaattttgatctttgggcgattttcagagcaaaacaggaagaaggcagacggtggtctcttcggagcattggggtcttttatctttcctttcttaccccctttgggaggaacatagttcttcatctccctgtcataacgagctttgtcgctcttggccaaatcttcaaatttggacttttcctttgaagacatggtcttccatctctcggagcatttcttggagaactcagcgaagttcaccgacgagtggggatgcttcttcttgtgctcctcgcggcaggtctgtacgaagaaggcgcgtacgaggacattttgccccgcggcttgttggggtcacccttgcccatgacgatggctctgcgtctgtctacctgctgcgagcgctgcttccctcagacctccgcagagagacttccttccccaagctccagcgagaactggtttctcgctaacgcactccccagcctcttgttttgcagagttctccgcgccacggaaacttgaccatgatgtcattttttaacagctgaataatgctctattgtatacatgtaccacattttatttatccattcatctgttgacatctaggttatctccattttctggctattatgaataaagacacaatgaaatggttgagcaagtgtccttgtggtaggatgaagtgtcctttgggtatgtggctgaaaatggtatagctgggtcttgagatagattcccatctttcagaggaccccacatgttgatttccgtaatggctgtgcaagtgtgcgctccaccagcaatggaggctcctccaagtttctcttgcgccacatctctgccatcatatgctctcacttgtgttattaatcttaaccattctgacaagtctaagacagaattttaaattagttttgtgcttgttctttaatggctaaggatgatgaacatttctttaggtgtttctcagacatctgagatctctctattgagaattctgtttagatctgttcctcattttttaattggtttatttgtattttaaaaagtatatggttccttgagttctttatatattttagatactagccctctattggatgtggaattggtttaaaaaaatcttttcccattacataggctgttatatggtctgattgatggtgccctttgtcttacagaaagttttcaaatttttgcggtcctgtttattaattcttgatcttagagcctaaactaatggtgttctggtcacatagtcttctactgtgccattgactttaagggtagtccccattttctattttattatattcagtgtaactagttttatgttgaagtctttgaatcatttagagttaaggtttgtgaaaagtactacgtatggatctattttcattcttctacattgagctttctaaatcttctgaatccccacctgatctttggccatgcagctgcttgctgacatccttgcttaatttgaaaggtatgactttctctcaatctccctctccctggcaactgctaagatttgtaacttgcttgactgttattttcctctcaagatctaataaagggccctttcttttcctaataagtccacttttaattcattttattaataagactaagaactttgaaaagaaactcagtttctccagtaacatgaacaaccataaagggacattaaaacgtttctcaggggatacagcaggtgatcttgttccaggactttaggtgggtaagcacttgctggtgggtcaaacctacagtgaatactctctgaataagctttctctaggagggattcaatctccaggctttatcactctgtcttgtctcaggcatataagccttttgaactgactctgtttcctgtgaaggagggaaaaggttcctattttcgcccatccctgcctccctttagtagcgataagagcaaactatggagtatatatgcaatgcctccctccaccctaccctctctgctctgtcaccattccccatgctgccccagtagagcagcacaaagtactgggtatatttcctattcttcctcatttccttcagtgtttccattgccttggattatcttcatgttctttatggtatggacctcattctcgtggatgattccttgtttccttctgattcactgcttagctattttagacatatatttccaaccacctgcccctgctccatgcacacatgtcttctgttacatgcatgctaacctaactcaggtgttcttttattaagaagaaggatgaccaagaaaggagctacagagacaaagtttggagctaagatgaaaggatggacaatccagagactacccgacccggggatccatcccataatcagccaccaaccctggacactattgcatatgccaggaagattttgatgaagggaccctggtatagctgtctcatatgaggctatgccagtgcctggcaaatacagaagtggatgctcacagtgtgatggaacacagggcccctaatgaaggagctagagaaagttcacaaggagctgaaggggtctgcaaccctataggaggaacaacaatatgaactaacaagtacccccagagcttgtgtctctagctgcatatgtagcagaagatggcctagtcggccatcactgggaaaagaggccccttggtattgcaaactttatatgcccgagtacaggggaatgccagggacaagaagtgggagtgggtgggtaggggagcagggcagggagagggtatagggaactttcaggatagcatttgaaatttgaaatgtatataaagaaaacatctaattaaaaaaaagaagggtgactatatttatgaaatgtattctggattttcctatagtcatgtgataaagtaaatgcatatctttttaaaaaatatacatcccaataaatgccccctcctcctagtccctcccccataaagtcacttcccttcatcccccttccccttctcctttgagagggtgcccaccattccctgagtatcctcccatccttatatcaaatctctgcagagttaggctcatcctctctcactgaggccagacaaagcagccctgtagaggaacaggttccacaaacagacaacagctttagggacagcctctgctctagttgttcagaaacccacatggagacatctgttacatgtgtgtgtatggggtctgggggacttggtcctgcccatggaagctctttggttagtggttcagtctttgaaagctcctaagggtctaagttagtttgctgtgtttttcttcctgtggagttcctatccccttcaggaccttcaatccttccccaactcttccataagagttcctgacctctgtccagtatttggctgttggtatctgcatctattttagtccactgctaggtagaacctctcagagaacagttatgccaggttcctatctgcaagaatagcagactatcattaatagtatcaggaactggtgcttgcccatggatggggctcaagttgggccagttattggttgactatttcctcaatctctgctccatctttgtccctgcatttcttgtaaacagtagaaatttggtgggttggtgcccttagccctccactgggggtcctgccacatacccattgttatacttctaaactaaggtcatctgactaactcctgggagcttccactatcccaggtctctggcacatacttgagattctgcccactctccaatctctactactggcagctgcagatttcaagtcattctctgggtgctccggccggccctctctcctgtctctccctacatttaatcctgaccctcccattttcctgcaaaaccacccccaagttccctcccttcctctgcctcctatgactattttattccccattctgagattcaagcatcctcacttgggccttccttcttgttaagcttctttgggtctgtggagtgtatcctgggtatcctgtactttatggctaatatccacttattagtaagtacatactatgtatgttcttttgggtctggaaaactaggtcactcaggataatattttttttttagttccattcattaaaaattcatgatgtccttgtttttaatagcggagtagtattcagttgtggaaatcgccacattttctttatccattctgtgttttagggacatctgggttgtttccagtttctggatattacgaataaagctgctatgaacatcatggagcatatgtctttgtggtatggtggagtatcttttgagtatatgcccaggagcagtatagctgggtcttgaggtagaactacttccactgccagattgatttccagagtcattatacaagtttgcaatcccaccaacaataaatgagtgttccaatttctttaaatctttgctagcatgtgatatcacttgagttttagaactcagtcattccaattgctgtaagatagaatcttggtgtcattttgatttgcatttccttgaggactaaaaatgttgaacatttctttaggtgcttcttgtccatccaagatttccttgtttaaaattctgtttaaatctgtattctatttttaaattgggttatttgatttgttacagtataactacttgagttccttatatattttagatattagccctctgtcagatgtagggttagtaaagatctttttccaatctgtaggctttacagaagattttcagcttcaccagtttccatttatcaattgttgatcttggagactgagcaactagtattccgttgaggaagtagtctcctgtccagtttgttaaatgctatttctgactttctcttctatttgatgtagtatatcctgttttccattgagattcttgatccacttggacttgagttttgtgtagggtgataaatatggatctatttgcattcttctacatgcagacattcaggtagacaagcaccatttgttgatactttctcttatccattacatagttttggcttccttttcaaaaatcaggtgtccataggtgtgtgagttaatttctggtctttgatttgattccattaatcaacctgtctgtctctgtactaatactgtgcagtttttttttttatcacatttgctttgtagtacagcttgagatcagggatggtggttattttattgttcaatattgtttagctgtcctgggttttttctttttccatacaaagttgagaattgctatttcaaggactgtaaaaaacattgtgttgaaattgatgggaactgcattgaatctgtagattgcttttggtaagatgatcattttactatgttacaatcctaccaatccatgaaaatggagatttttccaccgtctggtatgttcagtttctttcttcagaaactttaagttctttttctacaggtctttcacttacttggttagagttacacaaagatagtttatattagttgtggccattgtgaaaggtgttgttttcctaatttctttctcagactgtttatcatttgtataagagaactctactgatttctttgtattttgtatctagcccctttgctgaaggtatttatcagctgaagaagttccctggtacttcaatgggcaggggttgggtgtgcttatgtatactatcatatcgtcagtgaataatgatactttggcttctttctttctgatttatattcccttgatctatttttgctgtcttatggctctagctagaacatcaaatactatattgaatagatagtgagtgggcagccttgtcttgtccctgattttagtgggattgctttaaggttttctccatttaatttgatattagctattggcttgctgtatcttgcttttattatgtttcagtatatatcttgtattcatgatctctccaagacttttaacatgaagggctgttatattttgtcacagcctttttcagcatctaatgagatgatcacatgattttttctttcagttattgcatccatgttcataaaagaaattggtctgaaattttctttgttgagtctgtgtgctttaggtatcagtgtgactgtcacctcatagaatgaatttggccatgttccttttgtttccatgttatagaattgtttgaggagaattggtattagctcttctttgaaattctggtaaaattctgtgctaaaaccctataaccctgggatttttttatttttcttgtggaacttttaatgactgtttatatttccttggggcttataggactggttagtttacctgatcttgatttaactttggtaaatggtatctgtctagaaaatcatccatttcatttagattttccaattttgtggagtacaggcttttgaaccttgtgtttttggtttttggtttttctttaatttcctcagtttctgatgttatatctcccttttcatttctgatcttgataatttggatactgtttcttctttgccttacagttggtttggctaagagtttgtctaccttgttggtttttctcaaagaatcagctcttagttatattgattctttgtattctctttgctactaattgattgatttcagccctgagtttgattatttcttgtcttctactcctttttagtgtgtttgcttctttttgttctaaagctttctgctttcaggtttgccattgttagttgagctttctccactttttaaatgaaagcatttagtgctatgaactttcctcttagcattgctctctataagtttggatatgctgttccctcattttcattaaattctagaaagtatttaatttacttctttatttcttccttgacccagtaatcattcattagagagttattcagtttccatgagtttgtaggttttctgttgtttctattgttgttgaagttaggctttaatccatggtgatcttaaaagatgtaagggatgcaatagcgctccatagccaaatacctgtgggaaagcactggtctatcaggagtgtggaaacacccgtgagcacaagtaagaccaccacttatgctcagagggacaagcccagagccctcatgacacgggatccgaggaacggcctgggacaggatccttccagtttccatctgcactgggagctgatcctgtgccacagtgatgcatacccaaataccatcaggaaaaaattgaactcccaggagcaccaatgtacttgtgagcacaggtaagaccacaacttctgctcaaaatcctggcccaagagcgacccagccagagcgatcaggacacaggaaccaaggcacagcctgggacgggatccttctggcttccatctgcatcccagagctgaccctgtgccatagcccttgttacccaaatttttcccagagagaactagtctcccaggagttacacaggcttgcaggagggacaagacacagtcagagacagaaagaccagctaacaccagagataaccagatggcaagaggcaagggcaagaacataagcaacagaaaaccaaggctacttggcataattagaacccagttctcctaccacagtgagccatgaataataccccaacacacaggaaaagcaagactctgtttaaaatcacatctcatgatgatgatagaggactgtaagaaggatataaataactaccttaaagaaatacagaagaacacaggttagcaggtagaaaatcttaaagagaaaacacaaaaatccctttaaaaaatagcaggaaaacacgaccaaacaggggaaggaattgaccaaaaccatccaggatctaaaaatggaaacagaaacaataaacaagaaatcacaaagggagataaccttggagttagaaaacctaggaaagagatcaggggtcatacatacaagcatcaccaacagaatagaagagagaatctcaggtgtagaagacaccatagaaaacattgacacaactgtaaaagaaaatgcaaaaagcaaaaagctcctaacacaaaacatccaggaaacccaggagacaatgaaaagaccaaacctaaggataataggtatagaagagagtgaagattcccaacttaaagggccagtaaacatcttcaataaaattatagaagaaaacttccctaatctaaagaaagagatgcccatgaacatacaagaagcctacagaattccaaatagattggaccagaaaagaaattcctcccatcacataatagtcaaaacaccaaatgcacaaaaccaagaaataatattaaaaccagtaagggaaaaaggtcaagtaacatataaaggcagatgtatcagaattacaccagacttctcaccagagactatgaaagctaaaatattctgggtcaatgtcatacagtccctaagagaacagaaataccaacccaggcgactatgcccagcaaaactctcaattaccataggtggagaaaccaagatatttcatgacaaaaacaaatttacacaatacctttccacaaattcagccctacaaaggataaaagattgaaaactccaacacaagaagggaaattacaccctagaaaaagtaagaaagcaatctttcaacaaacccatataaagatagccacacaaacaaaaacaacattaaaaataacaggaagcaacaagcacttttccttaatatctcttaacattattggactcaacttcccagtataagacatagaataacagactggatatgtaaacaggacccaatattttgctgcatacaggaaagtcacctcagtgtcaaagacagatacttgctcagagttaagggctggaagacaaatttctaagcaaatggccccaagaaacaagttggagtagccattctaatatcaaataaaatcaactttcaaccaaaagttatcaaaaaagataaggaaggatacttcatacttgttgtatcagttagggttttacactgtgaacagacaccatgaccaaggcaagtcttataaagacaacatttaattggggctgccttacaggttcagaggttcagtccattatcatcaaggggggaacatggcagtatccaggcaggcatggcacaggcagagctgagagttcttcgtcttcatccaaaggccactactggaagactgacttccaggcaactaggatgaggatcttatacccacacccacagtgacacacccattccaaccaggtcacgcctattctaacaaggccacaccttcagatggtgccactccctggtccaaggatatacaaaccatcacacttgtcaaaggaaaaatctaccaagatgaactctcaattctgaacatctatgctttaaatgcaagggcactcacattcataaaagaaactttactaaagcacatattgcacctcacacaataatagtgggagacttcaacaccccactctcagcaatgggcagatcatggaaacacaaactaaacagatgcacagtgaaactaacaggagttatgaaccaaatggatttaacagatatctatagaacattttatcttaaaacaaaaggatatgacttctcctcagcacctcatggtaccttctccataattgaccatataatcggtcacaaaacaggcctcaacagatccaagaagattgaaataatcccctgcatcctatcagatcaccatggacgaaggctggtctttagtagctacaaaaccaacagaaagtccacatacatgtggaagctgaacaacattctactcagtgataacttggtcaaggaagtaataaagaaagaaattgaagactttacaatttaatgaaaatgaaggtacaacatacccaaaacttatgggatacaatgaaagcagttataataggaaaactcatagctctgagtgcctccaaaaagaaactggagagagcatacactagtagcttaacatcacgcctgaaagttctagaacaaaaagaagcaaatacatccaagaggagtagaaggcaggaaataatcaaattcagggctaaaatcaaccaagtagaaacaaaaagaactatacaaaaaaatcaacaaaaccagaagctggttctttggggaaatcaatgagatagaggttttgtacattatcatggtagagattctggtggcatacaggcaaacatggtagctgagagttcattatccagttctgcaggcagtaggtagaaagagccaatgggccttccttaggtttttttaaaacatcaaagcctatctccaataatacactttctccaacaaagccaccctcctaagcctttcagataatgccactgcctggtgatcaaatattcaaatctaagagcctatcaggcctttctttttcaaccactacatttagcatagggcttctgattttgatggattattttacttaatatgtctcctgtgctctaagagaaatttaggggattatctttcagccataggtcagaatagacagtttttttctttttggaactccacttgatagctccaaatccttacagaaaaaaaaattgatgccatatctgaaataaacaatcatatttttgttatgtcaaggaatacattttttttaaaagtaaagcttgacttctccagatttagatcctatgagggactgaccttgcctgtcaggaagttgagtccttgccattaaggtatatctggaataggatgctggttcccaggaagctttcaattggttcttacaaaccaaagtaattcttgaattgaggagtgtatgctactgctgattctcagctctattgattttcctggctattccacatttctcactatttttttaaactcaagcctggcatgaagtctaatctttgatgtcaatgtgactgcatctgaaagcaactaaaatccaaggttctggacattctgatgaggtatttccttaatcagacaacttgaattcagaagacctataataaaccttatggtggtagctcatattaaaacatggaagtgggaagctttgcctctttcctgctggccttcactttcactggcaagtttatctatcctgttcctgagccattcagtctccggttttagaacctacttctttgggattccagagcagactgaaaactggcatctctgtaggacctccctgggattccagcactagattgagactgcacagacatctactctcagggactgaacaaatactgcatgtttgacctttccattgcagacatggacatatgtattgttgttatattatattatattatattatattatattatattatattatattatattatattatattacatatttaatatattttatcaactcttttcatgtagagaatcatggcttatattgccagtaaataagggaagaaaatgtttaaaagtatataagtataaaattgggggttgttgttgtttgtgtgtttgtttgttttcgagatagggtttctctgtgtagccctggctgtcctagaactcactctgtagaccaggctggccttgaactcagaaattcacctgcctctgcctccttcaatttctcctatggtaagtgttcatccaaaatgaaaaagctaggaagcctaaagacgtcatggaaggtcttagtaagtcatatgaggtatataaataatgaaacagatggcatgtataatattttctgagatcaaagctgaacttattaatagcaaagttctatttaaatcagtatatttctcttatgatctattctttgtaacatttacaaggatttaaaaattaagaaactgtctaatcaagataatgaaaaactatttcttaacaaaatcaggatttacttgaaatgtttggttctacttaagctttatccaaatgttacactacagttgaaagtaccagattgatgtaactgatgttctcagtgtggagtagacatgcttggaggctttaatagtttgaacaaggacaacctctgtataagcggaacaaggatgttccaacacttggtctccagttggtgatgctgtttgggaaggtttgggaatggcgaccttgtgggagaaaatgtgttactatagactggagagggatttgagattttaaagattccatgccacacttggctttgagttgcagttcaagatgtgcatggtcctcttcctgctgctgccatgccatcctcaccattatggactccaaacttgacggccatacgccaaaataaacatttatttgtttttgtataagttgccacagtcatggtgtggcatgtgtttgaaccagatgttcaaacctctgatctacagaggccatcctcattcaaagtcttacagcctccaaatctgtttattcaacatccaggaggctacatcaatcttttatttttaactttagtgttctatttaggtaaagcttaagtaaaactatatgttgaaagtaaatcccgattttgttaagaaatagtttttaaatggttacagaaatataacataggaattcaacccagagaatagatcgttgctgtaatgaacataaccatattaggttctggaggaatgaagaaattttggaactctggaaaataaaagcagttgaatgatgtaagcaatgcttattgggccatccttataggaaacagaaagacagtaatattggcagcaatgtggactatggaggcccaatgaggtttcagagggaacaagttcagcagcagagctagagacaacacctgtgagatttggcaaagaatttggctgccttttgcacttttcctaaaaattgtctgagagtaaatttaaagtaacacactatgtttttttttatggaaacaatttcaagaaagcataatatttagtctgcaacatggttattattagcaataagtgaaaaagagcaagtggaataaaaggaaatacaaatgtagttttgaagagaacatgatcaccactgaactaagcattacagccaagagctgagcataagtgctattaacaagagcatctctggggctggtgagatggctcagcagttaagagcactggatatccttcaaaggactggggttcaattctcaccaaccatatggaagctcccaaactgtaactctaacaccttcacatggatataaatggaggcaaaacacccatgcaactaaaataagaaatgaataaataaataaataaataaataaataaataaataaataagcccctgctctgccctggaacaaagggaaggctgtcctcagagcaaaatcccacttagccaagcatacaacatgtgaaacaaaaagtgttgaggaatgttctgctcctagaaaacattatgatatggccaggaagtggaatacagtagtttgaatagctgtgtccccaacaggctcaaatgtttggatattctcagttactggttctgtttggggagttctaagatatgacatgggaggcagaatatgaatgtttaaaatctccatgttacttatggttcactcactgttttgtgcttgcagttgttcaagatgtgagctctctgcttcctgctcctgctgccctgcctgtcaccatcatatggacatttaactttcttagttacttttctattgctgtgaaaacacaccatgaccaaggcaactaataagaaagtttattgggagcttacagtttcagagggtgagtccatgaccatcatggtgcagaacacagcagcagcaggcaaacatggcactggagcagtagctgagagtttataaccttattcaccagcatggagcacagagaagggaggctaactatgatagtgtgggcttttaacacttgaaaggctaaccctagtgacacacctccagtgaccatacctcctagtcctcccaaatagttctgcaaactggagatcaaacattcaaatagatgagcctatgtgggccattctcatttgaaccatcacattacccttctggaccataaaacaaaataaactctttttctgtacgttgtctttgtcatggtcttttattacagcaaccaaaagtaactaagtgggaggtctgtaccaatgtggacagaagaactaaatggaagtcactgtattctgatctttgccttccaaggtcaaccaggtcccaggaaatcatgagaaatctctcttaaggtcctgcagctctgtctccttggtcagagaagctgtggaaaccctgatgtttgactctattcaacattcattctccaaaggggatagtcaacatggagaaatggcttcagtgcttctcaagtgatatggtcagcgagatcccaactcatctcaacagataatacaactggtaaacaaacaaacaaaaaaaaaacaacccaatacaaaaagaacaggatccaaaactaactgacccctgagtatcatgtccctaattttgactactgcatgatcttaaagaccctctacactttttgacatttgtcttagttaaggttttattgctataaagagacaccttgaccaagacttatcaaggaaaacatttaattctatcttataaattaaaaaaaaaacatttaatttaaatacagtttcggaggtttagtccattatcaccatggcaggaagcatggcagcctgcaggcaaacatggtgctgaagaaggaactgagaattctacattttgatccaaaaaacagccagaaggaaactcttctatgcaggcagccaggtctcatccatactggatagagcctgagcataggaggagacctcaaagcccacctacacagtgacacacttcctccaacaaggccacaactcctaatagtgccatttcctatgaaccaagcatattcaaatcaacacagcatctatactacaggaaagtactctataatctgtcaaaagagatttgtaagcatcaacccagccacagcaccactgtctacaaaggtaccctgcttacaagatatgctagtggaatggtgacacaaaacttgtaggaattaccaagcaatatcttctttgactgacagtccactaggaaaccccatgaaagaagaggcagaaagagtttaagaaacagaggggggcccgcgccccggccccatctggagactcgggaggctagtgggaccccgcggaacttgtcagtcaaacgccttcctccaccccctgcgaggacctcccccgggccgcggtagcgcgcacgcacgcgcacagagtcccccctcacccgagccaaccaccctctcaagttgtagcagttgcttcccgggcatgctctgtgggcgtccggtgggcgcgggaggctgagcgagggcaacgctccaaggatccaaggatccaagtattggggtgcgggtggctgccccgggcgatgaggggccatcgctgacaggagaacgagagctcggcggcggctcgggcggacagcgccggcggcagccgctgaagacctgtccggactccgcacgcccctcacgctcgcgctcgccccagcggtccacacttcgggctcgcctccgcccgccctcgtcgccgggcgtcagtaacttgtgcggcccgcgcgcccccgccctcccctccgccagccccgggatgcggccgcgcggcgcggggatgcggcagtgaggcgctgtcccgtgagcagctcgcggaacgcgcgcaggggcgtaggcccgccgtgcccgtcctccgccgattgcccgggccagccaccgcgggaggcgccgagcgcccgggtcgccgagatgtcgtcgccgtcgccgcccgcaccagttgcctgcgcctccacctcggcctcggagaaagtggacggcttcacccggaaatcggtgtgcaagccgcagaggcagaagcgctctcagggctcgtcgcagttccggagccagggcatccaggcggacctgcaccccctgccccagctcaaagatgccacttcaaatgaacagcaagagcgctcctgccagaagctacaacagtgctgtgtactgtttgatttcatggactctgtttcagacttgaagatcaaagaaattaaaagagcaacactgaatgaactgattgagtatgtttcaactaatcgtggtgtaattgttgaatcagcgtattctgatatagtaaaaatgatcagtgctaacatcttccggacacttcctccaagtgataatccagattttgacccggaagaggatgagcccacacttgaggcctcttggcctcacatacagtttggtgtatgaattcttcctaagattcttggagagtgggctggtgagatggctcagccggtaagagcactgactgatcttccaaaggtcctgagttcaaatcccagcaaccacatggtggctcaaaaccatccgtaaagagatctgactccctcttctggagtgtctgaagacagctacagtgtacttacattaaataaataaataaatatatctttaaaaaaaaaaaagattcttggagagtgctgatttccagcccagcattgcaaagcgatacattgatcagaagttgtccatcagctcctggagctttttgatagtgaagatccacaggagtgcgacttcctgaagaccgtcctgcattggatttatggcaagttccttggcctgagagcattcatcagaaaacagtttaacaacattttcctcaggtttatatatgaaacggaacatttcaatggtgtggcttagctccttgaaatattgggaagtatcatcaatggctttgcattgccagtgaaagcagagcataagcagtttctaatgaaggtttttattcctacgcatactgcaaaaggattggccttgtttcatgcacagctggcgtactgtgttgtacagttcctggagaaagacacaacgctgacagagctttttgatcagaggactgctgaaatttcagccaaaaacatgcagtcagaaagaggtgatgttttaggagaaattgaagatatcttagatgtcattgaaccaacacaattcaaaaaaattgaagagccgctttttaagcagatatccaagtgcgtctccagctcatttctaggttgcagaaagtgtactgtacttctggaataatgaatatattcttagtttgattgaagagaatattgataaaatcctgccaatcatgtttgccagcttgtataaaatttccaaagaacactggaatcagcctattgtagcactggtgtacaatgtgctgaaaaccctcatggagatgaacggcaagctttttgacaaccttactagttcctacaaagccgaaagacagagagagaagaaagaactggaacgggaagagttatggaaaaaactagaagagctgcagctgaagaagactagagaaacagaacaatgcttaaaacatgcacagtattcacagcagtaccagtgccaaataaagatcagctccccctgctgggcggtagttttgtacacttttttttttttgaatatataaaaacttcagagcagacctcatcagtataatataattaggaggccagtttttcctggcaagcataaaagcgaaagaattatggactaaaacatagccctgtgctgtatcacagccaagtatattgtaaactctgtctaatcatggattgtgtcactgtctctgttgtgtgaggtgatcgtgggagtggcaagcgtgtgttgcgacttgagcccggttgtgctgcacacacagataaagccgtcctctgcacacttcctttatcaagtgttttcaccgtgctgcacaccttgagtacatccgaggaaagagcctcgtaagataagcggaggtgttgcccttccctcacgtctcctagagaggtgtgggcgggggacaagagcccagcctcattaaagacactgccatactctgggttttacaacatctgacatttccaagtttctgaagcacaaagtattaaagttgggggaaagtaaaccaaaattctgatgttaccaaatccccccttcagcagcggcacctcggagcgtgtgcggagcagcacaggccacgggtggtcccgaggctcacctccttcattcctctcctccaaggctggaggcagggccttcccagtcctcaccatgccggtccccaggcctgcctgcctgcagggtggagctctgggtccctcccacagtgtgatgcagactgctagctgtcactgcctggctttatgtaagggaactgcagcaggtgtcctcagagttgactatgtagaagctttgtctgtttttacctggtcaggtatttttcacactttttaccagtagcatcccagccacttgccttgcagttgtatggaaaactgtttgataatgagagatcttcactggaaattgagcagcatttaataaagtctatgtttgtattttaaaaaaagaaagaaagaaagaaacagagggggactactggagagatagcacagcagttaagagcactgactgctcttccaaagatcctgagttcaattcccagcaactacatggtggctcacaaccgtctgtagtggaatccaatgccctcttctggtgtgtctaaagacagctacagagtattcacatacattaaataaataaataaataaataaataaataaataaataaataaataaataaataaatctttcaaaagagagaaagaaacagaggaggtaggggacattgaaaaaacaagaccctgtaaactaacaatgtctgcacacatatgaactcacagaaactgaggcagcatgcacagggcctgcagaagtctgtaccagattaggtcctagagctgaaaagaaagtgaacacatgaccccattcctaacccactactagcaacctccagttgataaccactttaaaatgaaagtttgttttttccccaagggaatctcactggggaaacaaactactctttaagagtaatctgcatgcccaggagtaaatgaccaacagaaaacaaattcaaaggcatctttggaggttccttgtctcataaagttgtattggagcctttccatgtttcttctctaggtcctgttatgcatatattatgacttccagtttagtgtttttatgggattcctgagtatgtgatgtgtgtatatctacttcttgtgcaatgccttttcttggtctcttttttttttttggcttgtttgttttgtcctattcttatccattactcttgttttcgcattaaaagaatacaatacaatacaatacaatacaatacaatacaatacaatacaatacaatacaatacaatacagtacagtacagtacaatacaatgcaatgcaatgcaatgcagtacaatattattaccctttaggcgactgttatctgttaaaagaccaaaagtaatatggatgggaagggagatgcggagaaactgggaggagtagaggaaggagaaattataatcaggatatattatgtaataaagtgtatttttaataaaaggagaaaatgattagtatactgtctagtttttatcgtcaagttgacataggctacagtcaccttggatgtatgaatataaatgagaatttgcctatacagattggcttgtggcatatgtggggcattgcctttattgctggttgacataggaggcccaggcccaccatttgaagtactatgacctggggtttataaaagggtagctcagcaggcctgggagcaaaccagcaagcagcattcctcggtggtgtctgcttcaaactcctaccttaaggtctggccttggcttccctcagtgatagactggaatctgtcagatggagtaaaccctttcatctccaagatgcaacagaaactcaacgagagcctctcgcctctctatctgtctctctgtctctgtctctgtctctgtctctctctctgtccctctctgtctctctctgtctctctgtctgtctgtctctctaaggctgtctgtctgtctgtctgtctgtctctcatcaatccaaggaatcctagacatgacgatcaatttcatataaactattataggaacaaccatttcttcatctgattatttttttttttctgggcaagaaactgctgctatatacaagacaccatgtttggcttaatttcaacactgcagctgaaaggcaatgcctgggccagaagacagggatttaagaaaggatttctgctttcttgattgctttcttccctcaaatgaacatatttgcaatctatatatgagaacatgattaaaaggtagaataggacaggatcatgattgggacaactggagtggccaacccaccccctcctcattgccccacttcagttcctgccatgagtcttacacaaagaccctaggccagcagtttgctggtgccctgcttctcaggacctcttgcttcgttctctaaagctcacatctataaactgacaacaaactcctttttgaactcttcctcctgtgaacaagagctcctgaaaagactgatggagcctggatgtggtggcagacgcctttaaactgagtattcgggaagcaaaggcaagaggatctctgagtttgatgccagctccgtctatagaacccgttccaggaaagccagggttacacagagaattcctgtctcaaaaaaaccaacactcccagccccctccaaaaaagggtgattgcttacagaaaggggttgatatatcagaactccaatactctggagagagtggaatgctacaggactagaggactagaggctaactaacttgtctaccagggccagctctaagacactgccccaggcaaggtgctgggtctgctctcccaaatgctgaagccagcaaggggcagggccattagcataggaaacttatgagcatctgatcagaaagacactgaagatgagaggcatttgttactctcaaccattaatgtggaggtgtctgagagaatacctcatgatgatcaatggccttatagggaaactggagaaatgttcctctttcttgggtcaaaagtgttgactcaaaaccacatctctaaccttaagggaataaaagatagtttttctgaaattattttgggtgaccatggcctaggaacacagactttacctcaaattcatgttcaaatgaagaaaacagtttcatgaagtaatatagctttataaaacaaaaagtcataaatcaaagcaagtttaaaataccgtggagttatagcagaggagtaggtacatagaaattgaggaatcttttttataggcccaagatactattgaataacctgctgagttttgaggttggtagaagcttgcagtctggtaaattaataaatttttatccattagtcacagggtgttagttctgacaccacggcaagactaatacttgcccaaaataaggtatttagcttctggacctaccacattccagtctttccacagtgctgaaattctagtcactcagtttctgtaaatacagctgctttttggaaactctcctttgcagtcctctttgttagccaaccaaatattttttttgagtagggtcacatattatttattaaatatcataagttcccacatagctaagtaactcattgctaggatctgatgtagaggctgagtagagcaagacagcatcttctggaaagaagaataggtaataggtaatgtaaccttttaaattatctgatattaataccaataaagacaggagaagtgtaaactgaggataaagcaggctcagcaaggtaactttattttcttaattacatacaaagtatctatttacaagcctcatcccacagctaaactgctagctctttggaagtgtctatctgtgtctttctacggagctcggagctcatctacctttcccttgagctcctccaaacccaaaagggctcctcagttctctttgttagaatagtgcttgacctgtgtcctgccagctgcttttctgttgctcttttctgagagagagagagagacactatgaaaggtccaattgcatataaaagaagtctctacctcctcccctacacccttggatggggaggctccaagccaagtcagtagttgctaaatcatttcaagtttatagtgagttagctctagagcacccagctgactttgtctggggtcacacatcaagaaacacaagccttctcccaagcaacttgccttaacatggacagggactttccctgcattagcattcttatctatggaggcttttagaggcacgcctaaactgcatctcttcagaacacacctaacagcaactgcataatgctatacctatttaagctttgacattttgctaataattagtgtttctacatacaataatcaaatatcctgtaacaggtaaaggccactaagaaacaaaatcctggatgatgttaaaccatctgctcatgatgcagatctgaatgattttcttatgctctttatctgacatagcacatgaactgggatgactatatctacaatcaaataattaaagacacaatttgacctaatggagtgaagctaacaaatgaaggaaagatgtatttaaaataaccaaaatgtacatatttacctagattgactatatttccctgtgtttatagttatttgtactgtatgagctatcttactcatatttaagtggctggaaatgacacctccaatcactttagtattgtcttccctttttatttgtaaaatacaaacattctttaatgatttttaaaaaggctggataattgcactatagaactttttagataatagttaaaattagaaacatcaatacttaatgtataaatcaacataggtgttgttatttaagattgctatcttttgtataattctaaacctttggttatctacagctagagtaaagagaattcaagttatatttaaaaactagattttaaaattttatccaaactatactgtgtaatgagtgtatataggacagtaaaaaccttggatctcttaaatgttagttttggaataacgtatgggcttagggtaagctagcagtcataactacaaggcatgattaaatgaaaggacattatatcttcacttgtgacttctctaagatcaagattattttatcacttaaagatatgttggtggaacaactaaatatcataaaaaattaaatctaaaaacttaaatctaagaatataaacattgagagaaacatttggttcttggggtactcaattgtcagctaagaggagtaccatccagctacttaaagtccacatgcctgtgttctcagacgatgagagaaagctcactgtcttctaggaaatgggttaaaattatctggatacactccagttcttttaataagaatgaaatcttctgtgtgattttatttttcttttaagtaatgaaatcctgtccaacctgcctccctgccctgcccccaatcccacttccccctccctccctccctttgagaaagactctgtaggtaattttgaattttagtaaccaaagttaaaagtcttttacaatattagtctacattattagtttatttaatagaccaagtcttataaacaactttaaatatttgtccattaaaacaagttttacaaatttaattcacgaggagttttctaagtagtgttgacataaaactacagctgtaaaatggctcagtggttaagagcactggctgctcttccaaaggttctgagttcaattcctagcaaccacatggtggctcacagccatctgtaataggatctgatgccttcttctgtgtgtctgaagacagctacagtgtactcatatacataaaataattaaaaaaaaaccctacagctcttatcttaaaaggaataagtaataatttatttggatccatttgagtggctatgtctccagagaacagatctgtgttattacaaactgttccaatgtagaagtagtttcatgacatttttatagttttacaagacaaagaaagtcatacattaaagcaagtttaaaacacattagtgggttcaaagaggcaggtacaaggagatgggggagcttaatctacaggccaagatgctatctgatatcacgcttacttctggggttggtgggagctaatgatatactaagtcaataattttaaacggtcttatttattatcaaaagatgtcagagtctgaatagggcaacagaaggctcttccggaaggctaaaactatctcagataaatagcctgtaaaactgtaagattccagtctctccacagtattgaaatttcaattggaacatcagtctctctgcaaatccagactttttcaggaatttgtcattcatagccagacacagattttttttcagaaactgtcatttacggtatgtatcattctctaaacagatcttgttgttgttgttaaagcagtgaccctccaaaaaggaaaaggctttgtccaatgagcggaaaaaaaccctaaaacttaatcataggtttttaaaatccatatacgaaaacataaaatgcagataacaattttaataagatcattttaaaatgaaagttcagggggctttttctaaaccacacacacacacacacacacacacacatcataccttgaatatgtaacaattataaacacagataaattatatttgtagtttttgttttcttaaataaatctaaattaattacttgttaaatgtttcaattattatgactagtaccttgaaatactttttattagaaaaagtatttgcttttattagtgtttataaagcattcaaagtaggataaagtttatcatttatgactatcattttcacttttaacctaaaaacaggagaaaaaatttaaaatatatcattgtggggttaattaggctacttaatattaagcttatttaaactctaaagatgtattagtaagcctccaagtaggtttttgaaatgacaattagaaaaatacttaagagttggcacctatattggccttgttaaaatcagggtcttaaaaaactgttaggtagggctgatgagatggctcagtgggtaagagcgcctgactgctcttctgaaggtccagagttcaaatcccagcaaccacatggtggctcacaaccatctgtaacaagatctgactccctctcctggtgtgtctaaagacagctacagtgtacttacacgtataataaataaataaaattttaaaaaactgttagttaaaaaatattcttagaataatttaatgtttgtattcacatacactttcacacacatctgaaacatatacaaaagcacagacataaattgtcttcttgacctttggagtacagttcagtatttcaaggaagtgcaattgttcataggaagaacatatcctgcagcaggagcaaccacctcttaaagttcatatatgtctcaagcaatttgggccttgtggtagaaccagaactaaaataaggatcaaggagatagcatctagaccagaactatgtgagtatgtatatcttgtccctaaaagcagatttaaaattctaactcaaaaactcaagttaattgttccccaaagagatttagagccattagctgtctctattttagctatgtggttgcattaattaaatagactttttgtcatttacctttattttgttcctttaaatttcagttttattatgagccaaaataaatctgggtcaagtttacaactttagtttacatgagcacttacttataagccaatttggtactaagtatattatgaaaaataaataaacactgctttgtttagcaagtataataagacagtttggaggagtaaatgtttctccagttttcccaaatacttgcaagttagtaattattacacataaaactggctagaataccagaatgtggtttatctttaaacatttccttcgttttgaacaccttctgtgatggttattcttggttatcaacctgtctacatctggaattaactgtaactcagaaatgtctagatacaattgagagggagttttgttttgttttgttttgttttgcttaattggatcatttgaagtgagaaggtcaaatcttcgaggtggaaagacccacctttaatttagaccacaccttctgttgacagcctgtataaaggacatagaagaaggaagctctctctctctctctctctctctctctctctctctctctctctctctctctgtatgtatgtcccttcctagcaaatccactccttcattggcattagagcccacttcttcaggattatggtatatactgaggaccagctgagatatccagtctcatggacttgagcaactactgaattcttagaccttcagtatacagacatacacatagagccattgttgggctagatggactatagcctgtcagtccttctaataaatcatgtgtgtgtgtgtgtgtcagagagagtcattctataaattgttactctaggaaatgcagaataatataacaatattccttcttaaatgctccccacacatacacacacttttttttttcttttctcctgaaaaatcgcctggagatgctaggaaggaaacttgtttagaatcagtttcatgtgctacttttgggattgactttctcagcttttaccctgagactgtcttctacatgtttgtacatatataaggatgctccagaaactgggtgagccaataaacttcatcctgtgaatgttaactttagcagctgcgtctccagagactgactgactagaattttagtactgagggaagattggaatgttcctgtcccaaagggtaattagcttatgttgagctagttctagcttccaaaacaaacaccctttgtctacctctgtgtctgaattaatgccctgtgactaagagataaaaacattttagagtttattaattcagcaaaccactagcacctatcaatcccaaagctaaggagtgtcaccaaacagcatctaaggctaatagacaatgtattttaaacatgtcctgattaacctaattctgtgttcctgagctgtgttttcttagttagggtttccattgctgtaaagagacactatgactaaagccactcttataaggacaaacatttgattggggttagcttacagtttcagaggttcagtctattatcatcacagcaggtagcacggcagaatccaggcagacaaggtgctggagaaggagcagagagttctgcatcttgacctgactgcatccaggagagactgtcgcccaggcagctaggaggagggtctcattgtccacccccacagtgacacacttcctccaacaaagccatacctcctaatagtgccactccctaggacaagcatattcaaaccaccacagttgttacgtttcatactgcggtatgattgtggtggcggtgatgggacagttagtgagcctagacaaggtatccctctgaggaatcacaccatccaacaggcctagtataaagaagatttgttaggggcagggggagggctggaaaggggcagaaaaaggaggggagaaagataaaaagagaaggagaggaggaagaggccagccgggaacatgtggggacaagaaagagagagtgaaggagagagagtgtggggtagcagtcttcttataagctgaggcacctggcttgtacccggaagcaggtgatgatgtaagctgttgctaggtcactgttgctaggctcccaggaagagcctattggaattgtctgtaagtcaataacggtcactcatacctgctccagaagaaactatctcttattccctttaagattagagctgtggtttttgcattgacaattagggatcccaatctggggttctgagaatgatctttcttttggaggaatcacacgaatggaagctaggttccagcaaggacccattcttggagtccagacagcctgatgttaccttctccgctgatattggtaagtacttcctgggcctccagacatccgttggtttcgttggctatccattttggagtttctgagctggttaagtaggatcccctttagatctgctctctaagcatggggtttaatggatctagtttgtttatttgctttgaaatgtttgctctataaaaactgttctagaaatttagtttggcttgtttgcttgcttgcttgtttttgaatctccagagacattttagattctggctgtttaagtcatttttcagattttgtttgcttttggaactttaaagacgatttggtttttaaaaagtttgtcttagttttctttgtctttgacattcattgatttattgtttttggcctttgtctcctgactctcctcttcaaatgcatagggatgtgtttggagatgaaactgctgtctggtactccagtggcttatgcatgatagttgctgactaacttgcaagtatttgaacaaatggaaagatctaaagacaacgtaaacatttgctacctccaaactggtatatctcctgtgcttaacaatgccctagggcattggttctcaacctgggggtcacaacacctttgggtcccacatcaggtgttctgcatatccaatatttacattatgaattaaaataaaagcagaattacagctataaagtagcaatgacataattttatggctaggggtctgtcttagtcaagatttctattactgtacaaacatcatgaccaagaagcaagttggggaggaaagggtttattcggcttacacttccatactgctgttcatcaccaaggaagtcaggtctgaaaatcaagcaggttaggaagcaggagctgatgcagaggccatggaggggtgttacttactggcttacttcccctggcttgctcagcctgctctcttatagaatccaagactaccagctcagagatggtaccacccacaaggggcctttcccccttaatcactaattgaaaaaatgccccacagctggatctcatggaggcatttccccaactgaagctcctttctttgtgataactccagcctgtgtcaagttgacacaaaactggctagtacagggtcaccacatgtggaactgtattaaaaggtcacagtattaggaaggttgagatccactgcccaaaggattaaaaattttaaagataaaataagaaacattctttaattaaaatgtgaaactgggtgggctgccttgtctagcctcaataggagaagacacacctagtcctcctgcaatttgatctgccaagggagttgatatccacaggaggcctccccttcactgaggagaaagggagagggtactggggagaagggaggtgaggcagagggactgggagagaagagggagagaaagctatgattgggatgtaaagtaaatattaattaatgaaaaatgtaagtgaactataaaaaaactaataaaattggtaattcattacaataaagaactcttttaaaactccatgtggattaagttatatgctaaaataaaaataatatctaaaaatgtttagtttataccaaaactaaggacagaatctacaatacatcctcactctctacactttctttctttctttttttttttaaagatttatttattacatgtaagtacactgtagctatcttctgacacaccagaagagggcgtcagctctcattacagatggttgggagtcaccatgtggttgctgggatttgaactctggaccttcagaagagcaatcgggtgctcttacccactgagccatctcaccagcccctctttctttctttctttctttctttctttctttctttctttctttctttctttctttctttctttctttctttctttcttccttccttccttccttccttccttccttccttttcctctctctcttatccctttctattctgacccctccatgtaactggtgtggcagatacaaggacattataaagaaactgtctgtcaatatgataattagactgttgaaagaataaaaacttgctaaggataagggagtttcctatgactctcatcttcagggaaggaaagagcagcaaccagagagtaaacttgtctcccagaaagagacttcacacaattctaatatcttgtcaggccacattgcaggatgagacaaaaacctagacaaggaagagtcacagatggaagtgactagaactgcttagctgtggaaatccttagagatgcggatgcttgcagtcaaccattgaactgaacacagggaccccaatggaggagttaggggaagggctgaaggagctgaaggggctttatctgacatcaatgtgaggggaggcccttggtcctgtgatggcttgatgccctagtgtagacgaatgctagggtggtgaggtgggatgggggtggggcaccctcataggagaagggttggggtggggataggggagtttcagcaggaaaaccaggaaaggggataacatttgaaatgtaaacataaaatatccaataaaaaaaaaaaagaaaaaagaaaagtcttttctaagcatgtcatagataaaggtgaaacactccatgggaaattagggacaatttgaaaaccttggagaaatgccctataacattcatagcaaaagtgtcaatatatatatatatatatatatataaatcaataggcaaaaatcgatataaagaaaacccagtagaaggtactatgctaaagataaaataaacaatacatttccacttatcattaccagtaacacagggaataaaactgaaatattaagaataaaatatccgttttctatgtaaaaaaaaatatagaggttgtaaaatttaatttaatccaaaaccctaagataaggttaatgcttgattttttgcatccatattcttaaatattaatttgttcttagtaatatttaccaaaaacaaaagaactttaaaaactgttattttatccttttactaaatgctcatttaaaacctgtttctcaagttagcttttcttatccaaattatacaaaagtcatcagtctaaaagtctaatagcaatattcacaatgttttataacttaagtagtgatgttccttgatttaattagtatctaagctgtcctgtaatacaattagctaagattaaaaagttaaacaatttgtatcttactaataagaaagggggaaggataatgctacactgacttctcccaaagtccttttctaaccatttaaatatgttagttcatatattacaaataattatatatacaggggaaatacaaagtcaatctggttacaaagtttggttttagacatgtttcctttttgaccttcactccattttatcaaactgtgttgttgattacttaatttaggtatagtcatcttagctcacatgttatgtcaggtacagagagtataaaaaataattcaagtgcggatcctgaatgaatggattgatatgatccaggattttgtttcttaatggcctttaccagctattctcccctgaagatgctgtcctgcccactattcagcctcatctacatcaggtcctatgagtgagcttcctagttgtgagggaacttacgatatttaataagtaacatgtggcattgctcctgaccaaaatgtgatgctttgtagacaagggaattgtgaatgacaactcctgagaggaggctgtgtctgagcagaccgatttgatctgcaataccatggagagagtggaatggtgcaggctaattaccttgtcttgggctagttttagcgagccctcctcccagtagccataccttacctacctctgtgtcagaactaacattctgtgactaatagataaaaaccttttgaaatttactaacttagcagactgctagcttctaccaaccccaaagctacaaatgtcatccaactaaatttgccttgattttgcctttctttgttctgtaaaactgtgaaattgcttccacattgggacatagagttgggtaacttcaatctgtgttcctggacaatggtcacttgaaatggcttcagaataaactgtcctcttatttcctttaagatgagagctgtggtgtttttgctttaccattttctcattatctgtgaatttcatttttttaattgaagagataagaactcaggggccactgacttagtggaagttttgtgtgaccatgggtgtctgagaccttaaatcctgaattaaagtccatctgaggaaagcttgcttctatcaaactcaaagtgtatctatccacttttctgaatcagcagcaagcttcagccttttcctacctcaacatgagatcctgggggagattccatttccttgataaccatttcttcaatagtctggtattgaagatacctagaataggatatgtgtttctctgtagaagatctttgcttcttccaggactgccacactgctgcatgctcccagacaaaaagctcactctttccttctttctttccttcccactagcaatggaggagggtcttctttcttgacatcctctccaacatgtgttgttaacttacgttttgatcttagtcattctgattggtgtaaggtagaatcttagggtcattttgatttgcatttctctgatcactaaggactttgaaaatttccttaggtgcttctcagccattcgagattcctcagttgtgaaaactctgtttagttctataccccaatttttgattgggttgtttgtttgtttggtgattaacttcttgaggtatttatatgctttgaatcttagctctttattggatgtagggttagtgaaaaaaaaattcccaatctgtagttggccgaattgtcttaatgactattccctttgccttacagaagttttccagttttatgaggtcccttttatcaattcttgatattagagcttgagctattggacttctgtttaggaaatttacccctgtgtcaataaattcaaggatatgtcccacattcttatctattattttcaatgtatctggttttatgctgtggtcttgataaacttggacttgagctttatgcaaggtgaaaaatattggtctatttttattcttctacatacagacagccagttagaccagcactatttattgaagatgctttcctttttccattgtaatttttggcatctttgtcaaagatcaagtatccataagtgtgtggttttatttctgggtcttcaattctattccattgatcaacatgcctgtctctgtaacaataccatgcagtttttttttgtttttgttttttgttttcactattgctctgtagtaaagcgtgatgtcagggatggtgattgctcaagctgtctcacccaagaggaatagaaggcaggaaatagtcaaactcagggcagaaatcaaccaaagagaaacaaagaaaacaatgcaaagaatcagaaaaccaaaagctggtactttgagagaatcaacaagattgataaatccctagccaaactatctaaacaggcccatactgcacaaggaaatagaagaagttactaaaatcctcccacccaagaggcagtatccaaattaccaaaatcagaaatgaaaagggaagccgggcgtggtggcacacgcctttaatcccagcactcgggaggcagaggcaggtggatctctgagttggaggccagcctggtctacaaagtgagttccaggacagccagggctatacagagaaaccctgtctcaaaaaaccaaaaaaaaaaaaaaaaaaaaaaaagaaatgaaaagggagacataacaacagaaatggaggcaattcaaaaaaaaaaaaaacttcagatcctattataaaagcctatactcaacaaaactagaaaatctagatgaaatggatggtgttctagacagatgacacatacaaaagttaaatcaagggcaggtaaactatctaaacaggcccatactgcataaggaaatacaaatcattaaaatcctcgcaccccaaaaaagcccagggtcagatggattcagcacaaaattctattagaccttcaatgaagacctgataccaattttctcaaactattccataaatcagaaagagaaggaacactacctaactcattttatgaagccacaattactctgacatgtaaaccacacaaggacctaaccaaaaaagagaactttataacaatcttgcttatgattatcaatgcaaaaatactcaataaactcaataaaattcttgcaaccgaatccaagaacatatcaaaaccatcattcaacatgatcaagtaggcttcatcccagggatgcaaggttgtttcaatacacgaaaatccatcaatgtgatccactatgtaaacaaactcaaagaaaaaaatcacattatcatctccttacatgcagaaaaagcatttgacaaaatacaataccccttcatgttaaaagtatgggagatatcaggaattcaaggcccatacctaaacagagtaaaagcaatttactgtaaaccaacagccaatatcaaattaaatagagacatacttgaagcaaacccactgaaattggggataagatatagatgtccactctccccatacctattcaatatagtacttgaagtgttagctagaataataacacaacaaaaagagatcaagagaatacaaattgacaaagaagaaataaggttatcactaatggcatatgatatgatagtatacataagcgaccccaaaatttatatcagagaactcccccagctgataactcacttcagcaaagtggctgtgtataaaattaactcaagtaaatcagtagccttcctttatacaaatgataaacagactgagaaagaaattaggggaacaactcccttcacaatagctacaaataatataaattatcttgcagaaactctaaccaaacaaatgaaagacctgtatgacagtaacttcaagtctctcaagaaagaaattgaaggttctataccctagtatagaggggaataccagagccaggaatgggagtgggtgggttggggagcagggcgcgggggaaagggataggggattttcacagggggaactaggaaaggagataacatttaaaatgtaaataaagaaaatatctaataaaaaaagaataaatacaagaaaggagaaagaaattgaagaatatctcagaaaattgaaagatctctgatgttcatggattggcagaatttacatagtaaaaatggccatcccaccaaaggcaatctatagattcaatgtaatccccatcaaaatcctaacacatttcttcaaatatatggaaagagcagttctcaaaatcatttggaaaggtgaaaaatccagaatggcaaaaacaattcttaacaataaagcattcaaatgtaaccattaggatttacttttgagaatggacacatgccattgatatttgtcacttagtataaattttctgatagttccatacattttcttgccaattttctcatttcagttttctttgtagataaatacaattccacttggaagtgcattactttttcattagccatgtttcatttgatagatcccaattctggctggtcattgcacctcctttccttcagtctcttctctatttttgtctcttctgttcttttacagaaactattttgggtcagaatctttgactgttggatggcaatcccgtctgtccacttgatgctgtttttctactggagatggactctttgagtttcctctacccactgtacagtatttcatctaaggtctctccctttgatttttgagattctctcacctccaaggtcttcagaacaccctagaggctcctttctggctacaggagatggcctcttaagaaatcatatccccaaagaagtgagtcacagctaaagtcacctccactgattcttgggggcttccttatacttccttatagtctctgtctcatcctgaacatgccccacacctcctcaccatagtcaggtgcagatttccattcattttcatggacatctggccatctcttctgtctttccgaacacctgattatgaattgccctccccaacccctctccatcccagctcccttcctccatcttcctcatatgactattttatccctccttctaagtgagattcaaacttcttcccttggtccttccttcttgtttagtttctctgggtctatggaatgtaacattttacttgtattttttggctaatatccacttttaagtgagtatatgtcatccatgttgtttttggactaagttagctcactcaggacgatattctcaagttatatccatttacctgcaaaattcgtgatgtcttggttattagtagctgaatagtattccattgtgtaaatgtaccacattctccttatctactcttcagtgagagacatcttttcagtttctgcctattatgaataaagcttctatgatcatagtgtagcaagtgttttgtgggatattggagcatcatttgggtatatgcccattagtggtatagctgggtctttaggtagaacttcttccgtttttctgcaaacacacacacacacacacacacacacacacaattgattttccaagtggttgaataaattttcacttgcaccaacaatgaaagagttgttccccttgctccacatcctcagcagcatattctaactttttttatcttagccattctgatgggtataagatggaggatgaaaaggacttgcttttgacaaaaatgtcaaacccagacaatggaaaaagaaagtatcttcaaaaaatggtgctgacttaattgaatgtcagcatttggaagaatgtaaatagatacatatctgccaccatgcacaaaattcaaatccaagggaatcaaagaccttaatataaagctgaatacactaagtctaagggaaaagaatgtggggaatagtcttaaactcatgggtataggagacaactttctgaacagaacaccaatggctcaaggctgtaagacaaactattaataagtgggaacctttcaagctgaaaggcttctgtaaggcaaatatattgtaaataagacaaaacaacagataacagaatgggaaagaccttcaccaaccctacatatgacagtgggttactatccaaaatatataaagtactcaagaagtcggccaccaacaaaccaaataacccaatttttaaaatgtgatacagagctaaacagaattctcaacagaggtacaacagtgcacccatgaggaagacccagctctgctgtgctcatgccattgggattacctcacttgcaagccccatatgcagggacagctctactgtgctgtgagatgcagggcctgctgtctcagctgctagaaaggtgaggatcacaatcagctctgctgctctcatgactcccttgaagccaactcatttgcccccagctagtatcaagggacagtctcctgccaccttctgatccaccttccctttatctgctcagttatcagctctcctgtattttacaaatttaggtggggagctggtttacaagaaatcacctgagtgcagactcattccttgttcacaaccactcacaggagaatggaattaacatcaaatataattagctctggggctattcataacatttcctcctttctgtccaattaaaagactattttatctcagatataattgaacataactattattattttgtaatttataaagtactagagacctaacacccagtccaccatctttgttaattaaacagaacctctgtcatggatctttacttaaaagacttataattctacatctggatatatcttggctttatattgaatgccatcttaaaaccatcctctcagaactgttcctctcaaagtaaaaaacctgggttggctagtagactgcagtttttcaaccccatcagaaatccaagaatgactgatattaactgaaaatataaagaaagcctaacacagcttccaaaacttagtcaatttacagagatcacggatcacttggacagtcccttacttcaacatgttggagcattggtattcagcttattgcccagagtcatctgacagacttagagaaacagaaatatttttttaatatttttattagatattttccccatttacatttccaatgctatctcaaaagccccctataccctccccctgagaaacagaaatattaaggagtagcttactaaggggacccacttagccaactcaggtagcttactagaaagctcacttgaggaaccgatcctgattaaggggccggaggcgggtcctgggcactagcggttccgaccccgccctccgtgccgcacccgagtggcccccagccgagcgggcccccacttctcggcccgacccagacccttctgcgcctcccttggccattgtccggctccaggaggccggccccgcggccccccggcggcctccggtgctcgggcccgcgtcagcctcctggctccatacgcgagctcggggatctgtggcctccgtagtccccctccccagcccgccctgttgtggagcccggcggggcggcggctgcaagggggggaggggcgggggaaaggggttgctgcgctcaggagaggccctggctccgccccgggcctgcccaaggggagagcggagcggtcagcagccgggtcgggtcggggccccgcccgagaggagagtggagcggcagcggtggcagaaatgatggaagaactgcatagcctggacccacgaaggcaggaattactagaggccaggttcactggagttggtgtaagtaagggaccactcaacagtgtgtcttctaaccagagtttgtgcagcgtggggtccttgagtgataaagaagtagagactcctgagaaaaagcagaatgaccagcgaaatcggaaaaggaaagctgagccatatgacactagccaagggaaaggcacttctagggggacataaacttagtgattcctttgagtttgctgggggaagctggccaggaaccagccctggcagaagtgttccaccagatgcatgatcctcatatcaacattccttatccaatcccttactgcttcaagtagaaccgcctctgtatggtttagatggcagtgcagcaaaggaggcctcagaagagcagtctgctctgcccaccctcatgtcagtgatgttagcaaaactgcgacttgacacagagcagttggcaccacagggagctggcctctgcttcactttcatctctgctcaacaaaacagtccttcttctatgggttccagtgtttgaaagtgacctgtgattgtggaagctgcaatgatgatactttctttttgttgttttgttgttcttttttttatttgtttgtttctttggtttttttttttttgttgttgttgttgttgtttttttgagtcagggtttctctgtatagccctggctgtcctggaactcactttgtagaccaggctggcctcggactcagaaattcccctgcctctgcctcccaagtgctgggattgaagtcatgggccaccattcccagcggtgataatgtcttttctccatcacatgtttattagtgcgtgaagtgttcagaggattggcacaccatcacagagcttagattactattgcatccatacacctttgacatctctggcctatggagaccctttgagaatggatcttgcctatatgcgtctatgtttccctgccttcagaggtatgattcttgggatttttgtgaatcacccagcaccttccatctggaaagccagtaggcaccctctcatctgcattctgcccatttctctcatcttctctttccttggcttcatgatattcacaggccattcaaactcagtcatttttatcgtgaggcaaaccatgttcataggttcatagactgggattttttttttttccctaaacttttggccaagtagatcttggttctggatttcacagtggttttgttttttgtttgtttgtttgtttgttttgagacagggtttctctttatagccctggctgtcctggaccttactttgtagaccaggctggcctcaaactcagaaatctgcctgcctctgcctcctgagtgctgggattaaaaggcgtgcgccaacatgcctggctcagagtgttcttttactgaaatttattcacagcatgaacatcatcattaatagttcatgtgtaggcattagtacttgtatctcacaaattatagtctcaaatttctggtcttttctgcatttttctgtgaaacattttgctggcttctggtaaagtatatcctctataggtcattataaatgaaagacatcaaaaagctaaaattccaaagggaagaaattttgtgctcaaaactgagtttattagtcagaatgaaagactatgattgatgtttactggttaagtgatacaagcatggtggtctctgcaaacactaggtctggtagaataacaatccatgagaccaaaagaaatctagttcaataccactctataaatatttctacactggttgtgggtgttttgtgtgttattgccaatgaaattctagcagcactcagggaaaatctttcccagtgaatatgtgaacagttctgaagtaaaaggtctcctgacagtcagaagccatgatataccacaatgtcccatggaacaattaaccacacacaagaaatttattgggaaaacactacagggaggctgcctctgttcaggtgagaagcccaagagaaatgagtgggaggcaggcttttcatagtttaattttttggggtgggtgtggcggaaggattttcagaattggaaatagctctggttggagattgcctggattttatgttctgaatttgagtaaactaaggagtttctgagttattaaaactgggaagtaaactataagttttcccggtagactcagttgccaatgctgagtgaaacttcaagattctgatctcagggttgtttattttaggaacaagtaagcacagtataattttggaaagaaattttttggtaatagttgtctcaattgtatgtatacaatgcaaataaatgtgtggctacctcaaaggttttttgcaaagtacatgtgagtctttctttaaagttggattctaaaactaaagagcctagaggaggatcaagcatacagtgtagaggacaccaagctgtaaagtacatgtcctatatcccccaaggatggtttgtactgatggagaaacaatgatctaggatgattgtctgggacaacttaatagtctgggactttcaggtttggtttggcactacatctaccacaggtcaccaagctgcttactacatccattcctttacttctggttaaaaaaaaaaaaagtgtacttctcttgcactgaagagaaagcgctgtggttttacatccctggttaacttagtgcttattcttgaccataatttccttttgccctctacagaaaaatatattttatggttgtttctggttcataggatgttaatgttgtgttagtgtaaatggaaagacagtcaaaagatgttttctagaatataaaatatgttgttgagatatacaaagtgtgattacattgcttgactctatagacatgaaacttgcaaatgctgctagcataatcccagcaatcagaacactgtggcaggtgtattcctcttgatttgaggtcagactactctacatcaaagtgacattccaacctgtgggccccaattgcctcttctgtcctgcttggattctccaagtgtattgaggtggatttcctaaccttttcagtgggtgtgtctgtattttcaaatttttattggcagagaactgagtgctagcaggatcttgatattgtcatttctatggcccatcaccagctttacatttgtaaatactcctcccacccctgctgagatacttgaatggcaagcagctctctaagccttgaggcaatccagagaagttctggtgatgtttcacacatgattgcttgtaagaaaaaacctgacatccaattcctgggacaagaattggagggccgaatttctggatattaaaagagatgtagagaggagaatgcagatggagatttagtgggagacagagaagataacagatagatgagaacggagcgggagagaggttaagaggtatctatgtatgaggtcataggcttgaattgtcttaaatctaaatgatagctgggagactgctccaatgaaagttttatgctttatagtatatagaaaccttttcattacttataacactggtgtgtccacaaacactcccagtacactcatgaccaagcacccttgtgtatatagatatataacattttaccagagtgcttttggtatttaagtcaaattagacattgattggttattcccagtaaattcatgacatcattgccctaagcatattttgctgaaaggaaaaattatagatcaacgtctttttggttggttctgtgtatatatttcactttgtgtacctttcaaagcaccttccataaagaggacaatggaacataagagtcaatgttcttgcaggcaccagtttgcccttttcatatacagtgttttgtgtcagccctgtctttagcaatgaagacttattgtcagtttgttaaaagcaaccccttttgttgtcagtggccagcagtctttggatatttttatgaaaccactttggctagcaactttcttgatgtaacacagtggaaaagacaagatcaactggaactccatctctttcagaattcagagatttcatttgaaacaccttcatacacttataagctggtacttaaaaaaaatttattttttgttttgttttgtgaacatcttactaagactacatccagcaggactccatggagtcttgctccatggtgctttcctatgcattggcagaactgtacgtgtgacaatgtattatataaaacatcttaccttgtaatagatggggaattttcctggaccttacaaccagaattaaggcaacttgacgaaatttaagatttaaagctgtgatcctactgtttactcaacttgagggtttagcacacttttcaaagaacaacgtaaaaactaacattattctccttggacttctcttgatatcaacttttaaaacctaacttgatgcatagatacaatggtaatttatgtactttttcaagtcctgctcagaaagtgcatgagtgtcacttgatgaaagcatgaaatgcagaggcttaaagcatagttcaaaaatgcatatacagttataggtattggttgataaaagtcatgtttataaatgtttgttgtcttgtccacttgaccacttggagccagttacctaatcctttataaaagattactgttcactatcccattctttccccaagtgatggttcccttgatgttctagaagcactccaaagctctctctcaaggccagtcagagagatacaaatagacaacagattacacagacaccaacatggagacaaaaggcagacagaaagggagagctatacaagcagccttcaggaagttacagatttaaactaactgaacagatacacagaggatggaagcacagggaacatgaagtagagaattcaactttgtactcacactcagctaaatgcctctgaggaaaaggctttcatttctttccttaactcaacacagatgcattattaaccaccagtatgtttaatctactcacatatgaggaatcaattagcttgtgacttttttttgcataagtacaatatgggaaaaactaaaaatcaccccaatgcgaaactagtagccctgtcatctgaaaggtgtccatgggcacagaaccctgttctttaaagtcagacccccaggtttgggcttgtgcttctgagctctcgcctccatgctgagctagaatccattttaacctctcataatcatcacaacaggttttgaacctaagaggtcacatgagaatcctggaactcattataatcatgaaaagagttgacttcctagcaacagtctaatgagacttgggtaaatctcgagtctcctttcccccacttatgctgacatgcatgggtgtacatagagtgttacagggaacaatcaggaaaccatttatcaacaaacagtgcattatgtattgtaattttgttctagttttctttctctctttctgtctgtctttctttctgtctttctttctttctctctctctttctttctttctttctctctttctgtctgtctttctttctgtctttctttctttctttttttctttctttctttctttctttctttctttctttctttctgtctctctctctctctttctttctttctttctttctttctttctttctctctctctctctctctctctctctctttctttctttctttctttctttctttctttctttctttctttctttctttcttcctttccttacttttttttttgtgacaaagatcaggacagttttccaaaggagtttctctttattgcctcatccttcaagcagtaaataatattgtcccttgacctaacatcattttaattcaccattttctttgattgaggcatccacctcctctactttttctttaagtctgataatctgtctcccacaggttctctatgtatcatttttattcgcctcactgcattttctcttcaggattttttttgtggcatttctatgcacctattgaacataattttaatattttatattgtccttatttccttcaggcatctggtgttattttcttgaccaagattcattttgttcctgtctgagtggattcacaggtttacaaactttaatgtccttgatcatgactgtgggttttccatcctttgtcttggatatcacataaattgtgctccttataagatacctctatggtttgtggtttgagccaaggacattttatctacgtttttgtttgttttgggtatctgttctgagcatcagaattcaaagggactgcttaattttgtgcatttatagtccagagggctacacgcacaatatgagaagttagacaggatccattgtatctgaagggttcagaacccaggtgcagtgtcctactacatccagctctggtctagtctggcagcaactttgtgaagaagctttgcagagtaggtcctgggaagttgtgtggaaggcagcctgcaacagagttggaggagtggttcctgatggggagtgtgggattcctgcacgattagatgagtttaagaaaaagacaaattaaaagcaaagaaacgaataagcaagcaagcaagcaagcaagcaagcaaaaattcaaaacaccaaacattgctgtgaagaagtgggaagctaattaattaaaaggcccataagtaggtgggcttagaagaattccaggaagctgttgaattttgggcgggtccagaaggcggcgctaggcagaaagaagggaagttccgcggtttcatctttcttcttgcatctcggctgcctcgtgatcaggaagtcatggagggagactagtgcctagtatttgcggtgcctgaaaactttcttaagaagcagttgttttgctggcctcctaggacatccaggagctggtcctgtcatcttccaggttagaggagctgttggactaggaacccggcaggagctgggcagcggtgtggagcaggggtgccttttctgccgccattctcacaattcagtatttgcggaacctgaaaacttccttaagctgccgttgctcctcctaggacattcagcagctgatcctgtcaccttctaggtcagaggagctgttggactgggaaatgggcaggagctgggcaggtgtgtggagcaggggtacattttctgccgccattctcacaattctgttgtggatatcttaccattatcaggaagtttgagatcctgtgaattgggttcatggtgatgctttaatcaattttatggttgccagaatatttttctaaaatatcctcggagaaccttggctgcatctggagtttgtataccgggaggtttgcctttgcaaaagccttcataaagctcctttaattcaaattcgttcattctttcttaactcccctgttcctccatttgccatttcatttccctttctccagggaactgagtaggcattctgagagagctttgtaagcatttgtcatatagggaccagtgcagatttgattgaattcgaaaatattcgttataaagtatctttgaaagacccaaaacgtgaggactctcccacgttctgactcaggagaggcgacattccagatcacttgcaagaaagggtcttgatgcaaattgtaagaggacttttatttcaagagagctctcaggtccacattcatacaccatgcagggctagaggactgtggtgtgcagagtagctgggtaagggggtatttaaaggaagaaaccataagtcaaggggatggggagggcgttgttggaaaataccaaaagtacaagttaagtggaaagtcaagacagatgtctatgagtctcagtaacaatagcaagcacatttgcacagtgagttcctggagtggtcagggtgggtcaaggtgactttctttgccagaatatttttctaaaatatcctcggagatccttggctgcatctggagtttttataccgggaggtttgcctttgcaaaagcctttataaagcttctgtaattcaatttttgttttatggttagcataccttgggggcattgagtcacaaagatcttattcttacacctggccctaaaggcctactttttgtttttatgtttcactttttaattgtcatgtcgctgtacatattaatattaacctagcaaagttatagtctctgttagtttaacactgaggtatatgcagtcaaaatacagcattgagaaatgtgtcttcataggcttagttattaatgtcacaccttaggtttgaataaaacatgaagacaggattgcagcaaggtacagctgaggagaagatatatagtaggttctgtcaaccctgagtgtcaccagagaaaaactaattgtaccatgtggggaagttttataaaataatacatcgtgaccaggagatggatttggtcacatgctacaggcagtttaataggccactgtagtttcctatgaggctttattattttcctaagacatgcaacttgcagcaacgcacaaagatacctggttcttgtgatggtggtgcagttaatttttggcatttcagtctgagggaagaaagcattcagagatatctgtctggttccaaactgcacctggccatcagatggggggaggggaattgaggatgagatggaggacagaggggcaggccaagagataaacaggagccaagaaaacacctacccaactatgactattgatatgttaacagacatcccagttagccattcctcctgaatttctatgaatccttccaaggttctgcccagcatgctgtgagagaatgatttaaggcaaagatattttaataagtggaaaatttactatggattaagacaaaattagacagcacctttggaatgattatggttgctcacttacataagaaaaatgactccttgcttcatgaaaagcccatgcacattcatggtttgttgagttctgcactgtggacttcttgcaggtgtgggaatgcttagaccctgcactcagtgctttttttcacagaccttttgttggtgaagttcaactgtctggattgtgtggatcagaataattttcttccagtctttcctgctcctcttccttgttgcttggaaaaggactctgtatgtgtgttaactgtgtgactgacttgcacatctctagggtaaactgaaatactcagagaaaaagaaacattttcataatttcttctctttccctcatgtttatccttttatcatgtattgacatctctcatttgtgttccatgaaaagttcccggttaattctgaataatattttcccattttcaggtattcatatgctcagctaaatgtacataactgtaaatcaacactaagagcactggatagttaaggtcaaggagattctcacaaaggatccaggtatgttagaggtattgaacaaggggtggagtggggctcacctgttaggagaaagaggacatgaatttgatttttccagattctatttccttaatgattctggaaaagaataatattagatgtgatgatttggatttcccatggtaggcagtgctgtcagtcgtcacttgatgttaatagtaaattaattttgattatgggaaattgctgttgcccattgtaatcaaagtttcttttactcagattgaaagcatcatcaggctatggttgtgacaagggcaatttatacataaagcaaatgtcagcagtagattccctcctagggcctgtgaccttccttaagaattttcaggctgattttcactgtaacctatgtattttttttcgtgtggagcttgaaccagaaaaccttctgttacccacagatagtcttgccactgtcataaaaatttacatgtcttgtctggcagattcagattgtagcaagcaggttgcaaacctgagtatgatatggataactctgcttcctgccccaattttcctagcagtttttgtcactatgcaagttcccaccatggtatgtaagatgtctgctgagagtgaatcgtctgatatgaggtttttttctccagaagctctacttgctttctgaatcacctattctgtccagtctaaatgtttttttgtccttgacctgtgttcttattgatgctctgtgttgcattagtcctgattagagtggaataattattgttgatctactctgtactgtttgctttagttttgggtctgtttgccttatttctgatgtatgtttcttctcttatattcttgagagcttttatactgagcagtgtctactttttttttttttctttttggtttttcgagacagggtttctctttatagttctggctgtcctggagctcactttgtagaccaggctggcctcgaactcagaaatccgcctgcctctgcctcccgagtgctgggattataggcgtacgccaccacgcctggcagtgtctactttttaccccagggctctataagtaagtttcattctcctactgtcactgtaatttgggaggatttctgcctacatctattaacctaggcctagtcatgtaagcttctactctccatacagtattatctaggccctggtgtgttttcagcctctgaaatttgctgctgaataagcccccaccctttcttactccttctcaatgcttacctgggtgattcaatttagtttttccagctctaactcctctcccagcggagttcttctctcagacactgaattgttccactagaccttaaattaactgtagaaatcttttgtgatcctctggctccttctcattctcctgctcattctgtctttgcccaggcctagcatgttctctcttcaatctgactctgtaaaactctcccagtaaaactgtgtccttctccctctctgtggatctactctctcaactgtactgtactgcagcccatgcactctactgtattcctttattattctcttctttttgtaatgtctttctctgtctcaagtagcttctctttcctctctcattacagcaaagttgggcagatcctattctgtcagatctttctctgatattccatattttctgtcattcaattagacattgctttcgaacatggatgtgttcttctacatataaactgtagttttgatattttggattaaagtcaatactaaggccttgcctgtactaaaaccagagcgattgatgttgtgtgtcttgggctgaaccacaccctaagtcacaacaggttcaagtatccctacccagtgtgatgtcagtttacttctgtacaatttcttctttctgaaatgaaaaccaagatccacatatactactcttcagtatgttgatatctgtttcattttttctgacttctacttgggactttattataatgttctttgaagatcggtcgatgacattctgttccttgtgagattatattccttaggatttttaatctggaagattttgctggtagtgtaggtggcaaagtatgtttactttgttctcaattccttgtgtgggatagagctttactgtgttgtatatgagaaatacttactagttcttgtgtttattcattcttagcaagaaatttcttatttcctatttcatgaaaaatgtatgcgttattttgtgcatactttcatcaattcatttttaaagtagtttttttgtttgtttagttggtttctttttgtggttgttgtttggttttacgagacagggtttctttgtgcagtcctggctatcctggaactcacttcatagaccaggctggcctcaaactcagaaatccacttgactctgcctcccaagtgctgggattaaaggcatgctccatcactgcccagctctaagcaggtttctgactaaaaaacatgtcctaatgaattactacattcaaatttattttatatactgtcaatactgttagccagttactttggattgccagttattttctctgaggacttgaaaaatattattccattcactcctgcttttaacctatttataactatttattactaatgtatgctactgtagtgtcaccacactgatggtaagggacaggacaagacaataggaaaagagatctacattgttatagcacttagatgtgacaaaagccagatatatctaggagtagagcaagccaatctgtaatagcgttccctagggaatgctaagctagtatgctatgttcttcttctacttaagaatcccagtgtctgaacacactacccattactattatagtttgtccactttcaaaatattgggatgaaacaagtgatagtaaaaattgaccgcaaggctgataaggacagaattaagtctctttagagtcagatatgtacttgaagaaatgccagtgtcaagttttaaagtcaaagtcctactgttcttattgacttcttggtgaatgtaataccatgggttattcttcccatgttagaatgagctcttgttcagtctccataagatgaaagatgtacttttcctgttatacacacagacaaaaataattccatgatatacattcattccatgtatttactgttattgaaactaaagcctaacatatatcagtcatgcaggaatttaggatctgtttctgaaatgttgacaacaatactcaccctttatgtcacaggcaagattcataaagtgacatgctttgtaaaaatgtcctgattattccctgaatattcatgcattcctatgcccagtttttctagcccatttgatgttgtcttgaaatgcctgggtcatagagatttacatattataaatttatgacagcattatatttttccctatatctacatttccgttctacagaaagtcctcttaccactcaatttcccatcacatgagttagggattatcctcatttctttcatgcatgttacagctgttagaatatttacagagaaacattctggtagagtatttgtactatccattttctttgctattggaggtatttcaaagctcctaaagttttctttaatttgtgctatttaaatctcctggtgctagcattttcaggtgaatggcctttgtaggaaattagtgtggaggctttgcacatccttgtctctctctgcttagtagaatagaaggatgacagatgtcttcagtttttgtagtgataggtttaggatgatggctactatgtttattagactcagtcatgttctttctttctttcttttttttttttttttaaagatttgtttttttttatgtaagtacactgtctctgtcttcaaacacaccagaagaggacatcagatcccattaagaatggtttgctgggaattgaactcaggacctgagtgatgttctttctcttccacattcttcagagctttcatagtgatccactgtgatattttgccctaggcctttcatagatatactgacatggttgagagccttctctcactgattgtatgtactttgtgccttgagttatttggtttgtgctttttgaaacagtcttgcatctatggcatgaaatcaagttgagttcattttctatatccattagagagaatttctttattattttattcatgcatatttttatggtcatttgcttttgcatcccggtacagacagctttgtgtgatgactgcaccacattccctactttctgtattctgcaatgttctctgtgcaagatgattgagggattttctaaagaaatttgtgaattaggtgctacatctatttagtctcagatagtgttaaaagacaccctgcaggccttgatttccatacttgcttattgctgggcctagtgttaagacatagaaagctttcttgttcacttgttcctaggatatcatttttttccctgttagttctcattaattgtgtatgactttctatggtactccatcatctgctatttcccagtttcaatataaactaatgaggcaggggcatcaaaagagaccacctgtatacccgttaaaagctaagagaaatatttgacatgagagaactataaggtcaatgtaatacaaaaatgtgctgaatatttgcttataccaactttgtgtagtaatagtatcttgatgtttagaatgagttcttatgtttttattcatgcataaatatgtttgtgtgtatgtatgtatgtatgtatatatgtatatatgtgtatatatatatgcattagtatttatttcaggagaccctgtcatacattcttactttcttttttttttttttttttcttttcttggctttttgagatagacattcttactttcatttggaactacaacatcgttaccaggtagaatctttgtctgtattccaagacaacagggcacatatagtacatagatacactgtatctgcctgtgagaatgaaatggaatctcatcatagggttaggtgtggtattctagtatgatatctaatgaaatactattcaactatgggcatcattcatggtgggcactagccatttgtctttgactctagacccaggaagataagttctcaataacaaccctgataatagtgttttacagcctggatgcatatactctgtgtttatgtcaggtgtccattgaagtcagaaagagtcctaggattatattcatattccttactacactaaatatgtcactccatgctctcatgtctgtagaaatgttggcaagattccttgtatcatgttgcttttaatgtcatttcatgtggtttatcattgtccattacattgttgtagtaatttcatttttttatttgcaaaccctgttgtgaaacttcaagaagagttccaatatttgaaaatggaaaaaaaaagaaaaaaaagaaaaaaaaaagaatgagttcttctctggtaaaattccaggtcagtgtgctgttcacatttctttgaaaattcctttttcactcaaatcattccatatttctgttattgatatgtggtcatggtatgtaaaggatttattttctatgatattcattttcttctgggatgtggagaatttaatggttgggtcttatcacatatataataccattatattccctgaatctttaactgtgaggacatataatttccatggactgaagacctgcaagtctcaaagataatctattgtaaataatgctcaaattttatcaattgctaatttctactttggatggagttgtgtccttttatattagtatggaaggaagttctcatgtgtcacttaatttgcattggggtccctgtgctcagtcttattgttatctgcaagcaccacaaatgcatttgtattggtcagactctggcatagcctcaggggatagctataccaggctcctgtcagcaagtgcttcttggcatctgcaatagtgtctggggttggtgtctgaagatgggatggatccctaggtggggcagtctctggatggccatttcttcagtttctgatccattctttgtccctgcatttcctttagaaaggaaccattctgggttaaaaatcttgagatgggtgggtggcccctttcttcaactgtggtccttgcctatgcactgtatatggtctctacaggttcagtccccaatttgttgggtatttcagctaatgtcatcacagttgggtcctggggaactcttgctttcttggcatctgggactttctagtggatacagccagtttctggctacaccccgcagtgctacacacctccattcaattttctgactctcaatacttctcccctgtctcctcccactcctaattcgcctctccccacccatctaccccccccatcctctctccctctcaggttcctctctccctttacttcccttcataatttttctcctaagtaagactgaagcttccacagtccttcttgttaggcttcatgtggtctgtgagttgtatcttgggtattccaagctttggggctaatatccacttatcagtgactgtatacaatgtgtatccttcttaggatgatattttttagttccatccacttgcctgcaaattttatgaagtcattgtttttaatagctgtgtgttacccctttgtgtaaatgtaccacattatctttatcaattccattgttaaaggacatctgggttgtttccagctcctggctattataaataagtcttgaatgaacataatagagcatgcgtacttgttatatgttggagcatcttttggatatatgctcatgaatggtatagctgggtcctcaagtagactatttccagttttctgaggaactactagactgttttccagagtggtcataccagcttgcaatcaatcccaccagcaatgggttatcttcccctttctccacatcctaaccagcatctgctgttacaggagttttgatctatttgcatttccttatgactaagaatgtcatttctttaggtgcttctcagccattcaagattcctcagttgagaaaactttgtttatctatataccctattctttctttacatttttaaatatattttttattagatattttcttcacttacatttcaaatgctatcccctttcctagtttcttctccgaaaatcctgtattcccttccccctccgcctgctccccaagccacccactccctcttcctggacctggcattcctctatcctgggacatagaccctttgcaagaccaagggcctctcctcccattgatggccgactaggccatcactgtaacatatacaggtagagacacgagtacaaccttgttttctttgactggtggtttagtcccagggagctctggggttactggttagttcatattgttgttcctcctatagggctgcagaccccttcagctccttgggtgctttctctagctccttcattggggactctgtgctccatccaattgatgactgtgaacatccacttctgtatttgctaggcactggcatatcctcacagaggacagctgtatttgggtcctgccagcaaactcttgttgacatctgcaatagtctctgggtgtggtggttgttttggggatggatccccgggtggggcagtctctggatggtccttccttcagtctcagctccaaactttgtctctgtaactccttccatggatattttgtacctccttctaagaacgatctaagtatccacacttgggtcttccttctttttgtgttttgcatgctttgcaaattatatcttggatattctaagtttctgggctaatatctgcttttcagtgagtgcatatcatgtatggttttttgtgattggattatctcactcaggatgatatcctccagatgcatccatgtacctaagaattccatgaattcattcttttttttgttttgtttttggtggttttgtttgtttgttgtttcgagacagggtttctctgtgtagtcctggcttgtcctggaactcactcagaaggtcaggctggcctcaaactcagaaatccacctgcctctgcctcccaagtgctgggattaaaggcatatgccaccatgccaggaaattcattctttttaattgctgagtagtccatctgatttaggattggtaaagatcttttcccaatctgttgctggtctttttgacttatggacagtgtcttttgccttacagaagctttgcaattttttaaaaaatatttattttattttattttatcttattacatgtgagtacactgtagctgtcttcagacactctggaagagggcgtcagatcttgttatggatggttgtgagccaccatgtggttgctgggatttgaactcaggaccttcagaagagcagtcagtgctcttaaccactgagccatctcaccagcccagctttgcaattttatgaggtcccatttgttaattcttgatcttacagcacaagccattgctgatctgtgtaggaattttccccctgtgcccatatcttcgaggcttttccctactttctcctcttaatttcagtgtctctggtcttttgtggaggtctttgatccacttagacttgagctttgtacaaggagataagaatggattaatttgtattcttctacatgataaccaccagttgtgccggcaccatttgttcaaaatgctgtcttttttccactggatggttttagctcccttgtcaaagatcaagtgaccgttggtgtgtgggttcatttctgggtcttcaattctatttcattgatttccctgtctgtcgctgtacctggaccatccagtgtttatcacaattgctctgtagtaacgctttaggtcaggcattgtgattccactagaggttcttttaccattgagaagaatttctgctatccttgtttttttgttattccagatgaatttgcaaattgccctttctaattcgttgaagaactgagttggaattttgatggggattgcattgaatctgtagattgcttttggtaagatagccatttttactatattgatcctgccaatccatgaacatgggagatctttccatcttctgagatcttctttgatttctttcctcagagatttgaagttcttatacagatctttcgcttccttagttagagtcacaccaaggtattttatattatttgtgactattgtgaagcgtgttgttttcctaatttctttctcagcctgtttagcctttgtgtagagaaaggccattgacttgtttgagttaattttatattcagctactgcactgaagctgtttatcaggtttaggagttctctggtggaatttttaggatcacttatatatacaccatcatatcatctgcaaaaagtgatattttgactacttcctttccaatttgtatccccttgacctccttttgttgtctaattgctctggctagaacttcgggtaatacattgaatgggtagggagaaagtgccttgtctatagtctctaattttagtgggattggttccagcttctctccatttactttgatgttggctactggtttgctgtatattgcttttattatgtttaggtatgggccttgaattcctgatcttcccaagccttttaccatgaatgggtgttggattttgtcaaatgctttctcagcatctaacaagatgatcatgtgtttttttgtctttgtgtttgtttatgaagtggattatattgataaatttctgtatattaaaccatccctgcatccctggaatcaagcctacttgatcatgatggatgattgttttgatgagttcttggattcttttagtgagaattttattgagtatttttgagttgatattcttaagggaaattggtttgaagttctctatctttgttgggtctttatgtggtttaggtatcagagtaattgtggcctcatagaatgaattgggtaaagtaccttctgtttctctttagttgaatagtttgaggagaactggaattaggtcttctttgtaggtctgttagaaattctgcactaagtacatctggacctgggctttttttggttgagagacttttaatgactgcttttatttctttaggggttatgggattgcttatgtgatccgatttaactttggtacctggtaagtgtcaagaaaattgtccatttcatccaggttttccagttttgttgactataggattttatagtagaatgattttttttggatttctttggtttctgttgttatgtctcccttttcgtttctgattttgttaatttggttactgtctctgtggtgtcttgttagtctcactaagggtttatctatcttgttgattttttcaaagaatcagctgttctgagtttgagtaaactaaggaatttctgagttattaaaactggcaagtaaactctaaattttccctgtagactcagtggttgaggctgagtgaaacttcaagattctgatcccagggttctttattaagtataattttggaaagaaatttcttggtaataattgtcttagtcctctgtgcacaatgaaggtgaaggtgtgactacctcaaaagtcttttgcaaagtacatgtgtttcttttttaaagttggattctaaaaataagggcctagaggaggatcaagcatacagtgtagaggacaccaagctgtaaggtacatgtcctatgtcccccaaggatggtttgttctcatggagaaacaataacctaggattgttgtctgggacaatttaatagtctgggactttcaggtgtggtgtggcacaacaactaccacaggtcaccaagctgcttactacatccattccttcacttctggtaaaaaacaaacaaacaaacaaacaaataaacaactgtacttctcttgcactgaagaacaaactctggttttataccctagagcttatttttatttatttatttattcatttattttagtttttcaagatagggttcctctgtatcctgttcctccctggctgtcctggaactcactttgtagaccaggctggcctctaaatcagaaatccgcctgcctctgcctcccaagtgctgggattaaaggtgtatgccaccacgcctggcctagagcttatttttgatcataatatccttttgttctctacagaaaaaaaaattatggatgtatctagttcttaggatgttaatgttgtgttagtgtaaatggaaagacaatcaaaagatgttttctagaatataaattatgttgttgagatatacaaagtgtgattacattgcttgactttatagacataaaacatggaagtgctgctggcataattccagcaatcaaacactgtggcaggtgtaaccctaactcatgtccacacacacttgtgtatatagatatataacatttaaccaaagtgcttttggtattcaagtcaaattagacattgattggttattcccagtaaattcatgacatcattgccctaagcatattttctgaaaaggaaaaattatagatcaacgtctttttggttggttctgtgtatatattttactttgtgtacctttcaaagcatcttccctaatgaggacactggaatataagagtcaatgttcttactggcaccagtttgcccttttcatatacagtgttttgtgtcagccctgtctttagcaatgaagacttattgtcagtttgtgaaaagcaaccccttttgttgtcagtggcctgcattctctgggtatttttatgagatcactttggctagcaactttcttgatgtaacacagttgaaaagacaagatcaactggaactccatctctttcagtattcaaagacttcatttaaaccatcttcatacacttataaagtggtacttttcaaaaaaaatttttttttgcagatatcttactaagaatgtatccaacagaactccatggagtcttgctccgtggtcctttcctatgcattggcagaaccatgagtgtgacaatatattatataaaagatcttaccttctaatagatggagaattttcctggacctcacagccagttacctaatcctttataaaactctgttaaagattactgttcactgtcccattctttccccacgtgatggttcccttaatgttctagaaacactccaaagctctctcttatgcccagccagacagatacaaacaaacaacagattactcagatagacacaaacatggagacaaaaggcagacagaaagggagatatacacaaggtagccttcaggaagttacagatttaaactaactgaacagacacacagaggatggaaggcacagggaacatgaagtagagaattcaactttggactcacacttaattaaatgctctgaggaaaaggcttttatttctttccttaactcaactcagatgcattattaaccaccagtatgtttaatctactcacatatgaagaatcaattaacttgtgaccttttttttttttttttttttttttgcataagtacaatatgggaaaaactaaaagtcaccacaatgggaaactagtagccctgccatctgaaaggtgttcatgggctttgaaccctgttctttaaagtcagacccccaggtttgggcttgtgcttctgagctctcgcctccatgctgagctagaatccattttaacctctcataatcatcacaacaggttttgaacctaagaggtcacatgagaatcctggaactcattacaatcatgaaaagagttgacttcctagcaatagtctaatgagacttgggtaaatctcgagtcttctttccccagcttatactgatatgcatgggtgtcatagagtgtttcagtgaacaatcaggaaactatttatcaacaaacagtgcagtgtgtattgtaattttgttctagtttttctttctttccttcttacttttttttcttcttcttctttttttttttcacttttttgacaaaaatctagacagttttccaaaggagtttctcttaattgcctcacccttcaagcagtaaataatattgtgccttgacttaatatcattttaattcaccattttctttgactgaggtacccacctcctctaccttttctttaagtctgataatctgtctcccacagtttctctatgtttttgtttttgttttttttaacctcactacattttcttttcaggtgtttttttgtttgtttttttgttttttggttttgttttgttttttggcattcctgagcacctattgaactcaattttaatattttatagtgtcctcaggcatctggtattattttcttgttcatggttcattttgttcctgtctgagtggattcacatggtttacaaactttaatgtccctgatgtgtgttttctattctttatcttggatatcacataaattgtgctccttataggatacttctatggtttgcagtttgagccgaggacattttatcatagtttctgtttgttttgggtatttgttcttagcatcagaattcagagggattgcttaattgtgtgcatttttagcctacattgctagactcacaatatgagaagttagacaggattagttgtatctgaagggttcagaacccaggttcagtgtcctactacatccagctctggtctagtctggcagcaaccttgtggggaagctgtgcagagtaggtcatgggaagttttgtgagaggcagcctgcaacagatttgggggaggggttcctgatggagagtgtgagattcctgcataaattgatgagtttaaggaaaagacaccttaaaagccaaggaaaaagcaagcaagcaaacaaacaaacaaaaaatccaaaacaacaaaaattagtgtgaagaagtgggtagctaatgacttaaaagttcctgaagtaggtggtcttagaagaattccaggaacctgttgaatattgggcgggtccagaaggcggggctaggcagaagtgaagggaagttcctaggtttcatcattctctttgtatcttggttgcctggtggtcaggaagtcctggagggaaacttgtgcctagtattagtggaacatgaaaacttccttaagcaacagttgctgtgctggcctcctaggacattgagcagctggtcctgtcaccttccaggtcagaggagctgttgtactggttaatgggcaggagcagggcaggtgtgtggagcatggttgcattttctgcctccactatctcaattctgttgtggatatcttaccattatcaggaagtttgagatcctgtgaattgggttcatggtgatgttttaattaattttatggttgccagaatatatatacataatatattattattattcatttaaataaccccgtagatccttggccttctctggagtttgtgtaccgggatggttgtcttttcaaaagccttaatagagctcctcgaattcaaattcattcatgctttcttaactcgcctgttcctccatttgccatttcatttccctttctccaggaactgaataggcacccagagagagctttgtagatatttgtcatatgggggaccagtgcagatttgattgaattagaaaatattctttttaaagtaccgtcatgttgctgtacatattaatattaacctagcaaagttatagtctccgttagtttaacactgaggtatatgcagtctttgatgtaaatacagcattgagaaatgtgtctttataggcttagttattaatgtcacaccttaggtttgaataaaacatgaagacaggattgcagcaaggtacagctgaggagaagatatatagtaggttctgtcaaccctgagtgtttccagagaaaaactaattgtaccatgtgggcaagttttataaaataatacatcgtgaccaagagatggatttggtcacatgctacaggcagtttaataggccattgtagtttcctgtgaggctttatcattttcccaagacataaacctgcagcaatgcacgaagatacctggttcttatgctggcggtgcagttaatttttggcttttcagtctgagggagaaagcattcagagatatctgattgggtccagactgaaccaggccatcaggtggggggaggggaattgaggatgtgttggaggatagaggggcaggtcaagagataaccagcagccaagaaagtacctacccaactatgactttattgatatattaacagacaccccagttagccattcctcctgaatttctttgaatccttccaaggttcagcccagcatgtgtgagaggataatttcaagccaagatactttaataagtgggaagcttactatggattaagacaaaattggacagtacctttggaataattatgaatgctcactttcctaagaaaaatgactccttgcttcatgaaaagcagtctgcccatgcacattcatggtttgttgagttctgcgctgtggacttcttacaggtgtggtaatgcttagacgctgcactcaggagttttttcagagatctcttgttggagaaggtcaaaagtttggatcctgcatttcacaatgtttttcttacattcttccttgttctgcagtgtttctgggaaatggaatctgtatgtgtgctaactgtgtgactgactctcacatctctagggtaaacagaaatcctcagggaaaaagagacgttctcatgatatcttctctttccttcatgtttatccttccacctggtgttggcatctttcatttttgtcacatgaaaaggtccaggttctttttgaacgatattttcccattttcaggtctccattactcagccaaatctgcataactataaatcaaatctaagagccctaagatggtaaaggccaaggagactctattgaaggatccaggtgtgttagaggctttgaacaaggagtggggtgtgggttcacctgaaaatgtatgtattcctatgcccattttttattacacacttgatgctgtctgcaaatgcccagggcatcaagttttacatgttgtaaatttatggcagtattgtatttttccctgcatctccaatttctgttttacagaaaatcctgttgtcagtaaattttccatcacatgaattagggattatactcagttcatacatactacaattgtttgaatattcacagagaaacattctggtattatctggtttctttggtattgcagatattacagagctcctagagtttaatctaatctctgctatctaaatctcctagtgcttgcattttcaggtgaatggcctttgcacatgaagtgtcccagagtgcttgcacagttagcatctcttctttccctgtaccgtcccttgttattcatgttttcatccaatccttgtgtttcatatatgttttaaggaaggttttggatgggtatccatgctgtcatatattcataatcccatgttccatggtaaatgacagcaggggtttccataactccactttctccttcttttacagtctttgcctttttcccactgctggctttttattcagcactctctgaattggcagtttccctttacaaaccatgtttggctgagttatccagaaagcaccaacaatttaaatgtatttccagtatttctacatatagcagtatgtcagttataaattcatttttgggcctgtggtcattttgtttttttttttgttttgttttgttttgttgtttgtttatttgtttggtttgttttttgagacagggtttgtctgtatagccctggctgccctggaactcactttgtagaccaggctggcctcgaactcagaaatctgcctgcctctgcctcccaagtactgggattaaaggcgtgcaccaccatacccggcttgggcctgtgatctttagagtgacttttgaccagcttctagtgaatgtctatttcctttgtaggctgacctcagttcaaaccagtaaagtttctgttacctatttgtcactactacacctgtcaacataccttgttagacaggttggtattacagcacaagggtcagtcagtatctagggagaaccattaatgacaccttacacccatcagcctgcagagatccttttagcagtatgtatgctaaaccagcatatccaagatccttttagacactgagtgctcttctcacttatcagattgttctttaggaatgtataaaaccaaatgatacatttttttatattttttcttgtattctatagcgtgttaagtattttatcagattggattatttcttgggatacttgcaagtcttgacttaaagaattatcttttttgtaattcgagaaaacttaccttcctcatatccttatttgaacattgaaaatattctaagtcttacttgctccttgtaagcactgctgtactgtgataacttagtttggaagcttgtttgtcttctgagtagagtagaatgatgacagctgtcttcagtttgtgcagtgataggcttaggatgttggctaacattagactcagtaatgttctttctgttccacattcttcacagctttcatagtgatgcactgtggtattttgctgtaggcctttcatagatatattgacatggttgtgagctttctcccactgattatagtttatgccttgagttgtttggtttgtgcttgttgaaacagttttgagtctctggcatgaaatcaagttgagtttactttctgcatcattagagagaaactttttaaatgttgcactggtgcacccatactattattattttttgtgtgaatgttttcgtggttatttgcttttggacccaggtaaggtcagctttgtgtgataactgtaccatattccccttctttctgtgttctgcactgttttatctgtaaattttttgtgggatttttcagaagaaatttgtgaatttggtgcagcatttgattattcctgagaaagtgctagaaggaacactgagagcctgggtttctgctcttgattattccctggcctagtgtttattgttcctaggaaatcaatatttcccttgtcaattctgtttcattttctatcactttctatggtactcgatcatttgctttttttcccattgtcaatctatacttctcaggctggggcattggaagatatcattcatatacctgtcaaatgccaagagaaatatttgacatgagattaatataaggtcaatgaaatacataaaaagcactgaatatttgctgatatcatggtcatgacaactttcttcagtaatagtatctacatgttcagaatgaattcttatgttttcatttatgcatacacatacgtatgtatgtgtgcatatatgtgtttgtatgtgtattggaatgtatgctaggagaccattatcacactttctttctttctttctttctttctttctttctttctttctttctttctttctttctttctttcatgtgaacctataagagtggtggccagagatgaaatctttaacagctagactccaaagagtgtcattgcagtcatatttattactgattgggaacatgagaacttcctgcaacaatgcctcaatgcagatacacggttgttcagacagatgttccaactttgatagtattttaacagatttgatataatgagggaattattccaagggcattaccctcaaatgactcatatatatatatatatatacacagtcccttgcagccaacagtgaggttctaccatttctccttcttgattttgtatgtcaaattattttatgcaatatgctctcagcataaaatatattcatagtaatactattcataaaattgcatatagaagttgtatacaactcaagtgtcactttacactaaagacacttaccttgagtttttaaataaaatttctaaaattttctctgcaccccatcccacccctcctctccacccctccaagaggatatccctacacctcaccattccaccaggcctccccaattcctggcacttctagtctctggagggttaggtgcatcttctttcactgaggtcagaccaggcagtcatccactgtttatttgtcatggtcatcatgtcagctgttgtttgctgcctggttgttggcccattttctgagagatcttggggggtccagttcagttgagactgctggcatatggatggggccaccttcctcctcagctccttctgacttttcctaaattcaaccacaggggtcattggcttccatccattggttgggtgctagaatctgcatcggactcaggtgcttgttggacctcttagagggcagccatgccaggctcctgtctataagcacaccacagtatgagtaacagtgtcactgccctttgccttcccttgatatggatcctaatttgggcctgtccatgggcttcctttctctcatgttcttctccagttttgtccctggagatccttcaaacaggaacatttctggatcagaggttttgtgtataggatttcaactccattactccacttgatacctgtctctccactggacagcactttatccaaggtctctccctttgagtcctgggagtctctcacctcctaggtctttggaacatgggagatggacctccatagcctacctcctgaggctgtctatttccattttttctactgattctcagggcttcagtcctcccccatccctcacaatgactgatcatgtttccccttcccctctctgtccctgcttccactcagttctctccccacttcttcccccaaaaatgctttcctctgtctcccaagtgggattgagacatcctcacttggaaacttgagctttttaaccctctgtagtcatttatgttttattatatactttttttggctgatatccatttgttagtgtgtacatactatgcatgtccttttttgggtctgagttgcctcactcaggatggaattttctagttcaatccattttcctccaaagctcctgatgtcgttgttcttaatagatgaataatactccattgtgtaaatgaaccatatttcagtatcgattcttccattgtggggcatctgggttgtttccagatcctggctatcacaagtaaggccactctgaacataatgcaacacaagcccctgtgtcatggttggtcatcttttgtgtatatgcccaagagtggtatagctgggttttaaggtatatctatttccaatattctgaggaatctccagattgatttccagaatagttgaccagttttcaattccacaagcaatggaggagtggtcctctttctccacatcctggccagcatgtgctgtcacctgagctttttatattagccattctgattggtggaaggtggaatctcagtgttgctttgatgtatatgtttctgatcactaaagactttgaacatttcttttgaagtttctcaaccttccacagttgcttcattgtgaattctctgtataggtatctacctcattttttgattgggatgtttggtttcttggtggttagcttcttgaatcctttagatatattggatattagccttctatcaagtgtggagatagagaagggtttttttttcccccaatctgtaggttgccactttgtcctatttgctatgtcatttgcctgacaaaagctttctagtttcatgaggtcccatttgtcaatttgtgaacttagagcctgagccatttgagttctttttaggaaatttcctcctgtgaaagtcagtttggggctctttcccactttatcttctgtttccttgattgtatcttgttttatgttgagttccttgatccacttgaacttgagctttgtgcaaggtgataaatgtggatctattttcacttttctacatacagactgccagttagaccagcactggtgattgaagatgttttcttttttccattacatatttttggcttctttgtcaaagatcaattgtctgtaagtgtgtggtttaatttctgggccttcagttctattccattgatcaatctgtctgtctctattccaataccatgcagtttttatcactattgctctctagtaacacttgaggtcagggatgatgattccttgttgagaatagttttagctattctgggttttttgcttttttaaatgaatttgagaatttttctacaactttgaacaattgtgttggaatttggatggagatttcattaaatctgtagatggcttttggtaggatggccatttttactatgctagttgtactagtccttcaccatggggtatctctccattttctccattttttataactttaaaaaaagaaatgaagtacactgatttttaaacatagcagctcctatgtagtttgcttgtgtgtgctttctggttgctaaatctagatatagagtctagttttaagtgggaaattacctttctgtttttcaactccttcacagactaagtttggctgtcttggaaatatctttgtggatagatcttgtacacataggtgtgtattgctctgtctcctgaatcctggagttaaagatgtgtcccatgatacctggacctaataatgttttcctccttagaacttgatctgttccaggctgttcttggactttgaaacctgcctccattttcaaactcaaaccagaaacttaactgggtgaaattttgtctgagatcatcactctctcactttctgttactcctttattcctcacaccatgagccttgttcttttaaaccatccctttccctttactgactcattagtgtagctacctctgtaattttaggtacttggagccccttatacaaatcatattgcatgcttatagtttgcgtagttgagaaattttgggcaatgggtgcggggaattaaaggggattcccacatcccaccagagctccagtgctctgggcaagtggacagcaatctccatgaggctcaggtgggcatctggctgtgggaagctatggatctccagtccgcaggggtagagagggagcagtttgtggtttctgggtctcacagaggccacagaccacaggtcctcagtcatggatatcccagatgtcattgtatgttgtggaagagctgagaacaaagtgagggctctgggggcaactcggtcagccccagagctgaagggagaatggagcagggggataaggcactctgtggctcccaggatgtgagggtctttggtctgatctggtgactagaaatgctgagaggctttgctgctggaggtgacatgtggctctttagggtcaggcctattccatcattgaagaacagagggctttgatgagtggagagatggttcctggttttaaggtgtttattgtagaaagtcagagagagggagaggcgtagggaagtagaagccagccatggccatgtggagagagggaggaaaggatagggaggaggagagctagagatgagaataagagatttaagagcttaagagagagaggaggggccaaacagccctcccccccttttcttttgtaaaacagaactgttagagtggcatttttatttttaaatcattaagactggtcaagaaataaaacagaaacatagtaaaatgtttaaaaaattaaagaatattcttccaagtataaattttataaatacaaaacaaattcacaaatgactttgaatgctaaataaacatctagttaataaattcagtcggcactggctacggcacgtcagagctagagaattggattcattcatgtgtagtgttgaaaccatgtgctcatgaaacagtcttaagacacattctctaagctgttgtctacaagagctactgtggagacaaagcctccttatgaccgaaactcctaaagctcaatgacaaaataaatcattgttgaaaaattattttccaggatacctgaacacatgaatgatctcaaaatgcacaaaagcctctgtaaaccaggactgtacccagtacagctataaaacttagtagatactgaacaaaaactgtagcaaaggaaatctttcctacattctcctgagtgcttaatagtaaattgagaatatagtgcaggccacacttggatgtggtcaaccagctgttattgctttatacgtgtatctgctttagagcatggtttaatgttccattttcatgaacgatttatgtttttcttcacgtatagcctttagaaggacaaaattagatccgtgacttctatgcagctagtgcaaacagccccttttatagtgggctgggttacctatcccttgcagcattactgttaggaggagctggtaactgaggttggagtctagccagaatgccaggagcttgggaccttgtcaacgtgacagatagtcacaggattattcagttgtggggctccgtgttgtcagacacccgtgtctgggaacgtagctcactgttctgtcccttgtagagttttctactgggtctccaaagtaagctttgctcaattagaacacaggctgcctttcacagtcccacagagaaaagctctaaagaatagctttaattttaaattatataatcttcaactcatgttttcatagttctttcccacagccttaaagtctgtcctgaaggtcataacattaccattttcctgaggaatatctgacacattgttgcttcatggaatcttactgtttctggttatggagacataaaccttggctgggagaacattctcccaaaatcttggctgcgagaacattccacttaggaggaacttgtagtacagtgtatatgttaccatttgagcaagccgtatgcctacagcaaccatcagcactggataagtcacatatagtattgaccctgctcccttctattgctatcccagacctggaagacagacttttttctttaaagttttaactataggaatgttattctctatgtttttattttcactgaatgcctatataaaaccagtggaaccatgaagtaatcacaaaatgcatcacacaagattcaggtaaaaatcacaccttattttgtgtgtagaaagaaagaatcagtctgtgtttcttttcatgagcagcaagtaccctttacccctgagtcatctctctagcccagaggtttagaggttctgctacagtttcatgattgatcctgaatataaccctgagttctatttttggaaaaatgaaggaagaatcataaatgatagtaatctttgccacccataatcatgttagatgaatgatctcaaataataaagataagaatagtaatgaagtgaaagaatcataaaaggatctggtccttgcagtctataatcatgttagatgagtgatctcaaataataaagcaaagaatattgctgaagtcaaaagattcagactttaagttggacagtaatagatttatgtgcagtaattaatgaagaattagtaaagttcttatgcaacttaaacattcctttccattgtaacaaatcattttactttttcattttgttgttacatgtaacatttatttactcaggttctcttaactattctgaagggaaaccactgtggaatttatgaaattattatctgtattggttttgtcatgaataagaaaatggtacatgacaataaggctacctaatgctaattttttgtttcactaaatattctcaaactaaatctataatacatattttaattcttcatgaaaagattttcttttaagttattcttgtgttttacattccatactctattttcttgttctagaaaggatgcagcattgtatataggccttaggatctcaagtgagcattttagactaaagtctggctgttgacacccaactgcatacaggataggaacagggtctccatttgagcaaaggtgacaggttttagaatttgttagcacagtttcacttaccatcatttaccatctgagatgtgatactgggatcaacaaagtattcttaaagatacattcctgcatccagacctcaaatgtatactttattatgtctcaataactctggggatgctgaacccacaagataggagtccccaatcttacaatggaaaactggaaaatcattctaatctagattgtgagaaaacactccagagtgtcatctacccaacaagaggatgccttcctgtgccaggtagtacacagataataatggattaataggtttcatcacttttcatgaacactcaatgatatttttttacctcattgagcagacattatatccatgacaaccatcacagtaaaggctgatcactccttatctgaaaattcagattccaatacatccccaaatttaaaattcttacattaccacagtgatgccatcagcgaaaaaagtctgtggtcttatgtgatctcagtttttattgtcaccttaactaaatttagagtcacctagggaacatgattctagacatgtctataagcacatttcctcagagcttcagctgagaatggaatacacaacctggatgtatgcagcaccaaatagtggactgtggacctgggacaagtaacaagtagaaagtaagctgagcaccaccatgcatctctctctgcttcagtagtgcagacacaatgtgaccattcacattcatgccatactttccttgcaagtcaggcttgtatttctctggaaccaagagcctgtcctcttaaagaaatccttgtgtaagttgtttttgtcaggactctattctgtctgtctgctgtctgtctgtctgttatttatctatcatcctagttgaatgagtatatgggcatgagattggaggtcagagaataacttgcaggatatgcctctgagagggtccatgcaatagaactcaagtcaccaggattgtgcagcaagcacttttagctgaagagccatcttattggctcttgtgttaggctctctaccccatggatgcatgtgtacaaaacacataagaatcatgtgtttgaatttgttcctcatgtaaagatgtctcattatgtatgtaaatgtttgaaaatactaaacactaaagtagatctaggctcaagtagttcagaccagcgacagttgtcctgaagtagcttccattggtctatgtatgctatgccacaacaccaaaaagtgcaatgattacccaacagaaatcttaactgctcctagttctgtaggctgatgtccactgtcaggcactattggtctggcttctgaaggtctcttccttctcttctagatagccaccctcccacaattgctgtctgcttgtactttgatggaatcccctatttagaagaacagcaatgttactggagtagggccagacctttacctgcttaccttcctaaaagtcttggcctccagacacagccatgtgctgtggagtttagacctggacacacaggttggagccaatgggggttacacacagttcaagctgtgctgctctctcttctctgcagggtgtagttctgatgctttgtatgggaatctgcttgtgagcacagaagttcctgttacctagttagtttttaatcagtcaatgaggatgctagctgctaatggctaagaagaggtgggaattctaggtttccataggcaggctaagagatgcaagaggaggaaagcagattcaccatgctttagagtgagcaaccagccatgagatgttaaggataaggtttctctgtgaagtcctgactgtcctgaaattttctctgtagatcaggttggccccaaactcaagacattctcctccccagctacaccaattctggcttgattcctcattgctaattctggacagagagcacaggtcagggcccagcaaggagatcaagaggacaaaccctttagacactccaggaataaaatctgcagcacccagtgtggctgtggccatagacagttgaagtgaattactgctcttcagttagtggccctgttgtaattataaacagtgactgtaatatccacttcacctctcactggcattgacatagatgatgaaagccagctccagatatcacacaatatactcaaggtcacaatctgaaaccactctgaggtctctctgtttaggctgaaatgctcagagcaaggtaacagccaggcagatgaggatattagattgacctaaaatgtgaattcctagaacatcacagtatcccagatcactttttgcagaagaagtacataatgttgcaatccatactacataacaaactcggaagacacatgaagcaaaccttcaaagaaaacatatagaaataatctggtgatgtggcacacaacacaactttaatcccagcacttgagagggtaaggcaggaggatctggatgtcaagttcaacagtggcttctacagataaaagaatagaaaataaaataaatgaaatgaaataaatgttggttaaaatatcaaccaacctgtcctacaatccaacttccaaatatgcaagaagttgtgagtaaataatgtgtattccagtcttcttattatctagtctccttccctgcctctatgtttgataaacttattttcttccaggaaatataattattaaggaaattctcacacattatactatggatgaaagttatcgacagtatatacagtgaactaagcctatgaatgaagtatagatgtggctagacagtgctggatttttccataaccttgattatgaatgattgtgagtcaccacctaggtactttgaacagaattctggccctctaggagaagttagcatcttaaccacatcagcacctctctaaacccaagtcagaaaaaaaatgtttcttaagtaaaagatgtaatacttggaatttgaaggccatagcgaggctgcctgccatgtgcttgcctgccacagggtggagaatccaaaggaggtctgagaagatgagcagagcagagatctaggaaatcacatagagaactcaaaaagatacatcagtaggtgaagtttcaaaagcgctgattagtcaggaacttgtggtgtgaggtcaggatgagaccatgaccagagtacagtgcaggttgagggttgaacaatgcagctcagagtctgagaggattcagggaaaggtaggacatatttttatagaattcatccttgatgctaataagtgagaggaagcatggacagcaagagagaagttgtaaattttataattgtgctaaggaaattttagatgtaaaaaatgtagaaattagatgtaaaaactgtagatgtagaaattttagatgtaaaaaggggcaaattcaaggcatagcttgacttattaggttcatgaggctcccatttacaaagataggaagagggggtacactgaggatgggggggtacaaatgaggaccttggctattggtgtatgattaagacactttcaatattccattttaattatatatcttggtgactaattttttgtatattttatttatttatatttcaaatattatcccctttcccggttcccctccagaaaccccctattacttcccgcctgcttctatgagggtcctcccacatgcccccacctactcctgtctccattccctggcattaatgtacactgggccatcaagtctacacaggacctaggacctctcctcccaggcatgcccaacatgaccatcctctattaaatatgtagctggggacatgggttgctccatttgtactcgttggttggtgatttagtctttgggagctctggtgtgtctggttgtttgatattgttgttctccctattgggttgcaaaccttttcagctccttcagtcctttctctaacttctgccatatggaccctgtgttcagtccattggttggctgcaagcatctgcctttgtattttttaggcactggcagagcctctcaggagacatctatatcaggctcctgtcagcaagcactaattgtcatccacaatagtgtctgggattgttgtctgtatatgggatgaattcccaggcagagcagtctctggatggccttcagcatctgttccacactttgtttccatatttcccttagacaggagagtggggtgaaacaaatttaatctttggggttgtgaggtctgatcccaagaggacttacatatcacatgtaattagttggaagacatatgtgataaaacaaactctagtgtgagttttcactgtacttcatataattcttgggtttctttgttctgcttttattgtcattttagatagggtctcaataagaagtatatctggacagacacttgttatatagaccgggctggtcttcaactaagagtcatctacctacatgtgctactagtagtgctgggatcaaaagcaagtgtacccaccataggttcccatcttattttacataggtctccctaaatattctgtgctagctaggaaatgaagatccccatgcctcagtcgagataccaagtatgagtggctacctactcttgtctttaattttattttttttaaacaggatcttattaggtttgccttatcaagggtgttggtggagtaatgtgctaccaaccactctcagacagagtaggtgagatgagtgtcctgttctcccattctgttctcagtgttgttcttgaagcccaagtgaagaggaatgttaatttatacaaaggcctgaggagagatgactcaatcacttagagctgtggatattttagtagagaacctggatttgatgaccaatacctacaaggcatccaatgctgtattatgacagagcaaggaagacaatgcctccagtcctccatcttgtgttgttgctaaggccatttcaggtttaatttgaatttgatcttcttgatgaatcctatgggaattactaaacttcatttctagaaacccaagttcaagatatcctagatgactttctcagcctgtttgtgctggaatcccctctggctaactgcttatcttagattgtatcagacactacttgcttctgtgagtatcccacttcagttgcctcttgtgaaaatctggtgctcaggaaactcagtgcccttgctagcttagcccccttacctaggataatgtttaagaagcaattattgtgtacagttgtctccctatagaggtctgtatgttttttttcaatttttttgttagatattttcttcatttacatttcaaatgctatcccgaaagtctcctatactctcccccaatcctgttcccctacccacccaccccagtttttggccctggcgttcccctgtactggggcatataaagtttgcaagaccaagttggccatcatttggaagagaggtctgtatgttaaccttgatatttgctataataatctacctctaacattttggacctaatttaaaccaagcatgcattaaatattaaatactgatcaagaggtggaccgatgttaggaaaatctctccaattttcaaggtagaatggactcagtctcatgttatagccgtttttttgttttgttttgttttaagtgttaaaatcaattaggcgaccacatgttcacaggagcctattttattcctaaaggactacaattctcagcactcgaagaagttatgtgcttcctcggccgaggaggcttccaggttaattttgagtattatagatgcaaacgatgtatcttgatttcaggtggaagaaggggaaatgcaaacttggtgttctgagactcccttaggtaagcttccagactgctacatggtgagtacagggtcattgcccacatctgggtggagcaggctgctaagtctctggagctggtgtggtgtggatctggatggtaaggagtagatagatctggcaccctgtgcagtcttatttagttggacttattccctggaccagacaaccccgatttacaacaagccaataggccaatccccattgatagtttctgtgtactctgctggtgaaatgaaccaattcaagaaagattagattatattaagtgccagttcatttggaagctgctcttggatgagttcactggccccaagcaccgagttaagggaagtcccaaggtgtgaaggggcgcagaaagggggaagagaaagagaagaatcaggcatgtacagagagagaagggagaaagagggcaagagagagagcctcacagagagacacagagagagacaaagatggagagactgacagagaagatttattcaatcagtgtgcagaggaatattaagccagaacagcagatatggctagcctgcaatagttcaggaagaattagaaaaggtgatattctaagcctacataaaattgtacagagactagaaacgtccatgattacgctaggtaagcagactgtggccatatgcttcagagaagacaactacctcaggttagtaagattacttagacagagctccttctctaaagcaaggaatatgcttgggaaaggtggttatggtctggagccaggaccttcggggaaaggttgtgtccaatcttgagaagccaactcttgccaccatgtcgggctgtggttattagtcccaagtctactgttggattgtttagtaatgttcccgatatatcctgtgttccctgcgaacagcatggatttgatagaccctccagagttttttccattgtatgacagtttcgctgacttcatagaagtgtcccctctctttacctgttccctctgtaagtagtatacaagatgctattcttaagaagcttactgcatgatatgtagctgtgcaagacttatgttgcaagatatctgatcatgctctgaaccctgagtgtaacaagattaaataaaccatgggtcaagaagtgccagaagcaaccagctgacaggaagggaacctaggattattaagtaaaagtcacagagagtaagagggaattgggagcaaagacagagagatgcacaggaagcagcatttaggtacattcagtttggaggatgtcatttgagaaggtgtggcagaaagagattccttctgggatttcacataaagagaaaggtgaacagatgttttctctgcctctctgagctaccaggcttccacccagcatctggctcctgacacttccttgaccaaattgaattgatttagaatttattaaaaacaacagacatctcaactgcagcttttatgttttccatcttcgagtttttctaattttctcatcctctgagactttctgcttaggagcctgtcactgaagaattatctgatgtttagaacattgttgtacttatgaactaattctggaaatatctttgctgtgggaatctcccatctgtctaagtggttggaattgctttctgtagtccatatatacacaagtagatcttgcattccaataaactggtacttttgcttaagcttacagccatatttaatatagtgtgaggaattttaagctttaaacatgctatcctacagtgtagtactcaacttgattgtttaaaatatttttaaagaacaataacaaaggcaaaattatttatttggacatctcatattatcatcttttaaaacctaaattaatgcttagctataaccttaatttatataattttccaagtgagctaaccaggatttgcatgtatatcatttgctgaaagtgtcaaatctagacgcttaaatcatccttctaaaatgaatatgctattatggatattggttgataaacagtgatgtttgtaagtgtctgctatcttgatcagttgaaggcagtcacctaaccctttagagatttctctgtacagtatcccattcctttcccacgtgatgcttttcttgctgttccataaagattgcaaagatttttcttaaagtaagctagaaggacaaaaataggcatcagagagacacatacagagtatacacacacacacacacacacacacacacacacacacacacacacacacacagagagagagagagagagagagagagagagagagagagagagagagagagagagaaagagagagagagaagacatatacacagagaaagatgcagaaagcagccttgaggtagtcacacattcaaactcatacaccaaacagacagggtggaatgtacagggaacatgaagtagaagtttacaatttagatgtactctttgttcaatacctctgagggaaaggctttcatttctttccttaactcatctcagattcattattaatcatcaatgtgttcaatctattctcacaggaagtatctattagctggtgccatcttttttttttttttttttttgcataagcttaatgtggggaagtatataattcaccatgatggaaagcaaggagccctgccatccgaacgatgtccaagggctcagaatcatgtactttaaggacagacccccaggtctgggcttgtgtttctgagcactcacctccgtaatgagctggaatctatttcaacctgtcaaaatcatcacaacagtttttgatcctcagaaatcttctgagacacctgggcctcattataatcatgaaaagagttgacttcctagctagaatccctaaagagacttgggtaattctggagacttcttcctctgcttatgcagatgtgcatgtatgtacattgagaattatagagcacaatcaggaatatatttatgagcaagtttttaaacagtatctattatagtcctaagtctagttgttgtctccttgtttgtttttaataaaatctggacagtgttcccaaggtgtttctctattttactcctcacacattacaagcaggatatgatattgtgccatatacaacattatttcagttcatcattttctttaactgaggtgttccagcaactctacaatgtgttcaagcctgatattttgtttctcacaggaactcttggtattatttttctttgactcacagcatttttcatttcttttttcatttcatttttgtgggtatttctaactacttattgaactcaattttcatatcctaagttgtcttcatttccttcaggcatctgctattatttcttgttcatgaatcattttgttcctgtcctctctgagttgattgacatgcatctcctgatcctcactctgagttttcagttctgtatcttggatatcatataaattgctctccttaggggatatatactatactttaagactaggacattttaacatcataatttagagggactattttcttttttgagtttttggcccaggagtctggtattgcaacatgagaagttagtcaacataacttggttttgaatggcccagaacccaggtgtagtgtcctaccacatccagttctggtctggaatggccgcaaccttgtggggaagctgtgtagtgtaggccctgggcatcctgacagctgcagttgtgtggaaggcaccctgcaacagagttggtggagtggtatctgaggggagggagggcctacttgcctgattagatgcatttcggaaaacgacaaaaacaagcaatgaagtaagcaagccaggaaaaccaaccaaccaaacaaacaaacaaacaaacaaacaaacaaacacagctgagaggtactgggaagctaattcattaaaagggtcctaagtcggagggttttaaagaaacatgtagcaggaaactgctgtatattgtgtggaaccagaaggagttgtcccaaggaactaggccatagtaacaggaaataccaccactcctgcattctctgcatattctggatgtcctcgtggtcaggaagtcttggggggtgggggtggggctagagccaagtattagggaaactcgaaaacttctttagggtacagttgctgtgtgggcattgtgggagagtcacctgtgataagtctgtcctggaacctgacatgtaagaggaactggcagaagtaaagcaggggtgtggagcaggggtgattttctgcagccactctcactattctgttgtgaatatcttacaattgtcaagaagtttgagatcctattgaggtatcaaaatggaagccagtagatgtaagtttatacaaaaaaaaaaatcgggtctcaaggttagacatgtccagccagctgcagctgctgggagttactagcactactacatatttttttctgccttctttcccctgaagaaataaaattcctggtcagtcacctaacgtgctgcatcagggaaggtttgcataccaagctggaatatacactggtgtgaaatgcttcagagttgagtcctggtggtctttgtggtttcaatatctgggcataacactgtgaactggggttcattgtaatgttttaatgaattttatggattccagaacattcttctaaaacattgtagatcctatgcagtatctgtagtttgtacatggagattctctttggtaaagccttaaagagctcttcgaattcaaattcatccattctttcttaacacctgtattcctccatttgccattttaagagtacctatttgccaggacaatgaattcatatgcttcctcagagagctttatagatattaatcatatgaagatacagtgcaggtttgattggattagaaagtttacattataaagcaccatcatatggattgtgactattaatatttattgtgtgaagttatattctccattaaacatgaagataggatagcagtaaggtattgctaaagagaagatctattgtaggttctgttaaccctgaacagacctgctttccggaaaaccagctgaaagagtggctgcagcaggccccaaataagggagggggaggggaaagtctatgctctgggtcactggcagtcagcaaaagacagacccatgggtgagacacatggggactgggaactaatgcttggagccagtgctcctgagccactgagataaattgtccaggcctgacttggaattttcagccaaaggaaagtaagtgtctcaaaagttaagaggaaagtctcacccaagggaattagtcctagaatgaggatcatggaaatacacggttagctccaagctcaagaactcttcggtaggaccatgagggcatttactctgaccaatgggggatggggtttcccaggactgggctagggagtgttggtctagatgcaaacctacagagtttctaaatctcagtcatggtactacatgatgtgtttataaaaagataaagaaagaataggttctatgggtgtgtggtgaggtatgggggaaaggggtgtctcaatgggcctatgcctagacatccctttcccctgagggaccagccacatgatggtatagtatagaacagagtttattcaggacatggggaggggaggtaagagggtagtagaggcagagaaacgcagagaaagggagaaagtaaagaagtagaggccagccatgaacatgtggagagaggggggagggaatggggaagggacgggggaaggaagagcccaagtgggcaagagagaagcaagcgatcaagagagcaaggaaggtgcaagcagccccttttgcagcaggccaggcctacctgactgttgccagataaatgtgagggtggagtttagacagaatactaacaggtctccactgtcagtagaaagaggacatgaatatggtttaggccgattctatttcaataatgattctagaaaatttcactttgaataatattaaatgtggtaatatcaatttcctgttagaggcagtacagacaccagtgagttgattgcaatatttgattagttttgagtttctgaaataactgttgcccattgacaatagtttcttttacccatactgaaagcagcctcaggctatatgtgtgacaagtctcaggtttatacatgtagcaaatgtcagtggtagtttccctcgcagggcctgtgaccttccttattggattttagccagattctcagtttagtctaagcaatttttcctgaggagccggactcagcttgaacaggaaagccttttgttatccacagatagtcttgccgctatgatgctagtggccatgccttgcctggcagattgagattgtagcatacagggtgcaaatctgcatatggccgttgataactctgcctcctgccccagacactatgaatgctaccaccagggagtccaagataattgatggcagagtgaactgtgtgatctgaggggttttttttgtgtctgtagatctttatttttccgaggtatgtttctgcttttcttacattcttgagaggttttatactgagcaatgtctaatttttaccacagagctataaatgtaccttttattctcataatgcaattgttgtctgggaggattactgcctttgcctgttaagctaggcctagtcctggaagcctcttgcctccctacaatcttatctagacctagagtgttttcagcctctgaaatttgctgttgaataagctccccctttcttgttccttctcaactttctttctttttttcttttttattagatattttcttcacttacatttcaaatgctatcccctttcctagtttcccccatgaaaatccactatgccctcacccctcatcctgctccccaacctacccactcctgcttcctggcctgcctcggacagtgcggtgggaatttcacctaagtggtcaggaacccaatgtgactggaaccaggttgtgaataggatcggtgtgacagacagacagacaagcactcagtggtgaagctgctgctgctgctacaaaatctttacctcagggttcagattacacacacaatcaagaagaaacaattttctcttggcaaatcacacatcttagttcctctttaaacctaacacaaatatagcttactaggaaattaaatcacccctcggcactcgcctgtggttttgctgccagactgaactttcatattgactcaaggctctcataaccttttatttactactctaataatctcattcaacaacacatgcattgtcaatctaaactttgtaatatttcttgcttatttcttttattcccaaatatgtctactccttaccatctagaagtatctccaaatgataggaaaacatacaactgccatctcaaggtccactgttaaggcacaccaaggagccctacttcttattctttcccatagacttaattctgaatatctcttttttgtcccatttttcacaatccatctgactaagttcttatcataacttccagtccagggaagtggaatatctgttggattaaacttataagggccacaatatctaggttcttcccaccatcctctactcagcttccctagaactgactaatcccccctcttcactgttaatcctaattcctgtaaattctggatttcttcatcctgtatagtttctcttttacttctgacaattttattaatgcctaattctaattgttgtattaaattaatggtggcacccaaaatcagcaactgctatccaggcaagcatgccaaggacactctttgtcctcccagaaggggacatgtaatgggcagactgccagggacctccaggaggcttagctccgcagagcacaaacctcgggtctggtagccattcaatgagtttttctttcattgctacacagactccactggagttggtgtggcagctcccggttttttatttttttaagcgaagttggtaacgatctctctgaatagtactgagagacctcaaaatgagcctaaaagtaaatggaaagattaataagactatgaccaccagagccaagaccactgcaccaaaaattatatattgcagccaatccacaggactaaaagatcttaaatcttcaggaaaaatagaagctaatttattcacatcccagctatccaaatatcgttgactaataactgtaatttgttcctgtaattgtttcatatcataggagatactatcatctttccaaatatctatcaaatgggcccttgtcctattccattcttctaaggatgaattataggacaacagtgtaacacgaatatattgaaatttaacatgacatttagtggacaatctagctttaatatttgccacctcctatcccatttccaaaactacatcttctaaggcattaatcctttcttccaatttcaaatcaattatcctttattcagacaaggctaaggtaatatttctatgcaattcattaacaaatgttgcagtttgcatacctttcaccagagcagtagttgaaactgcaaaggtagtaagcattgctatcatggcagatattcctaaaataagagcagccataaatcttttaggcctagttagctcattaatattttttacaacctctaaagtcgaattataccaagattcttcccctatatctactggcaggaaaacataagcagggcgctttacaatcatcataatagaaaaatccttattaattcctgaagatatacaattagtaagaatacaggatttataattaacataataggaatctccttcttgttgaatagaaaccaaggaaccatgccccaaaagcatggcatatggatacgccaaacaaactgtaactggggtagcctcactaatcacagccttaggtttcttcaaaagaatcatattagcagaagggtacattctgaataaatgaggatggcctgaataaaagttcccatctttatctttatgataccaaataggactgacctaaggaattacttccttaggaattagaaatcattacaatcattgactctaggttctctcttgattattctatgagtcagcattttaaaactgtagaacctttactcctagaaaataaaaacagaaatacatttgtttttgtttgtttgttttgtttttaaacatagcagctcctatgtatgttgcttggatgtactttctggacataaagattattttattattatacctttctctctctctctctctctctctctctctctctctctctctctctctctctccctccatccctccctccctcccttccttccttccttccattttttcatactccagattttattgccctcctggtcaatcctctgagtgttccacctcccacacttcctgcccacctctctgtctccataaggatgtcccctcctcctccccacctgaccagacctctaaacatcctggagcctccaatctctccaggggttagatgcatgctccctaattgaacccagacccagcattcttccactgcatatgtgctaggggcctcttatcagtaggtgcatgcttcccggttgatgatcgagtgtctgagagatcttgggggttcaggttaattgagactgctggtcctcctacagggtgcccctcttcctcagcttcttccagctttcccctacctcaaccacaggggtcaggagcttctgtccatttgttggctgcaaacatctgtatccaactgctcttgggtgtttcagaagacagtcatgatagtctttgtgactgctccatagcctcagtaataatgttaggcctaggggcctctccttgaaaggttacaaggttgtggggaataataatcttatattgggtcggggaagaggactgaagccctaaggccctgcatatgtataattattctcttacccacttgtaggagttctctggaatttcattaagtttgtttctgccttctttgaatttctgtgcttgttccctctttatgtcatttgtccacattgaatggtgttcagattatattttgacttttgcctcttgtgtttgtttcataatttatttgtcatgagaattggtattgagttagtgatttgtggtatggtaattttattaacattgtcaaattgctttagctccagcgtcttaattttcttttgctgtgtgtcatttaggtcaggtggcagggatttccatatcaggtgttgtgaattaactttgagaatcaagggtggtgggcaggaactaggttacagttacagtctaaatatatcattacttactttcatgagtgcacattgtcaagattcctggtatcattttgctttaatttttttttttatgtatataatgtggtttagcattttctgtaatggtgttgtatttatttcatctttgaattattcagaccttggtctgaaatttcaagaagaattcaatctttgttcttcacagagaccctgggagaaggacagcaacaagaatgagtgtgtgtctggtaaatacaccacaggtcagtgtcctttccacatttctttttttaaaaatctctttttattcaagtcatccaaaagttttaatctctatatgtagaatgttatctaaagggcttattttctatgatctacattctttttggtcagtgtaagagcagcaatttgtattttcagacacatctccataacacttttagaaaacaattatccttcaacctcatctgcatcaaaaaaggtatcttaattacttctttttataaagtagaaaagtgctgctgtcctctgcgcccacggagacaggaacgacatggacacggataccaagttgggttcacacaacagcttctttacttgttctccttcttgcagcttttcttataaaactccccttacaacagcttctcttactacaactagcttctacttagggcaagggctaaaaaacaaaactcctatccttgcatctttggatctcatctagctccaccccacctcatccaatcagaattcacacacgctccagctcaggtcggctgacaggtccggatcacaaggaatagtccagcctggcaggcagcccacgcatgcagccacactgtgcatgctcaggcaaggcagtaaacaacttggcccatgcggccacacccgcttcctgcagaaaagctttttttttggggaggggggggttcgagagttgtagccctgtctgtcctggaactcactttgtagaccagactggcctcgaactcagaaatccacccgcctctacctcccaagtgctgggattgaaggcgtgcaccaccacgcctggctgaaaagcatttttgtccagtatcaaataggtagttttccattacagggtctgttaaccttcaaggacgtggccttggacttctcactggaggaatgggaatctctcagttttgctcagaggacattgtacatggatgtgatgttggagaattacaataatctgttatttgtgggtaagaataaacttactgttgaattcctgtatctttctttaggttttcctactatgtgcttttgtaaatgctctgagatatgcagagactcctgaatgagagaaattctagttaaaaatcataactttttcattgtgtttccttcacatttctctgctttctttggaaaaataaccagtgctatattctctgagatcactccttatctcttatctagcttcactcaagataaaaaagttcaagcaaaaatttaaatatccagaacaagaaattatatttctatacatataatagtttcaattataaaaatcttactattgctttaaaatgttcccttatttatgaatctaaaaatatacaaggtttcaagtggacatagagctgttgttttgcacaatttttttttatttaactttttgacatttgatctctgtgtttagatctgggacaccataatctttatcctagcattttggatattgaagcaaatctatttagtaatttccctgaggctatcagttatatcataaatttgtacctgaccaagtttatacctgattcagtgttactctgaataaaattataaccataaaattagagatattttgtttagaattctactttctgaaaattcactagagaaggatcatttatttgtcccagcttatgcaaagtacaattttcttttttattggtcattttatttatttacatgtcgattgttatgccccttcttcattccctgtctggaaactctatatcccacccctccccccccagcttttatgatgatgccccccaccgatccacctactcccatctcatgcccctaggattctcctatgctgggataatgaaccttctgagtaccaagggactcccctcctgttgatgccatataaggcaatccccttctatatataaagctggagccatttgtacatccatgtgtacactttggttggtgattttccccttcgaagctttgtatggtcttgttgtttgatattgttgttcctcctacacagttgcaaagcccttcagcttcttcagtccttcccttaactccttcatgtagcccccctgctcagtctaatggttggctgcagagatctgcatctctttggtccagtctctggatggccttaccttcagcctcttttccatttttttccctctttttccttaacacgggagcaattctgggttattatatttgaggtgggtatgatgtccaatttgaaactgaaatttagcaggttactatcatttccaatcatttgatatagaccatatttgaagttcttttgaggatacatgtaatgattcaaaaaaaggagaaaaacctctcttgagagtacgaatccatgagatcactgattattgaatcacttactccttatataagtaattcatgtcacctctaattgcccctccctactttttttcagaaaatcattgcatatgtggaaagtatgagaaggtcttggatcaagacagccagtacattgtccatgaacacatgaatattcaagagaagtcttctaaatgggacaaacttagcaatgtgatacttgaagccccccaatgtacaccttacaaaactaatcacacctctgatgctcttcaattttcgaaccaaaaaagacttaagcccaggaacactaaagaagtttgcaaatacaatgactctgtaaacagtttaactttgttttctaccattagtctcaatcagggaatccacatgcagaagaaaaaacacaacggaaatgcagaatctgagaaggcttttatttctaaacataaagtcatggtgaaacgaaataatactggagtgaacccttacaaatgtagtaaatttgacaaatatcttacccagagagacaaacttcaaagtcagcagagaatttatcatgaaaagaaacattacagaagtagtaaaagtgacaaatgctttacccatcagatcgatcttagtatccatcagggaattcatgcagaagagaaaatttataaatgtagtgaatgtgacaaatgctttacccacaaatttcatcttaatattcatcagagaattcatacaggagagaaaccttacaaatgtagtgaatgtgacaaatgctttacccaaaaatctcatcttaatattcatcagagaattcatacaggagagaaaccttacaaatgcattgtatgtgagaaatgctttactgaaaaaggcaatctgagaattcatcagaggattcatacaggagataaaccttacaaatgcagtgaatgtgacaaatgctttacccaaaaatcccatcttaatattcatcagagaattcatacaggagagaaaccttacaaatgtagtcaatgtgacaaatcctttactgaaaatggccatctgagaattcatcagagaaatcatacaggtgagaaaccttacaaatgtagtcgatgtgacaaatcctttactgaaaatggccatctgagaattcatcagagaattcatacaggagagaaaccttacaaatgcagtgaatgtgacaaatgctttactaaaaaattcagtttgaggattcatcagagaattcatacaggagagaaaccttacaaatgcagtgaatgtgacaaatgctttactttcaaaggcagtctgaggattcatcagagaattcatacaggagagaaaccctacaaatgtagtgaatgtgacaaatcctttactgaaaatggctgtttgagaattcatcagagaattcatacaggagagaaaccttacaaatgcactgaatgtgacaaatgctttactttcaaaggcagtctgaggattcatcagagaattcatacaggagagaaaccttacaaatgcactgaatgtgacaaatcctttactgaaaagggcaaactgagaattcatcagagaattcataaaggagagaaaccttacaaatgtagtgaatgtgacaaatgctttactgaaaaaggccatcagagaattcatacaggagagatagcttacaaatagtttgtatgtgacaaatacaatacaatgtcagtctgagaaatcatcagtttttaatacagtagagaatatttataaatgaagtgaatgagacaatcctttaccaagatatatcatcttaaaaatcattagagaatacttacagaagagaaacttttcaattatatcgaaggtatgaatcctttactcttggcctatttcctagaatgttaacagtgaatacttacaggatacaaacttaactcatgcattgtatgaagaaatatctttgacttcatttcaggtcaaagagaatatctaataactttttaggcaaagtatttctgttggggaaagtgtggcctgtgttttattcacgttctattcttgacaacaattgaggctccacactagagaattagtatgattatgaaaatcatgtgaaaactttcatgcaatgttcaaatcttaaataatgtcaactattttttgcttgaagaaactctgaaaatgtaaaaatgtagaaagcttttcatgacacctttttacttgttcacccttaaatgttacaagatgaagacaagttgggaagtgaggagatattattgtgtaacacattcattgagacagaaataatccatttcaaaaggaaactatttaaggtctttaatgcagtcctaaaaatatctaataaaactggtaacattctgtgtatttaattcaaatgagccaattgagaaaaattatacttaaaagaatatctggcaaactgagccacccagacagcatattctttatcctataaatatgcttacagatgttacgtgtgcttcgagtattcagtaataataattcttctcaaatgcttggttcacattataggataacaactgatcattatttcccatttattgaacgaaagtcctataggtctctgaaaaatgctgaccgttgatacatattacaagacattgtggtgtactccactctaccgtaaggaataaaatagatttccattcttttcttaaatcatctacggaatcttaatattttgcacatctcagaatatacattctgaagaaaaacaacagcttttgtaactaatagcgaagtcattaacatatgctgcagtgtgtatactttgcactaaggacacagaagcaattgctgtaaccataatagaaactatcaggacagccattcctgctaaaatcatgcctatggcccttttagatcgcaacaacaattctgtggttgcatgctcaagaattcctaggcctttatcatcataccaatccttagttaaattaactggtaaataaacataatcaggttgcttaacaatcaaaaaattacttaaggtataattaacacagttagttatttgacaattagtacagttaacagtattattatctatcaataaattcccactcaaagaagcctatggctctggaacacacgaacatacaaaaacttcagtcttattgtgtttgtcctgaaatgccatgatattccacataggaatccaggtaattgtggacgcccactcgccagcaagtaagatgccacaacaggatccttctgcaacatgtttattgggagagcatggactgcgtaggcgaaagaccccgagccccagaaatggtgctacttatataggcctagggagtgacatgtccataactgattggttatgctaccagtacctcattaatatgcctcgagccaggcagtgactctgcaaaaaactctggcacatgcgcacattggttgtttacccatattcatgggcattggcttactgaaaccagtgccatcttgtaatggcgtttgcggcttcccacatctccccctttttattgtaataaaatgatgctggattaggcctatgcaattatgtccatccgctacggctcctgttttaggtcgttcctctgtgtcacagccttacccgtcatagggtaaccctatcgccaccaggccccgtgtcttaggttgctctgtgcatgaggaaagttgcccatctttggataatgcaatgctgtgtgacagtaattgctaaatgacttattttgttcgtcctgaaatgtcatgatattccctataggaagccaggtgatgttaattcttttaactgttatcatcccaagggctgcaatggcttttcttaatgaagaaaaataagtttcattattttttgtcccaattccatgaaccaaattaataggaggatgattagtataatccaaaatattccaatcacacagggtggtattagagcaaaggcatgaaattgtaatatatgtccatcagaatactctcctaaatatttggtttgattgacataaacagtaatatctacagtctcatcccaagtgacaggatgaattataggtggatttggaacatatgcccaataaacttatgcagagctgcctcgatgtaacatccagataatgctaatcaatagggcaatcagctgtattcgatcctgtgctgtcatagacgttatcattcgaggttcctggcggtggcgttgaaaagaaagacgaaacatctgtctttaatattcccatcttggttttcagcatggcgtacacactgggttggcaaccacctaggggaaggtgtgtctgttgggaaaacataaacatacccacggccccataaaagtacaggatctgggctgtgtaatgagccgtccatcggatctttccaataaactaaaggttttgctttgtcttcgggatgccagtgcctgtcagctgcagacaacccatcagcatccaaagttaaaaaatttaaagtaaacaacgtatgagttagaaagatgaattttatagtaaccacatttagccaaaacaataggatccaaaactaaagcttctcctaccaaagcttggccaatacaatcattgcctgcagttgaaggtctgggaagatcagaatgaacttttatatgaccaatttatatagaattttttttcaagcaagaatggtgtttgttccacaccacctccagtaggatctttgtgacaagttccacagactgagtgaggcaattgacgtcaaaaggccctgtaggtgtatgagtcatattaaaaatcaacaaatgtggactggtgagatggctcagtgggtaagagcatccgactgctcttccgaaggtccagagttcaaatcccagcaaccacatggtggctcacaaccatccgtaacgagatctgactccctcttctggagtgtctgaagacagctacagtgtacttacatataataaataaataaatctttaaaaaaaatcaacaaatgtaaacgcaaagaatcatctatataagtaacaaactgtttttcagtagctcttttctacttgtaaggccaacaagttaaaactcaaagagaggtaggatcagcactccccctaagaatatcaaataagagtttcaattctcctgtagtaagctttaaataaggatgaagccaattaatatcacttgacagcttttgactatcatttaatgtttttaaattgtccttatgaataagtattttctgagagaaagcaggttgatttgtaagcctaaaacctaaataattataagcatcttaagtttgcactttttttttttttggagctatttgtaagcctttatcaggtaatgtttgtagtaaatttctacaacatagaagcaagttctgaggattgttccctgcttataagatatcattcatgcaatgtataatgtatattattggttattgctgtctactaggttgaatggcttgtgccacaaatttttgtcatagtgtaggactgttagccatgccttaagaaagaactatccattgatactttttcattggctctttaaaaatagtagaaagaacactgaaagcaaacctttcacaatcctgagaatgcaaaggaatagtaaagaaatgatcttacaaaatctattgctattttataatatcctttatgaatgtctccaactgcttgattttttttaagatttcaaaacactgactacagcacacaattcaattatctgtgccaaagtaggagtaaactccaaagaataaacatgtgatccaatcacatatacttctttcccatagaagggctgtttataaatacagtggatgtatttttttatgggatgcatgcgtaaaattacaggaattacaaaagcatgcatagaagcaattttaacaacttttgtgtaatgattatcaattttacctaaagaattactatgtcagagacgaaatctcaatattctgcaataaccaatttaattgctgtttgagacaagaaatagacatctcatcaggtttttaagatttttaaaaaaatatcttcatgattttatcttacaaattttgattaacaccacaacagcttcataatagcatgttaaaactttacttagagatgaagaaagatgattccacattactgttctcttaccaaagaattgctgtgggcacattgagatacaataactaaaataagcagctaatgtttaattaccactgattacaatagataacaattgattacagaagcttcctctattctatttagagtgggcagaccagaatgtaatgcctttagaaattctacaccctcattgacatttcatatatctaagtttaaactttattttgagtaacatctgcatagatctgtaataatgttttgtgttaaaaataattctcgggctggcaagatggctcagtggttaagagcgccgactgctcttccaaaggtcccaagttcaaatcccagcatcccatggtggctcacaaccatccataacgaaatctaatgccctcttctggagtatctgaggacagctacagtgtacttacatgtaataaataaataaatcttttaaaaaaaataattctcaggaggcaagtagaggtgaaatcccaaaacttcactgggcagggtttgcaaaaccgaagaaacgccacacctgcctccatgaggctgctctgagctttgcattacctcaaatataatctgagcatactgccagagtcctggcccaaagattatcccttctgcagtgaggacagattccaggggaaaaatttgactgtatgtctatgcttctaatttttggacagtctttcataagatgatttatacttaactttagtgctggaagcattgcctgtactgtagcccctgcaagcagcaacgatagccaaactgattgtatgagggtccaatttctacacaaagatgaatatatccagataagtctgtctttgctttgtatggcctgatgtctacagggagctgcattagtgttctcataaggtagacgcttataatcatcctaattacaatatataggtgagttaaaaatcatgagcttgcgatcaaactgcactcagtgaaacactgtcaattttaatcataatttttaagtttcttttgcaatattagaatatatccttaacttttggaaagcaaaactcaattttaaacaatatagtctctttaaaatcaataccaaaaatcatcaccttcacattatgaagtttggctacctgttcttatatatgaatgcatgacagtgcagcttttcatacgtcattgaagagacattgctttaatttctatcctttataagtctactttctagaataataattacacaaaatattatcccaatttagaagtatctttaaaaacctgttttcctgggttggctcatgccatgtgttgtttagaatgactccaaccttgagttaccaattttaagctaactttctgttataagcaaaattctgttggcccctttaagaattgcttgtgtagataatcagcctctagcagggcttttccacctctacttgactcccaactgcagtgcagtgtaacttatcagtttttgctatgcaaattgagactgcctttgaaacaagttaaactaaatcaaaggatggacacccagcagataaagttttaaacatttatatttttcaacatgaaatacagaacaacactcattcaaacaacaaaacaaaaacaaacataaattgacagacatatggacaatttggtgcaccaagaacagacaatagacagacagggattagaacttgatgtctcaaagggacccagatatcctaaccagaactaagaatatctccataagagacagagaggaagcaaggcgtctcccgatttcctcctgtccctaggagagctctaaaatagcttatttccatttttcttctcttttgctaaaaggtcccgaacaggggataactgcttttctgaaacctagtctctctatctttttctctctcatgttcaaagtctaattctttatctccttcttctgggaattctgccagcaaagggtgaggagtcacagtggtagcttctgatagttgctgcccagtgccctgcttttctaactctcctaattactcctcaaacttgtcaaattctttcatatatatatgaatacacacacacacatatcattcctacttctgggaattaagaacaacgtaaatgtaagaatttttctaacacctgttattatgtttttgtagttttgtgttttactctttatttattttattttattttaaaccctattcctcccacctagagcagctcttggctgtgaacaaattttcttaacccatgttcctcgtgtcttgagggattccttgagatcctgttaaaaacaattcatgtctacttaatgtgtgtcccatattctagccactcttcctacctttctcgggtttactgtcgatggagtcccccatgcccatttctcatctcctgtatctactctcaggcattcctttactaaggaccacaaagtaaaagcttcaatgggcaccttttcaggaccatgagcagcctaaaagcttctaattcgctcaccaattttattccatgtttccacattaatagtaccatccctaggatggtaggcctggtcagagtccctcattaacttgtaccatgaagcttggccacaggacagcagtagatcctctatttgggggattcaagagatcaaatgactcagacagctggggcattactagctctgcactgccaccccagggacagacagagccctagtatgggaaatatttattttaggagaatttatttgtctccaagagaacttactgttcctcttacaaagaacagggtattttgtgtacataatttgttacacactcgatgcccactgctgcaatctctacctaagttgataagtcctgcagagtaacttcagtcaatgtcaaatggtaacaacaactaaatcaaacagtagccatgaatttgaaagcactgtgtatttaatgcaaggtaaatgaaaaagaaatgaaataacatctgattggctctcccggaacacccgcccccttctcatcccgccgcccgcccccctcggcacgcccacagcggaggaaggaactgagcgcacaggcgcggtgctgcctctctcagctggtttcccgccctccttccttccctcccagtcctctcgcccctcctcaggcccgagcatcttcctccttctggcgccatccttagctgagctttcgccagggaacgtcttcctagtccctcaggcagcggtgcgggcgcgaccctgctctacgctcgcggttcctggggaggagcgtagcaccagagcacggggggagccgccctgccaaccgcgcctcggcgaccccgtggggctgaggcgacgccgcaccccgcagcctgagcgcacagcggccttgacccagaactcggagccgtgagcgccgcccccacccatccggaccgcggtcatggccgagaccgaggagcggagcctggaaaacttcttcgccaagagggacaagaagaaagaacggagcagtcgggcggccaacgttgcgagcggcacggacgggagcagcgcggcggcgggctccaggccgggcaatggccggagctcggtctcaggtgccaggtcgggctacttagggagctcgggctctggtgctaggtccagagacagcgggagcgcgggcccggccgacaaggccataacgaaggatgaaaatgagtggaaagaatttgagcacatagaggttgattacagtggattaagagttcaggaaatgcaaataagtgaaaagcaagatggtgataatgagaagagagaagatccaggaaataattgggaagaaggtagaggtggcagtggagcagaaaaatctccaggtccctggaataaaaccgttctggtacaagcgcctcctgctccagtaacagttacagaaaccccggggccagcaatgcccagtggtgtatttaggcctcctgaggcaaggctaaccacaacatggaaaactccacaaggaccaccggaaatatacagtgacacacagttcccatccctgcagtccactgccaagcatgtagagagccggaaggataaagaaatggagaagacctttgaagtagtaagacacaaaaatagagatagggagaaggtttcaaaaaaccaggcccttaaacttcagctagaccaccagtatgctgtgcttgagaatcagaagtacagccacacacagtataggtaaggaatggtctttgctaagcctaccaaggtaattagaccacagctaaccaccaagaacagccagtcatcgttttgatttctggatctacagtgactgactgaatacctcaagtccagtgactgtccctgttgcattatggaagttcaagagtcacgactgatcttgatgtgtgttggatttaggagtgtttcattgtcttaagtatttgtgaattagattcaacagtgtttccatagttgctctgcgtataaaaccaaacctgcagccagtggccattcaaacatctttatgttcagatactgagccttcgcaaggttgactacctcagatttgctgcccttagttatagatttcatttggatcacatcttcgacataaggttacagctactagtgtctgtgtgaaccttgaaaccaactctactggattcctgtcagaaagccttcagaagtcagacatctgggttctgatctgctgtaaatgatgaagaggtaagtgatcttaattaacctgttctgtgcctcatcctaaggcaaactctgtaggctttgcctatgttagactccctggaacaagccactctcagaaatgatgtgtttggatcatctgtgtggggcttatgatttataatttaagtttttatttgtatgagataactgtggatttaattcaaccaaacttgggtccaccaaatggggagtgggtgggggatagtcttatttctttgaataatttttcattcagatagtgttgttcggttccacattaagaccttgctttgacttggagtaagttctttaagggcatattgtgtggagaaatagtctgaaagaagcattggaattgtaaagtgccctaaggatttgccaatccggaggtgaaaccagatagcctttgatacatataaaggacagtggatctgctgcactccaggtgctgctcaagcctcctaatcaggtctaattgaattgctgtggacgaagtgtggtgtctgatcactgctgtggacagagtatggggtctgctcaggaggagagggtttcactaacctggcttttaacagttcaaagcaacaggagcaaaacacccaagttgtgcaagaatctggcatagtgtctgataaatccttgtgtgtgccccaaatgtgaaggttataggctattctgtagatccattcattgtttagccagctcttgacattcaccttgggaatatgttcggtaatcacttggagacgcaggggaatagccagtaatgtagcatttctgttgttaataatttcagtttaactatctagtagtacttggctctcagaaaagtttactgctaaatttctttctacctaatgaaatagcctgtcagttacctactttgtcactacagatggttcagtacacatactctatgttgacatatgactatgtgatatgatagtagtgcctgggtttctctctgtaaacgaatccctttgccaaacacagttcagacttgctcactactgacaggagtgtaacaagaaatggatgttttcccagcttgaagcatgtttagtggatttagggcagcagtgtgggaagcaggaggtggaggccagtgtctcctaccagactgtatgccacttctgggcaataatgctggcatgacctgaaccagctaggaggaggtggggtgattagagacttgagattcttagttaaactgaagacttcatttgggcaccagaaaccttaacaaataatctcacaccttgagccacaaacttctattaaaagatgctttaccccagcgtgacacacaaacacactttctgtttggggttatggtttaagatgtgaacagaaacaagatgaggtttatttaatgccatactgtactggaacgctgaagatctgcagcagatgtaaattccaagtcgtgttattttttaacattgtgaaattatcaaaatgcacatgaatcaagttttaataacactgtctgggtggatgaggctgtccattgcaccatttctttctttgggttctcaggcatggttcctacagtgtaagaactctgtaacatttaacaatgaataaatagtaaacctatgggaaaaaaaaagaaaggaaataaaaaggaaaggatatggcttctcctaagtatggtgaagtagaatgtttcttatcaaaagaaagagaatagctagacacaggaacagtctacaatggacagaaccatgagcctcatgaggagagggaggaggcaaagccagaccaagaggccaggagggtaaatgatcagtaaaaaagaccaggtagccaaatggatgcgttacatgaggaagagcagctgggaggacatttgcccagcctctgtgctaggtgtctggaaaggacagcaatgcactgtatgtaacaggtagggatagaggactgtttggagaacctggaaccaaggactgatttgatttgttaattaggcaccttgaccttttgttccaaggtttaatattcaacattagggaggactgaagagattgaaatgatttaattgtaatctcaaaagttattttttaaaaaaatgaacgttcttttatttcttctctgcctaaattatcaatggaggtaaagggagggagggacttaggtgggagaagtgagagggagggaaaaaggggagcaggatgagttatgggtgggagacaagagagcacccagagggccagaaaaatgaatggaaatatggagcagtagaatttggagattggagagaaacctctagaaagtcttatagacctggggtgttagaggcttcctagatcatgccatgtctccatattgatgataatgaactgaacctctgaacctgttaaccatccccattgaaatgttcttttgtccttataagtgttgccttggtcacctgtctgttcacaacagtaatccctatgacagcaattcttaataatagagcttgatgaaaggctaagctacaggagatattgctcaaaacagacacatgtatgaaagtagctgatcaaaggaataaaatttttcatggctgggaaacattaggaatagaaacaagtaaaaagtcagatcagagatgcatagaggtaacaaaattgaaagatcaataccaagacaatataattgtaaaattcccaaggtacaacaactttattttggtaggtacttttccctcaagaatttgagaagtttaatcatgagaaaaagcaatgtcattgtaacagggggcacagactggaatcaaggtgacctaagccaccacagcttatctcagaatcattattgtaaatatttctttttgtaaaaagattgcagataaagctgatggaaatactatatgttgccagagtgaaatcactccatacacaagcagaagatgaattaagaaaagttgctttagtgactgtgtgctttcatgacaggctaattatcagactcatcagcctagcataaatttgaattcaatatatgctgtcactcttaagtttcttttaggttgagttcacagattatgctttgaacaagttaaatatggactggagactgcatatctaggctcttaggcagatggaaaatttacgtagtacagatattgtaagagtcgtttcttacataaccattttcctaaaaaaaaaaacccacaaagatagcagtatataattttcatttgcacataatttttattattcagccgggtgtggtggtgcacgcctttaatcccagcactcaggaggcagaggcaggtggatttctgagttcgaggccaccctggtctacagaatgagttccaggatcagccaggactatacagagaaactctgtctccaaaaaaaaaaaaaaaattattattcaaattgttttgttttcctccatgttgggatgaccatatgtttgtaaaaaagacaatattttgatgtattcccaaccatttttgaacatctgttagaaggctcagagtgaaatgtttatagggtgcaaatctaacaacctgaccttgatcactatataacaaatgtccatatttcctctcttgtcagggcactctgggggagtcagcttgtgaggcagaaatgccaaaaagctgctcatgagaaatgaatttctaggtctctcctcctggatattctggcgaaagccaactctccagtttggatcggtttgtcaggcgaaaagcctggaagctgtttcacgaggataagagtccagggaaattttcctcccagagttatggcatctctttccctaacccattatattcaaatttccaccacattaatctagtgtatagattcacatgcactctatatagtattaccttatagtaaatgccttttaagactgtattctaacatagctaaagcctttttccattgttcttagattccagatagcagcaaggagcttaacctattcagtaactaattagccccaccataaaacaataaaagatctgtcatttactcagctgtctgtagatagagactaaaagtctcactgagatagaaatcttttactacaggctacattccatgtcaagtataagttgatatactaccctgataagggggaactctcccgacaggataagttttactagacctaagaatttagagctcctgataactcactactcttaaggcctatcaagagttaacaaccccctgatgcttttaggctgatcctaggcagggcttgttatccctaatgtaaacatttaattagtccctgcaaattcctttctgctgtaactggtgaatttcagtgtatcttgtctttttgtgacttgtatcctctgataattcgttgtaatataagtctgaagctcaaccagaacattacattcagatccaacaccattctagcgtgttcgactgtctgtcactacatcctaatttgcccatctactctagagactcttttctacacgggcacaggggaccagagggcctgctgcactctcttgaatattttgttccccaatctaggtaggactaaagcatccacactttgatcttctttattcttgagcttcatgtgtactgtgagttttatcttggttattctgagctgtggagcagagaatgacagaaaagccatcaagacgctgacccacctgggaatccatcccatgtacagacatcaaacccagatactaatgtggatgccaagaagtgcttgctgagaagaacctgatatatctctctcctgagaggctctgccaaagcctaacaaatacagaggtggatgcttgaagccacccgttggactgagcttgggttcacgatggaggagctagagacaagacttaaggagctgaaggggtttgcaacccataggaagagcaacaacgtcaaccatccaggacccccccccccccccccagagcttacagggactaaaccaccatccaaagagtacacatggaaggatccaaggctccatctgcctacgtagcagaggatggccttatcaggcatcaatgagaggagaggcccttggtcctgtgaaggctccataccccagtgtaggggaatgtcagggtggggaggcaggagtaggtgtgtgtgggagcacctgtacagaagcacagggagggaggatgggatagggggcttccagaggtgaaaaccaggaaaggggattacatgaaatataaataaataaaatatcagcatcaaccaacattagccactgtgaaaattctctggcactcatttgcggtctgagaatgaaacaactatttagacttaagtatgaactaatacacttgaaaaaatataattgaagcataaaaatataattgaagcataaaaaaatgtccagagtacatcctacaaagttgttttccaatttgcacatatctgtcctggcctaaatccttgtaaaaatacacacatacacacacacacacacacacacacacacacacacacacacacacacacacacatgaatgcattcattcctgttaaggtttcttaaagcctatctacagaatttctcttcagcatgaatttgttcatgtaacagataccaagcaacaaggcttcaagtcagaaaactcaatccttcctcgagagtgcgatcataatatttgaatagattgttgatccatatcagactcctttcttcagaatcaataatcttgtgttaccgggtacaagtgtgttacctaagaatattagcaaatcctttatagacatatattcccctcagtatgcattttttcagatgctcaatactacagtaatatgcaaaatatctaacacgttcattatgcactaaagtttgtactcttgtgtaaagctatctatcaggaggtaaaattcaggtacaggtttagctctctattggacaagttaacaaaagcagtttagttaaaaagaccaaagcccctgtcatttaggactcctcggactcttccttctttgcttccactttcttctcctcagctggggcggcagcagtggagggagcaggaacaccagaaggtgcagctccagcagttggagcaggcccagcagccccaacattgcagatgaggctaccagtgttgacattggccagagcctttgcagacaagccaggccagaaaggttcaagctgacaccagctgctttaatgagggcattgatcttaacttctgtgaccatcaccttgttgtcttgcaggatgagggcagagtagatccaggcaagctcggagacggacaccatgttgcggactgctggcaaggtgttagtcgctggatgatgtaagggcctcaccccaacgtggcattaacaaactgaacacattaacagggtttctctgtagacatcccaatggctatcttaggaagctgacagtgacctatggggacctgtgctgccccatgcccatgtatgcttcacccgtgcagtgccttcctggctgtgttaaatcaccagtgctgtggactggactcagtcgacccctcaactcgcaggggcccctcaactctcgggagaatcagagtcctggtacacaggcatgaaggaatcagcagggtgacaaacagatgcaaacacaagagagtgttgatctgaatgtaatttctcaaaggaagcatcagacttatgatacagaagaaaataaggaagttaggtgacacatcacccaaggtacattgaggttacccgatgcttaatgactctttacacaaaaaagaaaaatgcatacataaagactgacaggaactaggtaatgtaacaactgagacaaagtcatctctatctaaggtcagctatatatctaaaagccaggtgtgaggtcattatgttcccagggctggtcctttcttgcccaaaccatagttctaattctcatttattgtttagcccaccaccagccagctcttagtaaatatctaactatgctatgcttctgggctagtgaaagtatgtgctagggagttctgttctaggtaaccttgtcatgaataatgcaatactctagttcctccttaaaccacatctcgacctacttcctaaagcattgtaaattcttgtaaatgtgagtgactgggctgttattctaagtgattttgttggggactttcttctattaagtaatgtagtctgccatatataactatagtaagaattctaaacttactttgctaagcttgccctgagatttctaactctatttagtagatagtaatgcctgaattctttcactgtctctttttcaatactggaggcaatccgtgttaatcggtaacagtctaatgaaatcccaagtccagggccggctcaagggctggctaggacattggtgaaggccaggaagcaaagttcaacctaatttagatatttgacaaatcattccttggagacactgataataaaacaatactgaaaaaaagcacacagacccattcacctattaacgcaaggacaagtttgaaacattcatgctatgggatgccaaggctccaggagacttccatgaaactttttgcctcaggaccttgtctaagcttttggacttgccacacagatttcactggagtggctatggcacaccagcacctggatctgtaaggttctgcaaagaaaggctttgcacgttcactcttctgcctcaccagtcttgatttctgaacttataaatttgaccataagctacttgtgaagtaaaagatcgaacaaaagaatgagggttggcgatgactcagaagtttaagagcaggggtgggtgtggaggggtgggtgcactggggagaaagctcagcggttaagagtgctgactgctcttccacagattctgagttcaattcccagcaaccacatagtggctcaccaccatttgtaatgggatccaatgctctcttcaggtgtgtctgaagagagctacagtgtgctcatatacataaatacaaaattaaaaaaataaagttaggagcactggcctgctcttgcagaagactcaaaattgattccaagcatcaacatggtggctcccaaacatcttcagggacctgattccctatcctaacttctgagggcaacagacaacaaatggtgtacatatatgcaggttggcaaaatgttcatacttgacaatagaccagagaaatagtgtttttaattaatgggctatctccccaagcctctaaatcacttcttaaaatgccggaatgtatataaactcactggcagcatatccttggcaacctcactaaaactgtgatgtagctctaaatatcacacaggaggagcaatgataaatacttacaaaattttaaaaaaaaagaaaaagactggagctggacacttaaagctagcttcaaagcacaaggccctctcctggcctctgcagctacttgcacctgtgtgtgtgtgtgtatgtgtggcatgcgtagtgtgtatgcatgttcatatgtgtgtggtatatatgtgtgcactttcatgtgtatgtgcagtgtgtacagtgtatgtttgtatgtgtattagtgatgtggtgtgtatgtgtacagtgtatgtttctgtgtgtatgaataacgtgcagcatgtatgtgcatatgtgtaaacaaaaatatttgtctctaggtgtgtaacaaaggtgaataaaataaatctttttaaaaaatgagttgggctggaaatatggcttagcaggtgggagcactgactgttcttccagaggttctgagttcaattcccagcaaccacatggtggatcacaactatttcttttgggatctgacatcctcttatcttgtgtctgaagaaagtgacagtgtacacacatacataaaagaaataatgttttttttaaatgggtcaaaataagtcctatctgaaaactaaaaagttgttctgggctggcgaatggttccattggtaaagaacctggaaaaacctgactgcctgaggtttggattctcagaacctatataaaaggctggatccaggttagagagatggcctacttgttatgagtacctgtttctcctgcagagaaccttggtcaactgtcttcactcacatcactgctcacaacaggttatctgatggcctcttctgaccttctaacacacttgcacacatgcagggaaaacacattaataaatttcaaaaaattaaaaaaaaaagaaaaagaaagaagaaagaaaaatttaaaacctggacacagccacatgcttgtgttcgtgtgaccccagtgtttactctcactctggaactgagaaagcacagacctctagcagtcagggcacatctgcctggcaaacaccactaaatgtcagcgatgtaggaaaatcaccacatgatcaaaatctatgacactgtcctaaagggtttttctcttcaaagacacagggtgcaatctcataaaacaactcatatcaaacatttaataactttagtaagccaggccttgtggtgcatgtctgtcacctcagccttcagtagcctaaagcaggatgacaagtttgatgccagctagtattaacatagcagaaactttctctaacaaacaagggtctgaagagatgactcagtgattagagcagtggctgatttcccagaggacctgggtttggttcccagcacccacaaggtcatacataactattaactcaagttccagggaatttggtgccttcttctggtctctgtgggtactgcatgcacatggtgcacaggcacatgcaggcaaaacacccaaacccacaaaaaggggggaaaaaagtaaattcattaaattatgcatggtggtacgtgcctgtaaaaatacatacaaattgacaatgtgttcagcatgcaaagtatactccttaaatagcataacaccatacatgattttaaaccacagagagactggagagacagctcagtgtttaagagcatttactgattttgcaaaggacctgggttcgattcccagtatccacacagctctggctccaagggatatggtgctctattctgacctttgtggacaccagagattgccatggggcaattacgcaaaataaagctaaagaaaaatatttagctgaataaagtttgaaggttgaaaaaaaaaagtatatcaaggccaaaagttattcccccacaaagactgctcaacgtttctgtagtctgtgcaggtgaatgtaaggaactaagagttgctggagtgatgagaaacaggcatttgatcaccctgacagaacaggcagataactggtccccagggccaccacactaactgtgtcctgaacagtgttcacttagtccatgtgtgctccatctctgctgtgtgtgtcaagacagtatctgcctatctgcacaaggcatagcacataatgatgcaattaggctaagcaattctccctttgaccagtaacatggcttactgttagctaccttgattattacaggaagaacatgtgcctggagccacaaaagctcttgactaccagagcactttatgagaggtcctgtcatccagccacacttaagttgctccctctctaggccaggcttgtggacaatgcacagcttagcctgcatacctgcaaagcacagcagtgaaactttatccagttcgatggtgtgtgtggtggtggtggtggtggtgggaggtccaccagcaccatgttatcattcttggtgactctcccgtggtaggtcagctcgagccatggcttgtgcttgttaactggtgggagaaaaagggaagcaacagtaagatgcagatcactgcttcagcgttctgctgcctttgaagatgaacatgtgtcgtctagcttccacacagtgcacatacacacaggaaagcaaagccagaggcacataaatcaaagagagcaaagagactgatcatctgaaaagggtgaactgtggtttgattatgggagtgccccatgtaaaatctaacccagatcatgaagacagaaattgactccttccctccacaagaggctcctgcgacatgagctctgacagagcgacatcaggagggtcatcattcctaccctctgtccccaaggaggcagaatgggatggcacaatagcagggatgcctgagggctttgacggaatccagtaaagctcacggcagtgcgggccaaccttcatcaaaggttcatggaacagaaggcacctctactatgcaatgggagatgggcaactcacccactgctgagacctcagtatattttatatgaaccacactaagaaggaagctgggacaactcgggggatcagctcgtggcaaactgctcacaaacaatgaagactcagacacatctcaccatcctgtagttttagggttctctctgtctctctctttttctctgtctctctctttgtctctgtctgtctctttccaagctaaaaactctaggctggtttcaaatttaaccttcctgcttctgcctcccaaacttctgggatcacagctgcacaccactgaaccccactccagtttttcattttacaagggaaactattaattcagcttgtaaccaatatcaacatttgattcaaacttgtattgatgctttgttttgctaataaaattacaagtataataaaataaaattgaattttattccaacatttgaatccacaagactctcttttttgatttttttggtttttcgagacagggtttctctgtatagccctggctgtcctggaactcactttgtagaccaaactggcctcgaactcagaaattcagctgcatttgcctcccgagtgctgggattaaaggcgtgtgccaccacgcccggctacaagactcttaatttaacatgatgtcaccttgttttttccagaaccacagggatataaaaatagtaagcataatgatgtgtggggcagctgccctgtcctaacacagaatggacaggctcactataacagaaaatctacagctgaaaatggttaacacatttcagagaagaacataactttatgtcgatttaatctactgccattccaggattctaattttataattcacaatttctcaattgctcctttcaagctggcagtataaggagagatatcgccatttccagaggctgaacttttcaataattaatgaatgttatttttagtatttcttcacattgctgggcatggtggcacacacctttaattccagcactcgggaggcagaggcaggcagatttctgagttcgaggccagcctggtctacaaagtgagttccagaactatacagagaaaccctgtctcgaaaaaaccacaaaaaattttttcttcacattcaatttgcattatgaaacatttatggaaagaagcgactgatgtttctgtaatcatcctctctcgaaccaccggaagtttatgggcggaaagtcaaggactccatcaggcatcttgaagccctagtgcagcactccattgcatgccacaacatcaaagccagctacattcgtaacagcaaacctcatgatcacacctgttagagtgtcggttttctggggttactctcaggcaaaaatgatctttgtgactacagatcttaatgattagaaacttgattttagaatctatgaatgccaggcagcagtggtccatgacttaatgccaatgctgtgaggcagaggcaggtggatttcttagtttgaggccagcctggtcttctgagcaagttctaatatagccagggcaattcaagaaaagcttgtctcagaaaaacaagaacaatcagtaagaacagtgaagctcagggttaacttcaggtaggaaagtttatcccagcacatcttaattctgtgggtaaagaaggctgttcttctgcccaagtcacatgaccaagagattctgcctggttattttcagatccactatgtgccacagagcccgacaccaatcatactcgacaagtcttcttctgctgctttatttcttttgcgtgaagaattccatcggctgaaagaaagaatttgacatatgcttcctataccagaatacctatggtggccatactgtaagtttcaaccatctttaaggcatttcaaatataagtgaacctataaaatcccaagacaaactgaatcttggtccatcaaatggctctgcaatcctgagatatcgccaccagggggcagcaggtgctcgggttgacatgcgtgaaattatgttttgattaaaaattaacctctagcccaccccgtggctactaaaggtatatcagcagcccgcattgagatgctcggggtggaaaagtacctgcgactgtgttctatgtcacatgcccacagtcttctgcaaattcagggaagcttccagactcccaacttccaccactctgcttggtaaaagatccccccaaaaaatcatccaaatttgccatggatctgggttttaacacacagataagtctgtctaaacacacttgaaggccgctcaagggaaatgaatggcttatttccctctccagtggcatgagtgacaccaggggtgaggtgaacaacatctagacagccgagatcgagtaaagacaccctcccacccatgtatgacttagtggaccagggagtctgtggagttactcatgggagcacagtgactcgaaagcagcttcagcatagaaaactgttgggagccgcccccacattcgccgtcacaagatggcgctgacatcctgtgttctaagtggtaaacaaataatctgcgcatgtgccaagggtattttacgactacttgtactctgcctttcctgtgaacgtcagctcggccatgggctgcagccaatcagggagtgatgcgtcctaggcgaaatataactctcctaaatagggaaggggtttcgatttcatgattgaaggggctttcgcttttggggctgggggtttgcgctcctagctcctgaagatgtaagcaataaagttttgccgcagaagattctggtctgttgcgtctttcctggccggtcgcgcgaacgcgtataacaattggtgctgaaatccgggacgagaaaaaatccgggacgaaaaaatacaagaaaactcgggaccggcgcaaggaagatccctcattccagaaccagaactgcgggtcgcggtaataaaggttcccgtaaagcagactgttaagaaggattcaactgcatgaattcagaacttttcagctgggggaacagagtaccagtgagtacagctttacaaggtacgcctggccttgaactttctaaggaaattcaagacagtctatcagaagtaaagtggaaaatggctttgcaaggtatgtttggccttgaattttttctagtgttaggagcccttttgttccttttcacatgttatcaggtgattaagatagggctgaaaattctggatgaaattcagggcaatctatcagaagtaaagcggggagagagagtaggagcaaagagaaaatatggtacacaaaataagtatacaggcctttccaagggtcttgaacccgaggaaaagtttaggtcaggtaagaatacctggggagagattagaaggaaggaaaagaaaaaagaaaagaaaaaagatcgattagcggaggtctctaggagatactcgtcactagatgagctcaggaagccagctcttagtagctctgaagcagatgaagaattctcctctgaggaaacagactgggaggaagaagcagcccattaccagccagctaattggtcaagaaaaaagccaaaagcggctggcgaaagccagcgtactgatcaacctccgggcagtcggtttcaaggtccgccctatgcggagcccccgccctgcgtagtgcgtcagcaatgcgcagagaggcaatgcgcagagaggcaatgcgcagagaggcagtgcgcagagaggcagtgcgcagagaggcagtgcgcagagaggcagtgcgcagactcattcattcccagagaggaacaaaggaaaatacaacaggcatttccggtctttgaaggagccgagggtgggcgtgtccacgctccggtagaatacttgcaaattaaagaacttgccgagtcggtccgtaaatacggaaccaatgctaattttaccttggtgcagttagacaggctcgccggcatggcactaactcctgctgactggcaaacgattgtaaaagccgctctccctagtatgggcaaatatatggaatggagagcgctttggcacgaagctgcacaagcgcaggcccgaacaaacgcagctgctttgactccagagcagagagattggacttttgacttgttaacgggtcagggagcttattctgctgatcagacaaactaccattggggagcttatgcccaaatttcctccacggctattagggcctggaaggcgctctcccgagcaggggaagccactgggcaattaacaaagataatccagggacctcaggaatccttctcagattttgtggccagaatgacagaggcagcagagcgtatttttggagagtcagagcaagctgcgcctctggtagaacagctcatctatgagcaagccacaaaggagtgccgagcggccatagccccaagaaagaacaaaggcttacaagactggctcagggtctgtcgagagcttgggggacctctcagcaatgcaggtttagcggctgccatccttcaatcccaaaaccgctccatgggcagaaataatcagaggacatgttttaactgcggaaagcctgggcattttaagaaagattgcagagctccagataaacagggagggactctcactctttgctctaagtgtggcaagggttatcatagagccgaccagtgtcgctctgtgagggatataaagggcagaattcttcccccacctgatagtcaatcagcttatgtgccaaaaaacgggtcatcgggccctcggtcccagggccctcaaagatatgggaaccggtttgtcaggacccaggaagcagtcagagaggcgacccaggaagacccacaagggtggacctgcgtgccgcctccgacttcctattaatgcctcaaatgagtattcagccggtgccagtggagcctataccatccttgcccccgggaaccatgggccttattctcggccggggttcactcaccttacagggcttagtagtccaccctggagttatggattgtcaacattcccctgaaatacaggtcctgtgctcaagccctaaaggcgttttttctattagtaaaggagataggatagctcagctgctgctcctccctgataataccagggagaaatttgcaggacctgagataaagaaaatgggctcctcaggaaatgattctgcctatttggttgtatctttgaatgatagacctaagctccgccttaagatcaacggaaaagagtttgaaggcatccttgataccggagcagataaaagtataatttctacacattggtggcccaaagcatggcccaccacagagtcatctcattcattacagggcctaggttatcaatcatgtcccactataagctccattgccttgacgtgggaatcctctgaagggcagcaagggaaattcataccttatgtgctcccactcccggttaacctctggggaagggatattatgcagcatttgggccttattttgtccaatgaaaacgccccatcgggagggtattcagctaaagcaaaaaatatcatggcaaagatgggttataaagaaggaaaagggttaggacatcaagaacagggaaggatagagcccatctcacctaatggaaaccaagacagacagggtctgggttttccttagtggccattggggcagcacgacccataccatggaaaacaggggacccagtgtgggttcctcaatggcccctatcctctgaaaaactagaagctgtgattcaactggtagaggaacaattaaaactaggccatattgaaccctctacctcaccttggaatactccaatttttgtaattaagaaaaagtcaggaaagtggagactgctccatgacctcagagccattaatgagcaaatgaacttatttggcccagtacagaggggtctccctgtactttccgccttaccacgtggctggaatttaattattatagatattaaagattgtttcttttctatacctttgtgtccaagagataggcccagatttgcctttaccatcccctctattaatcacatggaacctgataagaggtatcaatggaaggtcttaccacagggaatgtccaatagtcctactatgtgtcaactttatgtacaagaagctcttttgccagtgagggaacaattcccctctttaattttgctcctttacatggatgacatcctcctgtgccataaagaccttaccatgctacaaaaggcatatccttttctacttaaaactttaagtcagtggggtttacagatagccacagaaaaagtccaaatttctgatacaggacaattcttgggctctgtggtgtccccagataagattgtgccccaaaaggtagagataagaagagatcacctccataccttaaatgattttcaaaagctgttgggagatattaattggctcagaccttttttaaagattccttctgctgagttaaggcctttgtttggtattttagaaggagatcctcatatctcctcccctaggactcttactctagctgctaaccaggccttacaaaaggtggaaaaagccttacagaatgcacaattacaacgtattgaggattcgcagcctttcagtttgtgtgtctttaagacagcacaattgccaaccgcagttttgtggcagaatgggccattgttgtggatccatccaaacgtatccccagctaaaataatagattggtatcctgatgcaattgcacagcttgcccttagaggcctaaaagcagcaatcacccactttgggcgaagtccatatcttttaattgtaccttataccgctgcacaggttcaaaccttggcagccacatctaatgattgggcagttttagttacctccttttcaggacaaatagataaccattatccaaaacatccaattttacagtttgcccaaaatcaatctgttgtgtttccacaaataacagtaagaaacccacttaaaaatgggattgtggtatatactgatggatcaaaaactggcataggtgcctatgtggctaatggtaaagtggtatccaaacaatataatgaaaattcacctcaagtggtagaatgtttagtggttttagaagttttaaaaacctttttagaaccccttaatattgtgtcagattcctgttatgtggttaatgcagtaaatcttttagaagtggctggagtgattaagccttccagtagagttgccaatatttttcagcagatacaattagttttgttatctagaagatttcctgtttatattactcatgttagagcccattcaggcctacctggccccatggctctggaaaatgatttggcagataaggccactaaagtggtggctgctgccctatcatccccggtagaggctgcaagaaattttcataacaattttcatgtgacggctgaaacattacgcagtcgtttctccttgacaagaaaagaagcccgtgacattgttactcaatgtcaaagctgctgtgagttcttgccagttcctcatgtgggaattaacccacgcggtattcgacctctacaggtctggcaaatggatgttacacatgtttcttcctttggaaaacttcaatatctccatgtgtccattgacacatgttctggcatcatgtttgcttctccgttaaccggagaaaaagcctcacatgtgattcaacattgccttgaggcatggagtgcttgggtgaaacccaaactccttaagactgataatggaccagcttatacgtctcaaaaatttcagcagttctgccgtcagatggacgtaacccacctgactggacttccatacaaccctcaaggacagggtattgttgagcgtgcgcatcgcaccctcaaagcctatcttataaaacaaaagaggggaattgaagagattttaccccgagcaccaaaagtgtctgtgtctatggcactctttacactcaattttttaaatattgatgctcatggccatactgcggctgaacgtcattgtacagagccagataggcccaatgagatggttaaatggaaaaatgtccttgataataaatggtatggcccggatcctattttgataagatccaggggagctatctgtgttttcccacagaatgaagacaacccattttggataccagaaagactcacccgaaaaatccagactgaccaagggaatactgatgtccctcgtcttggtgatgtccagggcgtcaataataaagagagagcagcgttgggggataatgtcgacatttccactcccaatgacggtgatgtataatgctcaagtattctcctgcttttttaccactaactaggaactgggtttagccttgattcagacagccttggctctgtctggacaggtccagacgactgacaccattaacactttgtcagcctcagtgactacagtcatagataaacaggcctcagctaatgtcaagatacagggaggtctcatgctggttaattaactcatacatcttgtccagatacaactagatgtactatgacaaatagctcagctggggtgtaaacaaaagtttccgggattgtgtgttatttccattcagtatgttaaatttactagggcagctaatttgtcaaaaagtctttttcagtatatgttacagaattggacggctgaatttgaacagatccttcgggaattgagacttcaggtcaactccatgcgcttggacctgtccctgaccaaaggattacccaattggatctcctcagcatttcccttctttaaagaatgggtgggattgatattatttggagatacactttgctgtggattagtgttgcttctttggttggtctgtaagcttaaggcccaaactaggagagacaaggtggttattgcccaggcgcttgcaggactagaacatggagcttcccctgatatatctatgcttaggcaataggtcgctggccactcagctcttatatcccacgaggctagtctcattgcacgggatagagtgagtgtgcttcagcagcccgagagagttgcacggctaagcactgcaatagaagggctctgcggcataaaatgagcctattctagggagacatgtcatctttcaagaaggttgagtgttcaagtgtccttcccccaggaaaaacaacacgggaccagaccaggacccctctgggtgatgagcctgggaggaggttatgtgtacggctcctttacctacacactggggatttgacctctatctccactctcattaatatgggtggcctatttgctcttattaaaagaaaagggggagatgttgggagccgcccccacattcgccgtcacaagatggcgctgacatcctgtgttctaagtggtaaacaaataatctgcgcatgtgccaagggtattttacgactacttgtactctgcctttcctgtgaacgtcagctcggccatgggctgcagccaatcagggagtgatgcgtcctaggcgaaatataactctcctaaatagggaaggggtttcgatttcatgattgaaggggctttcgcttttggggctgggggtttgcgctcctagctcctgaagatgtaagcaataaagttttgccgcagaagattctggtctgtttcgtctttcctggccggtcgcgcgaacgctaataagagaaaaccccacctcagggccagtgaggattcctaaaggctacatgcctggagctctcttccggactttcaggaggctcagcacagcatgaaggctaattctgattgtctagttgattggatctggaattaactatgagtcacacctcagtgtgggtctatagaagtgtttctagggtggatgaagattcccagagcagacagaaattcaaggcaaatatactactatttgtttgtctaccttcattccttcctggtgagtgtgcctatcccatttctttgagaagcccagtttttcagcctttcaatatggactgaagcccagagactctccaggaatgcccaaggccttcaacaccagattggaactgctaaggcatccagcatcttggatagaggaaccactgggtccatatcatggaagtcaatgcaaccagtcttccttatcatatgtattctgtctcagttccctcctaaaggaccctgactaacacatgtgttattgtgtgaactcctggagggcaggtgttcctgtctctgtctcccatgtagggagctggcatgactggctagaatctccatctctgaacttctctgatgctcccttctggagcaacaaatgccactatccttgaatcagacaagacagtatgacatgacagagtaggcagctgccctttaagatgcaatttcagctacccccaaaaaaacacacctccacttcccacagctcccatacctacacctcccacaccaaaacctcccacaacttctactcctatatctcccatgtctctaccacccacacctccacctcccacaccttggtgaccgtctacagtcactttggttccacagcaagagttcaggttccatttgcaaatttgacctgcttgcagaggtgctctcgaccttagtgtccccagactggaaatgctgttgacagctactctaactccctctctggaaaatgagaaggtggtactcagggtccctgctcctgggttacaactttgtcctccacctcttgctcctcctccttctctacctcctcctcttcctcacgtttctctgtcctccttttaactcaaaagtgatggatgactgacaaggagcaaatgagtcagaaataaggaagcagaaaaagagaatgatgttgccaacttatcattcagaggtgctctctgagacagagaatcagagcaacaccatcaatcacacagcagacgcccttgcaggcgatctgtggtgtcagccattgcatgagcaattggaccaggagcctagggctacctgctagccaccacagaggaaggaggctgtgtagacacataaaagggggacaattagcccagaggttagagaggacaatgagaacctgctttcttgcacaggttggactccctgtgagtcctacttgggccagactcaaaacaggagagaaatgaagccaggaggtgctcagtgtggaacctgtagccctttgccacactgagggtgggagggaaacatgagttcatctgaatggatggagtcctaggaagctgtatctcggccatggctctgcaaggcgagtgcatcctacatggatggatataagattgagagagcatgtgagaccttttcccccttgccgcagaccttctgggcccctgtgtctgcgtggaacggggtctctcgaagtgggttggcaaagcgtggatgagcgacaaacagacacacacacaggagagttcgtgtggaatctgagtgtaattttacaactcgagcatcagactttttatgcagaggacaataaggaagttgggtgacatatttgcaaggtacaattgaggtaacaggaatcttacataaaacagtggaatgcaaacacaaaaggtctaactggaaccacccaggatagaatacattgataacagctgggatcaacaagggctccacctaaaattcactaatcttagaagccagggtcaagggcttcatgcccttgccatagttcctattttggtctcttgtatagtccaccttccccttaagccattgtaaatacgtgtgtatgggtgtaactctgctatagtatctattctggtttctcctttggtgtgaaacttccttcttcctaagtgatggtaaattcctgtgtaagggagtgacttagcttttacaatcttgctgaattctaaacccttgatcttggtcaaggacgcccttgaactgctggaacactggcggaaggctttagccatgtcagagcacttataataggaaaatactgaaagagagcatgtggatccatactctagactagcgcggtaatggaactcgggaatgaaaaattaatgtatgggtagagaacactagactccaggaggagagcttccttgaaactcttttgcctcatgagtgacttttaagcctttcggcttgtccagttgactcaaccggagagcgtagcatcccctcatatttttatttctttatttcttttttccctttttttctttttttggtttttggtttttcaagacaaggtttctctgtatagccctggctgtcgtggaactcactctgtagaccaggctggccttgaactcagaaatctgcctacctctgcctcccatgtgctgggatcaaaggcgtgcgtcaccactgtccagcctatatttttatttcatactttaaactttattataattttgatgtatagattatcgctgcatattaagttgtgattttttaatctccttggggattggtttttcttcatgtacacacaaattctttgcagagtcctgtaagtacatgaacagagcttcttccagaaaaacatccagtcatttttattatccagttagtagatctgtattttattaggggctagaaaagtttaaaaaaatgtattcatttattggtctataaagtattataaggagatgaataattataattttattttgtaatttgatgtctatatctgttaaggtttgatgagctcattctacaatagcctgtccctgtgtattataggtaatgtcagtggactatgagaaactaagagtcaaacatgaattttaatatgcgttttaagtttaaacaatggtattttctgattttgaggccttggcattataaactaatgaaacaaatactgtatcatatttttgaaagtttccccaggttaggccaaggcataaataacaatgagaattaagcatacatacatacaggcataaaggcaaactttcgaaaagacaggacatatgtaacatttgtctgttttaaatctcagggattaaaacaggggttaaatacccaagctgagctaacagctttgcaggaatgcaggaccagttttctgagtgcaatggtgatttgtaatgtaagatcttgctaagttactttcataggaaaatcaacaagcttttgttaagaaattaaactaatccttaccttcatgtatattaccaaaaagcatagaatgaacttgaacatgtccattagaggaaaggcaatttctaaattgaagggggcctgtccttcatatataaaagacaatgtatctcggctgcatcatggtcaggaagtgatagtgggagagtagtcagagtatttgtggtacctccttaagctgcagttgctgtgccttacagaatattcagcagctagtactttcaacttcaaggtcagagcagctgttgggctgggaaatgggcaggagaagaacaaggtgtgggcaggggtttattttctcctgccactctcacaattctgtcatggatatcttaccattttggagaagtttgagatactatgaacctgggggttttggtgatgttttaattaattttataagttccagaatatttttctattttttaaaagatttatttattattatatctaagtacactgtagttgtcttttagatacaccagaagagggcatcagatctcattacagatggttgtgagccatcatgtggttgctgggatttgaactcaggaccttcggaagagcaatcagtgctcttaaccactgagccatctctccagcccaagaatatttttctaaaataacctcttagatccttggaagtatctgtatttgtacacaggaattctctatgctaaagcctcaataaagctccttgaaatcaaaatctcccatctttcttaactccccatttttctgtttgctatttcatttccctttctccaagggactgaataggcatcccaagagagcattttagatattagtcatatgagggaccattgcagatttgattgaattagaacatgtaggttataaagcaccatcatatgactataaatattaacatttactgaataaagttacactcttcattaattttacactgaggtatatgcaggctttgatgtaaatacaccattcagaatatgtcttcacagatttagatattaatgctacatcttaggtttgaatgaaaatgaaaacaagattgctgcaaattatgactgagaagaacatatattatatgttctgttaacccagagtatcaccagagaaaaaccaattgcaccatgtgacaaactttattaatatttatattgtgactaagatatggactttcatcacaggctacagggagttgtatagggcattgtaatttcctatgaggctttattagtttcctaggacttgcagcctgcagcattccaagaagttacctgtttcttaggctggtggtgcttagagattaatttttggcatttcagtcttagggagaaagcagtctgagttctctggttggatccagactgaaccaggccacataagccctagcctttgcatctgagagtgcttacccaccgatccacccactcctacctcatactactagcatgatacatcactggggcatcaagtatgggaccctcttttttatttcttaatgtcatttgtctcatacattctgttttattttcattcctcctggcatctccacattaggactgaccattcaggagatggtactaaggactcgtttcagtaaaaccccaacaccagtagctcagcaaagaacacacaactcagttacaatatttataagctgcatgccttgggcagatattccactatactattctattctccagcttttagaacccttgctatctgtggcttttcaggcaatgtgttcttctccatctttcttccaccttttcttcctctaacttcctctgcctccttcatctcctcgtctgcttcttctttttccgtctttgcactctctaaaatcttcagccccacttttcccttctattgcccaatcacaagctctggcctttattcgaccagttaaaatggagagaaggttcacatgaaattgcatgagtatatagtccactgttcattggggcagcccctcttgaggaagcagaataagcattaaagtacaaacagcaccagggcaatccacattttgttcaatcccttttgttcaactaaaaggatcttttcttcacatataaattgagcacaactcttgaattatgaaaatttaaaagtaaaagtaccctaaacacccaggccatccatcttctccatttagataaagcactctaccgtctattctaacttaaaaggcttacaattctatacctgaattatctcctggttttagcttgtatctgaaaaccatcctctcaaatctatatcatgtcagtcagtcctaatcatcttgagttagctatgagtatacaacaagtcttcagcacatgtaagaaattgaagcacatcctaaatattacctgaaaatatagaaagcataaaacatagcttccaaaacccaaccaaactatagacacagctaacaacctggacagtccctcactcctcaaaatagtggagcatcagtcttcagtcttctggccaggatcatctgtcagaactttgtaaagcaaaattttgaaggactgcttagcctgtattggcagatctattagttgctcttccaaatagaatgtcctatttctgggcaggagttttgtctgttgatgaagtgaggcaattcttctctgtggctatctcgccataactggagcaactccactgatgcacatttcacatttatacaaagaatgggatgctgtcaggagcagacatgtctctagtcaaatgatatataataatgaaattgccttaataatgaaattgccttattgttgtattctgtggacttcttatgcctttgaaaactatctatctacgcaaagtatatctgaactgttaagccttgactactctcaaccatttctgattgaagtatctcaaaaaaaaaagcccttttataattaaaacaggactatgattctgttacctggcccttaacttgtattttcattaatctaaaaatagtcagtaatagcagacatagaaggactaagtccaagctttttatttttttttaaagatttatttatttattatatgtaagtacactgtagctgtcttcagacactccagaagagggtgtcagatcttgttacagatggttgtgagccaccatgtggttgctgggatttgaactctggaccttcggaagagcagtcaggtgctcttacccactgagccatctcaccagccccaagctttttattcttaaatgtgttgcatgggcacaaatcctatctaatagcaacctattcttatttttctagtattctaattttaataatactatatcctgtctttatcttccctaccacttttatttatctaagaaggaaggctagagaagaggaaaggaaaggtagaagtccctgagtctaagatctctagggattttgttgccctcctttgcctgttacgtatcccgtttagagttttcttagtcttctccacaatctctagtcctgtagggttatatgatatttttgtaatatattttatataataacattttaaaaagctgcttcatcatactagagacatatgctggaccattgtgtgttttgatttgtatggatattcccagaatggccataacctctaacaaatgggtagttacagaatcagccttttctgatgctgaggcagtttcccattgaaatccttattacgtgtctatagtatggcgcacacatttcagcttaccaaactttgtaaaatggaatacatccatttgccaaatgacatttcttttagtacccttacgcttagttcctgaagataatggaatttgattgtataatgagcaagtagaacattgcctcacattttccttggctctttctttaaatctttgctgttaacatgattttttatggaattctaaagcctcttttactctttctatcaatagctggtcaatttcattatcaccttgtgccagagggcctggcaaacctgtatgggatcttatgtgtgttatatatagtggatcactcctgtttcttatcttttgttgtagctgaagaaatagtgaagtcaattcagattcatcctgaatacgattaacagtctgtattggaaaaacaaccctttctgcatattgaaagtcagttactatattaagagactcttgagaatctgacaacactgtgagtattgtacataattcagatctttgaactgatttatagggacattcagcgacctacatcttctgatttatatcctgcctttcctgatttattagtctcagcataacatgtaggggctccagataatggaatttcctttattttatgagggaaaatccacatagttctttttatgaaatgaaatcatttgttttcatggtatctgttattaatctctccaaaaagttactgcatgttctttaccaagattcactcacgttgtgcccctaaggaggcaatctctgcattagtagaaggtaccactattttaggtggatccattccaactacttgtcaatgtctcactttttccttttaatatcaattcagagaccttctccatgtaggtttttcttactgtgtttatgtgctaaaaaatccattcttttattatattcatatatttgtttgtttgtttttgagcctgtttctctgtatagcgctggctgtcctggaactcactatgtagattgggctggcctcgaactcagaagtctgcctgcctttgtctcccaagtgctgagatcaaagacatgtgtcaccgctgcctggcaaatatccattctaatttataatcttccctctgcatgggaattcctggagggatatgggtagaaattaagatgactaaaatgcaggccatatttggacaaatacagtctaattgtatagattccttgcaccttgtcgcttctccaggccacatggttttgttccatctttcttccacctccttttcttccatcttccactttctcctttgtttccttgcttgcctctcctccttcccctcttctccctctctaaaacctccagccccacgtttcacttccactgcccaaatcacaggctttagtctttatttgaccaatttgaccgatttaaatggggagaagtttcacattaaaacaccagagtatgtgatccactcctccttggggcagctccatttgaggaagcagatttagcatcaaaatggaaacagccccaaagcaatccacaacaaatactaccctaaatacacacccatgacattcctccattgggtcaaccctgtgggcacagagccatggcctaactaccatggaagtcccccactaaggacaagacaactgagtccaacattcacttttctccttccacaatttttcccttttttattaatttacccctgtgtctcatctggccattggtagcctcccttcccacttaagggagccccaaataaaatctctttggttcttccttttcatcagtggcatgaatgtcagtttctctgttctggaaaacttctggactaaggcaggagttctatccccatgtatctctctgagaacatgatacatggatgagagctttctttcaagccaagaaattcatagtgtattcaggtgctatggactggactcaggaagtccctcaactcacaggaaaatcagggtattggtgaaagaccccaccataaggcttagcaagctagctgcagtaacgccattttgcaaggcatgaaaaagtaccagagctgagttctcaaaagttacaaggaagttcagttaaagattaacagttaaaaatcaaggctgaataatactaggacaagggccaaacaggatatcggtggtcaagcgcctgggccccggctcagggccaagaaccgatggttcccacctgggccccggctcagggccaagaacaggtggtacccagatgaagcggaaccagcaacagtttctgaaaaagtcccaggtcccccaaatgaccaggaaatatcccaagccttgatttgaactaaccactcagctcgcttctcgcttctgtgcccacgctttttgctccccagccccagccctataaaaagggtaaaaattccacactcggcgcgccagtcctccgatagactgagtcgcccgggtacccgtgttcccaataaaagcctcttgctgattgcatccgaatcgtggactcgctgattcttgggagggtctcctcagattgattgactacccacctcgggagtctttcatttggaggtcccaccgagattaggagacccctgcccaaggaccaccgacccccgccgggaggtaagctggccagcagtcgtttcgtgtctgtctccgtttccgtgcgtgtttgtgccggcacctaatgtttgcgcctgcgtctgtactagttggctaactagatctgtatctggcgagtccgcggaagaactgacgagttcgtattcccggccgcagccctgagagacgtctcagaggcatcgggggccatctctgtggcccaatctgtatctgagaacccggctctttgaccaagggatacgtggttctgttgggcggcgaggggccgaaacgctcccctcccccatctgaatttttgctttcggttttccgccgaaaccgcgccgcgcgtcttgtctgtctctgtgttgttttgtcattgttttgtcatttgtcggttcgttattgttttagaccgtttctaaaaatatggggcagaccgtaaccactcctttgagcctgaccctagaacactggggagacgtccagcgcattgcgtccaaccagtccgtggacgtcaagaagagacattgggtcaccttctgctctgccgagtggccaactttcgatgtggggtggccgcaagatggtacttttaatttggacattattttacaggttaaatctaaggtgttctctcccggtccccacggacacccggatcaggtcccatacattgtcacctgggaggcacttgcctatgacccccctccgtgggtcaaaccgtttgtctctccaaaaccccctcctttaccgacagctcccgtcctcccgcccggtccttctgcgcaacctccgtcccgatctgccctttaccctgcccttaccccctctataaagcccaaacctcctaagccccaggttctccctgatggcggcggacctctcattgaccttctcacagaggaccccccgccgtacggagcacaaccttcctcctctgccagagggaacgatgaaaaagaggcggccgccacctccgaggcttcccccccctctcccatggtgtctcgactgcggggaaggagggaccctcccgcagcggactccacctcctcccaggcattcccactccgcatggggggagatggccagcttcagtattggccgttttcctcttcggacttatacaattggaaaaataataacccttccttttctgaagacccaggtaaattgacggctttgattgagtccgtcctcatcacccaccagcccacctgggacgactgtcagcagttgttggggaccctgctgaccggagaagaaaagcagcgggtgctcctagaggctagaaaggcagtccggggcaatgatggacgccccactcagttgcctaatgaagtcaatgctgcttttccccttgaacgccccgattgggatcacaccactacagaaggtaggaaccacctagtcctctatcgccagttgctcttagcgggtctccaaaacgcgggcagaagccccaccaatttggccaaggtaaaagggataacccagggacctaatgagtctccctcagcctttttagagagactcaaggaggcatattgcaggtacactccttatgaccctgaggacccagggcaagaaaccaatgtgtctatgtcattcatctggcagtctgccccagatatcgggcgaaagttagagcggttagaagatttaaagagcaagacattaggagatttagtgagggaagctgaaaagatctttaataagcgagaaaccccggaagaaagagaggaacgtatcaggagagaaacagaggaaaaggaagaacgccgtagggcagaggatgagcagagagagaaagaaagggaccgcaggagacatagagagatgagcaagctcttggccactgtggttagtggacagagacaggatagacaggggggagagcgaaggaggccccaacttgataaggaccaatgcgcctactgcaaagaaaagggacactgggctaaggactgcccaaagaagccacgagggccccgaggaccgaggccccagacctccctcctgaccttaggtgactagggaggtcagggtcaggagcccccccctgaacccaggataaccctcaaagtcggggggcaacccgtcaccttcctggtagatactggggcccaacactccgtgctgacccaaaatcctggacccctaagtgacaagtctgcctgggtccaaggggctactggaggaaagcggtatcgctggaccacggatcgcaaagtacacctagccaccggtaaggtcacccactctttcctccatgtaccagactgcccctatcctctgctaggaagagacttgctgactaaactcaaagcccagatccacttcgagggatcaggagctcaggttgtgggaccaatgggacagcccctgcaagtgctgaccctaaacatagaggatgagtatcggctacatgagacctcaacagagccggatgtttctctagggtccacctggctttctgattttccccaggcctgggcggaaactgggggcatgggactggcagttcgccaagcgcctctgattatacctctgaaggcaacctccaccccggtgtccataaaacaataccccatgtcacaggaagccagactggggatcaagccccacatacagaggctgttggaccagggaatactggtaccctgccagtccccctggaatacacccctgctacccgttaagaaaccagggactaacgattataggcctgtccaggatctgagagaagtcaacaagcgggtggaagacatccaccccaccgtgcccaatccttacaacctcttaagtgggctcccaccatcccaccagtggtatactgtgcttgatttaaaggatgcctttttctgcctgagactccaccccaccagtcagcctctcttcgcctttgagtggagagatccagaaatgggaatctcaggacaattgacctggaccagactcccacagggtttcaaaaacagtcccaccctgtttgacgaggctctgcacagagacctagccgacttccggatccagcacccagacttgatcctgttgcagtacgtagatgacttactactggccgcgacttccgagcctgactgccaacaaggtactcgagccctattacaaaccttaggggacctcggataccgggcctcggccaagaaagcccaactttgccagaaacaggtcaagtatctggggtatcttctaaaagagggtcagagatggctgactgaggccagaaaagagactgtgatggggcagcctactccgaagacccctcgacaactaagggagttcctagggacggcaggcttctgtcgcctctggatccctgggtttgcggaaatggcagcccccttgtatcctcttaccaaaacggggactctgtttaattggggcccagaccagcaaaaggcctatcaagaaatcaaacaggcccttctaactgcccccgccctgggattgccagatttgactaaaccctttgaactctttgtcgacgagaagcagggctacgccaaaggcgtcctaacgcaaaaactgggaccttggcgtcggcctgtggcctacctgtccaaaaagctagacccagtggcagctgggtggcccccttgcctacggatggtagcagccattgccgttctgataaaagatgcaggcaagctaactatgggacagccgctagtcatcctggccccccatgcagtagaggcactggtcaagcaaccccctgaccgctggctatccaatgcccgcatgacccactaccaggcaatgctcctagacactgaccgagttcagttcggaccagtggtggccctcaatcctgccaccttgctccctctaccggagaaaggagccccccatgattgcctcgaggtcttggctgaaacgcatggaaccagaccggacctcaccgaccagcccatcccagacgccgaccacacctggtataccgatgggagcagctttttgcaagaaggacagcgaaaagctggggcagcagtgacgacagagaccgaggtaatctgggcgagggccctgccagctggaacgtcagcccagcgagccgaactgatcgcactcacccaagccctgaaaatggcagaaggtaagaagctaaatgtttatactgatagccgctatgccttcgctacggcccatgttcatggggaaatatataggagacgggggttgctgacctcagaaggcaaggaaatcaagaacaaaagcgagatcctagccttgctgaaagccctctttttgccaaagaggctcagtattatccattgcccgggacaccaaaaagggaacagtgctgaagccaggggcaaccgaatggcggatcaagcagccagggaggcagccatgagagagagcgcagaaacgtccacgctcttaatagaggattcgtccccgtatactcccagctacttccactacacagagactgacagaaaagaccttctgagactgggagccgtatacgatgaggacaaaaagtattgggtcctgcagggaaaacctgtgatgcctgaccaattcacctttgagctcttagattccctacaccggctcacccacctcagctatcagaagatgaaggcactccttgaccgggaagagagcccctactacatgttaaatcgggataaaactctccagcacgtaacggaatcctgtacagcttgtgctcaagtaaatgctagtaaagccaaaatcggagcaagggtgcgagcgcggggacaccgacccggcacccattgggaaatcgattttaccgaagttaagccagggctgtatggatataagtatctcctggtgtttgtggacacattctctggctgggtagaagcatttccaaccaagcgtgaaactgccagggttgtgaccaagaagctgcttgaagaaatttttccaagattcgggatgccccaggtattggggacagataatgggcctgccttcatctcccaggtaagtcagacagtggccgatttgttggggatcgattggaaactgcattgtgcttatagaccccagagttcaggtcaggtagaaagaatgaatagaacaatcaaggagactttgaccaaattaacgcttgcagctggcactagagactgggtactcctactccccctggccctctaccgagcccggaatactccgggcccacatggactcactccgtatgaaattctgtatggggcacccacgccccttgtcaattttcatgatcctgaaatgtcaaagttaactaatagtccctctctccaagctcacttacaggccctccaagcagtacaacgagaggtctggaagccgctggccgctgcttatcaggaccagctggatcagccagtgataccacaccccttccgtgtcggtgacgccgtgtgggtgcgccggcatcagactaagaacctagaacctcgctggaaaggaccctacaccgtcctactaaccacccccaccgctctcaaagtagacggcatctctgcgtggatacacgccgctcacgtaaaggcggcgacaactcctccggccggaacagcatggaaggtccagcgttctcaaaatcccttaaagataagactaacccgtggggccccctgatagtcatggggatcttagtgggggcaggagcctcgggacaacgtgacagccctcaccaggtcttcaatgttacttggaaagttaccaacctaatgacaggacaaacagctaacgccacctcccttctggggacggtgacagacaccttccctaaactatattttgacctgtgtgatttagtaggagactactgggacgacccagatggagttggttgccgctctcccggaagaagaaaaaggacaagactgtatgacttctatgtttgccccggtcatactgtaccaatagggtgtggagggccgggagagggctactgtggcaaatggggatgtgagaccactggacaggcatactggaagccctcatcatcatgggacctaatttcccttaagcgaggaaacactcctaaggatcagggcccctgttacgattcctcggtctccagtggcgtccagggtgctacaccggggggtcgatgcaaccccctagtcttagaattcactgacgcgggtaaaaaggccagctgggatgcccccaaagtttggggactaagactctatcgatccacaagggccgacccggtgacccggttctctttgacccgccaggtcctcaatgtaggaccccgcgtccccattgggcctaatcccgtgatcactgaccagctacccccatcccaacccgtgcagatcatgctccccaggcctcctcatcatcctcctccaggcacggtctctatggtacctggggctcccccgccttctcaacagcctgggacaggagacaggctactaagtctggtagacggagcctaccaagcactcaacctcaccagtcctgacaaaactcaagagtgctggttgtgtctggtatcgggacccccctactacgaaggggttgccgtcctaggtacctactccaaccatacctctgccccagctaactgctccgtggcctcccaacacaagctgaccctgtccgaagtgaccggacagggactctgcgtaggagcagttcccaaaacccatcaggccctgtgtaataccacccagaagacgaacgacgggtcctactatctggctgctcccgccgggaccatctgggcttgcaacaccgggctcactccctgcctatctactactgtacttaacctcaccaccgattactgtgtcctggttgagctctggccaaaggtgacctaccactcccctggttatgtgtatggccagtttgagagaaaaaccaagtatcaaagagagccggtgtcattaactctggccctactgttgggaggacttactatgggcggcatagctgcaggagtaggaacagggactacagccctagtggccaccaaacaattcgagcagctccaggcagccatacatacagaccttggggccttagaaaaatcagtcagtgccctagaaaagtctctgacctcgttgtctgaagtggtcctacagaaccggagaggattagatctgctgttcctaaaagaaggaggattatgtgctgccctaaaagaagaatgctgtttctacgcggaccacactggcgtagtaagggatagcatggctaagctaagagagagactaaaccagagacaaaaattgttcgaatcaggacaagggtggtttgagggactgtttaacaggtccccatggttcacgaccttgatatccaccattatgggccccttgataatacttttattaatcctactcctcggaccctgtattctcaaccgattggtccagtttgtaaaagacagaatttcggtggtgcaggccctggttctgacccaacagtatcaccaactcaaatcaatagagccagaagcagtggaatcacgtgaataaaagattttattcagtttccagaaagaggggggaatgaaagaccccaccataaggcttagcaagctagctgcagtaacgccattttgcaaggcatgaaaaagtaccagagctgagttctcaaaagttacaaggaagttcagttaaagattaacagttaaaaatcaaggctgaataatactaggacaagggccaaacaggatatcggtggtcaagcgcctgggccccggctcagggccaagaaccgatggttcccacctgggccccggctcagggccaagaacaggtggtacccagatgaagcggaaccagcaacagtttctgaaaaagtcccaggtcccccaaatgaccaggaaatatcccaagccttgatttgaactaaccactcagctcgcttctcgcttctgtgcccacgctttttgctccccagccccagccctataaaaagggtaaaaattccacactcggcgcgccagtcctccgatagactgagtcgcccgggtacccgtgttcccaataaaagcctcttgctgattgcatccgaatcgtggactcgctgattcttgggagggtctcctcagattgattgactacccacctcgggagtctttcattggtattcaggtgggcaaggagtcggtgttgagtgactatcagactttaacacaagggagtgttgatctgaatgtaatttctcaaagtgacccagtggaaaagacaagatcaactggaactccatctctgtcagtattcagagacttcattagaatcactttcgtacacttataagctggttctttttttttttttttttaaattccaaacatctttcagccagccaaagtccatggagtcttgtatcatggtgcttttctatgcattggcagagccacaagtgtagcaatgcagtgtacaaaagttcttacattctaatagatggtgattttcttgaaccttacaaccagcgttaatgcaacttgaagaaatttaagatttaaaactccagttctaccgtgtattcaactttatggtttagcatttttttcaaagaacaatgtaaaaacaaacattattttccttgtatttctcttgttatcaacttttaaaacctaacatgatgcattggtgcaatgataatttattaatacaatggtaatttatatacttcttcaaggtatgttcagaaactgcctgagtgtcatttgctgaaagcatgaaatgcagaggcttagcacaaccttccaaaatgaatataccattatgtgtactgattgataaacagtgatgtctgtaatcacttggagccagttacctcatccttttttaaaactctgttaaagatttctgtatactataccattcctttcccatataatggggttttcttgatgttcctgaaaatattgcaaaggtctttcttaagaccagcaatggagataaaaaagccaacaggcatacacacagagtatacagatagacacaaacatggagacagaaggcagacacacaggaagagagaaatacacaaggcagtattcaacaagttacagatttaaattaactgaatagacacacaggatggaaggctcagataagacgaagaagagaatacaactttggattcacagttaaattacctctgagggaaaggctatcgattttttccttaactcagatgcattattaattaccagtgtatttaatttgttcatatatgcagaatccattaacttgtgacataatttttctctctttttttttttgcataagcacaatatgggaaaatataaaactcaccacaatgggtaacaagtagccctgcattctgaaaggtgtccacgggctcagaaccctgttctctaaagaaagaccatcaggtctgggcttgtgcttctgagctctcacttccatgctggcctagaatccattttaactctcaccgtcatcacaaagtgtttgaaccacagaagtcacaagagaatcctggaactcattactttcattaaaagagttgacctcatgccatattctctaaggggactttggtaattcttgagtcttcttttcccagcctatgaagatatgcatgggtgtacatagagtattatagagcacagtcagggaatcttctatgaacaaatggctaaattgtgcagtatgtattgtaggtctttttctatctccttccttccttccttccttccttccttccttcctttcttccttccttccttccttccttccttccttccttccttccttcctccttccttccttcctctcttcctcccttccttctttcctttctttattctttcttttgacaaaaatctagacgcttattcaaagaaatttttctttattgcctcacccttcaagcagtaaataatattgtgcctaaatctgacatcattttaattcatcattttctttgactaaggcatccagctcctctaccttttgtccaagtctaataatctgtctctcacacgttctctatgagttattattatttgctttactgcattttattttcaggctcctttccttgtttatttctaagcacatattgaactcaattttcatatcctatgttgtcctcctttccttcaggcttttgctattattctcttgcccacgaatcattttgttcctgtcctctatcagttgacatatgtggcttacacacttttatctctttgatcatgactctgggttttcaattctttacctaggatatcatgtaaattgctctctttataagatacatacacagttgatagtttgagccaaagacattttatcttagttttactttgttttgggtattgagcatcagaattcagagggactgcttaattgtgtgcatttttagactagactcataatgtgagaagttaggcaggatctattgtatctgaaggattcagaacccaggtgcagtgtcctactacattcagttctggtctagtctggcagtaaccttgtgggaagctgagcagagtagatcctgagaagttgtgtttccacaacagagttggaggagtggttcctgatggggagggtgggcctcctgcatgattagataagattaagaaaaagacaaaataaaaacaaagaatcaatcaatcaaaaaatcaatcaatgaattaaataagcaagcaaggaggcaaaaatccaaaccaacaaaaattgctctgaagaactgggaagctaattaattaaaaagtcctgaagcaggtgggcttagaagaacagcaggaagctggtgagtattgggcgggtccaaaaggagtggcactgaggaacaaagaggaagtgacaggaatttctgccattccagcattctcaatgtgtcttggctgcctcgtggtcaggaagtcatggagggagactagtgcctagtgtttgcggaacctgaaaacttccttaagctgcagttgctgtgctggcctcctaggatattcagcagctggtcctgtcacctgccagatcagaggtgctgttgggctgggaaatgggtagaagcgggacaggcgtgtggagcaggggtgcattttctgctgccacccttacaattctgttgtggatatcttaccattatcagaaagtttgagtttctgtgaattgagtttatggtgatgttttaattaattttatggttgccagaatatttttctaaaacaaccctgtagatccttggccctctctggactttgtatactatacccggagggttgtctttgcaaaggccttaataaagctcctcgaattcaaattcattcatgctttcttaactcccctgttcctccatttgccattttatttccctttctccagggaattgagtaggcatcccgagagagctttgtaggtatttgtcatatggggaccagtacagatttgatcgaattagaaaatattccttataaagcaccatcatatggctgtaaatattaacattaaccaagcaaagttatagtctccgttagctgaacacagaggtatatgcatactttgatgtaaatacatcattgagaaatgtgtctatatatgctttgttattaatgtcacaattaggtttgaataaaacatgaagacaggattgcagcaaggtacttgtgaggagaaatttccttaaggaaatgaggacaacataggatatgaaaattgaattcaataggtggttataaatacaaaagaaaagaaaagaaaagaaaagaaaagaaaagaaaagaaaagaaaagaaaagaaaagaaagaagaccctgaaaagaaaatgtagtcaggtgaataataatcattcatagagaatgtgtgtgagacagattatcagacttgaagatatatagtaggttctgttgaccctgagtgtccccagagaaaaaccaatttctccatgtggaccagctttatcagataatacatcctgaccaagagatagactttggtcacatgctacaggcattttataggccattgtagtttcctatgaggctttattattttcctaagacatgcaaccttcagcacttaaagaagatacctggttcttgtgctggtggtgaggttaatttttgatgtttcagtctgagggagaaagcattcagagatatctgattgggtcgagactgaaccaggctatcaggtggggaggaggggaattgaggatgtgatggaggatagaggggcaggtcaagagataaccagcagccaagaaagcacctatcctactatgactttattgatatgttaacaggtaccccaggtagccattcttcctgaatttctttgaatttttccaaggttcagcccagcatgctgtgcggtgatgatttcaggagtaggtattttaataagtggaaaacttactatggatttttttcttttctttcttttttttgttttttgttttttgtttattgtttttttttttgttttttttttttgagacagggtttctctgtgtaaccctggctgtcctggaactcactttgtagaccaggctggcctcgaactcagaaatctgcctgcctctgcctcccaagtgctgggattaaaggcgtgccaccgccaggcttttactatggattaagacaaaattagacaacatcttttgaataatcttgatcacttacttactggattgctgtctggaatctgggtcaaaataattttcttccagtcttccctcctcctcttctgtgttgctcagaaaaagactctgtatgtgtgttaactgtgtggctgactctcacatctttagggtaaactggaatactcggagaaaaataggtattctcatgatatcttctctttccttcatatttatccttttctccggcattgacgtctttcatttttgttccatgaacagttccatgttcattctaaactatattttctcattttcaggtctccatatgctcagtcaaatctccataactgtaaatcaacactaagagcactggatagttaaggtcaaggagactctcacaaaggatccaggtatgttagaggtattgaacaaggggtggagtggggctcacctgccagtacaaagaggacatgaatttgattttgccagattctatttccttaatgattctggaaaagaataatattagatgtgatgatatggatttaccatggaaggcagtgctgtcagctgtcacttgatgtcaatatttaattaattttgatcctgggaaattgctgctgcccattgaaatcaaagtttcttttatccagattgaaagcagcatcaggctatgggtgtgagaagggcaatttatacataaagcaaatatcatcagtagattccctcctagggcctgtgaccttccttaccggatttttaggcagattttcactgtaatctatggatttttttttcctgtggagcttgaaacagaaaacctgttacccacagatagtcttgccagtatcataaaaatttccatgccttgtctggcagattcagattgcagcaagcaggttgaaaacctgagtatatacattgataactctgcttcctgccccaatttccctagcagtttttgtcactatgaaagttcccaccagggtgtctaagatgtctgctgagagtgaatggtctgatatgaggtggttttctccagaagatctacttgctttctgaatctcctattctgttcactctaaatgtttccctgtccttgacctctgttcttattgatgctctgtgttgcattaatccccattagagtggaataattatttttgaccttctctgtactggttggtttagttttgagtctgtttgccttatttctgaggtatgtttcttctcttctatccttgagatcttttatactgagcagtgtctacttttaaccacagggctgtataagtaagtttcattctcctattgtcactgtaatttgggaggattcctgcctacatctattaacctaggcctagtcatgtaagcttctagtctccatacagtattatctaaggcctagtgtgttttcagcctctgaaatttgctgctgaataagctcccccattctctctctctctctctctctctttttctttctttctttttttgttttgtcgagacagggtttctcagtgtagccctggctgtcctggaactcactctgtagaccaggatggccttgaactcagatctatctgcctctgcctcccaagtgctgggattaaaggcgtgtgccaccaagcctggcaagctccccctttcttattccttctcaatgcttaactagctgattcaactcgttttttccagctcaaactcctctccgagctgagttcttctctcagacactgaattgttccacttggccttaaattaactgtagaaatcttttctcatcttctggctccttctctttctcctgctcattctgtctttacctgttcctagcatgttctctcttcagtctgattctgtaaaactctcagaactcacgtgcagtgtcctagtacatccagctctggtctagtctggcagcaacattgtggggaagctgtgcagagtaggtccagagaagttgtgtgaaaggcagcctgcaacagagttggaggagtggttcctgctggggagggtgggcttcatgcatgattagataagtttaagaaaaagacaaaataaaaacaaagaatcaaccaaccaatcaatgaattcagtatgcaagcaagcaaaaatccaaaacaataaaaattgctgtgaagaattgggaagctaattaattaaaaggtcctgaagtaggtgggcttagaagaattgcaggaagctgctgaatattcagaaggagggttcagaaagaggggctctgaggagccaggcagaaacgacaggaagttctaccttttcagcattctccttgtaccttggctgcctcctggtcaggaagtcctggagggagactagtgcctagtattttcagaacctgaaaacttccttaagctgcatttgctgtgctggcctcctaggacattcagcagctggtcctgtagccttccaggtcagaggagctgttgggctgggaaatgggcaggagcagggcaggcttgtggagcaggggtgcattttctgtcgctactctcacaattcttttttttttttttttttttaaagatttattttattattatatgtaagtacactgtagctgtcttcagacactccagaagagggagtcagatcttgttgaggatggttgtgagccaccatgtggttgctgggatttgaactttggacctttggaagagcagtcgggtgctcttacccactgagccatctcaccagccccctcacaattcttttgtggatatcttaccattgtcaggaagtttgagatcctgtgaattgggttcatggtgatgctttaatcaattttctggttgccagaatatttttctaaagtatccctgtagattcttggctgcatctggagtttgtataccgggaggtttgtctttgcaaaagtctttataaagctcctgtaattcaaattcgtccatgctttcttaactccctggttcctccaattgccatttcatttccctttctccagggaattgagtaggcatcctgagaaagctttgtagatatttgtcatatggcgattggtggagatttgattgaattagaaaatttacgttataaagcaccatcatatggctgtaaatattaacattaacctaacaaagttatagtctccgttagtttcacactgaggcatatgcactctttgatgtaaatacagcattcactgatgcttcttagtgaaaggtttcactaagaatattagatgtgatgatatggatttcccatggtaggcagtgatgtcagctgtcacttcatgtcaatatttaattaattttgatcctggaaattgctgttgcccattgaaatcaaagtttcttttacccagactgaaatcagcatcagttaatgtgtttgaaaaggaccatttacacatgaagcagatatcaatcctggattccctcccagggcctgtgaccttccttattggattttagtcagattctctgtttagtctatgtatgtttctcctgaggagccagcctcagcttgaacaggaaagccttttgttacccacagatagccttgccactatgatattagaggccatgccttgcctggcagattgagattgtagcacaaaggatacaaatctgggtatggccattgataactctgcctcctgccccagtttgcatagcagtttctggacactgaatgctaccaccagtgagtccgtccacaatatttgttgacagagtggatggtctgatctgagttgttcttctccagaagatgcacttgctctctgaatcacatctttggtccagtctacacgagtttaagtccttgaattgtgttcacactgatgcagttggttgaatttggccttattatattgtggacaccaacaagagcttgctgacaggaggctgatatagctgtctcctgagaggctctattagtgcctgacaaatacagaagtgggtgctcaccgtcatccattggacagtgcacagggtccccaatgaaagagctagagaaattacccaaagacctgatggggtttatagccccagagtaggaacaacaataggaactaaccagtatccctagagctcctggagactaaaccaccaaccaaagaaaacacatggtgggactcatggctctagctacatatgtagctgatgatggcctagtcggacatcaatgggaggagaggcccttggtcatgtgtaagttctatgccagagtaaaggggaacacctgggccaggaagccagagagggtgagttggttagcagggggagaggcaataagataggggatttttggagaggaaactaggaaagtggttaacatttgaaatgtaaatgaagaaaatatcaaataaaaaaatgaaaaaaaagggtggaataatgactttcctgccttttctggactgtttggtttagtttcaagtctctttccatttgttttctgaggtgtgtttcttctcttcttacattctagaaagcttttatagtgagtggtattagattttccacaggactgtaaaactaacctttattctccgattataattattgtctgggaggcttactgcctctgtctaattaccatggcctagtcctgtaagcctctagcctctaaataatcttatttagtcctagagtgttttcagcctctgaaatttcctgctgattaagttccccctttcttctttgttcatttcaaatcctttttttttttttttaattttatttttttggttttcccgacagggtttctctgtgtagagtcctggctgccctggaactcactctgaagaccagtttggcctcgaactcagaaaagtgctgggattaaaggcatgcaccaccactgcccagcctcatttcaactcttaactggatggttcaactcagctgttcaggctcaaactactctcccagctgacgcattcagcctggctctcagacactgaattgctctgcttggccttaaattaactgtagcaatctttttttaaatcttctggcttcttctctttctcctgctcattctgtctttgcccgtgcctagcatgttccctcttcaatctgactgtaaaactgtcccagtaaaactgtgtccttctccctctctgtggctctactctctcaagtatactgtactgctgcccatgcactctactgtattcctttaccattctcttcttcctgtactgtctttctctcccttaagtagcttccccttcctctctcacctcaggagtgttgggcacatcctgttctctaagaactttctctgatatttcacattttctccattcaattagacaacactttcaaacatgtgcacctccttctacttagtaaatgtactttcgttgtttgggattaaagcaaatcctaaaggcttgcttgtattcaaccacagtgaggaaagctgtgtgccttgtgctgaaccacaccctaagtcagaacaggcttgaatatccctacacaatagtttagtttggcagaatttcttcctgaactgaaaaccaagattcacaaataatagtcttcattatgtagatagctgtgctatctcttctgacttctaccaagagtttcattgtgaacttctttgatgattggtcaatgaaaatctgtcctttgcgagactgtattccttagcatttgcaatctataaggtttgcgggcattatgagtggcaaaaatatggttcataatgtctccattcattgtaggggaaagagctttactatgtaggacatgaggaatatttcctagtgttcttatattcattcattcttcacaaaaaaatgtcttctttccgaagttctcatgaaaattttatgtcttattcttttgtgtatatttccattagattattttctatgtaggtttttgagtaaaacagtgtctaaacttatatatacatacactgtgtgaaaatatatgttttacactgtcaatacttgtagccacttttctgaatttaacattacagttgccagttattttctcttagggcttgaaaaatatgattccatgcactcctgattttaagctattcataaatatttagtactactgtatgctaatatattatcacctcttttgatggtaagggctaggacaagacagctggaaagagataaacattgttacagcacttagatgtgacaataggcagatacagttgggagtacaggaatccaatttctgagagactttcctagggaatgctaggctagaatgctatggtgttctagtactcaagagtcccaatgttttcacagtgcatgttgctctttgagtttatctactttaaaatggatgtgatgaaacaagtgatagtaaactttgacaggaaggctcaagcctgtggaattgtgtctattcagaatcaggtgtgtatttaaggtaatgtcagttgcaagatttaaagtcgaagccctagtgttcatattgacttcatggtggaagaatgtaaacccatgggttattcttcccattctagaatgagctcttgttcagtctccatgaaatggaagatgtgcttttcctgttatacaattagataaaacaattgcaggacacacatttattttatgtatttcttacttttgaatttaaagtacaacatctgtcacttgagcaggaacttatggtctgttgctggtagaaatgacaacaatactcagcctgtatgtcacaggtaagaatgatgaagtgacatactttgaaaaatattctcattactccctgaaaattcatgtattcctatgcccattttttattacacacttgatgctgtctgtctacaaatgcccagggcatcaagtgatacatattgtaaatttatgacagcagtgtgtttttctgtgcatctccaatttctgttttacagaaattcctgttgtcagtaaattttccatcacatgaattagggattatactcatttcatgaatattacaattgttagaatattcacagagaaacattctggtagaggatttgcattatctagtttctttggtattgcagatattacggagttcctagagtttactctaatgtttgctctctaaatcccctagcgcttgcgttttcaggtgaatggccttcgcacatgaagtgtcccagagtgcttacacagttaccatctcttctatctctgtctcatcccttgttattcatgttttcatcctatccttgtgtttcatgtatgttctgaggaaggttttggatgggtatccatgctgtcatatattcataattccatgttccatggtaaatgacagcatgggtttccataactccacttcctccttcttttacagtgttgccttttccccactgctggctttttattcagctctctctgaattggcagtttcctttacaaaccatgtttctctgacttgggctgaaagcaccaacaatttaaatgtatttccatatttctacatatagcagtatgtcagttataaattcactttttcagcctgagcttccagtgccatgtctgtatttcctttgtaggctgaccttagttcaaaccagtaaagtttctgttacctacttgtcactactacacctgtcaacatacattgtcacacaggatggtattacagcacaagggtcatcatctagggagaaccattaaggacaccttacactcatcagcctacagagcccctttttagcagtttgtatgctaaaccagcatatccaagatccttttagacactgagtgctcttctcagttatcagattattctttaggaatgtataaaaccaaatcattttttttgtatttttcttgtattattctatagcgtgttgagtattttatcagattggattattctcttgggatacttgcaggtcttgagttgaagaattatgtttcttgtaatttgagaaaacttgttttcctcatatccttatttgaacattgaaaatattctaagtctttcttgctctttgtaagcactgctatactgtgataccttagtgtggaagctttgcacatccttgtctgtcttctgagtagagtagaatgatgacagctgtcttcagtttgtatagtaataggcttaggatgttggctattatcctcattagactcagtaatgttccttctgttccacattcttcagagctttcatagtgatccactgtgaaattttgccctaggcctttcatagatatattgacatatatctatcagtgagatttctcccactgattatacataatttatgccttgagttgtttggtttgtgcttgtcaaaacagttttgagtcactgtcatgaaatcaagttgagtttactttctgcatctattagagagaaacttttttaaagttaccctggtgcacccatactgttattattttctgtgtgcatgtttttgtggtcatttgcttttggacccaggtaaggtcagctttgtgtgatgactgtaccatattcccctattttctgtattatgcactgttttctgtgcaagttttttgtgggttttttcagaagaaatttgtgactttggtgcagcatttgattattcccgagaaagtgctagaaggtacactgagagtctgggtttctgcacttgattattcctggcctagtgtttattattcctaggaaatcaatatttccctttttcccattgtcaatctatacttctgaggctggggcattgaaagagatcattcatatacctgttaaatgccaagagaaatatttgacatgagataaatataaggtcaatgaaatacataaaaagcactgaatatttgctgatatcatggtcatgacattatttcttcagtaatagtatctccatgttcagaacgaattcttatgttttcatttatgcataaacatatgtatgtatttgtgtatatatgtttgtatgtgtattggtatgtatgccaggagaccattatcacatattctttcatgtgaacctacaagagtggtggccagagatgaaatctgtaacagctaggctctgatgaatgtcattgtattcatatttattactgattgggaacctgagaactgcctggaacaatgccacaatgcagatacatgcttgttgaggaagatgttccaactgtgattgtatttaacagatttgatataatgagggaatcattccaagggcattaccctcaaatgactcattttgtgtatgtgtatatatgtattctccctggcagccaccagtgagtttctatcatttctccttcttgattttgtatgtcaatatattttatgcaatatgctctcagcataaaatatattcatagtaacactactcataaaatcgcatatagaagttgtatacaagtcaagtgtcatttttacactaaagacacttaacttgattttttaaataaaatttctaaaattttctctgcaccccaacccatcccttctcaccgctccaagaggatgtccccatacctcaccattccaccaggcttccccaattcctggcacttcaagtctctggagggttaggtgtatcttttttcactgaagtcagaccaggcagtcatccactgtttatttgtcatggtcatcatgtcagctgctgtatgttgcctggttgttggtcccttttctgagagatcttggggggtccagttcagttgagactgctggcatattgatggggccaccctcctcctcagctgcttctggcttttccccaattcaaccacaggggtcattggcttccatccattgggtgggtgctagaatctgcatctgactcagttgcttgttagacttcttagagggcagccatgccaggctcctgtcacaccacagtatcagtgtcaaggccctgtgcctccccttccttgatctgaatcctaatttgggtctgtccatggacatcctttttctcatgttcttctcaagttttgtccctgcagttccttcaaataggaacaattctggatcaaagattatgcgtataggacagcaacatcacttgatacctgtccctccactggaggtagactctacaagttcccccttgcctctccctttgagtcctgggagtctctcacctcctaggtctttagaacctgtgagatggacctcgatagcctacatcctgaggctgtctatttccatttctttctactgggcctcagggcttcagtcccccccccccaatccctcacaatgactgatcatgtttccccttcctctctatgaccctgctcccactcaggtcctttcttccttttttcccccatgactgctttcttctctcacccaagtgggatcgatatgtcttcacttggaaccttgaggtttttaaccttctttagtcatttaggctgtattatatacttttttttttggctgatatccatttattagtgagtacacactatgcatgtcctttcgggtctgagttacctcacctaggatggaatttgctagttcagtccattagcctgcaaagctcatgatgtcattgttctcaagagatgaataatattccattgtgaaaatgaaccatatttctgtatcagttcgcccattgtggggtatctggtttgtttccagcctctggttatcacaaacaagacaactctgaacatagtgaaacactagcccctgtgtcatggtggggcatcttttgtgtatatgcccaagagtggtatagctgggatttcaggtatatctatttctaattttctgaggaagctccagattgatttccagaatgattgaccagttttcaattccacaagcaatggcggtgtggtcctctttgctgttacctgagtttttatcttagccattctgactggtggaaggtggaatcttagtgttttgatttatatttatatttgatttatatcactaaggactttgaacatttcttttgaagtttctcagccttccacagttgctccattatgaattctctgtttaggtatctaccccattttttgattgggttgtttggtttcttggtggttaacttcttgtgtcttttatatatattggatattagccctctatcaagtgtggggatagggaagaatttttttcccaatctgtaggttgccactttgtcctatttactatgtcctttgccttacaaaattttctagtttcttgaggtcccatttgtcaattcctgaccttagagcctgagccattggagttttatttttaggaaatttcccgctgtgacagcaactttgaggctgtttcccactttatcttctatttcctggattgtgtcttgttttatgttgaggtccttgatccacttcaacttgagctttgtgcaaggtgtcaaatgtggatctattttcatttttctacatgcagactgccagttagaccttcactggttattgaagatgttttcttttttctgtttttgagtgactcattttcatgcttgtaagccctcatgtacataattatgtgaaaatgtctttcacaaccagtgtcccactgccaaatttctcaaaatagctttctcacctcacttatgtgcaagtgtctttcctgactgtgctggcacttaccctagcactctaagaaggtagccttcatgctccatgaatcctgtcccaatatttattgatttatgtttccacaacagctaattgagaatcaaagatgtggctctccagttaagggcacttcttgcactatgcaggtccagaatatcttttaccattgtcttggtgctatagcttctgcatttctgaagtctacagagctacatgcagtcaaagatcatgttccctaaaaaattgaaataaataaactttatttaaaaagtaaaaatgatctggaagtgttgtgtaggacacaagaaacagtacaggaaagagagtgagaggaaatgtgaagcctggatatgttaaaggacagctgacccttcatatcaatattttaccaattaggaaggatccctatgtatgataaaactattttgtatccatggaacccagagctggagactcttatgggttcattgtaatgtgagaaaagaagatttatcctatcaatgctgtatttaggtattaacttttatgaggaggcaccgtaattctgaagaaatttataatacatgaaaatgctgttatccagcatcccatcaaccaagaaatctgccccagaaggaaaatgggttgtatcagattccaccattttcttaatgtaaggtataagcatgagactcagatcttaatcctcaccactgatgttcccacactataaaatagttcatggttattaaacgagaatcattcatgactaatataaattgggttatatgttacatgtttagggatggatgaaatttgaagagaagttgttgctcctgcaaaggaacaggattagactgttagcaccacatcacgttccataaccacctagacttccagtttgtgggaatctcacctcctcttctgatgtccactgagagaaagcatgcaagcatggcacactcatacacatacaggacgaacattcataaataagactaaacaaaataaaataaaatgaacaatttaatattaaaattgtctaaaagcagtctagaggaatagtatgacatgcttctgcatgtgtatgggaaggtctttccacaaggcatagggaattgaagaattgtttagcctaatcagttaagagtccatgtgttagctcataatggatctgcttgttggaagcttgtagagaaagcaggaagcagatctaagagaggatatagtcacagggacaagcttaaaagcatgttctttggtgctataaggtcctgaacactaatttctctctggcactcagtagctggattgtcctatacatccaacaatgatttagcattcacatgaagttataagcagatttttatgagctgaattgtaacattctaccttttaaatagcccgggtacgtttcaattgataaatcacctcacaccaagttttgcatgcaagtaaagcagaaacaagtccatcttgaaggaggagtaagttagaaagctacacttttcttctcaacagtgtgcattagacactgatatgaatggttataagtaaatatgatgacaagtttatcatattgaagaaatccatgtgtcttagtcagggtttctattcctgcacaaacatcatgaccaagaagcaagttagggaggaaagggtttattcggcttacacttccatactgctgttcatcaccaaaggaagtcaggactggaactcaaggaggtcagaaagcaggagctgatgcagaggccatggagggatgttctttaatggcttgcctcccctggcttgctcagcctgctctcttatagaacccaagacccccttgtgggtgggacccagagatggtcccacccacaaggggccattcccccttgatcactaattgagaaaatgccttacagttggatctcatggaagcatttcctcaaatgaagctcctttctctgtgataactccagctgtgtcaagttgacacaaaactagccagtacaattgaccccttgtcaacttgacacacaaaaacatcactagtaagcctcaacccttacaatcttattcatccccaaggtctaaataactttaaacatcccacagcctttacatattcttaaaatttcaatctctttaaaatatccatctcttttaaaatccaaagtctttttacaattaaaagtctcttaactgtgggctccattaaaatagtttcttccttcaagagggaaaatatcaggacacagtcacaatcaaaagcaaaaatcaatgtccaaccttccagtgtctgggatccaactcacaatcttctgggctcctccaagggcttgggtcacttctccagccatgccctttgtagtacacgcgtcgtcctctaggctccagatgcctgtactccactgctgctgctgctcttggtggtcatctcatggtactggcatctccaaaacactgcatgacccctttagtcctgggccttcaattgcaactgcggctgcaccttcaccaatggccttccatggcctctcacagagtcgagccttagctgctcttcgtgaccccttcatgccttcaaaaccagtaccacctgggtgacccttacatattaccaagtcccgctgcagcaggagtacaaccttggctatctctggaacacagcctctttgtgctttcagaaaacacttcccagaagatgtcacctcaatgatgctggatcactgctaatttcttagctccagctaaccagcatcaatagtcccactaatgccaagtttttgctttagtagttctggtatcttgttaatcacaactgattcttcagccccagctaaccaaaactacagaatcttcacaatcaaaacagcaatggccctgaaaagagtctttaattttccctctgaaatttcacaaaccagacctccatcttctgcactgttctcaacattatcttccaagctcctacacagcatctgacagagctcttaacaacaaatggatcttcaagcccaaagttccaaagtccttccacagtcctccccaaaacatggtcaggttgtcacaggaataccctactcctggtaccaacttctgtattagtcagggttctctagagtcacagaacttatggatagtctctagatagtaaaggaatttattgatgacttacagtcggcagcccaattcccaacaattgttcagtcgcagctgtgaatggaagtccaaggatctagcagttactcagtctcacacagcaagcaggcgaagtagcaagagttagactcccttcttccaatgtccttatattgtctctagcagaaggtgtagcccagattaaaggtgtgttccttaaactcggagattcaatcttctggaatccatagccactatggctcaagatctccaaaccaagatccagataaggatctccaagcctccagataagggtcactggtgagccttccaattctggattgtagttcattccaaatatagtcaagttgacaaccaggaatagccactacaccatgatatttgccatttagattgagccattgcctgaggtggttttctgtaaaaaagtacaacacacttaataaatacatgtactgtttctgcaggtcaaatgaaataaggtgaattctaaacatgttctatgaggtagaaatgctcccagcaattttcagacaggctttaagcattctgattgctatctctatgttgtatcatgtggtttatatcagtaagaattttctatagatattaatggcatactgtgctgaagactcctattcagaaacattaaggaatatcccatttaatgactttgctcttttattttggagttataaggctctcctactccatgtttttccccttcccgtagctatggttcatgtaggttgagattctgaagagcaatcatggtggacagatgcagagaagctgccttgggtgggaaagggtcctaaggagctaatgggagtggtggagaatgacttgttgttaatgatggatgcaagctgacagttctgtactctgtggagacaagtctctaaatagctctttgcatatgaaaactcctttgcataagctacttccttaggaattacaaatcattacaatcatttactccaggttctctcttgattattctgagtcagcattttaaaaccttagaacctttactcctagaaaaaacaacaatacaaaaacagaagtacatttgtttttgtttgtttgctttgttttgttcttaagcatagcagctcctatgtatgttgcttagatgcactttctgggcatagagattattttattattactcttttcttttctttctctttcttccttccttcctgtcttccttcctctcattttttccacactctagattttattgccctcctggtccatcctctaactattccacatcccacacttcctgcccacctctctgtctccataaggatgtcccctcctcctccccacctgaccagacctctaaacaccctggaacctccaatctctccaggggttagatgcatgctccctgattgaacccagacccagcattcttccactgcatatgtgctaggggcctcttatcagcaggtgcatgcttcctggttgatgatcgagtgtctgagaggtcttgggggttcaggttaattgagactgctggtcctcctacagggtgcccttcttcctcagcttcttccagttttcccctaactcaaccacaggggtcaggagcttctgtccatttgttgggtgcaaatatctgtatccagctgctcttgggtgtttcagaagacagtctttgtgattgctccatagcctcagtaataatgttaggcctaggggcctccccttgaaaggtgacagggttgggagggaatcataatctgatattgggtgggggaagaggactgaagccctaagggccagcagaaagaatggaaacaggcaactttgggcctgtttagcaactttgggatcctactttggacctgttattggaccttcttttcctcaggctcttctccatcactgtaattctttcagtcaaaattatggatcagaattttgactggggttgcaaccccatccctcactcaatgccctgtttctctgctggaggtggactccaaaagttctttctcgcccctgaagggcatttaatctagggtctctccttttgggtttcttgagtatctcacctcctctagtacattctggagggtcccccacctcctatttcccaaggttgcctgtttccatttattcttctggccctcagggcttcagccctcttcccccacccaatatcagattatgattccaaccctgtcacttttctctcccatgtcagtcccttcctccctcctcactttggctctttatcttgttgacctgtttgagttctgtgggctgtatcttgggtattctggactttttttcatgactaatatccacttattagtgaatatatgccatgcatgtacttttgggtctgaattacctcactcaggatgataatgtctagttccatccatttgcctaaaaaacttaggatgtcctcattcttaatagctgagtaatattccattgtgtaaatgaaccacagtttctgtatccatccttttgtcatgggacatatgggttgtttccagcttctggctatcacagataaggccactatgagtatagtggagcacatgcccctatgacatgttggggcatctttttggtatattcccaaggatggtattgccggggcatcagatctatttatttccaattttctgaggaaactccacattgatttctagagtggttgtacaggtttgcaatcccaccagcaatggaggagtgttcttctttctctgcatcctctccaacatgtgttgtcacctgaggttttgatcttagccattctgtttgctataaggtggaatctcagggtcattttgatttacatttcttttatcactaaggactttgaacatttttttaagtggttttcagccattggggtgtccttagttgtgaattctcagtttactcaccattttttcattgcgttgtttgggtttttttggtggttatcttcttaagttcttaatatattttggatattagccccctattgcatatggagttagtgatggttttttcccaatctgtaggttgttgatttgtcttattgactatgccatgtaccttaaagaagctttctagtcaggaggtcccatttatcaactcttttttttgttgttgttgtttttttttgtttgtttgttttgtttttgttttttcgagacagggtttctctgtatagccccggctgtcctggaactcacttttagacaaggctggccttgaactcagaaatccatctgtctctgcctcccaagtgctgggttaaaggcatacaccaccaccgcccggctcaattcttgatcttagaacatgagacatttgagttctgtttaggaaatatcccctggtgcctaatgagttcaaggctttttcccactttctcttcttttaggttgtgtgtatttgattttatgttcaggtccttgattaacttggacttgggctttgtgcaaggtgacaaatatgggtctatttccatttttctacatacagacaaccaaattagactagcatcatttattgaagatgcttccttttttccattgtatatttttggcttctttgtcaaaaatcacgtgtgtgtaagtgtgtggttttatttctgggtcttcgattccatttcattgatcaacttgtctgcctgtgtaccaataccatgctgtttttatcactatagctgtgaagacagaattagactgtgtttcctttcaggaatagcaaatgccatttacccctgagtcatctcttctttccagggatttacacttctggtacacttttatgatagagcctgaatataatcctgagttctgttttataaaaattgagtgaagaatcctaaatgatacttatatgtccaaccgctaaccatgttagatggatgagctcaaataattaagaaaagaacaggagggcccccagtggaggagctagagagtgtacccaaggagctaaaggggtctgcaaacctataggtggaacaacaatatgaactaaccagtacccctggagctcgtgtctctagctgcatatgtatcagaagatggcctagttggccatcattgggaagagaggccccttggtcttgcaaactttatatgccgcagtatgggggaacgccagggccaagaagtgggagtgaatgggtaggggagtggggggctctcagggacttttggcatagcatttgaaatttaaattaagaaaatttgaaatgtaaattaagaaaatacctaatttaaaacaataaaataaaataaaaaaagaaaagaataggaatgaagtaaaagaaccttagatgattccttttttgtgtaatctgtaatcatgttagatcaatgacctcaaataataaagagaagaacattgctgaagtcaaaagtttcatatttttagttgtggcagtaatagacacatgagtaataatgtatccataaaaaatgaagtgttagtatgattcttatacatcttaatatggttatttccattataaaaatcattttactttatcacttttttcacatatgtcatttagttatacatgtatgtctaagcattctgaagggaaaccactgtgtaatttatgaaattattatctgtattgattttgtcatatagtcacaaacattacattatattaatgctacctattgctaactttttatttttatcattaaatattctcaaattaattcttcattaaataatcatttaactcttcttcatataaaattcttataaaatcatatcacaaggtatttgattgtatgtcttatttgtaattttgtttgtatacactgactttacacttcctaactgctacaatagaaagaaacgtatttcttttaagtcattcttgtatttggtgttctaactctctttcttctagaaaggatgctctattgtatataggtcttataatccaaactgagcatcttagactagctgttgacacccaacttcagataagagagatacagggttcctatctgagcaaaaatgacagttgtagaatttggaagcacagttttactcaccatcactttactatctgtaaactagatgtaacactggcattgttctttttatcaaaaaatgttcataaacgtatattcctggatgtagacctcatatatatacattacaatgtctaaattatgctgtgagtctgagtccattaactcatctaccttttactgagagaagacaacacaattatgactatgataattttagatgataccatttcttaaaacggcctcatagttctcatgacctaacatacttcctgttcttgattaggtttcagaatatgacatgaattctctctctgaaaggtaaccttaaatccaatcagaatatgttttactgtaattggtttttgtctgctgctttcataaagcaccatgttcaaggaaactaatagaagaaaaagactactttgggtaatgcttccagaggatagccatcaaccatgacagggaggacagatagaacattgccatgttgttgaagtagaaaggtgaaagatcacatcttcaaccccagtcactaaagaggaagaaagaattaagatggcttggatctatctattctttcttctcatagccaacccccatgtcatacttaattcagtaatgttccaacagctaaattcctcaaacgattgtgacccactgaggacccaactttaaaagataaaagtattatccaataggagaatcagccttctaatatccttgtactttttaaattgattttgatatcaatgtagaagacaaaactctaattttttgtatgggtttcctgtttgtttgtttgtaaaacagggtcccacactctatttctaactttcacatgtcctgatatagagaccagaatggcttttaggtcacatccctgacagctaggatgaaagacctttcgttgacgagctgattttttgtttgtttgtttgaatggtgtatcttcacatattggccattgagttaccaccaggcttacagaatttatttcagagtgagcattccttagatttttatatctctggataagatgttcacatcctgcacatgtataattattctcttacccacttgtaggaattctctggaatttcattaagtttgtttctgccttctttgaattcctgtgcttgttccctctttatgacatttgtccacattgaatggtgttcatattatattttgagtttgtttcataattcattttgtcatgagaattggtattgcattagtgatttggggtagggaaattttattaacattttcaaattgctttagctacagcctctcaattttcttttgctgtgtgtcatttaggtcaggtgacagggatttccatatgaggtgttgtgaaataactttgagaatctagggtggtgggaggaactaggttacacttacagtctaaatatatcattacttactttcatgactgcacattgtcaagattcctggtatcattttgcttttaatgtttatatatataaatgttgtttgccattgtctgtaatggtgttgtatttatttcatctctgaatcattcagaccttgatgtgaaatttcaagaagaattcaaactttgctcttcacagagaccctgggagaaggaaaacaacaagaatgagtgtgtctctggtaaatacaccacaggtcagtgtcctttccacatttctttttaaaaaaatctctttttattcaagtcatccaaaactttttatctctatatgtttaatggtatctaaagggcttattttctatgatctatatcttttgtaataatgagaatttaatgtttttccctttcatgcatataatggctttatagtttaacttgatttttatattgtgaggatatataattcccttggaatagagacctgcatgtctcaaataggatctattagaatgatgctcaaagaatagattgatggacattttctatgttgaataagttctgtccttttgtattagtgtaaagtaaggtctcttgtgccacataaattgcatttcagggatggtcatgtttctaaacacaagcttgtgaatgagggtatagaaataagtataaattcatatcactaaagaacatatataaaagagtataatttgtagaaggtaaaagtataagagatccactgtcttgaatcctgatagtaactatattattagctcctagggtcacagataatggaaggaaaatgtctttcttttaccattagtgtaattgtgagctgatacagatttcagtattctgacaacatttttttcacacctcataacacacagtaatcactgttgacacctgaaatctatttatctcaagagagacactgtccctgtggaaaattcacaatatatagatatttttccctccttttggtttcagaaataattttaagtcctgttttcttcacctttgtatttcatcacatgaactatattagtaaaatttttctagagaggatagctatggtgttgtgcatataccatcaattttcgaaaataaatgaatgtcctttcttatttttttgtctcttttccttagaagggaaaggcttgaatcagtctatgctaatcctcttcagtcaagctgtgcattacatagggaaaactgaagggttgtggcaatgtttctatttttcattacgatactattttctttacgtacataagtgtatatctgaaggtttttacgtacactgaatgatacattatgcccctaaaaccatgagtacagcaccaaaccctgggactgaattcagacataatagtgagctccaatatatttagagagaattagattagtttttaaagtagaaacagcaagtacctttaccctttaatcatttgttcatggagcaggtttacattttttgaggcatatttgcaataaagacagtatatagtctgtatattataatttttgataaacaaaggaagaatgatagatcacacttctctatgaaaagtgcaattgtgatatacatatggtcaaattctgaagaaaaaagttaaaattagaatactgaaattttcagttaggttaatacaatgaggaataatttattagattttaatgaatatttagtataattctccctcaatttaaaaacacagtttgatcaaaaattattatacttcattggaatgcattgccacatatgatatttgcttaaacatacatagctaatcattttatagtgaaagaccatatggtattagagaaattgttattaagcatatttatttatgtctccacaggagctaattaagagtcaaagatgtggctctgcagttaagctctcttcttcttgcagtattcagattcagttttctgtacctgcctggggacttcttttccttccagaactcttttttttcgagaatatcttttaccattgcctgcgtttctcatgtgcacagagctacatgccagcaaaagtaacattccatatgaaattaaagtcaataaacattatttaaaaattatctggaaatattacacaggacacaagaaaccatccaggaaagagaatgagaggaattgtgaagcctgaatgagtttcaggacagcctacccctcataacaacattttaacaattaggaatgattcctatgtatgataaaaatgtgttgtattcgtggaacccagagctggagactcttatgtgttcattgtaatgtaggaaaatatttatcccatcaatgctgtatttttgtgtcaacttttatgaggaggcaccgtaattgtgaaggaatttatgatacagaaatacgttgttatccagcatcccatcaaccaagaaatctgctccagaaggaaagtgaattgtatcagattccaccatttttttaatattttatttatttattatatgtaagtgcactgtagctgtcttcagaaactccagaagaaggcatcagatttcgttatggatggttgtgagccaccatgtggttaaataattttaaagctctcaaaaactgtttatttctattttatggttttgaatacattctcattaataatttccaaaagcatttgattttctgtgtcatatggaatgttcagtgtatgatgccctgatgttgcagttctaatgtgtttaaagaaaaaacttagtcatttagtccatccattatttctgcatttagtattctaccagtttcttctagaatgtgtgtagcattgaacttaggcctcagattgtcaaatggacatgttgtaatacaaatgtgagacacagctgcacataagactaagctagtgtccatacttgaacaaagtggacattgtaaaatttgaaagcatattttttatcataactttactatctttaatgggtcagtgggattctgtttgatatcaacccatatttcataaaggtacattactgcatctagacatcaaaagtacatgttatattccataaatgtttactgcttttgaaattacatcatgcattctcagtgaaaaagaaatataaggaagtctattagtagtttagaaagtttctttgaataaagtcaaagttcatttttcttcaatatatgttgcttacatttgcctgaatgtatgcctatgtgctatgtattcttttccttttttattttttttttatttagagagcctttctaaacgtgagcattatagtaagtcattctatagattgacagtggaagagcagcaattcgtatcttcagaaacatctcaatcacactttcagaaaacatttatccttcaatattttccttcctcatttgcatcaaaaaggatatctttttgttgttgttcttgtttgttgttgttcttgttgttgttttcaagacaggatttctctgtgcagccctggctgtcctatcctggaactcactctgtagaccaggcctggaactcagaaatctgcctgcctctgcctcccaagtgctgggattaaaggcattcgccaccacgcccagcaaaaaaggatatcttaattacttccttttttaaagtagaaaattatttttgtccagtatcaagtaggtagttttccattccagggtctgttaaccttcaaggatgtggccttgtacttctcactggaggaatgggaatgtctcagttttgctcagaggacactgtacatggatgtaatgttggagaattacaaaaatcttttgttcgtgggcaagaatgaacttcttgttgaattcctgtttctttctttcagttttcctactatatgtttatgtaaattctctgagatatccagagacccctgaatgagggaaattctagttaaaatcataacttgttcattgtgtttccattacatttctctgctttctttggaaaagtaaccagtgctatattctctgagatcactccttatctcttatctagcttcagtgaagttaaaaaaagttcaagtaaaaatttaaatatccagaacaagaaattacatttctatacatataatagttggaattgtaaaaatcttactattgctttaaaatgttcccttatttatgaatctaaaaatatacaaggtttcaagtggatatagagctgttggtttgggcaattttttttatttaactttttgacatttgatctctgtgtttagatctgggacaacataatcattatcctagcattttagatgttgaaacaaatctatttagtgatttccctgacactatcggctatatcataaatttatacctgaccaaatttatacctgattcagtgtcactctgaatcgaactgtaaccatagaattagagatctattgtttagagttctactttcgggaaattcactacagatgggtcctttatttgtcccagcttatgcaaagtacaattttgttttttatttattggtcttttatttatctacatgtcaaatgttatgccccttctgtttcctgtctggaaactctatatcccacccctccccctggcttttatgatgatgctcccaccacagatccacctactcccacctcatgcccctaggattctcctatgctgggatactgaaccttcacagtaccaagggactcccctcctgttgatgccacataaggcaatcctctgctatatataaagctggagccatttgtacttccatgtatactctttgtttggtgatttgatccttgagaactttgtgggtcttgatattgtttttcctcctacacagttgcaaagcccttcagcttcttcaggccttcccttaactccttcattgtggtccccttgctcagtccaatggttggctgcaaggatctggatctctttggtccagtctctggatggccttcccttcagcctcttttccattctttgtccctctttttcttaagacaggagcaattctgggttaatatatttgaggtgggtatgatgtctaatttgaaaataaaatttagcaggctattatcattttcaatcacttgatatagatatagatcatatttgaggttctttgaggatacatgtaataattccaaaaaaaaaggagagagagagagaaacctctcttgagagtatgaatccataagctcactggttattgagtcccttattcgttttataagtaattcatgtcacctctaattgccccattttgtttttgtttttgtttttttcagaaaatcattgcatacgtggaaagtataggaaggtcttggatcaagacagccagtacattgtccatgaacacatgaatattcaagagaagtcttctaaatgggacaagcttagcaaggtgattcttgaatccccccaatgtacaccttacaaaacttatcacggctctcttcaatactcgaacaaaaaaagacttaagcccaggaacacaaagaagtttgcaaatacaatgactctgtaaacagtgtaagtttgttttctaccattagtctcaatcaaggaatccacatgcagaagaaaaaacacaactgaaatgcagaatttgcgaatgtttttgtttctaaacataaagtcatggtgaaacggaacaatactggagtgaacccttacaaatgtagtgaatttcacaaatatcttacccagagagaaaaacttcaaagtcagcagagaatttatcatggaaagaaatcttacagaagtagtaaaagtgacaaatgctttacccatcagatccatcttagtatccatcagggaattcatgcagaagagaaaatttacaaatgtagtgaatgtgacaaatgctttacccaaaaatccaatcttaatattcatcagagaattcatacaggagagaaaccttataaatgcagtgaatgtgacaaatgctttactgaaaaaagcagtctgagaattcatcagagaattcatacaggagagaatccttacaaatgcagtgaatgtgacaaatgctttacccgaaaattccatcttagtattcatcagaaaatccatacaggagagaaaccttacaaatagtttacatgtgacaaatacaatactcaccatgtcagtctgagaaatcatcagttacttcatatagtagagaatctttataaatgaatgaacgagacaatcctttaccaaaatatatcatcttataattcattagagaatacttagagaagacaaacttcaaatatattgtaggtatgaatcctttacttttggcctatttcctagaatataacagtgaatatacttacaggctagaaacttaactcatgcattgtatgaagaaatatctttgacttcatttcaggtcagagaaaacatctaagaactttttaagggatagtatttctgttgggaaaaatgtggcatatgttttattcaaggtgtattcttgacaacacttgaggctccactctagagaattagtatgattatgaaaatcttgtgaaaattttcatgcaatgttcaaatcttgggtaatgtcaactatttatgctggatgaactctgtacatgtgaaaatgtagaaagcctttcatgacaacttttacttgttcaccctcaaatgttacaacatgaagaaaagtggggaagtcagaagatagtattgcataacacactgagaaagaaataatccatttcaaagaaaatttattaaggtctttaatacaatcctcacaatatctaataaaactggtaacattctgtatatttaattcacatgaactaattcagaaaaatgatacttaaaagagtatctggcaaactgagccacccagacagcatattctttatcctataagtatgcttacagatgttaagtgtgcttcgagtatccagaaatcataattcttctcaattgcttgtttcacattataggataacaactgagtatgagtctcttgtgatctggtcaaccactcctttcctattgtcctgtaactaactccaataaagctgaaagtttcaacaagtttgctttggttgttttcaatttgcacttgggatactgagatgaatatatgttgcatcttcccaggaaatgcctcacataaaaaaatacgcggaagtcataaatatttttgcaaggctgtatcataaagttaatagttattttcaagtgatagataacaatccctttggggtgtaaagaccctttcacagtggttgcttaaaagcataggaaaacacatatttccaattgtcttaaaactgagaaatcattcattgagctgcagggtagtctgctcacctaagaataatttgaattctatatcagtgtttagcattacaaaagttagaaacactgtattagatatggtgatttgtgttaattaaaatagggaagattcagctcagtgttccaggctagtattactaggttaagataaaaaggctcaagaaagcaaatatgtagaagctttcagagcctcagcagtaagtcagctctctcttgaattcaaggaaacatgagagaaaaatttagaaaaataaatgaaaacatggtttcatagatttcaaggatagctagccagactttgctgcgtctctgcatggttctgaagtcattaatacccatttattgaacaaaagtcttaaactctcagaaaaatgctgcccattgacacatattacaaagcattttggtgtcttgtcctgttgttacttaatactccactctaccataagtaatgaaatagatttccattcttttttaaatcatctacagaatgttaatattttgcacatctcagaatatacattctgaacaaaacctcaacaactcactattagggtattatcttcatcttaatttcatgtatgagttcattcatataaatatcatgaatctgtaaatcttagagaaaaatcctttttagagtagatgaggtgcatactcatgcacagtttagaaatccaaccatcctggaaatacatttgtaagtactgagaaaattacttttactccaagttcaagtatattagaatatttatcctaaattcaggaagtctcagaaaattaggatctaagaaaaaacattaaatgctacaatgaacaaatccatatcactccatgtattttccttgattaaaaaaaaaaaaccacggaaattgttcaacttgagtagaagtactgaatgataacaattcattggtctcaatactggaatttgatgaaacaggacttcctcattagtagaatctaagtatgagtagaagcagtagtggcccttgatttcaaataatcctaggtagtttctgccaattgcttcatcagggatgttgaaactcacacaccaggcaaatgaaaattagggggcttgagtagctcttatcagtctggaaattgcaaccagttagacagtctctcttgattctcattgcacatgatcagtggatttatgcctcacttcttaatgacttagagatcattaaccaaatctgaagtgacttccaggttcatgtaaaaatttctagaagtgcaaaaaacatttttgcacacattccttgtctgtggtacagcaagcatatggtgatggttgacaaaataggtccaggtagactgactgagttttgtggaaggcaacatgtgtagattgagaaagatgcaagtcattggctcaggaaaattaccatatcatgtttgaaaaacatggagactgaagatcagtggatttggaacattaactatttgtggaatagcattttaagatacaaagtaagagccacactataggagcctgatgggcatttctggaagaacttccagtggctagattttaaggaacccactaggtctatatcaataccttgcagggaaaggaaacttctcttcagctgcaggacaactgatgggacagcctggggatgggaaacatatggagcaggtggaaagttattccttggttgaaattgattttgttacaggagaactcagaagagggactgagggcctgaaggaagagagtgggatcagcagcccatccttgtcagtaggagtctggagctgcatggtgtggaactaggagtagagaacactgccttgggtcttacaaccatgtaaaaattcccttcctctgcagttgtccccaattttcagtcaccagagcagtggcaggaaatgcaaacaagaagacttggaaactccaaggtcacagaagctattaggctagtggacagacaggcactggaccaagattgaaatcccttactctgctgctcataataacactgatcctcaaattctattgtgcattttgtaactgtgtttttaaattgctgactatgtaaatgtgactaatcctgattttttttattcatcttattgttgcttgatacttacataattacataataatttctgataggatggtcttgtcggttccaaacatggttatatttttctggtggcaggtaaagctggtacaattcacatccatccatggtttttaacgctgctatttaatcactgtgctagtcaagatctttgccattggagattatacatccactggaaggtttaaatattagtcccataaggatccctggagttttcattgaatcttaagcatattttagcaatttttaagttagctgtctttagatttatcattatataaataattatttattttattttatttttttccaatttttattaggtagtccccccttcccccccccgctcccctatctacacactcccacttcttgatcctggtgttacgctgtactggggtatataaagtttgcaagaccaaggggcctctcttctcaatggtggccaactaggccatcttctgatacatatgcagctagagacaggagttctggggatagtgcttagttcatgttgttgttccacctatagggttgcagaccccttcagctccttgggtactttctctagctcctacgttgggagccctgtgtgccatccagtagctgactgtgagcatccacttctgtgtttgccaggcaccggcatagcctcacaggagagagctatatcaggttcctttcagcaaaatcttgctggtgtatagaatagtttctgtgtttggtggctgattatgggatggatccccaggtgcggcagtctcttgatggtccattctttcatctcagctccaaactttgtctctgtatctccttccatgggtgttttgttcccaattccaagaagggaagaagtgtctacactttggtcttcgttcttgaggttcatgtgttttgcaaattgtatcttggatattctaagtttctgggctaatatccacttatcagtgagtacatatcatgttagttcttttgtgattgggttacctcactaaagatgataccctccagatacatccattagcctaggaatttcataaattcattgtttttgatagctgagtagtactccattgtgtaaaagtaccacattttctgtatccattcctctgttgagggacatctgggctctttccagcttctgactattataagtaaggctgctatgaacatagtggagcatgtgtccttattaccagttagaacatcttctggatttatatatgcccaggagtggtattgctggatcctccggtagtaccatgtccacttttctggggaacctctagactgatttccagaatggttgtacaagcttgcaatcccaccaacaatggaggagtgtcctctttctccacatcctcatcagcatctgctgtcacctgaatttttgatcctacccattctgactggtgtgaggtagaatctcagggttgttttgtttttttgtttttgttttgtttttcgagacaggctttctctgtagccctggctctcctggaactcactctgtagaccaggctggccttgaactcagaaatctgcctgcctctgcctcccaagtgctgggattaaaggcgtgtgccaccactcagggatgctcagggtcatttgatttgcattccgctgatgattaagaaaggtgagcattgttttaggtgattctcagccatttgatattcctcagttgagaattttttgtttagctctgtgccgcatattttaatgaggttatttgattttctgtagtccaccttcctgagttctttatatatattggatattagtcccctatctgaattatggttggtaaagatcctttcccagtctgttggtggcctttttgtcttattgacagtgtcttttgtcttacagaagctttgcaattttacgaggtcccgtttgtcaattcttgatcttacagcacaagccattgctgttcaattcaggaatttttcccctgtgctcatatttttgaggctttttctaaacataataaaagcaatctacagcaaaccagtaaccaacatcaaagtaaatggagagaagctggaagcaatcccactaaaatcagggactagacaaggctgcccacttctccctatctattcaatatagtacttgatgtcccattcagagcagttagacaacaaaaggaggtcaaggggatacaaattgggaaggaagatgtcaaagtatcactatttacagatgatatgatagtatatataagtgaccctaaaaattccaccagagaattccagaccttataaaccgcttcagtgaagtagctggatataaaattaactcaaacaaatcaatggcctttctctacacaaaggataaacaggctgagatggaaattagggaaaaaacacccttctcaatagtcacaaataatataaaataccttggtgtgactcttaactaaggaagtgaaagatctgtatgatcagaacttcaagtttattaagaaagaaaccaaagaagatctcagaagatggaaagatctcccatgcttatggattggcaggatcaatatagtaaaaatggctgtcatgctgaaagcaatcagagtcaatgcaatccccagcaaaattccaactcaactactcaaaatatcaacttcaacgaattaggaaagacattctgcaaattcatctggaataacaaaaaacctagcatagcaaaaactcttctaaatgataaaagaatctctgatggaatcaccatgcctgacctaaagatgtagtacagagcaattgtgataaaaactgcaaggtactggtatagcgactgacaggtagaccaatggaatagaattgaagacccagaaatgaacccacacaccaatggtcacttgacctttgacaagggagctaaaaccatccagtggaaaaaaagacggcattttcaacaaatggtgctggcacaactggcggttaacatgtagaagaatgcgaattgatccattcctatctccttgtactaaggtcaaatctaagtggatcaaggaactccacataaaaccatagacagtgaaacttatagaggagaaagtggggaaaagcctcgaagatatgggcacaggagaaaaattcctgaatagaacagcaatggcttgtgctgtaagttcgagaattgacaaaaggaaaaaaagacagcattttcaacaaatggtgctggcacaactggccattaacatgtagaagaatgtgaattaatccattcttatctccttgtactaaggtcaagtgtatgtggatcaaggaactccacataaaacaggagacactgaaacttatagaggagaaagtggggaaaagcctcgaagatataaacatttattaagcagtgaaacactctgtattaagtttgtacctgaaatgtatgaactgtctgatataaatataaatatccccttgatctcttttagttgccttattgcttgagctagaacgtctgatactgtacgaaagagacttgaggacagtcgacagccttttcttgtgatagagaattctttcttgaaaactttgctgttaaaatggtggttttttaaaatgaaattcccaagcccatagtacacttcctatcaataactggtcaatttcattattaccctgtgccagagagcctggcaaacctgtatgtgttcttatatgtcttatatatagtcaattactcttatttctgattatttattgtagttgaataaatagtgaagtcaattcagaatcatcctaagtaagatcaacagtctctatgtgtaaaacaaacgtttctgtatactgacagttagttactatgttaagacacttgaaaatctgagaacaccatgagtattgcacgtaattaagatttttgaactgatttctagggactgccagccaccttacttaaatcttctgcctttcctgattttttagcctcagtgtaaaatggagcggctccagatattggaattccctttagtgtatgagggaaaatccaagtagtccattttatgaactgaagccacttgtttttagggtatctgttgttaataactccaagaaattactgcatgctttttaccaaagttcatgttgtgtccatagtgagtcaatctctgcattaataaatggtaccacgatttcagctggatccattccaactaatttttgaagtctctctcttttttttaataacaattcagagaccatctctatgtaggcttttaatttcttaccctgtttatgtgcttaaaaatatccattctaatatataatcttccatctgcatgagcattcctgtatgggaatgagtacaaggtaagataactaagatgcagggcattttggaacaatatgaactagttgtgtatcctgcatttacctttcttccagagctaagtccttctcagtcttggctggtaatttccttgggctatttatatctttatcaccttgtaaggtttgaaataaattgcttagcacttgattggccaagccaattgtaggccacagccagttagtatctcccaataatttctgaaaatcattgagagtcctcaaatggtctttcctgatttgcaccttttgtgacctatccttttgcagacttattttaggtaataaacaattaatagaagccactcgttatatttttttcaggggtgatttgcaatcttcagcaaggcaagttgttttgttgttgttgttgttgttttttggtttttttttcatcaaacattctttccatgatatttaaatctgaattagcaaatagaatgtcatctatataatgacagataatggattgggggaaattgtgaatcatctctaatggttgttgtactaaatattgaccatggccgagaccgaggagcggagcctggacaacttcttcaccaagagggacaagaagaagaaggaatggagcagtcgggctgccaatgcggcgagcagcacggacgggagcagcgcgtcagcggtctccaagccgggtgatggcgagagctcgggctctggtgctaggtcaggagacagcaggagcgcgggccctgctggcaaggatataatgaaggatgaaaatgagtggaaagaatttgagcaaagagaggttgattacagcggattaagagttcaggcaatgcaaataagtgaaaaggaagaagatgataatgagaagagagaagatccatctctctttggaagaaggtggaggtggcaatggagcagaaaaatcttcaggtccctggaataaaaccattccggtacaggcgcttcctggctccagtaacagttacagaaaccccggagccagcaatgcccagtggtgtatttaggcctcctggggcaaggctaaccacaacaaggaaaacaccacaaggaccaccagaaataaacagtgacacacagttcccatccctgcactccactgccaagcatgtagagagccggaaggataaagaaatggagaagagctttgaagtaataagacacaaaaatagagacagggaggatgtttcaaaaaaccaggcccttaaacttcagctagaccaccagtatgctgtgcttgagaatcagaagtacagccacacacagtataggtaaggaatggtctttgctaagcctaccaaggtaattagaccacagctaaccaccaagaacagccagtcatcgttttgatttctggatctacagtgactgactgaagacctcaagtccagtgactgtccctgttgcactatggaagttcaagagtcacgactgatcttgatgtgtgttggatttaggggtgtttcattgtcttaagtatttgtgaattagattcaacagtgtttccatagttgctctgcgtataaagccaaacctgcagccagtggtcattcaaacatctttatgttcagatactgagccttcacaaggttgactacctcagacttgctgtccttagttgtgaatttcatgtggatcacatcttctatataaggttacagctactagtgtctgtgtgaaccttgaaaccaactctacaggattcctgtcagaaagccttcagaagtcagccatctgtgtcctgatctgctgtaaaagatgaagaggtaagtgaccttaattaacctgttctgtgccccatcctaaggcatactctgtaggctgtggctatgttagactccctggatcaagctgctgtctgaaatgatgtgtttgtgtggagagccgtgccgcgagcaatcgcgtgcctgccgtgagcaatcgccattataagatgtcgctggcttccactgcgcctaactagtaaataagccttatgcgcaagtgcaagagtgaactcacgcctagtcactgtccatctcgctgcgtagtaatggggtgatgggcgaacaacgaatcaggagctgtcacgccacatcaggtgctgaaacgtcacactgcaggctatagaagcagcgccattttcccggttcggggtcttccctcctgataagtaagcaataaaagctttgccgcagaagattccagttgtcctgagtgtgttcttgccggcggggacaaaagctcgggataagtggcgctgagaagcccaggaactaccatcacaccggtgcaagggagatccctcgttcgtgaggcggaaccagaactgcgggacaaattacagctttatgaggtatgtctagccttgaactttctccagtgttagaagcctttttgttccttttcacatgtcaaaaagtggttaaggcagggcagagaattctggatgaaattcaagacagtctaccagaggtaaagcggggagagagagtaggagcaaagaggaaacatggtgcaccaattaagcatacaggcctttccacgggtcttgaacctgatgaaaagttaatgtcagggaagaatacctggggagagattggaaggaaggagaaggaaaaaagaaaagaaaaaaagatcaatcagcagaggtttctaggagaaggaacttatacccgccactagatgagtttaagcagctagctcttagtagctcagaatcagatgaaggacttagctcctctgaagaaacggacttggaggaggaagcagttcgttataagggagaaaggtaccagcaagataaaaagcgagctactcagtccagaaaaaggcaaaaagtggctggtgaaagccagcttgctgctcagccttcagacagtcggcttcagggtcctagtgcacctcagtcctatgtgcagaggcaccattcagaaccttatgtgcagaggtaccattcagagccttatgtgcagaggtatcattcagattcattcattccaaaagaggaacagagaaaagtgcagcaagcattcccagtttttgaaggagctgagggagggtgtgttcacgctccagtagagtatatacagattaaggagctcgcagaagcagttcgcaattatggagtcagcgctaatttcactatagcacaagtcgaaaggcttgtgaatcacgctatgactccctcctggtgattggcagactgtagtaaaagctgcagcccccagtatggaaatgtatcttgagtggaaagccttgtggcaggactcctgccagatgcaggcaagggccaatgccaccaggaaggggaccaaagaacgtggatgtttgaattgctttaggtcagggacagcatgctgctaaccaaacagattatcattggggagcgtacgcccaagtctcagctgctgctgttaaggcatggaaggcactaagaagggagaggcaagtcggcatttgaccaagattacccagggtgcacagaagtcattctcagattttgtgcccagaatgaaggaggcagcagggaggatatttggtgatccagaagcagctatgcctttaattgaacaattggtttatgaacaagctacacaggaatgcagatcagcaattacacctagaaagagcaagtggttacaggactggttaaaggtttgccatgagcttggatggccgcttactaatgctggattggcagcagccattctgcaggggaggaggcgctcagattcaactgagctcaaactttgctttaattgtggcaaaccaggacatttaaaaaaggactgcagagcccctataaaaaggtcagcaccaggattgtgtactaaatgtggaaaaggatatcattgggcttaggactgtcgttcagttaagatatacgaggcaggctcttgcagcctacaaggtcttattgttcaccctggagttgtagatcaggattataaaggggaacttcaggttctctgttcttgtcctcaaggtgtcttttctatatcacaaggggacagaatagctcaactaataattttgccaagcctacttggctgttttccttcctctggtattcctcgagctgccagagggattggttctactggaaatgattctgcttacttaataatgcctttagattccaggccatccttggagttagttatagaagggaaacaatttaagggaattttagatacaggagcagacaaaagtattatttcttctcactggtggcccaaaacctggcccgtaactcagtcatcacactctttacaagggctaggctatcagtcctgctccactattggctcccgttctttgagctggcaaatggatgtcacacatatttcctcctttgggaaaaatcaatatttacatgtttgctaatctgtctaggcagatttctttgtatcttgcaggaaattggtctgaaagattcgatgagacccttgaggccctgagagcggctgttctcaggatcaactcgacacgagtcgacctgtcattgacatagggtctctcctcctggatttcatctgctttttcttattttaaggaatgggtgggggtggttttatttgctgctgccatctgctgtggacttgtgtttatgctctggttggtttgtaagctcagaacccaacaaaaccgtgacaaggtcgttatcgctcaagcacttgcagccattgaacaaggggcctcccctgaaatttgcctgtccatgcttaagacctaaatggcatctgagttctctgctattgtgtcccacggatttgtggatacattgcactgggatataagagactcaacgctcattgatcagcacttacacctcgctgaggtttactaattagttttttggctggcctcttttatagagttccctaggtcatttagcagttactgtcacacagtactgcggtatccagagacgggcaactttcctcatgcacagaccaacctaagacacgggacccggtggcgatagggttaccctatgacaggaaaggctgtgacattggaggaatgacctaagacaggagccacagcagatggacatgactgcagaggcctagaccagcctcaaattttaataaaataaaaagggggagatgtggagagccgtgctgcgagcaaatgcgtgcgtgccgtgagcaatcgccattataagatggcgctggcttccactgcgcctaactagtaaataagccttatgcgcaagtgcaagagtgaactcacgcctagtcaatgcccatctcgcggcgtagtaatgggatgatgggcaagcaacgaatcaggagctgtcatgccacatcaggtgctgaaatgtcacgctgcgggctatataagcaacgccattttcccggttcgggatcttccctcctgataagtaagcaataaaagctttgccgcagaagattccggttgtcctgagtgtgttcttgccggcggggacaatatgtttggatcatctgtgtggggcttatgatttataatttaagtttttagttgtatgagttaactgtggatttaattcaaccaaactcggttccaccaaatgggggatagtcttgtttctttgaataatttttcattcagatagtgcttgttcgattccacattaaggccttgctttgacttggagtaagttctttaagggcatattgtgtggagaaatagtctgaaagaagcattggaattgtgaaatgccctatgaatttgccaatccttggtggaaccagatagcctttgatgcatataaaggacagcggatccgctgcactccaggtgctgctcaagcctcctaatcaggtctaattgaactgctgtggacagagtatggtgtctgctcactgctgtggacagagtgttgcgtctgctcaggaggagagggtttcactgacctggcttttaacagttcaaagcaacaggagcaaaacatccaagttgcacatgaatctggcatggtgtctgataaatccttgtgtgtgccccaaatgtgaaggttatggggtattctgtaggttcattcattgtttagccagctcttgacattcacctttggaatatttttggtaataacttggagatgcaggggaatagccagtagtgtagcatttctgttgtttgtaatttcaatgtaactatctagtagtacttggctcttagaagatgttactgctaaatttctttctacctaatgaactagcctgtcggttacctactctgtcactacatatagttcagttcacataccctatgttggcatatgactatgtaatacgatagtagtgcctgggtttctctatgtaaatgaatcccttgccaaacacagttcagacttgctcactactgacaggagtggaacaggaaatgaatgttttcccagcttgggagcctgtttattggatttagggcagcagtgtgggaagcaggaggtggaggccagtatctcctatcagactgtatgccacttctaggcaataatgttggtatgatctgaactagccaggaggaggtggggtgactagagacttgagattcttagttaaactgaagacttcatttgggcaccagaaaccttaacaaataatctcacaccttgagccacaaacgtcccttaaagtatgctttacccaagcatgacacacaaacacacattctgtttggggtatggtttaagatgtgaacagaaacatgatgaggtttgtttaatggcatactgtactggaacgctgaagacctgctgcagatgtaaattccaagtcttgtttttttgttttgttttcttttgttttttttttttcggtttttcgagacagggtttctctgtttagccctggctgtcctggaactcactttgtagaccaggctggcctcgaactcagaaatccccttgcctctgcctcccgagtgctaggattaaaggcgtgcaccacaacacccagcttttgttattttttaagattgtgaaatcataaaaatgcatatgaatcaagttttaatacactgggtggatgaggctgccattgcacaatttctatctttgggttctcaggcatggttccgacagtgtaagaactctgtaacatttaacattaaataaacagtaaacctatgaaaaaaagaaatgacataaaaaggaaaggatatggcttctcctaaatatggtgaagtagaatgtgtcttatcatcaaaagaaagagaatagccggacacaggaacagtctacaatggacagaaccatgagcctcatgaggagagggagcaggaaagccagacccagaggccaggagggtaaatgatcagtaaaaaagaccaggtagccaaatggatgcattacatgaagaaaagcagctgggaggacatttgcccaacctctgtgctaggggtctggaaaggacagcattgcactgtagcaggtagggatagaggactgtttggagaacctggaaccaaggactgatttgatttgttaaataggcacgttggccttttgttccagggtttaatattcaacattagggatgactgaagagatggaaatgatttaattttaatctcaaaagttattttaaaaaatgaactagttcttttatgtcttctctgcctaagttatcaatggaggtagagggagggagggacttaggtgggaaaagtgagagggagggaaaaaggggagcagaatgagttatgggtgggagacaagagagagcccagagggctagaagaatgaatggaaatatggagcagtagaatttggagattggagagaaacctctagaaagtcttatagacctggggtgtgagaggcttcctagatcctgccatgtccccatattgatgataatggactgaacctctgaacctgttagccatccccattgaaatgttcttttgtccttattttgccttggtcacctttctgttcacaacagtaaaatctatgacagcaattcttaattataaagcttgatgaaaggctgagctacaggagatgttgctctaaacagacacatgtatgaaagtagctgatcaaaggaatgaaatttctcatgactgggaaacattagggatagaaacaattaagaggtcagatcagagatgcataaaggaaacaaaattgaaagatcaataccaagacaatataattgaaaaatccccaaggtacaactttgttttggtaggaccttttccctcaagaatttgagaagttgctgtttcatgcgaaaacttgccatcatttatctgccttcatatgctgccattcgaacagggcagcacgtcttctgccttaacttgaacttgacaaacgctgaactctctaaacgaagccgactgaaggagcgaacacgcagactttttaattctgaggtgatttttcctctcagaagtccaacgtcacttaatgtcacgcccgtgagcgaaggcggcaggacgacgaaggccagtccaggcctttgctccttgcctaacagtcgcgccgttcccaagagggacccctagcgcggtgggagccagcgagctcagcctttaagggagcgctgaagacccagctcgctttactcggaggagtggaggcgcaaagcaccgctgacgcgcttcctcgaggccccgcccactcggctccacagcccgctagaggcctggaggaggcggagccaaggaggagcatgcgcacgcgccctcgcaagccggccttctaagggggaacgagcgatctcgcgagggttgagagcgggtagcgtaggtatctgtcctggttggctggagaagagaatcaactctcggagagaaggcgccgggtggcctctgagaaccttcccttttcctttccctttccctcggccctccgcctcctcagagtcagcccgccttccctgacctccgtgaccccactggccccgcccactcccgtcgacgtgattcccgccgtgaggtaaacgccagtgaggcagagtcccgcggaagaggacggcgaggcgagcggcgcggctgggccggctcgggtcggtggcggagccctcgcgcgtgagagcttccgggcacgtctcgctcctccggcggcccggacgccagtgtcgcggaggcccaagctgcttccctcggcgccgcgcctgcccgtggccgcggcgggtgacgcagccggaacatgttgtccgctgtggagcctccgccgctcccgcctcccgagagcgcgccttccaagccctcggcgcccggcgggagcagcaacggcaacaaaggcggccccgagggctgcgggctcgtgccccggccccgcggacaccgagatggaggaagtatttgataatggatcacctggaaagcaaaaagaaatccaagaaccagatcctacatatgaagaaaaaatgcaaactgaccgagcaaatagatttgagtatttattaaagcagacagagctgttcgctcatttcattcagcctgctgctcagaagactccaacctcacccttgaagatgaaaccagggcgcccacgggtaaaaaaggatgaaaaacagaatttgctttcagttggagattaccaacactgtagaacagagcaagaggaggataaagagctataaacagaaagttccaaagcaactaatgtttgtactcgatttgaagattcttcatcatatgtaaaatggggtaaactgagagattatcaggtgcgaggattgaattggctcatctctctgtatgagaatggcatcaatgggatccttgcagatgaaatgggtttgggaaagacacttcaaacaatttctcttcttggatacaggaaacactatagaaatattcctggtcctcatatggttttggttcccaagtctacattgcacaactggatgagtgaattcaagagatggataccaacacttaggtctgtttgcttgataggagatgaagagcaaagagctgtatttgtcagggatgttttattaccaggagagtaggatgtatgtgtcacatcttatgaaatgcttattaaagagaaagtctgtgttcaaaaaaattcagctggagatacttagttatagatgaagctcacaggataaaaaatgaaaaaatctaagttgtcagaaatagtgagagaattcaagactacaaatcggctgttgctaacagggacgcctcttcagaacaacctgcatgagctctggtcacttctaaactttttgttaccagatgtgtttaattcagctgatgactttgattcctggtttgatacaaataattgccttggggatcaaaagctagttgagaggcttcatatggttttgtgtccattcctccttcgtcgaattaaagctgatgttgaaaagagtttgcctccaaaaaaagaagtaaaaatctatgtgagtcttagcaaaatgcaaagacaatggtatactcggatattaataaagatatagacatgttaaactcagcaggaaagatggacaaaatgaggctattgaacattttgatgcagttgaggaaatgctgcaatcatccgtaactcttcgatggagctgaacctggtccactgtacacaacagatacgcatctagttaccaacagtggcaagatggtggtgttagacaagctactccctaaactgaaagaacaaggttcaagagtactaatctttagtcagatgacaagagtattagacattttggaagattattgcatgtggagaaattatgagtactgcaggttggatgaacagacaccccatgagagacaagactccatcaatgcatacaatgaaccaaatagcacaaagtttgtatttatgctaagcacacgtgctggtggtctgggcatcaatcttgcaactgctgatgtagtaattttatatgattcagattggaatcctcaagttgatcttcaggctatggactatgcccatagaattggacaaaggaagactgtccgagtgtttcgctttataaccgataacactgtggaagaaagaatagtggaacgtgctgagatgaaacttagactggattcgatagtaattcaacaagggaggcttgtagatcagaacctgaacaaaattgggaaagatgaaatgcttcaaatgattcgacgtggtgccacacatgtgtttgcttcaaaagaaagtgaaatcactgatgaggatattgatggtattttagaaagaggtgcaaagaagactgcagaaatgaatgaaaagctgtccaagatgggtgaaagttcacttagaaactttacgatggatacagagtccagtgtttataactttgaaggagaagactatagagaaaaacaaaagagtgcattcacagagtggattgaaccaccaaaaagagaaagaaaagccaactatgctgttgatgcatatttcagggaagctctccgtgttagtgagcctaaagcacccaaggcacctcgacctccaaaacaactaaatgttcaggatttccagttctttcctccaggtttatgtgaattactggaaaaagaaattctgtattacaggaaaactattgggtataaggtaccttggagtcctgatctacctaatgcagcacaggcatagaaagaacagctaaaaattgatgaagcagagaccctcaatgacgaggagttagaggaaaaagagaagcttctgacacaggggtttacaaattggaataagagagattttaaccagtttatcaaggctaatgagaagtggggtcgtgatgatattgaaaatatagccagagaagtagaaggaaaaactccagaagaagtcattgaatactcagctgtgttctgggaaagatgcaatgagcttcaggacatagagaagattatggctcagattgaaaggggagaggcaagaattcaaagaagaataagtatcaagaaagcactagatacaaagattggacggtacaaagcaccctttcatcagctaagaatatcatatggtactaacaaaggaaaaaactatactgaagaagaggatcattttctcatttgtatgctgcccaagcttggcttcgacaaggaaaatgtgtatgatgaattacgacaatgcatccgaaactcccctcagtttagatttgattggtttctcaagtccagaactgcgatggagctccagaggaggtgtaataccttaattactttgattgaaagaaaaaatatggaactagaagaaaaggagaaggcagagaaaaagaaaagaggaccaaaaccttccacacagaaacgtaagatggacggtgcccttgatggccgtggaagaaaaaagaagctgaaactatgaatgcatttttgtcttataatcactaactagtagttctttaatttacaggtcttcataagatgtgctggacagtgctcaactgttatgtcattcagacatcaggtccatctgcttactgagatagaaacatagtatgtagtttcacttttttttaaatgcaaccgctgtgctgaaatttttttatcattaacaattgaagtaataaaacaggcttcatttattaaaaagaaaagaatttgagaagtttaatcatgagaaaaagcaatgtcattgtaacagggggcacagactgggatcaaggtgacctgagccaccacagcttatttcagaaacattattgtaaatatttctttttgtaaaaagactgcagataaagctgatggaaataatatacattgttagagtgaaatcactccatacacaagcagaagatgaattaagaaaagttgctttagtgactgtgtgcattcatgacaggctaattatcagactaatcagcctagcataaatctgaattcaacatatgctgtcagtcttaagtttcttttaggttgagttcccagaatatgctttgaaccagttaaatatggactggatactgcatatctaggctcttaggtagatggaaggtttacatagtacagatattgtaagactcatttcttacatagccattttcctaaaaaaaaaaaaacccacaaagatagcagtatataattttcatttgtacctaagatttattattcaaattgttttgttttcctccatgttgggatgaccatatgtttgtaaaaaaaagactatattttgatgtaattcctaaccatttttgaacatctgttagaagactcagagtgaaatgtctatagggtgcaaatcgaacaacctgtccttgatcactatataaaaaaatgtccatatttcctcccttgaatattttgttccccaatctaggtagaactaaagcatccacactttgatcttccttactcttgagcttcatgtgtactgtaaattatatcttagttactctgagctgtggagcagagaatgacagaaaagccatccagacactgacccacctgggaatccatcccatatacagacatcaaacccagatactaatgtggatgccaagaagtgcttgctgagaggagcctgatatatctctctcctgagaggctctgccaaagcctgacaaatacagaggtggatgcttgaagccacccattggactgagcttgggttcctgatggagaagctagagacaagactcaaggagctgaaggggtttacaacccataggaagaacaacaatatcaaccaaccagaccctccagagcttaccaggactaaaccaccatccaaagagtacacatggaaggatccaaggctccatctgcctacgtagcagaggatggccttatcaggcatcaatgagaggagaggcccttggtcctgtgaaggctccataccccagtgtaggggaatgtcaaggtggggaggcaggagtcggtgtgtgtgggagcacctgtacagaagcacagggagggaggatgggatgggggcttccagaagggaaaaccaggaaaggggattacatgaaatataaataaataaaatatcagcatcaaccaacattagccactgtgaaaattctctggcaatcatttgctgttctgagaatgaaacatctatttagaattaagtatgaactaatacacttgaaaaaaatatatttgaagcataaaaatataattgaagcataaaaaatgtccaaagtagattccacaaacttgtgttccaatttgcacatatctctcctggcctaaatccttgtaaaaatacacacatacaccatacacacacacacacacacacacacacacacacacacacacacacacacacacacacttactcatgaatgcattcatttctgttaaggtttcttaaagcctatctgcagaatttctcttcagcatgaacttgttcaagtaacagataccaagcaacaaggcttcaagtcagaaaagtcaatccttcctcaagagtggcatcataatatttgaatagattgtttacccttatcagactcctttcttcagaatcaataatcttgtgtgactggatataagtgtgttacctaagaatatgagcaaattctttatagacatatattcccctcagtatgcatattttcagatgctcaaaactacagtaatatgcaaaatatctaagaggttcattatgcactaaagtttgtactcttgtgtaaaggtatcaggaggtacaattcaggtacaggttcagctctttattggacaagttaacaaaagcagtttagtcaaaaagaccaaagcccctgtcatcttcggactcctcgggctcttccttctttgcttccactttcttctcctcagctggggcggcagcagtggatggagcaggaccaccagaaggtgcagctccagcagctggagtgggcccagcagccccaacattgcagattaggctaccagtgttgacattggccagagcctttgcaaacgagccaggccagaaaggttcaatgctgacaccagctgctttaatgaaggcattgatcttaacttccgtgaccatcacctctttgtcttgcaggatgagggcagagtagatgcaggtgagcttggagacagacaccatgttgtggactgctgacatggtgctagtcgttggatgaagtgagggcctcaccccaacgtggcattagcaaactgaccacattaacaggtttgtctgtagacatcccaatggctatcttaggaagctgacagtgacctatgggaacctgtgctgccccatgcctatgtatgcttcacctgtgcagtgccttcctggctgtgttaaatcaccagtgctgtggactggactcagcccctcaactcgcaggggccccttaagtgtcgggagactcagggtcctggtacacaggcgtgaaggagtcagtggggtgacaaacagatgcaaacataaaagagtgttgatctgaatgtaatttctcaaaggaagcatcagacttatgatacagaagaaaataaggaagttaggtgacacatcacccaaggtacgttgaggttacccgatgtttaatgactctttacacaaaacagaagaatgcatacataaagactgacaggaactaagtaacataacaactgagacacagtcatctctatctaaggtcagctatattcctaaaagccagatgtgaggtcattatgttcccagggcaagtcctttcttgcccaagccatagttctaattctgatttattgtttagcccaccaccagccagctcttagtaaatatctaactatggtatgcttctgggctagtgaaagtatgtgctagggagttctgctctaggtaaccttctcatgaataatgcaatactctagctccttcttaaaccacatccctacctacttcctaaactattgtaaattcttgtatatgtaagtgattgggctattattctaagtgattttgtcggggactttcttctattaagtaatgtagtctgccatatataactataataagaactctaatcttactttgctaagctttcctgagatttctaactctatttagtagatgataatgcctgctttctttcactatctctttttcaatactggaggcaatctgtcttaatctgtagcattcttatgaaatcccaagtccagggctggctcaagtgctggctaggacattggtgaaggccaggaagcaaagttcaacctaatttaggtatttgacaaatcattccttggaggcactgataataaaacaatactgaaagaaagcacacagacccattcacctattaaccaagtttataggaacattatggtatgggatgccaaggctccaggagactaagtttccatgaaagtttttgactcaggacttttcccaagcttttgggcttgcttcacagatttcactgaagtggctatgatgcaccagcacctggatatgtaaggttctgtaaagaaaggctttccacgttcagtcttctgcctcaccagtcttgatttctgaacttataaatttgaccataagctacttgtgaagtaaaagatgtttaatggaacagaagaatgagggctggtgatgacttaaaagttaatagcaggggtgggtgtggggggtgggtgtgcaagggacatagctcagcggttaagagtgctgactgctcttccaaaaatcctgagttcaatcccagcaaccacatggtggctcaccaccatctgtaatgggatccaatgccctcttcaggtgtgtctgaagagagctacagtgtagtcaaatacataaatacaaaataaaaaaaaagttaagagcactggcctgctcttgcagaagactcaaaattgattccaagcatcaacatggtggctcccaaacatctgcagggacctgattctctctcctaacttctgagtgcaccagacactaagtggtgtacatatattcaggttggcaaaatgttcatacttgacaatagaccagagaaataaatttgaaaatggccagaaacataataaaaacaataatataataaatcttgaaaaataataaaggctgagaggggagtcatcccttcaggctcatttatgaagggggatacctgcagcagataccctcaacaaactccctggcacattttcttacatcacaccaagaaaacaatccagacttggccatgtgtcccctaagagtttgacattgggcatcagggacagaatgctcaataccacaaatgtgtctgcttcagagctctgtgaagtgagctcagtcagtgcttacctacacacacaccccatgagggatgggaacacaaagcagactgttctcaactttgaaatgtcatgtcttggagagctgcagccggagagcctggttcaaagggaacatacttagtaaagcttgtggtcttagacaaactcatctgtccttccacatacatgtatggagtactggtgtgtcccaagcactgaactagccagggcacttgggagagaaatggacaagatcaccattcctgatgacatgcagctgacatgctctctgaaatattttccccaccagggatggtatggtgagaccagaagccaaggacaggtggccattaggagcccaggagaagttggggcactgtcagttcactgagagtgagctactgccacctcacaagacatgtccaatcttgtcatcacagcagactcagtaccattgcaaaaacaacctcagcataagtctccagaataagccttgctcaatcccaaaataatctgaagtgtgagggaattgaataacaacttatgtaagtagacacatatttcccacagaatattaaacttaagaacatacattaacatttttaaaaattacatttattgttgggtatagtggctcatgtttttaatgccagcacgcaagaggcagaggcaggtggatttctgagttccaggccagcctggtccatagagttctaggacagccagagctaagtaataagatcctgtcttgaaaaaaaataatcaaaacaaaacaaaacaaaaataactgaatttttaaaaatctatttgtggagggggaacacagcttacaggaggccattctttccttcctcctgggatcagggatccagctggggagtaggtgcctttacccagcgaaccatcttgctgggtcaggaaaacatatttttaaacatgctacatatgattccacagtttacatggaaacagcagacattccatacaagactctgagtcaagcactgctttaatcctttggatgatgtttttattttgtttttattttaattatcattactgagggtggggcttggggtggagcttgcaacccacagccttatgcatgggatacaggtgctctactactgagcaaacatccccagtcttcaagagtgaatttaagctcttcaactcatatagacaaacaaatatgcccaagccttaggaagggcattggaattctgtttacagatgatgaaactgaggggtaaagctgaccttggtggtgtacgtctttaatcccagtgctcaggtggagggtgcagctttgagttcaaggccagcctggtatacagggtgaattcctggacagtcaggactacacagagaaatcatgtctcaaaaaacaaaacaaaaatacttcgtttttatttatgtgtaatgtttctttgcatataagtcagtgtaccatatgcgtgcctgggactcacagaggctgaaagagagcatcagttccctaggaactgcagtcatagttgatggtcatgagccactatgtgtgtacctgagaacgacctttggttccctgaagagcagccagtgctcttaaccaccaagccatctatccagatcctagttcttctctttaaaatgtggctggcaaaaagcatccttgcttcaagtggtggagaattaaatacaactttttatttctaaagcatttggaaaagtgcctggcctttcttcttgatgctaaggagcaaatgcagtattagctgtgaggtgggttctgatcactgcatactgtacacaactggtggtttgtaaatcaaagctgggggcagtgaccccagaatcctggaccacagtcattctttgcttcctttgtgtttcaagagagggtctcatgtagctcaggctggtcttcctcaaactgactatgtcacagaggatgtgcctgactctttaatccttcggcttccacctcacaaattctgaggggactaaaagcgtgtaccatctcaacatgtgacatgggtctgagctctgaatgcaaggtttgtggtaccaggctagcacattcccagcctgagttactactttccttttaaacatttttcttattttattgaaaacatattatttttttgtataagggtgttttcgcctacatgtgtatctgtgctccatcacatacatgcctggtgcccacagaggtcagaagaggacattgtacttcctggaattggagtttcagttctgatccaccatgtgagtcctgggaattcaaccctgctccacaagtgcagcagagtgtttttaattactgagctgcctccccaagcctctaaatcacttcttaatatgcaggaatgtatataaactggcaacatatccttggcaaccttactaaaactgtgatatagctctaaatgtcacacaggatgagcaatgataaatacttacaaagtttaaaaaaaaaaaaagaaaaagactggagcgggacacttagagctagcttcaaagcacaaggccctctcctgtcctctgcagctacccgcacttgtgtgtgtgtgtgtggcctgcgtactgtccgtaggtgtgtgggtctatttttgggtctcctattgaattccattaatccacctacttatttctttctataccagtaccatacaaatttttattactatttttctgccatacatctttaagttacagaaattgatagctccagattttctttttttgttgttcaagaatattttatctatcctgtggtttttgttttgtttgctgttccatacaacattgagaatatttctttcaagatctgtgaagatttgtgctaaatttttgataagaattgtactgaatgtctagattgctttttggtaagatggacatatacattatgttaatcctattgatacatgaacaagggagatctttgtcatgttctgatatcttcctgtttcttccttaagatactttaagttcttctcctacaggttttcacttgcttgtttagaggtaactgaaggtattttattttgtttgtggctaaagtggagggttctgtttccataacttctttttcaacccttttaatcaattgtgtgtagcagggctaaggctttctttaagtcaattgtgtatgcagacactttgctaaaatgtttatcaactgtaatttttggtagaattttttgtctcacttatacacattatcagaatatctgaatttcttcttttccaaattgtattcccttgatctcttaagctgctttattgcttgagctaatacttccagtactatatcaaagagatgaggggatagtggacagcctttccttgttcctgattttaatggaaatgcttaaaatttctctctatttagtttgattttgggtgatagattgctgaacattgcctatattttgtttgggtataccccttgcattctgtccctccaaacatatcctaaaagggggttgaattttccaaatacctttttggcatctggtgaaatatttatgtgggcttatctttcacttttttttttcctatggtgcattattgtgattgcttatcctggttgtcaacttgactaaacctggaatgcactaccatccataaatacaggaaatacctgtgatcaagatctgcggctttaagaaacaggcttctgccttacattgtgacataggatgagaacacttttattcagatcttgaggccatagaggccatgagatggttaggcctagttaaggttgtatatggctttaatttcaggagactaaggcaagcagaactctgagatcaaggccagcctggcacagatcaaattccaaagcaagtcatggttgtatacaccattaatgtagagcatcccttctgctggaggcctacataaagctgatgaaagaaggacgtctcactcttcttcacctgcttgcacttacttgccagcacatctgttggaacttacttcttcaggaatcctggttattcagaagaccaggcaagacatgtagcatcatgggactgcgctagattcttggacttcctgttcactgatttccattgtagggcttgttggactgtagactgcaagttattagtataaagtctcttaatatagagagatataccataacttctgtgactccagaaaaccatgagtaatacaattatgttggtatatttttaaaaaagattaacttatttattgtgtatggttttctgcctgcatatatgcctgagtaccacaagagggtgccagatcacattatagatggctctgagccaccatgagccaccatgtgtttcctgggaattgaactgatgatctctagaagagcagtcagttctcttacctctctgagccatctcttgagccgtgtggatttttatatattgaatcacccctgcattcctggaaatattggcattagttcttctttgacagtcggttagaattgtgcactaaaatcatctagcccaggacatttctcttttggttcagagacttttttttttttttttttttttttttttttttttttgagacaaggtttctctttatagccctggctgcctgccctggaactcactttgtagaccaggctagcctcaaactcagaaatccgccttcctctacctcctgagtgctgagattaaaggtgtgtgccaccacgcccggctggttcagagactattaatgactacttctattctgttaggggttataagataattcagatattttaccttttcttgattaagctttggtaattgttatatgtctagaaagtcatccatttccttcccaattttgtggagtatgggtttttcaagaaagacataattattttttaaacatcctcactgtccttagttatgactcttttgcaatttccaatatccttaaattggatactgtctctctgacttttagttagtttggctaagggtttgtgtaagttgttgattttttttccccaaagaatcagctcatggttttcttgattctttctgtttttcgttgtttctttctcactacttttttttgccttcattcgttttatcaattacttcatgtatttacattccaaatattggccgctcttcttagtcccatgaattcttcactacataagccctagcctttgcatctgaaagtgctcacccaccaatccacccactcctacctcatactacttgcatgatacatcactggggcatcaagtatgggaccctcttttttatttcttaatgtcatttgtcttatacattctgctttattttcattcctcctgatatcttcacattaggactgaccattcaggagatggtactaaggacttgtttcagtaaaactccaacaccaatagctaagcaaagaacacacaactcagttacaatatatataagctgcatgtcttgggcagatattccactacactattctattctccagcttttagaacccttgctatctgtggcttttcagggccatgtgttcttttccatctttcttccaccttttcttcctctaacttcctctgcctccttcatttcctcgtctccctcttctttttctgtctttgccctctctaaaatctccagccccacctttcccttctattgtccaatcacaagctctggcctttattcggccagttaaaatggagagaaggttcacatgaaattacatgagtatatagtccactgttcattggggcagcccctcttgaggaagcagaataagcattaaagtacaaacagcaccagggcaatccacattttgttcaatcccttttgttcaactaaaaggatcttttcacatataaattgagcacaacacttgaattatgaaattttacaagtaaaagtaccctaaacacccaggccacccatcgtctccatttagataaagcactaccatctatcctaacttaaaaggcttacaattctatacctgaattatctcctggttttagcttgtatctgaaaaccatcctctcaaatatatatcatgtcagtcaatgctaaacatcttgagttagctatgagagtacaacaagacttcagcagctgtaagatagaaatccaagcatgtcctaaatgttacctgaaaatataggaagcataaaacatagcttccaaaacccaaccaaactgtagacacagttgacaacctggacagtccctcattccttcaaaatggtggagcatcagtcttcagccttctggccaggatcatctgtcagaactttgtaaagcagaattttgaaggagtgcttagcctgtcttggcagatctattagttactcttccacatagtatgtccttttcctggacaggacttttgtctgtagatgaagtgaggcaattcttctctggtggctatttcgccacaactggagcaactccactgatatgcattttatgtttatacaaagaatggatgctgtcaggagcagatatgtctctagtcgagtgatctttaataatgaaattgccttaactgtagtattctgtggacttctgacgcctttgaaaactatctatctatgcaaagtatatctgaactgttaagccttgactgctctcaaccatttctgattgaaatatctcaaaaacaaaaactttatgattaactcaggactatgattctgttatctgacccttaacttgtattttcaatcatctaaaaatatttagtaatagcagacatagaaggacccagtctaagctttgtattcgtaaatgtgttgcatgggtacaaatcctatttaataacaataatattactcccaatttttacatcaatctatgaatttcataccattgaaaaccttaactctattgaaataaattctgtagaaatgtaagaaattataagttcaatgctacataaattataaagatttctatcactgtaagatatggccatgtaatgttttaagagtaaagttgacaacctattcttatttgtctaatattctaatttctatattactatatcccatctttatcttccctgtgacttttatttacctaagaaggaaggatagagaagaggaaaggaaaggtagaagtccctgagtctaagctctctagctccctccctgtctaaatctacaatatttgtaaaatattccttaaaatgataacatatctatgattcataaaataaccagaaccatccaccacaatataagatactgatacgatgatcttcttttgtctgcttatagctgaattgaggtgaaaaaaaatcccttctgtaggctgaagggaaaaaacaggaaaattggtttggtcaaaggaggactagttagtgtcatttgccttccaggcattatgtgctgagaaagttcatcgcttagatgaaatcttgactatggcagtctgaaaggctgaataggtgatctagatattcttgaaaagttttggaaacaactatttggaagaaacagcttcaatgtacttgaggtagaatcaaacaaggagacagaagggaaggtcgcataatctcaacatcctggagtgtgaatcttatcagtgctgtctttctcttctttcatcctgcactatacaaaacttacaagcaacatataattctggaaagacattcatatggagcatgcagggtgcacagactggttagttaagatcaataaaggaagacaactgcctttcttcagagattagtttgatcacatagtcaaactacaatatacatttccattcatgccatcttaaaggatggtatgtaaaaagtcatgagaattttgtacccagtaggggttattgggtgtgtatagacattttagtcaaagccagttccagagctgtctctatatacagagacataaacatcaccacgtatatagcacctagcttgttgattgtgttagtctccctttccttctccatagccaaggtattcaggaggtcttcctttgacatgtctcatttttatcaacttgaaaggaacccatagcttttcttttcctatggaaatataaggataacccctccacttgtataatacatttgttattttccattctgatttcatactatccttaatataaacaggctggtttagtttagtagttctttccacaatcgaatgactttcagcatcggtaatgttttcttcattagcatttaaaaacttaggttaataaagcattatataatcaattttggagatttttgttgcccccttttgcctgttaaatatcccctttagagttttcttagacatctccacaatcgattgtcatgtagggttatatgatattcttgttatgtattttatatataataacattttaaaaagctgcttcatcatactagagacgtatgctggaccattgtgtgttttgatttgtatgggtattcccagaatggctataacatctaacgaatgggtagttacagattcagccttttctgatgctgaggaagtttcccattgaaatccttaataagtgtcgatagtatgatgcacacatttcagtttaccaaactttgtaaaatggaatatatccatttgccaaaggacatttctttttgtacccttatgcttagttcctgaaggtaatggaatttgattgtataatgagcaagtaggacattgcctcacatttcccttggctctttctttaagacttgctgttaacatgatttgtttatggaattctaaagtctcttttattctttctatcaatagctggtcaatttcattatcaccttgtgacagagggcctggcaaacctgtatgtgatcttatgcgtaatttatatagtgaatgactcctatttcttatcaattgtggtagctgaaaaaatagtgaagtcaattcagattcatcctgaataagatcaacagtctgtattggaaaaacaaccctttctgcatattgagagtcagttactatattaagagactctagagaatctgacaacactgtgagtattgcacataattcagatatttgagctgatttataaggacattcagtgacctacatcttctgatttatatcctgcctttcctgatttattagtctcagcataacatgtaggggctccagataatggagtttcctttattttatgagggagaatccaagtagttctttttatgaaatgaaatcatttgcttttatggtatccgtcgctaatctctccaagaagttactgcatgttctttaccaagattcaccttgtacccctaaggaggcaatctctgcattagtaaaaggtaccactatttcaggtgggttcattccaactaattgtcaaagtctcatttttttctttttagtataaattcaaagaccttctccatgtagggatttcttactctgtttatgtgctaaaatcatccattctttttttttaattcatatgtttgtttgtttgtttgttttgttttatttttgagcctgtttccctgaatagttagtgctggctttccaggaactcactgtgtagatcaggctggcctctaactcagaaatctgcctgtttctgtgtcccaagtgctgggatcaaaggcatgtgccaccactgcccagcaaatattcattctaatttatcttcccactgcatgggaattccttgagtgaaatgagtagaagttaagataactaagatgcaggtcatctttggataaatactggttaattgtgtagatcccttgctccttgtgtcttctctaggccacgtggttttgctccatcttccttccacctccttttcttccatcttccactatctcctttgtttacttatctgcctctcctccttcccctctccttcctttctaaaacctccagccccacgttttccttccactgcccaatcacaggcttcagtctttattttaccaatttgagcaatttaaatggggagaagtttcacattaaatcaccagagtatatgattcacccctccttggggcagctccatttgaggaagcagaattagcatcaaaatacaaacaacaccagggcaatccacaacaaggactaccctacacaccacccatgacattcctccattgggccaaccatgtgggcacagaggcatggcctaactaccatggaagtccctcactaagcacaaaacaactgagaccaacatccactttcctccttccacattttttccctttcttattaatttacacctgtgtctcatctggccgttggtagacttccttcccacttaagggaaccccaaataaaatcccttaggttcttccttttcatcagtggcatgaatgttagtttctctgttctggaaaccttctggactgaggcaggaggtctatccccatgaattttgctctgagaacatttgagaccctgatacgtcgacgagggttttctttcaagccaagaaattcatggtgaattcgggtgacacagactgaactcaggcggtccctcaacccatgagagaatcaagatttcagtattcaggtgggcaaggagtcagtgttgagtgtcaatcagacaagaacacaagggagtgttgatctgaatgtaagttctcaaagtgagcatcagccttataatacagaagaaaaaaaggaagtgaggtgacacatcactcaaggtacattgaggttactcgattcttaatgactctttacacaaaacagaagaatttatacataaagactggcgggatctaggcaatgaaacaactgagacaaagtcagctctatctaagatcagctatattcttagaagccaggtgtgaagtctttatgctcccggggcaagggctttcatgtgcaagccatagttctatttctgatttattgtttatctcaccaccacccagctcttagtaaatacctagctatgttattcctctgggctagtgaaagtatgtgctagggaattctggtctagctaatgatctcatgaataatgcaatgctctagttcctccttaaaccacagtaggatcttcttcctaaaccattgtaaattcctgaatatgggagtgacttggctgttattctaagtgattttatggcggactttcttctattaagtaatgaaatctgccatacataactataataagaattctaaacttagtttgttaagcttgctctgaaatttctaactctgtatatcgtaaatagtaatgctttatttctttcaatatctctctttcaatactggagtcaattcgtctgtataggtcatagttactaaactccaagcccattgtaggctcaaggactgcctaggacattgatgaaggccaggaagcaaagttcaacctaattaagtatttgagaaatcattccttggaggtacctacaataaaacaatactgaaagaaagcacacagaaccattcaccaactattgcaaggtcaaatctgaaacaaatctgtttatgggacaacagaatagttccaggagacaagtttccttgaaacaatatgccttaggactgaggccaagcttttgggcctgtcatgcagtttttactggagtgggtgtggcattatggtatagttccctaccacctctttagttctgattctttttgacatcattactaatttaaattttttccaaagaggaagttgttgctactcacaatattgttagaaataggcaagtgtatatgtgtccataactgcctcttctccagccatcttagccttggcagactcattggatggtgatgagaagtagtgaaatcatttgaaggcatttgaatgcttggtgttaactgcaagtctcccacctccaccggatgcatggcatgaactttgtgccagggataattctgccttcccacacttaagaatccttcatcaaattcgcagcctactctggttggactccaacaatctcctgccttgcagctgcctctttaggcccacaggacctgacctgaggcttaaaaaggggaacacccacaattgtaaggactgctgtctatgcagggcctcattcccctgagtccaaatgtgatccttaacttacccaggtagaggctttgtttcacctaaacttcctcagctttgatgaccagggactaaaccctgtctataaacattgggctttcctacccaggaaaacccccttccattagtatagtggagtggtgccctaacatcataatgtcagtcacctgctcccttgctgacacagggctgatgatatgtttgtgtttttccccaggaatccacaacaccaggatgaatggcagtatgggatacccaaccatccagggaaaagtagaaaagggacaaaccctgctcctcctcagaactttttcgtgaggaggctgcacttgtaggagataagtctctacttgtctgtgatccctgtattcataccatttgctttatatgctattaagtacaaaatatttcccaggcctatgaacaaactgtcccatttcagtaaggaaacttgagctaacatagtcttaaatgattcagtactctcagaaaaagtatatccttgctcaatgagagcagggtgtccattcttgcttttgatatggggtttattggaaaagtttgggacaacttaaaaaggtttttcgacacatcctggatagtatcttatgctaaaatgggaataataataataataataataataataataataataataataagtattgcttaagtgtcttgtacaacacatctcttggcaatgctctatttgcataggtatgcttcaactactgatggttcttgagcatctagactaaggcctacccagagaggctattatagcttagctcatagaaattccccagggttctgtttaggttccctccttacaccctgagatgccctctgggatggctgtcctttcagggctggtagtcaatgaagggtaagaaactgtttggcagctcaacataagacacacatagtcaaccatatggaaggacatctgggatggggccaaaaaactctgactcctactgtgctatcaaaaattaaaataagccaggcaatggtgacacatgcctttaatctcagcacttgggaggcagaggtagtggatttctgagtttgaggacagcctgttccacagagtgagttctaggacagccagtgctatacagagaaacaatcttattttcaaataagatttattattcaaattgttcttttagtacatcttgaaatgataatatctttacaagaagaaagaagacaatatttattgttttaaagactaagctttttttgagcatctgtgagaaggctcagtgtaaaatatctgtaggatggaaaggtagaaacctgaccttaatcaatatataaaaaatttgcaggggctagaattatggctctgtgggtaagaacactgaatactcttcctgaggttatgagttcaatttccagccaccacatggtggttcacaaccatctgtaatggaatttggtgccctgttctggtgtgtctaaagagagctatagtgttctcatatacataaaataaataaatctttaacgaaatgttcaatgtagactgcacaaagttgtcttccaatctgcatatatcagttatgccaaaaatcactgtaaaaatatgagtgtgtgtgtctctctctctctcccttatattactaatggccaaaatcactgtattaataccatacaaacgtgcacgcacacacacataccataaaagtttctatttaatttttgctgttacagtatctaccatttctagataattcccttagaagtcactatttaaagatgcagttccaaaacataactaatgggaacatgaagaaacatgaagtatcaaataatattcacatagccatagcaagtgaggtatgttgtgagatatgcagttgattgctgattattctacttggttccatctctgattggtgagctatttaatgttttagatattctgttctattaaacatctgaacattaacattgttaaatatgttgacaaaacggtaaatgttagggttacatctaccattggacatgtactcaggaggctgacacatgaaaataaagagttcaaatgtagccttgcctaatgattgacatccaaatcaggctggatagcaagcatcatctctagggattttgtgaaaatctgaaaaacaaaaccaggaacaaccacacaacacccttcacaagcgccttacttggaaagtatgagtatacacagtctgatatttaaataaacagtggatgacagagatgatcagcatgcatgctatacattgggggcgggtatcactaagtgaaaatgcaaaagaagatgaccaggatccacagaaggaatataacaatggcctaataaagttttgtgaatggatttgcctcacatacattaaaatttaaaatcggcttcaaataattcaaaatacaagctcccacaactattaatggtcatgagagacaactatgatgtttagtcttcatcaaaaggtcacatgaatagtgtgtttctcttgtgtgagttctttcctacatttacttgtgaatgcattcattcctgtcaaggcatctagaagcttacttacagaaattttctttatcgtgaatttgtttatgtaacagaaacagtactgcatgagtcacaagggtaacagaaatcatttcttcatatttgttagaagaggcaggcaaaatcctggacatatcacaccaagcttcaggtgccatgtgagaggatttattggcagaagcagcccctgagaatggtgagaggtcagaagaagagaagggtctgtgcgaagagagaacactcttttattcagtgcacgagaatgggaagcatgtgaaagggaagtggtgccatgttgggtgccatggcaacagatgcagcagaagtgctgttgcctacagatgaggagtgtcctcacagagtctagaagatggctgtaaagacacttctcgctgtccacagatgcacctgatgcacattgcttgtatttgtaggatttctcttccatataaactcttttatgacatttttgtgatagtgacatgaaaaggctttactggattgattacttttatagggttgggcttcagtgtgaattcttttctttttgtagactctagagcccaggtttttttccatattgtgtcccagtctaatcttgtaggacatttgtctgagggaaatgcaaaggcagatacagattaacacattctcttttccttgggaatgtcggcataaaggaagcacaaatgttttatgtaaacttccattaatatgcagcattgataaaatgagtttcaataacaacaacaataaacagattccttaacagaggtggaatgctcctcatgtgcaaaatttaatatttgtaacccttgtgactcacgcagtactgttgcaaaatcatgttttgcacattagtaacactcacgaccctagtttgagaggctgaagtatgctcatgtcattgtggacactttcagaacaattacccttatgtacattgatgcaaaatactcaataaaatactcaaatactgaatccagaaaacatcactaagaatctatccaaaatgatgaagattgttttttcatccaatatatcttgaagagtttccattccctctactcttctcagttcctgtccacttttcatttgttctggatcaaaccccttttatgtctctcaataggaaaacaaacaaacaaacaaacaaacaatgaaacaaaaaaatccatagactcactaattgacaaatctgcccccaaaaaaccaaggtaaaagttatatttcaaaagaactggtgcaggcattagtatttgtacattagaaattctagtctcaaatttctggtatatatttggacaattttgtgtgaagcattttgctgggagttgataaagtatatgataaagtatattttctatgggtcgttataagttaagatatcaaaaagctaaaatttcaaaggggtaagaaattttttggctcagctctgagttcattagtcagaatgaaagactatgattgatgtttactggttagatgacataaatgtgggcgtctctgcaaacactagttctggtagagtaacaatccatgagacaaaaaagaaatctagttctataccgctctgtaattatttccgcactggttgtgggtgtgttgtgggttatagccaatgaaattcctacagcattcagagacaatctttcccagtgcctgtgttaacatctgaagtaaaaagtctcctggtactcagaagtcaagataaactacaaagccccatgggacaattaaccacacacaagataatgactgggaagaacactggagggagcctgcctctgctcagatgagaagcagaagagaaatgagtggaaggcaggctttgtatagggtttagttgtaggtgatggattttcaggattggaaatatctgcggttggagattgctggtattttatgttctgagcttgagcaaactcagggatttgtgagttgttaaaaccagtaagtatgctatccattctccctgtagacaatgttgagtgtaactttagattctgaccccagggtggctaattttaggaataaataagcacagtataattttggaaagaaatttcttggtaataattgtctcaatcctctgtgcacagtgaagatgaaagtgtgactacctcaaaagtcttttgcaaagtctatgtgagtctttcttaaagttggattctaaaactaaagggcctagaggaggatcaagcatacggtgtagaggacaccaagctacaagatacatgtcacatctcttgcaaggctggtttgtattgcctgagaaacaatgatcaagggaagattgtctgggacaactttatagtttgggactttcaggtgttttgtggcaccacatctagcacagctcaccataccacttactacatccattccctcacttctggtcagaaaaaaagtgtacttcttttccactgaagagagaactctgtggttttatattcctggctaccttagagcttatttttgaccacaagtttcttttgctctctacagaaaaaaatatgttttatggatgtttatagttttaggatgttaatgttgtgttaatgtaaatagaaaaacagtcaaatatttttttaagatttatttatttattatatgtaagtacactgtagctgtcttcagacactccagaaaagggcgtcagatcttgttacagatggttgtgagccaccatgtggttgctgggatttgaactctggaccttcggaagaacagtcaggtgctcttacccactgagccatctcaccagcccagtcaaatatttttaaagaatataaattatgttgttctgacccatccagcaggtccagttattcgagggtctccagggaaccttctcctaagaaccaaatggggggagagaaaagaaggacacccagtgcgaggaacccttctgaataacatcaatgtgtcactgtattagcaaggttcaaggcttaaatgcacaagcaaaaagtggaagtacttctcagcaggaggaatggggcagcagaaatttttcttttggcgactaaacgggggaagcaggaacttggtgatatcagggtacatcttgaggtcaggacatcctgcactgacttgaggctggaacaatctgtggttgttctctgagcggtgcgttggtggcccgcttttgacccccttttcttctgggggaagaggtccaattcagagatcaggacaattgtgttgtcttaatagctcccaacattgttcagatatacaaggtgtgattacattgcttgactctatagacatcaaacatgcaagtgctgctggcataatcccagcaatcagaacactggggcagatgtattattcttcatttggggtcagactattctaaatcaaagtgactttccatcctgtggtctccaatttcctcttttggcctttctgaactctctacatgggttgaagttaattttctaaacttttatgcaggtgtgtctgtgtatttttaaatggttactgctatattggtagagaactaagcaggatcttgatattgtcatttctatggcccattaccaggcttacgtttgtaaatacttgtctccacacctgctgagatatttgaatggcatatttctatgcccattggtaatccacagaattctggagatgtctcacacctgatcgcttgtaagaaaaaatgctaacatccaattcctgggacaagaattggagggtagaatttcttgatggaaaaagtgatgtagggaatagaaagcaggtggaagtgatttatgagagacagagaagagaacagataaatgggaacaggggcagagaggtaaagagcaagatacgcataaagtcataggcttgaatagtctgaaatttgaatgatcattggtaaactgctccaatgaaaggcctatgctttaaattatatagaaacctccttctcataatttataacactggtgtatccaccagtactcacactacactcatgtacatatgcaatgtgcatatatatatatatatatatatatatatatatatatatatatacacatatgtatatatacacacatatatatacatatgtatatatatacatatgtatatatgtgtgtgtatatatgtatatatataaatgcatatatatacatatatatatatataaaacttttcacaagggtgctttgggtatttaagtcaaattagatattgattggttattcacaataaattcatgacatcattgacttagcatattttggaggaaggacaaattttagatcaatgtctttttggttggttctatatatacatttcactttttgtagatagcaaagcccttcccataaccagtactctggaacataaaagccaatgtgcttggaggcacattcttgacctcttcacacatagtgagttgtgtaagtctgctccttagcaatgaagacttattgtcagtttgtaaaaagcaacacctttgttgtcaatgccatgcagtgtttgcttatttttatgaaaccattttgtagaacagctcagttgataaaacccaatggaaaagacaagatcaactggaactccatctctgtcagaattcagagacttcattagaatcaccttcatacacttataagctggttctttaaaaaaaaattccaaatatcgtactaagaatacagccagccgaagtccatggagtcttgtaccatggtgcttttctacgcattggcaggaccacaagtgtggcaatgcagtgtacaaaagttcttaccttctaatagatggtgatttttcttggaccttacaaccatagttagtgcgacttgaagaaatttaagatttaaaactgcagttctactgtgtatacaactttatggtttagctttttttttttcaaagaacaatgtaaaaacaaacattattttccttgtatttcaatcaacttttataacctaatgtgatgccttggtgcaatgataatttattgatacaatggtaatttatgtactttttccaagcatgtccagaaactgcctgagtgtcatttgctgaaagcatgaaatgcagaggcttagcataaccttccaaaatgaatataccattatgtgtactgattgataaacggtaatgtctataatcacttggatccagttacctcatcctttttaaaactctgttaaagatttctgtatactataccattccttctccatgtaatggggttttcttgatgttcctgaaaatattgcaaaggtctttcttaagaccggcaatggtgatacaaaagccaacagacatacatacagagtacacagatagacacaaacacggagacagaaggcagacacacaggaagagagagatacacaaggcagtattcagcaagttacagatttaaattaactgaatagacacacaggttggaaggctcagataagagaaagtatcgaattcaactttggactcacagttagttaaattacctctgagggaaagactattgattctttccttaactcagatgcattattaatcaccagtgtgtttaatgtattcacatatgcagaatcaattaacttttgatgtaattttttttttgcataagcacaatatgagaaaatataaaactcaccacaatgtgtaacaagtagccctgcattgtgaaaggtgtccatgggctcagaaccctgttctctaaagaaagaccatcaggtctgggcttgtgcttctgagctctcacttccatgctggcctagaatccattttaacctctcacagtcattactacaggttttgaacctcagaggtcacaagagaatcctagaactcattacttttgtgaaaagagttcacttccagccatattctctaaggcaacttgggtaattctggagtctcctttccccagcatatgaagatatgcatgggtgtacttagagtattatagagcacaatcagggaatcttctatgaacaaatggctaaacagtgcagtatgtattgtaggactctttctatattttcccttccttccttccttccttccttccttccttccttccttccttccttccttcctaccttccttccttccttctttcctttctttattctttctttcttttgccaaaaatctagacactttttcaaaggaatttttcttaattgcctcaccctccaagcagtaaataatattgtgcctaaacctaacatcactttaattcatcattttctttgactaaggtatccagctcctctaccttttgtccaagtctaataatctgtgtctcacacgttctctatgagttattattattcgccttactgcattttcttttcaggctcttttccttgtttatttctaagcacatattgaacaaaatttttatatcctatgttgtcctcctttccttcaggcttttgctattattctcttgcccacgaataattttgttcctgtcctctatcaattgacatatgtggcttacatactttgatctcttttatcatgactctggattttctattctttacctaggatatcatgtaaattgctctctttataagatacatacatagttgatagtttgagccaaagacattttatcttagttttactttgttttgggtattgagcaccagaattcagagggattgcttaattgtgtgcatttttagcccacaatgtgagaagttaggcaggatccgttgtatctgaagggttcagaacccaggtgcagtgtcctactacattcagttctggtctagtctggcagcaaccttgtgggaagctgagcagagtaggtcctgggaagttgtgtttccaaaacagagttggaggagtggttcctgatggggagggtgggcctcctgcatgattagataagattaagaaaaagacaaaataaaaacaaagaatcaatcaatcaaaaaaatcaatcaatgaattaagtaagtaagtaagcaagcaagcaagcaaaaatccaaaccaacaatattgccctgaagaactgggaagctaattaattaaaaagtcctgaaggaggtgtgcttaggagaatggcaggaagctactgagtattgggcgggtccagaaggagtggctctgaggaaccaggagaaagtgacaggaagttccaccattccagcattctcgatgtatctcggctgcctcgtggccaggaagtcatggagggaaactagtgcctagtgtttgcagaacctgaaaacttctttaagctacacttgctgtgctggcctcctaggacattcagcagctggtcctgtcaccttccaggtcagaggagctgttgggctgggaaacgggtaggagtggggcaggcgtatggagcaggggtacattttctgttgccactcttacaattctgttgtggatatcttaccattatcaggaagtttgagttcctgtgaattgagtttatggtgatgttttaattgatttttatggttgccagaatatttttctaaaacaaccctgtagatccttggccctctctggactttgtataccaggagggttgtctttgcaaaggccttaataaagctcctcgaattcaaattcattcatgctttcttttttttttttttttttttgagatcagatttatttattatatgtaagtacactgtagctgtcttcagacacaccagaagagggcatcagatctcttacgggtggttgtgagccaccatgtggttgctgggatttgaacttcagaccttctgctgagcagtcgggtgctcttacccactgaggatctcaccagccctcattcatgctttcttaactcccctgttcctccatttgccatttcatttccctttctccagggaactgaataggcatctccagagaactttgtaggtttttgtcatatggggaccagtgcagatttgatcgaattagaaaatattcctcataaagcaccatcatatggctgtaaatattaacattaataagcaaagttatagtctccgttagctgaacacagaggtatatgcatactttgatgtaaatatatcattgagaaatgtgtctatatatgctttgatattaatgtcacactgtagtggctattcctggttgtcaacttgactatatttggaatgaactacaatccagaattggaaggctcaccagtgacccttatctggaggcttggagatccttatctggatcttgttttgaagatcttgagccatagtggctatggattccagaagattgaatctccgagtttaaggaacacacctttaatctgggctacgcctttcatctgggattaaaggtgtggtggaacacacctttaatctgggctacaccttctgctggagacaatataaggacattggaagaagggagtctagctcttgctccttcacctgcttgctgcgtgagactgagtaactgctagatccttggacttccattcacagctgcgactgaatcattgttgggaattgggctgccgactgtagagtcatcaataaattcctttactatctagagactatccataagttctgtgactctagagaacccttactaatacacacaccttaggtttgaataaaacgtgaagacaggattgcagcaaggtacttgtgaggagaaatttccttaaggaaatgaggacaacataggacatgaaaattgaattcaataggtggttataaatacaaaaaaagaaaaaagaaagaaagaaagaagaccctgaaaagaaaatgcagtcaggtgaataataatcattcatagagaatgtgtgtgagacagattatcagacttgaagatatatagtaggttctgttaaccctgagtgtcaccagagaaaaaccaattccaccatgtgggccagctttatcaaataatacatcgcgaccaagagatatactttggtcacatgttacaggcattttataggccattatagtttcctatgagcctttattattttcctaagacatgcaaccttcagcacttcaagaagatacctggttcttgggctggtggtgaggttaatttttggcattttagtctgagggagaaagcattcagagataactggttgggtccagacagaggcaggcaggtgggggaggggaattgaggatgtgatgatggatagaggggcaggtcaagagataaccagcatccaagaaagcaactatccaactatgacttcattgatatgttaacagataccccaggtagccattcttcctgactttctttgaatttttccaaggttcagcccagcatgctgtgtggtgatgatttcaggagtagatattttaataagtggaaaattgagtatggattttttgttttgttttggttttggttttttcggtacagggtttttctgtgtagctctggctgtcctggaactcactttgtagaccaggttggcctcgaactcagaaatccatctgcctctgcctctgcctcccaaatgctgggattaaaggcgtgtgccaccactgcctggcttttactttggattaagacaaaattagtcagcatcttttgaataattttgattgcttacttactggattactgtctggattctggatcagaataattttcttagtctattacccgtgctcgaacggccaggaagaacgcaacaaaccggaatcttctgcggcaaaagctttattgcttacatcttcaggagcaagagagagaatggcaaaaccctgtcccttttaaggagaattatcctccgcctaggacgtgtcgctccctgattggctgcagcccattggctgagttgtcgtcatggggaaggcagagcacatgtagtggagaactacccttggcacatgcgcagattatttgtttaccactcagaacacaggatgtcagcgccatcttgtaacggcgaatgtgagggcggctccccacattagtcttcctcctcctcttctgtgttgtttggaaaaaaactctatatgtgtgttaactgtgtgactgactctcacatctttagggtaaactggactactcggagaaaaataggcattctcatgatatcttctctttactacatgtttatccttttctcgggtattgacatctttcatttttgttccatgaacagttccatgttcattctaaacaatattttcccattttcgggtctccatatgctcagtcaaatctccataactgtaaatcaacactaagagcactggatagttaaggtcaagtagactctcacaaaggatccaggtatgttagaggtactgaacaatgggtggagtggggcttacctgttagtagaaagagaacatatatttgattttgccagattctatttccttaatgattctggaaaagaataatattagatgtgatgatatggatttaccatggaaggcagtgctgtcagctgtcacttgatgtcagtatttaattaattttgatcctgggaaattgctgttgcccattgaaatcaaagtttcttttatccggattgaaagcagcatcaggctatgggtgtgacaagggcaatttatacataaagcaaatgtccccagtagattccctcctagggcctgtgaccttgcttactggatttttaggcagattttcactgtaatctatgaatttttttttcctgtggagttgaaatagaaaacctgttacccacagtcttgctagtatcataaaaatttccatgcctggtctgactgattcagattgcagcaagtaggttgcaacctgagtatagactctgatgactctgattcctgcccccaatttccctagcagtttttgtcactatggaagttaccgccagggtgaccaagatgtctgctgagagtgaatggtctgatatgaggtggttttctccagaaggtctacttgctttctgaatcacctattctgtacactctaaatgttttcctgtccttgacctgtgttcttattgatgttctgtgttgcattaatccccattagagtggaataattatttttgaccttctctgtactggttggtttagttttgagtctgtttgccttatttctgaggtatgtttcttctcttctatccttgagagcttttatactgagcagtgtctacttttaaccacagggctgtataagtaagtttcattctcctgttgtcaatgtaatttggaaggattcctgcctacatctattaacctaggcctagtcataaaatctactctccatacaacattatgtaggcctagtgtgttttcagcccttgaaatttgctgcttttcgagacaggatttctcagtgtagccctgactgtcctggaactcactctgtagaccaggctggcctcgaactcagaaatccatctgcctctgcctcccaagtgctgggattaaaagcatgtgacaccatgcctggcaagctccccctttcttattccttctcaatgcttaactagctgattcgatttggtttttccagctcaaactcctctccgatctgagttcttctctcagacaccgaattgttccacttggccttaaattaactgtagaaatcttttctcatcttctggctccttctctttctcctgctcattctgtctttacctgttcctagcatgttctctcttcagtctgattctgtaaaactctcagaacccaggtgcagtgtcctagtacatccagctctggtctagtctggcagcaacattgtggggaagctgtgcagagtaggtccagagaagttgtgtgaaaggcagcctgcaacagagttggaggagtggttcctgctggggagggtaggcttcatgcatgattagataagtttaagaaaaagacaaaataaaaacaaagaatcaaccaaccaatcaatgaattaagtaagcaagcaattaaaaatccaaaacaataaaaattgctatgaagaactgggaagctaattaattaaaaggtcctgcagtaggtgggcttagaagaattgcaggaagctgctgaatattgggcgggtccagaaggaggggctttgaggagccagacagaaatgacaggaagtcccgccttttcagcattctccttgtaccttggctgcctcgtggtcaggaagtcatggagggagactagtgcctagtatttgcagaacctgaaaacttccttaagctgcagttgctgtgctggcctcctaggacattcagcagctggtcctgtcgccttccaggtcagaggagctgttgggctgggaaatgggcaggagcagggcaggcttgtggagcaggggtgcattttctgtcgctactctcacaattctgttgtggttatcttaccattgtcaggaagtttgagatcctgtgatttgggttcatggtgatgttttaatcaattttatggttgccagaatatttttctaaagtatcctcgtagaaccttggctgcatctggagtttgcataccaagaggtttgtctttgcaaaagcgtttataaagctcctgtaattcaaattccttcatgctttcttaactcccctgttcctccatttgccatttcatttccctttctccagggaactgagtaggcatcctgagagagctttgtagatatttgtcatatggggaattggtgaagatttgattgaattagaaaattatgttataaagcactatcatatggctgtaaatattaacattaagctaacaacgttatagtctccgttagtttcacactgaggtatatgtagtctttgatgtaaatacagcattcagagatgcgtcttcatagtcttagttattaatgttacaccttagctttcattgaagcatgaagacaggattgcagcaatgtacaactgaggagaagatatatagtaggttctgttaaccctgagtgtcgtcagagaaaaagcaattctatgatgttggaaagctttttaaaatattacatcttgaccaagagatggactttggtcacttcctactgccggttttatatgccctgttttctgtgaggctttattattttcctaagacatgcaacctgcagagctgcaagaagatacctggttcttgggctggtggtgaggttaatttttggcatttcagcattagggagaaaacattcagagttatctctttgggtccagactgaaccagttcatcaggtggggggaagggaattgaagatgagaaggagaatagaggtcaggccaagagttaaccaggagccaagaaagcaccatcccaatccctatcttcattgatatgttaatagttaccccagttagcctttcctcctgaattctttgaatacttccaaggttcagccctgcatgatgtgagaggaagaatctaggccaagctatttttataaatagaaaacttactatggattaggacataaatagacagtacctttgaaataattatgattgctcactttcttaagaaaaatgactccttgtttcatgaaaagcactttgcccatacacattcatggtttcttgagtgtggcactctggacttcttgcaggtgtggtaatgcttagaccctgcgttcacggcttttttttcagtgatctcttgttgaagaagttcaatggtttggatcctgcgtgtcacaatagttttcttacattcttccttgttcctcagtgtttctgggaaaaggactctgtgtaaaatgtgtgactgactctagggtaaactgaaatcctcagggaaaaagagacattctcatgatatcttctctttccttcatgtttatccttttgcctggtgttggtgtctttcatttttgttacatgaaaagttccaggttctgtttgaatgatattttcccattttcgggtctccattttctcagccaaatctgcataaatataaatcaaacctaagagccctaatatggtaaaggccaaggagactctatgaagcatccaagtgtgttagaggctttgaacaaggggtggggtggggctcacctgccagtacaaagaggacatgaattggttttgccagcttctatttcattaatgattctgaaagatttcactaagaatattagacatgatgatatggatttcccatgttaggcagtgctgtcagcagtcacttcatgtcaatatttaattaattttgatgctgggaaattgctgttgcccattgaaatcaaagtttcttttacccagactgaaatcagcatcagttaatgtgtttgaaaagggccatttacacatgaagcagatgtcagtcctggattccctcccagggcctgtgaccttccttattggattttagccagattctctgtttagtctatgtatgtttctcctgaggagccggcctcagcttgaacaggaaagccttttgttacccacagatagccttgccactatgatactggcggccatgccttgcctggcagattgagattgtagcacacaggatacaaatctgggtatggccattgataactctgcctcctgccccagtttgcaaagcagtttctggacactgaatgctaccatcagagagtccatccacaatatttgttgacagagtggatggtctgatctgagttgttcttctccagaagatgcacttgctttctgaatcacgtcttcggtccagtctacacgagtttaagtccttgaattgtgttcacactgatgcagtttgttgaatttggccttattatattgtggatttcaacaaaagcttgctgacaggaggctgatatagctgtctcctgagaggctctattagtgcctgacaaatacagaagtgggtgctcacagtcatccattggacagtgcacagggtccccaatgaaagagctagtgaaattacccaaagagctgaaggggattacagccccatagtaggaacaaaaatatgaactaaccagtatatctagagctccttgagactaaaccaccaaccaaagtaaacatgtggtgcgactcgtggctctagctacatatgtagctgatgatggcctactcagttatcaatgggaggagaggtccttggtcctgtgaaaattctatgccagagtaaaggggaacaccagggctaggaagccggagagggtaggttggttgcggggggggcacttgcgtaggggatttttggagaggaaattaggaaagtggttaacatttgaaatataaatgaagaaaatatcaaataaaaaatgaaaaaaaaaggatggaataatcacttttctggactgtttggtttagtttcaagtctctttccatttgttttctgaggtgtgtttcttctcttcttacattctagaaagcttttatagtgagtggtattagattttccacaggacagtaaaactaacctttattctcctattatgattattgtctgggaggcttactgcctctgctaattaccatggcctagtcctgtaagcctctagcctctaaataatcttatgtagtcctagagtgttttcagcctctgagatttcctgctgattaagttccccctttcttgtttgttcctttcaattcctttttaaaaaaaaaaattatttttttggtttttctgacagggtttctctgtgtagagtcgtggctgccctggaactcactctgcagaccaggttggcctcgaactcagaaaagtgctgggattaaaggcatgcaccaccactacccagcctcatttcaactcttaactgtctggttcaactcagctgttcaggctcaaactactctcccagctgactcattcagcctggttctcacactgaattgctctgcttggccttaaattaactgtagcaatctttttttaaatcttctggctccttctctttctcctcctcattctgtctttacctgtgcctagcatgttctctcttcagcctgagtctgtaaaactctcccagtaaaactgtttccttctccctctctgtggctctactctctcaactgtactgtactgctgcccatgcactctactgtattcctttaccattctcttcttcctgtactgtctttctctcccttaagtagcttccccttcctctctcacctcaggaatgttgggcatatcctgttctctaagatctttctctgatatttcacattttctgccattcaattagacaacactttcaaacatgtgcacctccttctacttagtaaatgtactttcgttgtttgggattaaagcaaatcctaaaggcttgcttgtattccaaccacagtgatgaaagctgtgtgccttgtgctgaaccacaccctaagtcagaacaggcttgaatatccctacacaatagtttagtttggcagaatttcttcctgaactgaaaaccaagattcacaaataatagtcttcattatgtagatagctgtgctatctattctgacttctaccaagagtttcattgtgaacttctttgatgattggtcaatgaaaatctttttttgcgagactgtattccttagactttgcaatctagaaggtttgcgggcattatgagtggcagaaatatggttcctattgtctccattccttgtatgggaaagagctttactatgtagtacatgaggaatatttcctagttttcttatattcattcattcttcacaaaaaaatgtcttatttccaaagttctcatgaaaattttatgtcttattatttttgtgcgtattttcattagattattttctatgtaggtttttgagtaaaaaggtgtctaaacttatatcacacactatgttcaaatatatgttttaaactgtcaatacttgtagccacttttctgaatttaacattacagttgccagttattttctctcagggcttgaaaaatatgattccatgctctcctgattttaagctatggataaatatttagtactactgtatgctaatatattatcacctcttttgatggtaagggctagggcaagacagctggaaagagataaacattgttacagcacttagatgtgacaatagacagatacagatgggagtgcaggaatccaatatctgagagactttcctcgggaatgtgaggctagaatgctatggtcttctagtactcaagagtgccaatgtttgaacactgcatgttgctatttgagtttatctactttaaaacagatgtgatgaaacaagtgatagtaaactttgactggaaggctcaagcctgtggaattgtgtctattcagaatcaggtgtgtatttgaggaaatgtcagttgcaagatttaaagtcgaagccctagtgttcatattgacttcatggtggaagtaggtaaacccatgggtttttcttcccattctagaatgagctcttgttcagtctccatgaaatggaagatgtgcttttcctgttatacaattagacaaaacaattgcaggacacacatttattttatgtatttcttacttttgaatttaaagtacaacatctgtcactggagcaggaatttatggtctgttgctggtagaaatgacaacaatattcagcctgcatgtttccggtaagaatcataaagtgacatactttgaaaaatgtcctcattattccctaaaaatttatgtattcctatgcccattttttattacacacttgatgctgtctacaaatgcccagggcatcaagttttacatagtgtaaatttatgacagtaatgtatttttccctgcatctctaatttctgttttatagaaattcctgttgtcagtaaattttccatcacatgaattagagattatattcatttcatgcatattactattgttagaatattcacagaaaaacattctggtagagaatttgcattatctgatttctttggtattgagactgctggcatattgatggggccaccctcctcctcagctgcttctggcttttccccaattcaaccacaggggtccttggcttccatcccttggttgcatgctagaatctgcatctgactcagttacttgctagacttcttagagggcagccatgccaggctcctgtcataccacagtatcagtatcagtgtcatggccctgtgcctccccttccttgatctgaatcctaatttgggcctgtccatggacctcctttctctcatgttcttctcaagttttgtccctgcagttccttcaaataggaacaattctggatcaaagattatgcgtataggacagcaactccacttgatacctgtccttccactggaggtggactctacaagttccacctcaccactgtagagcactttatccaaggtctctccctctgagtcctgggagtctctcacctcctaggtctttggaacctgtgagatgaaactctgtagcctacctcctgaggctgtctatttccatttttttctactggtcctcagggtctcagtcctccccccaatccctcacaatacctgatcatgtttccccttcccctatctgtccctgctcccttcatattaatattttaacaattaggaatgatccctatgtatgataaaaatattttgtatccatggagcccagagctggagactattatgtgttcattgtaatgtgagaaaagaagatttatcctatcaatgaagtatctagatataacttttatgaggaggcaccctaattgtgaaggaatttataatacatgaaaatgctgttatccagcatcccatcaaccaagaaatctgctccagaaggaaaatgaattgtatcagattccaccattttcttaatgtaaggaataagcatgagactcagatcttaatcctcaccactgattagtcatgttcccgtactatagaatagttcatggttattaaacaagaatcattcatgactaatataaatagggttatatgttacatgtttagagatggatgaaatttgaagagaagttgttgctcctgcaaaggaacaggattagactgttagcatcacatcacgttccataaccacctagagttccagtttgtgggaatctgacctcctcttctgatgtccactgagagaaagcatgcaagcgtggcacactcatacacatacaggacgaacattcataaataagactaaacaaaataaaataaaatgaacaatttaatattaaaattgtctaaaagcagtctagaagaatagtatgacatgcttctgcatgtgtatgggaaggtctttccacaaggcataaggaattgaagaattgtttagcctaatcagttaagagtccatgtgttagctcataatggatctgcttgttggaagcttgtagagaaagcaggaagcagatctaagagaggatatagtcacagggacaagcttaagaggatgttgtttggtgctataaggtcctgaacactaatttctctctggcactcagtagctggattgacctatacgtccaacaatgatttagcattcacatgaagttttaagcagatttttatgagataaattgtaacattctaccttttaaatagcccaggtaagtttcaattgataaatcacctcacaccaagttttgcatgcaagtaaagcagaaacaagtccatcttgaaggaggagtaagttagaaagctacacttttcttctcaacagtgtgcattagacactgatatgaatggttataagtaaatatgatgacaagtttatcatattgaagaaatccatgatatttgccatttagattgactcattgcatgatgtggttttctgtagaaaagtacaacacacttaataaatacatgtactgtttctgcaggtcaaatgaaataaggtgaattctaaacatgttctatgaggtagaaatgctcccagcaattttcagataggctttaagcattctgattgctctgtctatgttgcatcatgtggtttatatcagtaagaattttctatagatgttgatgggatactgtgctgaagaatcctattcaaaagcataaaggaatatcccatttaatgactttgctcttttattttggagttataaggctctcctactccatgtttttccccttcctgtagctatggttcatgtaggttgagattctgaaaagcaatcatggtggacagatgcagagaacctaccttaggtgggaaagggtcctaaggagctaatgggagtggtgagagaatgacttgttattaatgatggatgcaagctgacagctctgtactctgtggagacaagtctctaaatagctttttgcagatgaaacctactttgcatgagctacttccttaggaattatgaatgattacaaacatttactccaggttctctcttgattattctgagtcagcattttaaaaccttagaacctttactcctagttacaaaagaaaacaaaacaaaacgaaaaaaaaaaaacagaagtacatttgttttgtttgtttgctttgttttgttcttaagtgtagcagctcctatgtatgttgcttgcatgcactttctggacatagagattattttattattactcttttcttttctctttcttcctttcttccttccttcctgtcttccttccttccctcctttcatttttttccatactctagatttattgccctccctgtccatcctctaactattccacatcccacacttcctgcccacctctctgtctccatatcccttcctcctccccaccttctaaacacactggaacctccaatctctccaggggttagatgcatgctccctgattgaacccagatccagcattcttccactgcatatgtgataggggcctcttatcagcaggtgcatgcttcctggttgatgatcgagtgtctgagaggtcttgggggttcaggttaattgagactgctggtcctcctacagggggcccttcttcctcagcttcttccagctttcccctacctcaaccacaggggtcaggatcttctgtccatatgttgggtacaaacatctgtatccaactgctcttgggtgtttcagaagtcagtcatgatagtctttgtgattgctccatagcgtcaggtataatgttaggcctaggggcctcaccttgaaaggtgacagggttggggggaatcataatctgatattgggtgggggaagaggactgaagccctctgggcccgcagaaagaatggaaacaggcaactttgggcctctttagcaactttgggatcctactttgggcctgttattggaccttcttttcctcaggctcttctccatttccatcactgtaattctttcagacaggaacaattatgggtcagaattttgactgtgggatggcaaccccatccctcactcaatgccctgtttctctgttggaggtgggctccaaaagttctttctcactactgtagagcatttaatctagggtccctccttttgggttccttgagtatctcacctcccaggtctctagtacattctggagggtcccccatctcctatttcccaaggttgcctgtttccatttattattctcacctcagggcttcagttctcttcccccacccaatatcagattatgattctccccaaccctgtcacctttttctcccatgtcagtccctccctccctcctcactttggccctttatcttgttgacctgtttgagttctgtgggctgtatcttgggttttctggacttttttatgactaatatacacttattagtgaatatatgccatggatgtccttttgggtctgagttacctctctcaggatgataatgtctagttccatccatttgcataaaaaacttaggatgtcctcattcttaatagctgagtaatattccattgtgtaaatgaaccacagtttctgtatccattttttgtcatgggacatatgggttgtttccagcttctggctatcacagataaggccattatgaatatagtggaacacatgcccctgtgacattagttgcaatttattgaacatttacattatgtatgtatgtatgtatgtatgcatgcatgcatgcatgcatgtatgagcccaccactttgctgtaggttcttaggaacattcggtattcttgcagaagacctaaatttgtttataagcacctatgtcaggtgactcaaaactacccgtaactcttaactccaagagatcccatacacacacacacacacacacacacacacacacacacacacacacacatatatttagggaagtcctagttttacagaactgaagactgaaactgctaaaagcctgctaaagaggggtaagatcaaagtttactaatatctatttagtttcatgagcctggggtttagttagttttacatccctgaagattttatagtataatgtctttcttaagagattgcctttttttttagagaaacacccttgtttttgttttgttttgttttgttttatacttatttatttgtatgtgtctttggagatattgggtatattcccaagaatggtattgcggggacttcagatctatttatttccaattttctgaggaaactccacattgatttccagagtggttgtagaggtttgcaatcccaccagcaatggaggagtgttcctctttctccgcatcctctccaacatgtgttgtcacctgaggttttgatcttagctattctgtttgctgtaaggtgtcattgtgatttgcatttgtcttatcactaaggactttgaacatttctttaagttggttttcagccattggggtgtctttagttgtgaattctcagtttagtcatacacaccattttttgattgggttgtttggttttttggtggttatcttcttaagttcttaatatattttggctattagccctctattggatatggagttagtgatttttttttcccaatctgtaggttgttgatttgccttattgactatgttgtttgccttaaagaagctctctaatttcaggaggtcccatttaccaactcttttttggtttgcttgtttttgttttttaagacagggtttctctgtatagccctggctgtcctggaactcactttgtagaccaggctggcctcgaattcagaaatccgcctgtctctgcctcccaagtgctgggattaaaggcatacaccaccaccgctccgctcaattcttgatcttagagcatgagacattcgagttctgtttaggaaatatcccctggtgcctaatgagttcaaggctttttcccactttctcttcttttaggttgtgtgtatttgattttatgttcaggtccttgattaacttggacttgggctttgtgcaaggtgacaaatatgggtctatttccatttttctacatacagacagccaaattagactagcaccatttattgaagatgcttccttttttccattgtatatttttggcttctttgtcaaaaatcacgtgtgtgtaagtatgtggttttatttctggttcttcaattccatttcattgatcaacttgtctgcctgtgtaccaataccatgctgtttttatcactatagctgtgaagacagaattagactgtgtttcctttcaggaatagcaaatgccatttacccctgagtcatctcttctttccagggatttacacttctggtacacttttatgatagagcctgaatataatcctgagttctgttttataaaaattgagtgaagaatcctaaatgatacttatatgcccaaccgctaaccatgttagagtggggggctctctgggacttttggcatagcatttgaaatgtaaattaagaaaatacctaatttaaaacaataaaataaaataaaaaaagaaaagaataggaatgaagtcaaagaaccttagatgattccttttttgtgtaatctataatcatgttagatcaatgagctcaaataataaagagaagaatattgctgaagtcaaaagtttcatattttcagttgtgccagtaatagattcatgagtaataatatatccataaaaatgaagttttagtatgatttttatacatcttaatgtggttatttccattataaaaatcattttactttatcacttttttcacatatgtcatttagttatacatgtatgtctaaccattctgcagggaatccactgtgtaagttatgaaattattatctgtattgattttgtcatatagtcaaaaacattatattatattaatgatacctattgctaactttttatttatatcattattctcaaattaattcttcattaaataatcatttaactcttcttcatgtaaaattcttataaaatcatatcacaaagtatttgattctatgtcttgtttgtaattttgtttgtatacactgactttatacttcccaactctaccatagaaagaaacgtatttttttaagtcattcttgtatttggtgttctaactctctttctttctcctagaaaggatgctccattgtatataggtcttacaatccaaactgagcatcttagactacttgttgacacccaacttcagacaagagagatacagggttcctatctgagcaaaactgacagttgtagaatttggaagcacagttttactcaccatcactttactatctgtaaactagatgtaacactggaattgttctttttatcaaaaaagtgttcataaacatatattcctggatgtagtcctcaaatatatacattacagtgtctaaattatgctgtgagtctgagtccattaactcatctaccttttactgagagaagagaacacaacatgactatgataattttagatgataccatttcttaaaatggcctcatagttctcatgacataacatacttcctgttcttgattaggtttcagaatatgacaggaattctctctctgaaaggcaaccttaaatccaaccagaatatgttttactgtaatttatttttgtctgttgctttcataaaacaccatgttcaaggaaactaatagaagaaaaagactactttgcgtaatgcttccagaggatagccatcaaccatggcagggaagactgatagaacacagccatgttgttgaagtagaaaggtgaaaaatcacatcctcaaccccagtcactaaagaggaagagagaattaagatggcttggatctatctattcttttttctcatagccaacccccagtgtcatactttattcagcaatgttccaacaactaaattcctcaaaacattgtgacccactgaggatccaattttaaaagataaaagtattatccagtaggagattgattctttcatacctatataatcagccttctaatatccttgtgctttttaaattgattttgatatcaatgtagaaaataaagctctaatttcttgtatgggtttcctgttcgtttgtttgtttgtaaaacagggtcccatactctagtcctgactttcacatgtcctgatatagagaccagaatggcttttaggtcacatccctgagagctaggatgaaagacctttcattgacgagctgatttttatttatttatttatttatttatttatttatttatttattttggctgaatgctgcatcttcatatattggccactgagttaccaccaggcttaacagagttcatttcttgtttcatttcagagtgagcattccttagatttttatatctttggataaggtgttcacgtcctgcatatgtataattattctcttacccacttgtaggaattctctggaatttcattaagtttgtttctgccttcttgaattcctgtgcttgttccctctttatgacatttgtccacattgaatggtgttcagattatgttttgacttttgtctcttgagtttgtttcataattcattttgtcatgagaattggtattggtttagtgatttaggttagggaaattttattaacattgtcaaattgctttagctacagcctctcaattttcttttgctgtgtgtcatttaggtcaggtgacagggatttccatatgaggtgttgtgaataaactttgagaatctagggtggtgggaggaactaggttacagttacagtctaaatatatcattacttactttcatgactgcactttgtcaagattcctggtatcattttgcttttaatgtttataagtgtgtgtgtgtgtgtgtgtgtgtgtgtgtgtgtgtgtgtctgtgtctgtgtgtgtgtgtgtgtgtgtgtgtgtctgtgtgtgtgtctgtgtgtgtgtctgtgtgtgtgtctgtgtgtgtgtgtgtgtgtgtgtgtctgtatgtgtctgtgtgagcgtgtgtgtgtggtttagcattgtctgtaatggtgttgtatttatttcatctttgaatcattcagaccttgatgtgaaatttcaagaagaattcaaaatttgttcttcactggaccctgggagaaggacaacaacaagaatgagtgtgtgtctggtaaatacaccacaggtcagtgtcctttccacatttctttttttaaaaaaatctctttttattcaagtcatccagaagttttaatctctatatgttgaatgttatctaaagggatttttttctatgctctatattttctcttgtaataatgagaatttaattttttccctttcatgcatataatgactttatattttaacttgatttttatattgtgagaatatataattcccttggactagagatctgcatgtctcaaataggatctattacaatgatgctcagagaacagattgatggatattttctatgttgaataagttctgtccttttgtattagtgtgaggtgaggtctcttgtgccacatgaattgcatttcagggatggtcaggtttctgaacagaagcttgtgaatgagggtatagaaataagtataaattcacatcactaaagaagatatgaaagagtagaatttctagaatgtaaaattataagagatccactgtcttgaatcctaatagtaaatgtattattagctccctagggtcacagatgatggaaggaaaatatctttcttttaccattagtgtgattgtgagctgatacagatttcaatattctgacaacacttttttcacacctcatgtcacacagtaatcacagttgactcctgaaatctatttgtctcaagagagatactgtccctgtggaaaattcacaatatatagatatttatccctccttttggtttcagaaataattttaagtcctgttttcttcgcctttgtatttcatcacatgaactatattagtaagatttttctagagaggatagctatggtgctgtgaataaaccattaattttcaaaaagaaatgaatttcctttattattttttgtctttttctttagaagggaaaggcttgaatcagtctatgctaatcctcttcagccaagctgtgcattacatagtgaaaaatgaagggttgtggcaatgttcctatttttcattacaatactattttctttaagtccataagtgtttatctgaaggtttttacgtacactgaatgatacattatgcccctaaaaccatgagaacagcaccaaaccgtggggactgaattcagacataatagtgagctgcaatatatttagagagaattagattagtttttaaagtagaaacagcacgtacctttcccctttagtcatttgttcatggcacaggttttgcatttttgaggcatatttgcaataaagacagtatattgtctgtatattataatttttgataaacaaaagaagaatgatagatcacacttctctatgaaaagtgtaattatgatatacatatggtcaaattctgaagaaaaaagttataattagaagactgaaattttcagttaggttaatacaatgaggaataatttattaaattttaatgaatatttagtataattctccctcaatttaaaaacacagtttgttcaaaaattattttacttcattggaatgcattgccacatatgatatttgcttatacatgcatatctaatcattttatagtgaaagaccataaggtattaatgaaattgttattaagcatatttatttatgtctccacaggagctaattaagagtcaaagatgtggctctgcagttaaggtctcttcttcttgcagtattcagattcagttttctgtacctgcctggggacttcttttccttccagaactcttttttttgagaatatgttttaccattgcctgcatttctcatatgaacagagctacgtgccagcaaaaataacatttcatatgaaattaaagtcaataaacattattttaaaattataaatgatctggaaatattacataggacgcaagaaaccatccaggaaagagaatgagaggaaatgtgaagcctgaatgagtttcagtactgctgaccccccatatcaacattttaacaattaggaatgatccctttgtatgataaaaatattttgtatctgtggaacacagagatggagactcttatgtgttcattgtaatgtgggaaaagatttatcctatcaatgctgtatttaggtattaacttttctgaggaggcaccgtaattgtgaaggaatttatgatacatgaaaatgctgttgtccagcatcccatcaaacaagaaatctgctccagaaggaaaatgaattatatcagattccaccattttttaaaatactttatttatttattatatgtaagtgcactgtagatgtcttcagacactccagaagagggcatcagatttcgtatggatggttgtgagcctccatgtggttaaataattttaaagctctctaaaactgtttatttctattttatggttttgaatacattgtcgtaaaataatttccaaaagcatttgattttctgtgtcatatggaacgttcagtggatgccctgatgttgcagttttattgtgtttaaagaaaaaaacttagtcgttttgtcaatccattatttctgcattttgttttctacctgtttcttctagaacatgtgcagcattgaacttaggcctcagattgtcaaatggacatgttgtaatacaaatgtgagacacagctgcacataagactaagctagtgtccatatttgaacaaagtggacattgtaaaatttgaaagcatattttttatcataacttgactatctctaatgggacactgggattcagtttgatatcaacccatatttcataaaggtacattactggatttagacatcaaaagtacatgttatattctataaatgtttactgcttttgaaattatatcatgcattctcagtgaaaaagaaatataaggaagtctattagtagtttaaaaaatttctttgaataaagttaatgtttatttttcttcgatatatgttgcttaaatttgcctgaatgtatgcatgtgtgctatgtattcctcctgtcagtagtgttcagaagagatcattggattttaaagaactgggtttaacaatctactgtttagtgccatgtgggtgctgggaatcaaatttggtaataaatgacattaaaagacagtatacagggctggagatatggctcagcggttaagagcactgactgctcttccgaaggtcctgagttcaaattctggcaaccacatagtgggtcacaactatctgtaatgaaatctaatgccctcttctggcatgtccaaagacaattacagtgtgcttagatataatgataaataaatctttaaaaaaagacagtatacaatccaaactgcacaccaaaatttttgaaaagaatgatgatagcaaatctttcatttgctgtgaacgtctatgtaaatcacagaaaattcttgaagatgagagcctttctcttctcttctcttctcttctcttctcttctcttctcttctcttctcttctcttctcttctcttctcttttcttttctttgtatttatttagagagcctttctaaatgcgagcattataataagtcattctgtagattgtcagtggaagagcagccattcgtatcttcagacacatctcaataacactttcagaaaacatttatccttcaatattttccttcctcatctgcatcaaaaaaggaaatctttttgttgttgttgttttgggtttttttgttttgttttgtttttctgagacagggtttctctgtgcagccctggctatcctatcctggaactcactctgtagaccaggctggccttgcactcagaaatctgcctgcctctgcctcccaagtgctgagattaaaggcgtttgccaccacacacagcaaaaaaaggatatctttttttttttaaagatttatttattattatatgtaagtacactgttgctgtcttcagacacaccagaaaagggagtcagatcatgttacagatggttgtaagccaccatgtggttgctgggatttgaactctggaccttcggaagagcagtcgggtgctcttacctactgagccatctcaccagcccccaaaaaaggatatcttaattacttctttttttaagtagaaaaacatttttgtccagtatcaagtaggtagttttccattacagggtctgttaactttcaaggacgtggccttggacttctcactggaggaatgggaatgtctcagttttgctcagaggtcattgtacatggatgtgatgttggagaattacaacaatctgttgtttgtgggtaagaatgaacttcttgttgaattccttttactttctttgagtgttcctactatgtgcttatgtaaatgctctgagatatccagagactcctgaatgagggaaattctagttaaaatcataactttttcattgtgtttcctttacatttctctgctttcttttgaaaagtaaccaatgctatattctctgaggtcactccttatctcttatctagcttcagtgaacttaaaaaagttcaagaaaaaatttaaatatccagaacaagaaattatatttctgtacatataatagttgcaattataaaaatcttactattgcattaaaatgtatccttatttatgaatgtaacaatatacaaggtttcaagtggatatagagctgttggtttgggcaattttttttctttatttaactttttgacatttgatctctgtgtttagatctgggacaacataatctttaccctagcattttggatgttgaaacaaatctatttagtgatttccctgacactatgggctatatcataaatttatacctgagcaaaattatatcagattcagtgtcactctgaatcaaattgtaatcataaaattagagatattttgtttagagttctactttcgggaaattcactacagatggatcatttatttgtccagcttatgcaaagtacaattttcttttttattggtctttttttttttacatgtcaaatgttatgccccttctccattccctgtctgtaagctctatatcccacccctccccctgtttttttgatgatgctcccaccaccaatccatctactcccacctcatgcccctaggattctcctatgcggggatactgaaccttcacagtaccaagggactcccctcctgttgatgccacataaggcaatcctctggtatatataaagctagagccatttgtacttccatgtgtactctttattttgtgatttgacccttgagagctttgtgggtcttgatattgttgttcctcctacacagttgcaaagcccttcagcttcttcaggccttcccttaactccttcattgtggtccccttgctcagttcaatggttggctgcaaggatctgcatctctttgggccagtctctggatagccttcccttcagcctgtttttcattcttttttgttttcttttttttattaggtaatttcttcatttacatttgcaatgttatcccgaaagtcccccatatcctccccacctcactcccctacccacccactcccacttcttggtcctggtgttcccctgtactgaggcatataaagtttgcatgaccaaggggcctctcttcccaatgatggccaactaggccatcttctgctacagatgtagctagagacacgagacacgagtggtactggctagttcatattgttgttccacctatagggttgcagatccctttagctccttgggtactttctctagctcctccattgggtgccctgtgatccatccaatagctgactgtgagcatccacttctgtgtttgctaggcctcaacatagtctcacaagagacagctatatcagggtcctttcagcaaaatcttgctagtatatgcaatggtgtcagtgtttggagactgattatgggatggatccccagatatgacagtctcagctccaaactttgtctctgtaactccttccatgggagtttttttcccaattctaagaaggggcaaagtgtccatactttggtcttcgttcttcttgagtgtcatgtgtttcacaaattgtatgatatatcttgggtattctaagtttctgggctaatatccacttatcagtgagtacacatcatgtcacttcttttggagcaattctgggttattatatttgaggtggtatgatgtctaatttgaaaataacatttagcagggtattatcatttccagtcatttgatatagatcatatttgaggttcttctgaggatacatgtaatgattcacagagagagagagagagagagagagagagagagagagagagagagagagagagaaacctttcttgagagtacgaatccataagctcactgattattgagtcccttactccttatataagtaattcatgtcacctctaattgccccccccttttttttcagaaaatcattgcatacgtggaaagaatgggaaggtattggatcaagacagccagtacattgtccatgaacacatgaatattcaagagaagtcttctaaatgggacaagcttagcaatgtcattcttgaatccctccagtgtacaccttacaaaactaatcacagctctgatgctcttcaattctcgaaccaaaaaagacttaagcccaggaacactaaagaagtttgcaaatacaatgactctgtaaacagtttaagtttgttttctaccattagtctcaatcaaggaattaacatgcagaagaaaaaacacaaccgaaatgcagaattagacaatatttttgtttctaaacataaagtcatggtgaaaaaagacaatattgcagggaacccttacaaatgtagtgaatttcacaaatatcttacccagagagaaaacctacaaagtcagcagagaatttatcatggaaagaaaccttacaaaagtagtaaaagtgacaaatgctttacccatcagatccatcttagtattcatcagggaattcatacagaagagataatttacaaatgtagtgaatgtgacaaatgttttaaaaacaaattcaatcttactatgcatcagagaattcatacaggagagaaaccttacaaatgcagtgaatgtggcaaatgctttactgaaaaaagcagtctgagaattcatcagagaattcatacaggagagaaaccttacaaatgcagtgaatgtgacaaatgctttaccaaacaatccaatcttagtattcatcagagaattcatacaggagagaaaccttacaaatgcagtgaatgtgacaaatgctttacccaacaatcctgtcttagtattcatcagagaattcatacaggagagaaaccttacaaatgcagtgaatgtggcaaatgctttactgaaaaaagcagtctgagaattcatcagagaattcatacaggagagaaaacttacaaatgcagtgaatgtgacaaatgctttacccgaaaattccatcttggtattcatcagagaattcatacaggagagaaaccttacaaatgcagtgaatgtgacaaatgctttacccaacaatccaatcttactattcatcagagaattcatacaggagagaaaccttacaaatgccctgaatgtggcaaatgctttactgaaaaaagcagtctgagaattcatcagagaattcatacaggagagaaaccttacaaatgcagtgaatgtggcaaatgctttactgaaaaaagcagtctgagaattcatcagagaattcatacaggagagaaaccttacaaatgcaatgaatgtggcaaatgctttactgaaaaaagcagtctgagaattcatcagagaattcatacaggagagaaaccttacaaatgcagtgaatgtggcaaatgctttactgtaaaaagcagtctgagaattcatcagagaattcatacaggagagaaaccttacaaatgcagtgaatgtgacaaatgctttaccaaacaatccaatcttagtattcatcagagaattcatacaggagagaaaccttacaaatgcagtgaatgtgaaaaatgcttttcccgaaaattacatcttggtattcatcagagaattcatacaggagagagaccttacaaatgcagtgaatgtgaaaaatgcttttcccgaaaattccatcttggtattcatcagagaattcatacaggaaagaaaccttacaaatagattgtatgtgacaaatacaatactcacaatgtcagtcttagaaatcatcagttatttcatacagtagagaatctttataaatgaagtaaatgaggcaattctttaccaagatatattatctcaaaattcattagagaatacttagagaagacaaacttttcaaatatattgtaggtatgaatcctttccttttggcctatttcctagactgtaacagtgaatacttacaggctagaaacttaactcatgcattgtatgaagaaatatctttgacttcatttcaggtcagagagaacatctaagaactttttagggtaaagtatttctgttggggaaaatggtgtattcttgacaacacttgaggctccacactagagaattagtatgattatgaaaatcttgtgaaaatattcatgcaatgttcaaatcttaggtaatgtcaactatttatgctgtgagaaactctgaaaatgtgaaatgtagaaagcttttcatgacacctttttacttgttcatcctcaaacgttaccagatgaagacaagttgggaagtcagaagatagtattttataacactttaatcgagaaagaaataatccatttcaaaaggaaactatttaaggtctttaatacaaccctcaaaataggtaataaaactggtagcattttgtatatttttattgtcctgtaactaactccaataaaactgaaagattcaacaaatttgctttggttgtttccaatttgcagttgggatactcagatgaatatatgttgcatcttcccaggaaatgcctcacataaaacatagactgaagtcatgaacatttttgcaaacctgtatcataaagttaatagtggtgatttttaactggtggataacaatacctttgggatgtaacgaccctgtcacagtggttgcttaacagcataggaaaacacatatttccaattgtcttaaaattaagaaatcattcattgaagtgtagggtagtctgcccaccctaaaataatttgaattcaatgtcagtatttagcattaaaaagttaaaaatactgttttacatatggtgctttgtgttaactaaaataagtaagattcagttcaatgttccaggcaagtattactaggctaagataaaaagaaacagaaaatacgtagaagctttcagagcctcagcaacaagtctgctctctcttgagttcaaggaagtatgaaagaaaaatctacaaaaaataaatgaaaacatggctacatagatttcaaggatagctatccagactttgctgtgtctctgcatgattctgaagtcattaattcccatttattgaacaaaagtcctataagtctcagaaaaatgctgaccgttgggctggtgagatggctcagtggttaagagcaccgactgttcttctgaaagtcctaagttcaaatcccagcaaccacatggtggctcacaaccgcctgtaatgagatctgatgccctcttctggtgtgtcagaagacaactacagtatacttatgtatagtaaataaatctttgaaaaaaatctttttaaaaaaaatgctgactgttgacacatattacaagacattgtggtgtctggtcctgttgtgccttaatattccactctaccgtaaggaatgaaatagatttccattcttttcttaaatcatctacagaatgctaatattttgcacatctcagaatatacattctgaacaaaaactcaacaactcactactaaggtattatcttcatcttaatttcatgtatgagttcattcatacaaatatcatgaatctgtaaatcttagatgaggtgcatactcatgcactgtttagaaatccaaccatcctggagatacattgggaagtactgaaagaagtacttttactccgagttcaatatgatattagaatatttatcctaaattcaagaagtttcagtaaattaggatctaagaaaaaaatcaaatggtacaatgaacaaatctatatcactcatatattttccttgactttaaaaaaataacaaggaaattgttcagcttgtgtcaaaataatgaatgataacatttcattggtctcaatattggaatttgatgaaacaggacctcctcattagtagaatctaagtatgagaagaagcaatagtggcccttcatttcaaatgatcataggtattttctgccaatagcttcatcagggatgttgaaacttacataccaggcaaatgaaaaataagtggcttgagtagctcttaccagtctggaaattgcaaccagttggacagtctctcttgattctcattgcacatgttcagtggatttaggactcaccgcttaataatgactgagagattattacccaaatctgaagtaacttccaggttccaggtggaaaaatttctagaagtacacaatgaagacacatcttaccttgtacccctcacacaatattcattctatagccatttatacacacacttcttgtctatggtaccgcaagcatatggtgatgattgacaaaataagtccaggtagactcactgtttgagttatgtggaagacagcatgtgtagattgataaagatgcaagtccttggttcaggataattaaccatatcatgtttgaagaacatggagactaaagctcactggatttagaacattaactatttgtggaagagcattgtaaaatgtttaacaagagccacactataggagcctgatgggcatttctagaagaacttccagtggctagattttaagtaacccactaggtctatgtcagtaccttccagggaaaggaaacttctcttcagctttaggacaactgatgggacagcctgaggatgggaaacacatggagtaggtggaaagagttattccttggttgaaagtaattttattacaggagaactcagaagacggactgagggcctgaaggaagagagtgggatcagcagcccatccttgtcagtaggagtctggagctgcatgttgtggaactaggactagagaacactgcctgggttctcacagccatgtaaaaattcccttcctctttagttgtccccaagttaagtcttgtggaaattttcagtcaccagagcagtggcaggaactgcaaacaagaagacttggacactccaaggtcaaagaagctgctaggctagtggaaagacaggcactggaccatgattgaaaccccttactctgctgctcataagaacactgatcctcaaatcctagtgtgcatttcataactgtgttgttaaattgctgaccatgtaagtgtaacttttcctgatttttttattcatcttattgttgtctggatacttacataataatttctgagacgatgggcttgttggttgcaaacatggttatatttctcttggagcaggtttaaaattggtacaattcatatccatccattgtttgtaacgctgctattttacgactgtgctagtcaagatctttgccattggagattatgcatccactgggaggtttaaatattagtcccataaggaccactggatatgtcattgaaccttaagcaatatttagcactttttaaagttttagctgtctttagatttatcatactataaacatttattttttatttttattttttatttttccaattttttagtaggtatgttcttcattaacatttctaatgctatcctgaaaatcccctataccctaccccgctgctaccctaccctcccactcgcactttttggccttggatttcccctgcactgggtcatataaagtttgcaagaccaagggtcctctcttcccaatgatggccaactaggccatcttctgctacagatgcagctagagacacgggctctgggggtaatggttagttcatattgttgttccacctatagagttgcagaccccttcagatccttaggtacttttactagctcctccattgagggccctgtgttccatccaattgctgactgtgaccatccacttttgtgtttgccaggcactggcataggctcataagagaaagctatatctgggtcctttcagcaaaatcttgctggtgtatacaatggtgtctgtgtttggttgctgattatggaatggatccccaggttcagcagtctctggatggtccttccttttgtcttagctccaaactttgtctctgtaactccttccatgggtgttttttcccaattcgaagaaggggcgaagtatctacacgttggtctttgttcttcttgtgtttcatgtgttttgcaaattgtatcttgggtattctaagtttctggctaatatccacttagcagtgactacacatcatgtgagttcttttgtgattaggttacctcactctggatgataccctccagatccatccatttgcctaggaatttcataaattcatcgtttcttattgctgagtagtacttcattgtataaatgtaccaacttttctgtattcattcctctgttgagggacatctgggttctttccagcttctggctattaaaaataagggtgctatgaacatagtggaaaatgtgttcttattaccagttagaacatcttctggatatatgcccaggagaggtattactggatcctccggtagtactatgtccaattttccgaggaactgccagattgatttccagagtggttgtacaagcttgcaattcctccaacaatggatgagtgttcctctttttccaccctctccagcatctgctgtcacctgaatttttgatcttagccattctgactggtgtaaagtggaatctcagggttgttttgatttgcatttctctgatgattatggatgttgaacatgtttctaggtgcttctcagccattcaatattcctcaattgagaattgtttgtttagctctctgtcccattttttaatggggttatttgactttctggagtcctccttcttgattcctttatatatgttggatattagtcccctatctgatttaggaatggtaaagatcctttcccagtctgttggtgacctttttgtcttatttacagtgtcttttgccttacagaagctttgcaattttatgaggtcccgtttgtcaattcatgatcttacagcacaagcggttatagttggtcatgagacactgtgtgtacctatatacaaacttttgtcccctgaagagcagccagtgctcttaaccaccaatccatctctccagctcctagttcctctctttaaaatgtggctggcaaaaagcattcttgcttcaagtggtggagggttaaataaaaacttttatttataaagcatttggaaaagtgcctggtgtctcttcgtgatgctcaggagcaactgcattattagctgtaaggtgggttctgagcgccacagactgcacacagctggcgctttgtaaattaaggctggggtcagtgaccccagaatcctggaccacagtcattttttgcctccttgtgtttcaagagagggtctcatgtagctcaggctggttttcctcaaagtgactatgttacagaggatgagcctgactgtttcatccttctgcttccacctcacaaatgctgaggggactaaaagtgtgtgcctcctcaacgtgtgacatgggtctgagctctgaatgcaaggtttgtggtaccaggctagcacagtttcagcctgagtcactactctccttttagaggtttattcttaatttattcaaaacattttattttatgtataagggtgttttcacttacatgtgtgtttgtgccctaccgcatgcatgcctggtgcccaccgaggttagaagaggacattgtacttcctggaactagagtttcagttctgatccaccatgtgagtcctgggaattcaatctggtcctccacaagggcagcagagtgtttttaattactgagctgcctccccaagcctctaaatcacttcttaaaatgcaggaatgtatataaactcactggcagcatatccttggcaatctcactaaaactatgatgtagctctaaatgtcacacagaaggagcaatgaaaagtacgtacaaaaaaaaaaaaaaaagactggagcgggacacttagagctagcttcaaagcacaaggccctctcctggcctctgcaggtacctgtacttgtgtatgtgtgtgtgtgtgtgtgtatttgtggcatgtacacatttgtatgcatatacatatgtgtgtggtatgtttgtgtgcatttacatgtgtatgtgcagtgtgtacagtgtatgtttgcatgtgtattagcagtgtggtgtgcatgtgtgcatgtatgtttctgtgtgtaggtatattatgtgcagcatgtgtgtgtgtatgcgtacatgcgtgtatgtgtccctgtgtatataacaaaggtaaccaaaaaatcttttttaaaaattagttaggctggagatatggctcagtgggtgggagcactgacagttctgcaagaggttctgagttcaagttcagcaaccgaatggtggctcacaaccatttgtattgggatctgatatcctcttatggtgtatctgaagagagtgacagtgcacacagatacataaaataaataaatctttaaaaagctgagtcaaaataaatcctatctcaaaaataaaaagttgttttggctctattggtaaagaacctgacaaagcctgactgcctgaggtttggatcctcagaacctacataaaaggctggacccaggctggagggttggcccactggttaagagcacctgtttctcctgcagagaacctgggtcaactctctgcactcgcatgactgttcacaacgggggatatgatggccttttctgacctcctaacaaacctgcacacgtacaggtaaaacacattcataaactttaaaaaacaaaagaaaaaggaaaaagaaaaaagaaagaaaaatttgaaacctggacacagacacatgcgcacgcgtgtgtgtgtgtgtgtgtgtgtgtgtgatctgagtgtttgctctcactctgggactgagaaagcacagccctccagcagtcagggcagatctgattggcaaacaccactaaatgtcagcaatgtaatcaccacatgatcaaaatcgatgacactgttctaaagggtttttctcttcaaagacatagggtgcaagtttataaaataactcatgtcaaacatttaataactttattaagaaggctgaggcaagaggatgacaagtttgatgccagctaccattaacatagcaaaaactttctcttaaaaaacaagggtctgaggatatgactcagtggttagagcaccggctgatttaccagaggacctgggtttggttcctagcacccacaaggtcatgcacatttccacggaatctggtgccctcttctggtctctgtgagtacagcatgcacatggtgcacaggcacatgcaggcaaaacacccatacacacaaaaaagaaaataaaaagtaaattcgttaaattgggcatggtgatacatgtctgtaaaaataaatacagattgacaatgtgttcagcatgcaatgtatacttcttaaataacacaacaccatacatgattttaaaccacagaatgagagactggagagacagctcaatgtttaagaacacttgctgctttgcaaaggaccttggttcgacttccagtatccacacagctccggctccaagagatgtgatgctcttctgacctctgtggacaccagacattcacatggtgcacatatgcaaaataaaactataaaaaatatttagctaagtaaaatgtaaagattggggaaaaaaggaaatctaggcaaaaagttattaccccacaaagactgctcaatgtttcttaagcctcttcaggggaatggaaggaactaagaattgccggagtgatgtgaaacaggcatttgaataaacggacataagtgaacatgcagagccttggttcccaagcctaccacaccactctatcctgagcagtgttcatgtagtccatgtgtgctcagtctctgctgcgtgtgtctagacagtatctgcctatctgcacaaggcacagcacataatgatgcaattaggtttagcatttctccctttgaccagaaacatggctgtactggttagttttgtgtcaacttgacacagctggagttatcacagagaaaggaccttcagttgaagaaatgcctccatgagatccaactgtaaggcattttctcaattagtgatcaagggggaaaggccccttgtgggtgggaccatctctggactggcagtcttgggttctataagagagcaggctgagcaagccagaggaggcaagctagtaaggaacatccctccatggcctctgcatcagcccctgcttcctgacctgcttgagttccagacctgacttcctttggtgatgaacagcagcatggaagtgtaagccgaataaaccctttcctccccaacttgcttcttggtcatgatgtttgtgcaggaatagagaccctgactaagacaaattggtaccagcagagtggggtattcctgtgacaacctgaccatgttttggggaggactgtgggaggactttggaactttgggcttgaagatccatctgttgttaagagctctgttggatgttgtgtaggaacttggaagataatgttgagaacactgcagaagatggaggtctggtttgtgaaatttcagagggaaaattaaagactcttttcagggccattgctgttttgattgtgaagattctgtagttctggttagctggggctgaagaatcagctgtgattaacaagataccagaactactgaagcaaaaactttgcattactgggactattgatgctggttagctggagctaagaaattagcagtgattaagaagagaccagcatcattgaggtgacatcttctgggaagtgttttctgaaagcacaaagaggctgtgttccagagatggccaaggttgtactcctgctgcagcgggacttggtaatatgtaagggtcacccagatggtactggttttgaaggcatgaagcggccacgcaaagcagctgaggcttggcactgtgaaaggccatggaaggccattggtgaaggtgtagcctcagttgcaattgaaggcccaggactgaaggggtcacgcagtgttttggagatgccagtaccatgagatgaccaccaagagcagcagcagcagtggagtacaggcatctggagcctagaggacgacgcctgtgctacaaagggcatggctggagaactgacccaagcccttggaggagcccagaagatcgtgagttggatcccagacattggacagttggagattgatttttttgcttttgattgtgactgtgccctgatattttccctcttgaaggaagaaactgttttagtggagcccacagttaagagacttttaattgtaaaaagactttgaattttaaaagagatggatattttaaagagattgaaattttaagaatatgtaaagactatgggacttttaaagttgtttggatcttgggatgagtaagaatgtaagggttgaggcttactagtgatttgtttgtgtgtcaagttgacaaggggtcaattgtactgtttagttttgtgtcaacttgatacagctggagttatcacagagaaaggaccttcagttgaagaaatgcctccatgagatccaactgtaaggcatttttcaattagtgattaagggggaaaggccccttgtgggtgggaccatctctggactggcagtcttgggttctataagagagcaggctgagcaagccagaggaggcaagctagtaaggaacatccctccatgcatcagctcctgcttcctgacctgcttgagttccagacctgacttcctttggtgatgaacagcagcatggaagtgtaagctgaataaaccctttcctccccaacttgcttcttggtcatgatgtttgtgcaggaatagagaccctgactaagacaatggctgactgtcagctacctcaactactacaagaagaacatgtggtgtctggagccacaacagctctaggctaccagaacacttcctgagaagtcctttcatccagccagacttaagttgctccctctccaggccaggcttgtgtacagtgcacagcttggccttcgtacctgcaaaccacagcagtgaaactttatccagtacaatggtgtgtgtgtggtggtggtggtggtgggaggtccaccagcaccatgttatcattctcggtggttatcccgtggtaggtgggctctagccatggcttgtgcttgttaactgcattgggagaaaaagggaaaaaaacagtaagattcagatcactgcttcagtgttctgctgtctttgaagatgatcatgtgttatctggcttctgcgcaagtgaacacacttacaggaaagcaaagccaggcacataaatggaggagagcaaagagactgatcatctgaaaagggcaaactgtggtttgattatgggagtgccccatgtaaaatctaacccagatcatgaagacagaaattgactcgttccctccacaagacactcctgggacatgagctctgacagagcagcctcaggagggacagcactctcacccttagtccccacaggggcagcatggggtgacacaatagcagggatgactgtgggcattgacagaatctggtaaagctcacagcagcaagggccggtcttcatcaaagggttcatggaacaaaaggcacctcaactatgccatgggagatgggcaactcatccactgctgagaccccaatatattttatatgaaccacactaagaaggaagctgtgacaactcagggaattagcccgaggcaaactgctcacaaacaatgaagtctcagacacatctcaccatgctctagttttagggttctctctgtctctgtctgtttgtctctatccctttctctgtgtgtgtctctgtctttctgtctctttctctctgtctctctctgtgtttctgtctctgtctctctccctctctctctttaaggtaaaaaccctagtctggcttcaaatttaaacttcctgcttctgcctcccaaactgctgggatcacagctgcataccactgaatcctactacaatcactcattttacaaggcaaactattaatttgttttgaaactaatagcaacatttgatacaaccttgtatcaatgctttgttttactaataaaattacaagcataataaaataaaactgaattttattccaacatttgagtccatgagactcttagtttaacatgatgtcactttgatttttccagaaccacagggatataaaaatagtaagcatagtgaagtgtggggcacctgcactgtcctaacacagaatgggaaggcccactgtaatagaaaggctacagctgaaaatggttaagaaatttcagaggagaaaataactttatggtgattcatttcaccaccactctgggattccaattttgtaattcacagtttctcaattgtgcctttaagctggcagtataaggagagagatcaccatttccagaggctgaacttttcaataattaatgaatgatatttttaatatttcatcacattcagtttacattattgtcttagtcagggtttctattcctgcacaaacatcatgaccaagaagcagttggggaggaaagggtttattcagcttaaattcccacattgatgttcatcactgaaagaagtcaggactggaactcaagcaggtcagggagcagcagctgatgcagaagccatggagggatgttctttgctggcttgctcagcctgctctcttaatagaaccaagactaccagcccagagatgatcccacccacaaggggcctgaaacccttgatcactaattgagaaaatgccccacaactggatctcatggagacatttcctcaactgaagctcctttctctgtgataactccagctgtgtcaagttgacaccaaactagccagtacaattatgaaacatttatagaaacaagtgactgatatttctgtaaccatcctctctctaaccaccagaagattatgggctgaaagtcaaggaccccattggccatctcaaagccctagggcctcactccactgcatgccagaacatcaaagccagctacattcctaacagcaaacctagcgatcacacctgttagagtgtgggttttctggggttactctcaggcaaaaatgatctttgtgactacagttcttaatgactagaaacttgaatttagaatctatgaatgccaggcggcagtggtacatgccttaatcccaatagttgtagcctggtctacagagcaagttcactcaagaaaaccttgtctcagaaaaaaacaaacaaacaaacaaaacaatcagtaagaacagtgaacctcagggttaacttcaaacaagaaagtttatcccagcccatcctaattttgtgagctgaagaaggctgttcttctgcccaagtcacatgaccaagagattctgccaggttattttcagatccactatgtgccacagagtccctgacaccaatcactcacgacatgtcttccttcttctgctgctttataccttttatgtgtagaaatccattggctgaaataaagaaattcacatatgcttcctatatcagaacacctatgctggccatactgtaagttttgaccagctgtaatgcatttcgactataagtgaacctataaaatgcaagactgaatcttggtccatcaaaaggctctgaagtcctgggatagcgccaccaggtggcagcaggtgcttgtgtgtgcatgcttgaaattatgctttgattaaaaaataacctctagcccaacccctggctactaaaggagtatcagcagcccgagttgagatgctaagggtagaaaagtaccagcgaatatgttctaaattcctatttaggcatagtgtcacatgcacacagtcttctggaaactcaggaggcaagaggatcacaagttccagggtagcaagggcttggaagtgagactagtcaaaaataagtgagtacatgtaaagtctctagctgactctttctttccccaaatacactggaacagggcaggggctggagagtcagctcagcggttaggagcatttgctgttcttgcagagtacctaggtttagttctcagcacccacatggtggctcatcctctgcgtgggcaccaggcatacacatggtgtgcagaatgcatgcaggcaacacacacacacacacacacagacacaaacacaaatatatatatccaaaaaaaacacagctgaacactaaaacaggttggtataatttggagagcgagtgtccccttaaggcctggacgctctaacttgctcaacagcctgtggtaccattgtgaagtggcagaaccttcaggagttgggactagatggtaatttgggcatgtggtctggaacagaatggttgccccactccctctgtgtcctcagggtttcctctctgcatcccaacccccgtgtgtgaggggtcacttcagatatcctgctgatgtatcagttatttacagtacgtttcataacaaacagtaaaattacagttatgagggagcaactaaagttttagggctgtaagtcaccaaaccatgaggaactgtattaaagggtgacagtattaagattgaaaaccacagccctagaaggtcaacagcctccaggacatgccccaggcagtgatatactcagcaagacccagaaacaagtgacaatggactgcagaccacaactttgaacctatatgccagtgctcttttccttatttagggtgattttctcacacaattttcacagcaacagaaagctgacagaagtggggctggagagatggcttagcagttaagagcactgactgttcttccaaatgtactgagttcaaatcccagcaaccacatgatggctcacaactgtccataacaagatctaactctctcttctcgagtgtctgaagacagctacagtatacttacatataatgaataaataaatcttttttaaaaattaaaaaaaaataaagagagctgacagaaggatgtctgcagagatccaaactggaaaggcccactcttggggctggagatggctcagccataaggttcaagtattgcttttgcagagaacccaagtttggtttgaagcattttctgtcccaacacatacccacatacaaaaacacacagagacatagtttaaaataataaaaagcaaacctttataaagaagagacattctcaggccaacacagtttagcagatagaagcacttgctgccaagcctgacagcctgagtctcagctcaggaacccacagtgaaagaggggaccaaccccagcaagctatcctttgacctccacatgcccactggggtgcgtactcccacgcacttgcacacacgcacattaataataaccttaagtataaaatgtaaaaatgaaaaagagactgggctggagagatagctcagcagttaagagcactgactgctcttccagaggtcctgatgtcaattccattatctgtaatgggatatgatgccctcttctcgagtgtctgaagacagcaagagtgtactcatatatatatatatatatatatatatatatatatatatatatatatataaatataatttgggtagaacccaaacatcaactctaaatgcactccaaaccacgtgagctctgctcatcagtgcctctgtcaccagtgtggtagtgagcctgcagcccagtgaggaccaacacacagaggcagctgccaacacaaacgtgcctgctccaatgccaaggtaaagcagaacaaagcatgatctctccctccagagaagcactggctgtgggtttgtggctagcctgatctgaccgtgagctccaggccagccagaatggcacagtgaattctgggattaaaggcaaatactgccacaccagaactaaaacattagaaaaagcaggaggtcagaagaaacatgagccctggagtaggaatggatggggtagtggcagcattctgctcagcctggtggaactgcatggagtagggtgtgcagggaagggtgccagctcttttccttctttttctttctgcagaggtggtttggtacccggggtttcatggatggtaggcagtgctgggagtgagtgatgaggtggttactgaggtaaccaccacagacctgagggctggcagccctaagacacatataaataaaaaataataaacattaagaagacttaagccaggtgttactcatgatgatattttaaatccatgtatttatgcatggctcatgtaatactttttgaataaacaaatgtagagatggttggtaatgtcacctgagatctctaatactggaaggagggagatagctcagtaggtaatgccattgctgtacaagtgaaagacccacaacgtgaggactcccccatgttctgactcaggataggtgacaccccaaatcactcatgagaaacgttcttgatgcaaactgcaagaggtatattagaaaggcaaaacccacaaacacctggcaaaaactgcaaacacttggcagcctggaacaatggggcaagttctactccctgccattaataaggcctcttttggacacagttctagttcttaaataatttttcactctctctcaggatcttgcaatccccactctttctagtaaatagttctaatcttagaactagacacagttttctaacacacatggaaaagcagaagcataatacgagggcctttccactgaatctcaaggttttctgtgcggtggtgtctaatgtagagcgaatctctatcttggaagcagtgtggggctttcacgtctcctttcagagcagcatttacaattagctcctagcagggcttctcaagccacactagacttctaactacaggtgcagggctccaaagaccaattgatcctgtctgttttttctctttcaccaaattatccccagatagtcggagagtactgctttttcaaacccgtttcctcagggtacaaagcacctatgagaattactttcgcttctctagattttcacataggtctaaacacatacacaaaaacacacaaacagccggtcgtggtggcgcatgcctttaatcccagcacttgggaggcagaggcaggcggatttctgagttcgaggccagcctggtctacaaagtgagttccaggacagccagggctatatagagaaaccctgtctcgaaaaaccaaaaaaaaaaaaaaaaaaaaaagagagagagagagagagagagagagaaaccctgtctcaaaaaacaaacaaacaaacaaaaaaccacacacacacacacacaaccacaaaaaagaaaccaacagatctagatacccgcgacccttttgtgtcctccacaaatagaccagcttcaacaacagaactcggtccctctgaccgatctccggaaactaccagacagccctggctctccccacttcccagggcatcccccagggtggcagcctgtagtcctcctagcaagtctacagaccacagtcctccggtccttaaggcccgagaggacagctgcaaacagaaagcaggcatttcagaaaacaccatcatctacaaacacaaagacatctttgtccacttccactgggacaaccaaaaccagagaaatgacccagagggtctctgaatcagatgggtggttcacgacaagagggtaacaatttcactaccgaccaacagatgggacgaaggtccctacatatgggacaaaggtccctacagatgggccctacagatgggacaaaggtccctacagatgggacaaaggtctctacatatggggcatcccccagggcaatttttaaaaccaaactcaggtggatccaaaatcaggctgattagtataaagtcaggcagtgccgtgattcagaaacaaaggatgatacacaaacaaagcaacacaaaaagcacagaaaacagaaaacaaacactcagaacagagacaccgaccagcacaaacacattccagaggggatccccatatctccaagtcgattctctggtgtgagggatggtcgtgtttcccagcccatgcaccaaatgaaagacccacaacgtgaggaccccccacacacacattctgactcaggataggtgacaccccaaatcattcacaagaaatggtcttgatgcaaactgcaagaggtttattagaaaggcaaacctgcaaacgcctggaatcctggaacaatggggcaagttctactccctgccattagtgaggtttattttggacacagatctaggggcttaaataatttttcactctctctcaggatctttcacaagcacaaggatctggggaaaatagctatgtatggtggggtgcacctgccccccccagtacactgggaatccatggagcttattgactaactaactgaattgtctccagattcagagaaggaccctgtcacataaggaggagagtgatagggaaaggcatctgacatcagcatctggcctccctcaaccacacatagttgcaggtgtgcacaagctacacacagaggtgggtgatctcaagtgctcaagtgaatgtattgcagataatggccatggtgttggccactgagtgtattgggaataatgccagacatgggcattattcattatttctaggataaagcctaaatgatctaagtattaacatgagaagctcatggaagtctaaggctcacctaaaaagcctgcataggggttggtgagatggctcagcggttaaaagcactgactgctcttccgaaggtcctgagttcaaatcccagcaaccacatggtggctcacaaccatccataaggaaatctgacaccctcttctggagtgtctgaagacagctacagtgtacttacatgtaataaataaataaatctttaaaaaaaaaagcctgcatagatcatgagagggtttagagactctatagggactaagcttagcataagcccagtctggagtccagacacatggggcatggtctgtgccagacaaacacatcaccagtcttggacaggttgatgtaacttttcatgacccacctttacaatgatcttgctctcctttaaaaataaggttaatttcaacaagatgtttacattatgatggaatccattcattaaggcagaggaggcaagttcatggcaggaggtggtgggaaggagacttgcctctcagggaagcttccagactcccaactttcactactctgcttggtaaaaaaaaaaaaaaagatccccccccccaaaaaatttcatccaaatttgcctggatctgagttttaacacacagataagtttgtctaaacacacttgaaggccactcaaaggaaatgaatggcttatttccttctccagtgccatgaagtcatctctgctactgggtgactcctggggagaggtgaacaatgtctagacagcccagagagagtaccaccaacagaacaaagacaccctcccacccaggtctgactcagtggaccaaggagtctggggggttacttggcagagcacagtgactcaaaagaagcttcagcatagaaaaccccaccccagggcaaagtgtaggctatcaggcgcctaaaagatggcactggcctccggtacaccgtcgtggtaaacaatgctattgctactgagcaggcgctagcccgaatctggcgccaacccctcccgagcgggtgcatacaaatcaaagtgccggcagactgaccaatcccaggaggactcgtagctctccccagtgctggggtgtatataagcagtcctccctgggtttccagagttcccgtagcatcgaggtgttcctgaaataaaaaaggctgttgagaagaatccgaccgtgttgcgttttttcttgctggacgaggtgagcacaacaggcaagtgaggattcctaaaggctacatgcctggagctctcttctggacttgcaggggcaacttgaaggctagttggttggatctggaattaactatgaaacaagcctctgtgtgggtctatagaggtgtttctacggtggatgaagattcccagaggagacagaagttcaaggaaaataccctgctatttgtttgcctaccttcattccttgctggtaattgtgcctgtctcatttctttgagaagcccagtttttcagcctttcaatatgggctgaagcccagagactctccaggaatgcccaaggccttcaacaccagattggaactgctaaggcatccagcatcatggatagaggaaccactgggtccatatcatggaagtcaattcaacgtgtcttccttatcatatgtactctgtctcagatcctctcctaaagaaccctgactaacacatgtgttattgtgtgaactcctggagggcgggtgttcttgtctctgtctcccatgtagggagctggtatgactgactggaacctccatctctgaacttctctgaagctcccttctggagcaacaaatgccactatccttgaatcagacaagacagtatgacatgacagagtagacagctgccctttaagatgcaattttagctactgcagaaggaacacaacttcacttcccacagctcccatacctacacctcccacaccaaaacctcccacaacttctactcctatatctcccatgtctttaccacccacacctccacctcccacaccttgatgaccgcctacagtcactttggtcccagagcaagaggtctggttccatttgcaaatctgacctgcttgcagaggtgctctccaccttagtgtccccagactggaaatgctggtgacagctactctaaccccctctctgaaaaatgagaaggtggtactcagagtccctgctcctgggttacagcctcctcctccacctcttgctcctcccccttctctacctcctcctcttcctcatgtttctctgtcctccttttaaatcaaaagagatggatgactgacaagaagcaaatgagtcagacataaggaagtagaaaaagagaatgatgttgccaacttatcattcagaggtgctctctgagacggagaataagagcaacctcatcaatcacacagtggatgcccttgcaggtgatctgtggtgtcagccattgcatgagcaattggaccaggagcctatggctacctgctagctaccacagaggaaggaggctgtgtagacacaataaaaggcgacaattagcccagaggttagagaggacactgaacctgctttcttacacaggttggactccctgtgagacctacttgggccagactcaaaacaggaaagagatgaggccaggaggtgctcagtgtggaacctgtacccctttgccacactgagggtgggaaggaaacatgagctcatctgactggatggagtcctaggaagctgtatctcagccatggctctgcaaggagagtgcatcctacatggatggatataagattgggagagcatgtgagacatttttcccctcatatttttatttctttttttctttttttttttttcctttttttctttttttggtttttggtttttggtttttcaagacaaggtttctctgtatagccctggctgtcctggaactcactctgtagaccaggctggcctcaaactcagaaatccgcctgcctctgcctccggagtgctgggattaaaggcttgtgccactacacccggttctcccatctttcttaactcccctggttctctttttgctatttcatttccctttctccaggggactgaataggcatcccaagagagcattttagatattagtcatatgaggaaccattgcagatttgattgaattagaacacgtaggttataaagcaccatcatatgactgtaaatattaacatttactgaataaagttacactctccattaattttacactgagatatatgcaggctttgatgtaaatacaccattcagaatatgtctggtaggtgccacggcaacagatgcaggggcagtgctgttgcctacaaatgaacagtgtcctcactgggtctagaagatggctgtaaagacacttctagctgtccacagatgcacctgatgcacattgcttgtatttgtaggatttctcttccatataaactcttttatgacatttttgtgatagtgacatgaaaaggctttactggattgattacttttatagggttgggcttcggggtgaattcttttctttttgtagactctagagacctgtttttttttttttccatattgtgtcacagtctaatcttgtaggacatttgtctgagggaaatgcaaaggcagatacagattaacacattctcttttccttggaaatatcgacctaaaggaagcacagatgttttgtgcaaacttccattaatatgcagcattgataaaatgagtttcaataacaaaaatgacaataaacagactccttagcagaggtggaatgctcctcatgtgcaaaatttaatatttgtaacccttgtgactcacacagtactgttgcaaaatcatgttttgcacattagtaatactcatgatcctagtttgagagtctgaagtatgctcatgtcattgtggacactttcagaacctttatgtacattgatgcaaaatactcaataaaatactcaaatactgaatccaaaaaacatcacaaagaatctatccaaaatgatgaagatttttttctcatccaatatatcttgaggagtttccattccctctattcttctcagttcctgtccactttttctcccttctggatctaacccctttctgtctctcagtaggaaaacaaacaagcaaacaaacaaacaaaatccatagactcactaattgacaaatctgcccccaaaaagctaaagtaaacgttataatatatttcaaaagaactggtgcaggcattagtatttgtacatcacaaattctagtctcaaatttctggtctatatttgggcaattttgtgtgaagcattttgctggatgttgataaagcatattttctatgggtcattataagtgaagatatcaaaaagctaaaatttcaaaggggaagaaattttttggctcagctctgagttcattagtcagaatgaaagactatgattgatgtttactggttagatgatataaatgtggacgtctctgcaaacactagttctggtagagtaacaatccatgagccaaaaaagaaatctagttcaataccactctgtaattatttcagcactggttgtgggtgtgttgtgggttatagccaatgaaattcctacagcactcagagaaaatctttcccagtgcctgtgttaacatctgaagtaaaaagtctcctggtactcagaagtcaagataaactacaaagccccgtgggtcaattaacaacacacaagataatgactgggaagaacactggagggaggctgcctctgctcaggtgagaagcagaagagaaatgagtgggaggcaggctttgtatagggtttagttgtgggtgatggattttcaggatttgaaatatctgtggttggagattgctggtattttatgtcctgagcttgagcaaactcagggatttctgagtagttaaaaccagtaagtatgttatccattctctctgtagacaatgttgagtgtaactttagattctgaccccagggtcagaattattttaggaataattaagcacagtataattttggaaagaaatttcttggtaataattgtctcaatcctctgtgcacagtgaagatgaaagtgtgactacctcaaaagtcttttgcaaagtctatgtgagtctttcttaaagttggattctaaaactaaagggcctagaggaggatcaagcatacagtgtagaggacaccaagctacaagatacatgtcacatctcttgcaaggctggtttgtattgcctgagaaacaattttcaagggaagattgggaatttttgtttgtttgtttgtttgtttttcgagacagggtttctctgtgtagcctggccatccaggaactcactttgtagaccaggccagcctcaaactcagaaatctgcctgcctctgcctcccaagtgctaggattaaaggcgaacttcaccactgcccagcacgggaaaattttatagtctgggactttcaggtgttttgtggcactacatctagcacagctcaccataccacttactacatccattccctcacttctggtcagaaaaaagtatacttctctttcactgaacagaaactctgtggttttatattcctggttaccttagaggttatttttgaccacaaggtccttttgctctctacagaaaaaaatatattttatggatgtttctagttcttagaattttaatgttgtgttagtgtaaatagaaagacagtcaaatatttttaaagaatataaattatgttgttcagatatacaaagtgtgattacgttgcttgactctatagacatcaaacatgcaagtgctgctggcataatcccagcaatcagaacactggggcaggtgtattattcttcatttgaggtcagactattctaattcaaagtgactttccaccctgtggtctccaatttcctcttttggcctttctgaactcttcacatgggctgaagttaattttctaaacttttatgcaggtgtgtctgtgtatttttaactttttattgctatattagtagagaactaagttctagcaggatcttgatattgtcatttctatggcatatcaccagccttacatttataaatacttgtctccacacctgctgagatatttgaatggcaggcagctctctatgcctagaggtaatccacagaattctggagatgtctcacacctgattgcttgaaagaaaaaaacctaacatccaattcctgggataagaattggagggtggaatttctggatggaaaaagtgatgtagggaagagaaagcaggtggaagagattaagtgggagaaagagaagagaacagataaatgggaacaggggcagagaggtaaagagcaagctacacatgaggtcataggcttgaatagtctgaaatttaaatgatcggtggtagacttcttcagtgaaaggcttacggtttaaactgtataaaaacctccttctcattatttataacactggtgtgtccacaagtactcccactacactcacatccatatgcaatatgcatatatatatatatatatacatatatatatatatacatatatatgcacacacatatatatgcacaaacacacatacacacacatatatatgtaaaacttttcacaagggtgctttgggtatttaagtcaaattagatattgattggttattcacaataaattcaagacatcattgacctagcatatttttgaggaaggacaaattttagatcaatgtctttttggttggttctgtgtatgtatttcactttttgtagcttgcaaagcccttcccataacgaggactgtggaacgtaagagccaatgttcttggaggcaccagcttgacctctttatacacagtgagttgtgcaagtctgctcgttagcaatgaagacttattgtcagtttgtaaaaagcaacaccttttgttgtcggtgccctgccgtgttcgtttatttttatgaaaccactttgtagaacaactcagttgataaaacacagtggaaaagacaagatcaactggaactccatctctttcagaattcagagacttaattataatcaccttcatacacttataagctggttcttttaaaaaaaatccaaacatcttactaagaatacagccagccgaactccatggagttttgtaccatggggctttcctatgcattggcagaaccacaagtgtggcaatgcagtatacaaaagttcttaccttctaatagatggtgacttttcttggaccttacaaccagagttaatgcaacttgaagaaatttaagatttaaaactgcagtcctactgtgtattcaaatttatggtttagctttctttttcaaagaacaatgtaaaaacaaacattatttttttccttgtatttctcttgtgatcaacttttaaaacctaacgtgatgcattggtacaataataatttattgatacaatggtaatttatgtactttttcaagtcatgtccagaactgcctgagtgtcatttgttgaaagcatgaaatgcagaggctcagtgcaaccttctaaaatgaatatactattatgtgtactgattgataaacagtgatgtctgtaaatgcttgttgtcttgatcacttggagccagttacctcatcctttttaaaactctgttaaagatttctgtatactataccattccttccccatgtaatggggttttcttggtgttcccaaaaatattgcaaaggtctttcttaagaccagcaatggagatacaaaagccaacagacatacatacagagtacacagatagacacaaacagggagacagaaggcagacacatgtagagagagatgcacaaggcagtattcagcatgttacagatttaaattaactgaatagacacgcaggatggaaggctcagataagagaaagtagagaattcaactttggactcacacttagttaaattaactaagtttaatatgttcacatatgcagaatcaattaacttgtgacctaattttcctatcttttttttttttgcataaacacaatatgggaaaatataaaactcaccacaatgggtaacaagtagccctgcattctgaaaggtgtccatgggctcagaaccctgttctgtaaagaaagaccatcagatctgggcttgtgcttctgagctctcactaccatgatggcctagaatccattttaactctcaccgtcatcacaacaggatttgaacctcagaggtcacaagagaatcctggaactcattactttcattaaaagagttgacttcatgccatattctctaaggtgacttgggtaattcttgagtctccttaccccagcttatgaagatatgcatggatgtacatagagtattatagagcacaatcagggaatcttctatgaacaaatggctaaacagtgcagtatgtattgtaggtctctttctgttttcttccttccttccttccttccttccttccttccttccttccttccttccttccttccttccttccttctgaaggaagatgaaattgtgtaacttgtttaggagcccacagccgggatcggggactgggaacaaagcagaacagccccaggcaggccaaggcggggctgttgttaaagcattcctaagaacagcttgactgtatgaaaaggtattcaaggacaaatggggctatattatctaagctaacaccatctggttggattcacccctcaatccggagacaggcaaggccatccacaccatctggccggagctggccggagcttcctgtctcttcattacctcttggcgccaagtaaagtcacataaatcaactggttgttagataagtcccaagcccaccggaacagctctaatgccccctttttctgctgacatgtaatctttctgttaatgaatcaatcccgtgccttttgccaaaattccttgtattcccaaccttttgcgtctttaaaagcccctaggctccgagtctgggggtcgactcccctgcctcctgtgcgaggtacgtgtcgacccagagctctgccaaataaacctcatgcgtcttgcaacaagagagaattcttgtgttcttgggtgttccctgttcctggattagagcggggtccctaaatttggggtcctacacttccttccttccttccttccttccttccttccttccttccttccttccttctttcctttctttattctttctttcttttgccaaaaatctagacactttttcaaaggaatttttcttaattgcctcaccctccaagcagtaaataatattgtgcctaaacctaacatcactttaattcatcattttctttgactaaggtatccagctcctctaccttttgtccaagtctaataatctgtgtctcacacgttctctatgagttattattattcgccttactgcattttcttttcaggctcttttccttgtttatttctaagcacatattgaacaaaatttttatatcctatgttgtcctcctttccttcaggcttttgctattattctcttgcccacgaataattttgttcctgtcctctatcaattgacatatgtggcttacatactttgatctcttttatcatgactctggattttctattctttacctaggatatcatgtaaattgctctctttataagatacatacatagttgatagtttgagccaaagacattttatcttagttttactttgttttgggtattgagcaccagaattcagagggattgcttaattgtgtgcatttttagcccaggagtctatactcccaatgtgagaagttaggcaggatccattgtatctgaaggattcagaacccaggtgcagtccctactacattcagttctggtctagtctggcagcaaccttgtaggaagctgagcagagtaggtcctgagaagttgtgtttccacaacagagttggaggagtggttcctgatggggagggtgagcctcctgcttcattagataagtttaagaaaaagataaaataaaaacaaagaatcagggctggtgagatggctcagtgggtaagagcacccgactgctcttccgagggtctggagttcaaatcccagcaaccacatggtggctcacaaccatctgtaacaagatctgacgccctcttctggagtgtctgaagacagctacagtgtacttacatataataaataaataaatcaaaaaaaaacaaaacaaaaaaaaaacaaagaatcaatcagtcaatcaaaaaatcaatcaataaattaaatatgcaagcaagcaaggaagcaaaaatccaaaccaacaaaaattgctctaaagaactgggaagctaattaagtaaaaagtcctgaagtaggtgggcttagatgaatggcaggaagctggtgagtattgggcgggtccagtaggagtggctctgaggaaccaagaggaagtgactggaagttccgccatcccatcattctcgatgtatctcggctgcctcgtggtcaggaagccatggaaggagactagtgcctagtatttgcggaacctgaaaacttccttaagctgcagttgctgtgctggcctcctaggacattcagcagctggtcctgttgccttccaggtcagaggagttgttgggctgggaaacaggtaggagcagggcaggcatgtggagcaggggtgcgttttctgttgctactcttacaattctgttatggatatcttaccattatcaggaagtttgagttcccgtgaattgagtttatgttttaattgattttatggttgccagaatatttttctaaaacaacccagtagatccttgaccctctctggagtttgaataccggaagggaaaggggaaggggaaggggaaggggaccctgaaaagaaaatgcagtcaggtgaataataatcattcatagagaatgtgtgtgagacagattatcagacttgaagatatatagtaggttctgttaaccctgagtgtccccagagaaaaaccaatttctccatgtggaccagctttatcaaataatacatcctgaccaagagatagactttggtcacatgctacaggcattttataggccattgtagtttcctatgaggctttattattttcctaagacatgcaacctgcagcacttcaagaagatacctggttcttgtgctggtggtgaggttaatttttggcattttactctgagggagaaggaatgaagagatatctggttgggtccagactgaaccgggccatcatgtggtgggaggggaattgaggatgtgatggaggatagaggggcaggtcaagagatcaccagcagccaagaaagtacctatccaactatgacttcattgatatgttaacaggtacccctggtagccattcttcctgaatttctttgaatttttccaaggttcagcccaccatgctgtgcggtgatgatttcaggagtagatattttaataagtggaaatttttctatggatttttttttgtttgtttgtatttggtttttgttttttttttgagacagggtttctctgtgtagccctgattgtcctggaactcaccaggctggcctcgaactcagaaatccgcctacctctgcctcccaagtgctgggattaaaggagtgcactaccggcttttactatggattaagacaaaattagacagcatcttttgaataattttgaacacttacttactgaattactgtctggattctggatcagaataattttcttccagtcttctgtcctcctcttctgtattgcttggaaaaagactctatgtgtgttaactgtgtgactgactctcacatctttagggtaaactgaaatactcagaaaaataggcattctcttgataacttctcttcatgtttatccttttctcgggtattgacatctttcatttttgttccatgaacagtttcatgttcattctaaacaatatttacccattttcaggtctccatatgctcagtcaactctccataactgtaaatcaacactaagagcactagaaggttaaaggtcaaggagactctcacaaaggatccaggtatgttagaggtattgaacaatgggtggagttgggctcacctgtgagtagaaagaggacatgaatttgattttcccagattctatttccttaatgattctggaaaagaataatattagaagtgatgatatggatttaccatggaaggaagtgctgtcagctgttacttgatgtcaatatttaattaattttgatcctgggaaattgctgttgctcattgaaatcaaagtttcttttatccagattgaaagcaacatcaggctatggttgttataagggcaatttatacataaagcaaatgtcagcagtagattccctcctagggcctgtgaccttacttatcgtattttttaggcagattttcactgtaatctatggatttttgtttcctgtggagcttgaaagagaaaacctgttacccacagatattcttgccagtatcataaaaatttccattttggcagattcagattggagcaagcaggttacaaacctgaatatagacattgataactctgcttcctgccccaatttgcctagcaatttttttcactatggaagttcccaccggggtgtctaagatgtctgttgagagtgaatggtctgatatgaggtggctttctccagaaggtctatttgctttctgaatcacctattctatccactctaaatgttttcctgtccttgacctgtgttcttaattgatgttctgtgttgcattaatccccattagagtagaataattatttttgaccttctctgtactggttgctttagttttgaatctgtttgccttatttctgaggtatgtttcttctcttctatccttgagagcttttatactgagcagtgtctactttttaccccagggctctataagtaagtttcattctcctattgtcactgtaatttgggaggattcctgcctacatcttttaacttaggcctagtgatgtaagcttctactctccatacagtattatctaggcctggtgtgttttcaacctctgaaatttgctgctgagtaagccccccccccctttcttattccttctcaatgcttatctggctgattcaattcggtttttccagctcaaactcctctccgagctgagttcttctctcagacactgaattgttccacttggccttaaattaactgtagaaatcttttctcatcttctggctccttctctttctcctgctcattctatctttacctgttcctagcatgttctctcttcagtctgactctgtaaaactctcagaacccaggtgcagtgtcctagtacatccagctctggtctagtctggcagcaacattgtggggaagctgtgcagagaaattccagagaagttgtgtgaaactgcaacagagttggaggagtggttccccaacagagttggggagggtgggcttcatgcatgattaaataagtttaagaaaaagacaaaattaaaacgaagaatcaaccaatcaatcaatgaattaagtaagcaagcaattaaaaatccaaaacaataaaaattgctgtgaagagctgggaagctaattaattaaaaggtcctgaagtaggtgggcttagaagaattgcaggaagctgctgaatattgggcgggtccagaaggaggggctctgaggaaccaggcagaaatgacaggaagttctgccttttcagcattctccttgtaccttggctgccttgtggtcaggatgtcctggaggaagactagtgcctagtatttgcagaacctgaaaatttccttgctggcctcctaggacattcagcagctggtcctgttgccttccaggtcagaggagctgttgtactaggaaatgggcaggagcagggcaggcacgtggagcaggggtgcattttctgtcgctactctcacaatctgttgtggatatcttaccattgtcaggaagtttgagatcctgtgattttggttcatgatgatgttttaatcaattttatggttgccagaatatttttctaaagtatccttgtagatccttggctgcatctggagtttgtataccgggaggtttgtctttgcaaaagcctttataaagcaactgtaattcaaattcgttcctgctttcttaactcccctgttccttcatttgccatttcatttccctttctccagggaactgagtaggcatcctgagagagccttgtagatatttgtcatatggggaattggtgaagatttgattgaattagaaaatttacgttataaagcaccatcatatggctgtatatattcacattaacctaacaaagttatagtctccgttagtttcacactgagttatatgtagtcattgatgtaaatacagcatccagagatgtgtcttcatagtcttagttattaatgttacaccttaggtttcattgaagcatgaaaacaggtttgcagcaatgaacaactaaggagaagatatatagtaggttctgttaacccttaatgtcgtcagagaaaaaaaaattctacaatgttggaaagctttttaaaatattacatcttgaccaagagatagactttggtcacttcctacagctggttttatatgcccttgtcattttctgtgaggccttattattttcctaagacatgcaacctgcagagctgcaagaagatacctggttcttgggcttgtggtggggttaatttttggtatttcagcatgagggagaaagcattcagagttatctctttgggtccagactgaaccagttcattagatggggggaagggaattgaagatgagaaggagaatagaggtcaagccaagagttaaccaggagccaagaaagcaccatcccaatccctgtcttcattgatatgttaatagttaccccagttagcctttcctcctgaattcttctaatcctccaaggttctgcccagcatgctgtgaaaggatgactctaggctaagatatttttataaatagaaaacttactatggattaggacaaaattaaacagcacctttgaaataattatgattgctcactttcttaagaaaaatgactccttgtttcatgaaaagcactttgcccatacacattcatggtttgttgagtgctgcactgtggagttcttgcaggtgtggtaatgcttagaccctgcattcagggtttttttcagcaatctcttgttggagaagttcaacagtttggatcctgcgtgtcacaatagttttcttacattcttccttgtttctcagtgattctgggaaaaggactctctgtgtgttaactgtgtgactgactcaagagtaaactgaaatcctcagggaaaaagagacattctcatgacatcttctctttccttcatgtttatcctttcacctggtgttggcatctttcatttttgtcacatgaaaaggtccaggtttttttgaatgattttcccattttcaggtcttcattttctcagccaaatcttcataaatataaatcaaatctaagagccctagatggtaaaggccaaggagacactattgaaggatccaggtgtgttagcagctttgaaaaggggtggggtggggctcacctgccagtacaaagaggacatgaatttggttttgccagcttctgtttcattaatgattctgaaagatttcactaagaatattagatgtgatgatatggatttcccatggtaggtagtgctgtcagctgtcacttcatgtcaatatttaattaattttgatgctgggaaattgctgttgcccattgaaatcaaagtttcttttacccagactgaaaagcatcagttaatgtgtttgaaaagggccatttacacaggaagcaaatgtcagtcttggattcgctcccagggcctgtgaccttctttattggattttagccagaatctctgtttagtctatgtatgcttttcctgaggagctggcctcagcttgaacaggaaagccttttgttacccacagatagccttgccactatgatactggcggccatgccttgcctggcagattgaaattgtagcacacaggatacaaatctgggtatggccattgatagctctgcctcctgccccagtttgcatagcagtttctggactctgaatgctaccatcagagagtccatccacaatatttgttgacagagtggatggtctgatctgagttgttcttctccagaagatgcacttgctctctgaatcacatcttcggtccaatctacatgagtttaagtccttgaattgtgttcacactgatgcagtttgttgaatttggccttattttattgtggataccaacaagagcttgctgacaggaggctgatataactgtctcctgagaggctctataagtgcctgacaaatacagaagtgggtgctcacagtcatccattggacagtgcacagggtccccagtgaaagagctagagaaattacccaaagagctgaaggggattacagccccatagtaggaacaaaaatatgaactaaccagtatacctagagctccttgagactaaaccaacaaccaacgaaaacacatggtgggactcatggctctagctacatatgtaggtgatgatggcctagtctgtcatcaatgagaggagaggcccttcgtcctgtgaaggttctatgccagaataaaacaccagggccaggaagccagagagggtgggttggttagcaggggtggggcaataggataggggatttttggagaggaaagtaggaaagtggttaacatttgaaatgtaaatgaagaaattatcaaataaaaattgaaaaaaaaaaggatggaataatctctttcctgccttgtctggaccgtttggtttagtttcaagtctctttccatttgttttctgaggtgtgtttcttctctttttacattctagaaagcttttatagtgagtggtattagattttgcacaggactgtaaaactaacctttattctactattataattattgtctgggaggctgactgcctctgtctaattatcatggcctagtcctgtaagcctctagcctctaaataatcttatgtagtcctagagtgttttcagcctctgagatttcctgctgattaaactccccctttcttgtttgtttatttcaactccttttttaaaaatattttatttttttggttttcctgacacggtttctctgtgtagagttctggctgccctggaactcactctgcagaccaggttggcctggaactgagaaaagtgctgggattaaaggcatgcaccaccactgcccagcctcatttcaactcttacctggatggttcaactcagctgttcaggctcaaactactctcccagctgactcattcagcctggttctcagacactgaattgctctgcttggccttaaattaactgtagcaatctttttttaaatcttctggctccttctctttctcctgctcattctgtctttacctgtgcctagcacaggaaatcaatatttccctcgtcaattctcattcattttctgacattccatggtacttgataatctgctttttctcattgtcaatccatacttctgaggccagggcgttgaaagagatcatacatatacctgttaaatgccaagagaaatatctgacatgagagaaatataaggtcaaagaaatacataagaagcactgaatatttgctgatatcatgtgtccctgtgtctctgaatctcgccggcaagaacacacacacaggacaaactcggatccttctgcagcaaagctttaatgcatctcgagagatagatgatcagcttctggggaggaggagacccagagcacaggaaactcggtccttttatagaccacgaagagcggttggagatgtgccttgccctgattggctgctcaccatcaacccagatgatgccacgggacaggcagggcacaaggaatggaaaaataccccagcacatgcgcagactacttgtttaccagttagaacaccgaatgtcagcactatcttgtaatggtgactgcaagggcggctcctcacaatcatggtcatgacaactttcttcagcaatagtatctccatgttcagaatgaattcttatgtttttatttatgcataaacatatgtatgtatgtgtgcatatatgtgtatgtatgtgtattggtatgtatgccaggagaccattatcacacattctttctttcatgttaacctttaagagtggtggctagagatgaaatctgtaacagctaggctccgaagagtgtcattgcattcatatttattactgattgggaacctgagaactgcctggaacaatgccacaatgcagatacatgcttgttgaggatgatgttccaacggtgatattatttaacagatttgatataaggagggaatccttccaagggcataccctcaaatgattcattttatctctgtgcatatatattctccctggcagccatcagtgagtttctaccatgtcttctccttgattttgtatgtcaatatattttatgaaatatgctctcaacatgaaatataatcatagtaacactattcataaaattgcatatgaatttatatacaagtcaaatgtcatttttacactaaagacacttaacttgattatttttaattaaatttataaaattttttccacaccccatcccatcccttctcccctccctccaagaggatgtctgcatgccccaccatcccaccaggcctccccaatactaggtgcatcttctttcactgaggtcagaccaggtagtcatccactgtttatttgtcatggtcttcatgtcagctgctgtatgctgcctggttgttggccctttttctgagagatcttgggggcgggggtcccgttcagttgagactgctggtatatggatggggccaccctcctcctcagctccttctggctttcccccaaatcaaccataggggtcattggcttccatccattggctaagtgctagaatctgcatctgactcagctgtttgttggacctcttagagggcagccatgctagcctcctgtctacaagcacaacacagtatgagtaacagtgtcactgctctttgtctcccctggatatggatcctaatttgggtttgtccatggacctcctttctctcatgtgcttcttcagttttgtccttggagatccttcaaacaggaacaattgcaactccatcactccacttgaagctggacagcactttatccaaagtctctccctttgagtcctgggagtctctcacctcctaggtctttggaacatgtgagatggacctccatagcctacttgctgaggctgtctatttccattttttctactggtcctcagggcttcagtcctccccctatccctcataatgtctgatcatgtttccccttcccttctctgtccctactcccactcaggtccctccctccttcttcacccatgactgctttcttctctctcccaagtgggattgagacatcctcacttggaaccttgaacttattaaccctctttcgtcatttacattttattatatactttttttggctgatatccttttattagtgtgtacatactatgcatgtcctttctgagtttgagttacctcactcaggatggaatttcctagttcaatccattttcctccaaacctcttgatgtcattgttcttaatagatgaataatattccattgtgtaaatgaaccatatttcagtatcgattcttccattgtggggcatatgggttgtttccagctcctggctatcacaaataaggccactctgaacatagtggaacacaagcccctgtgtcatggtggggcatcttttgtgtatatgcccaagagtgtagctgggttttaaggtatatctatttccaattttcttaggaatctccagattgatttccagaatggttgaccagtttgcaattccacaagcaatggaggagtggtcctctttctccacatcctggccagcaagtgctgtcacctgagtttttgatcttagccattctgattggtggaaggtggaatctcagtgttgctttgatttatatttttcggatcactaaagactttgaacatttcttttgaagtttctcagccttccacagttgcttcattgtgaattctctgtttaggtattgtactggctagttttgtgtcaacttgacacaacttgagttatcacagagaaaggagcttcagttgaggaaatttctccatgagatccaactgtaaggcattttctcaattagtgatcaagggggaaaggcccttgtggttgggaccatctcagggctggtagtcttggttctataagaaagcaggctgagcaagccaggggaggcaagccagtacagaacatccctccatggcctctgcatcagctcctgctccctgacctgcttgagttccagtcctgacttcctttggtgatgaacagcagtatggaagtgtaagccaaataaaccctttcctccccaacttgcttcttggtcatgatgtttgtgcaggaatagaaaccctgactaagacaaattggtaccagcagagtggggtattcctgtgacaacctgaccatgttttggggaggactgtggaaggactttggaactttgggcttgaagatccatccgttgttaagagctctgtcggatgttgtgtaggagcttggaagatactgttgagaacactgcagaagatggaggtctggtttgtgaaatttcagagggaaaattaaagactcttttcagggccattgctgttttgaatgtgaagattctgtagttctggttagctggggctgaagaatcagttgtgattaacaagataccagaactactaaagcaaaaactttgcatactgggactattgatgctggttagctggagctaagaaattagtggtgattaagaagagaccagcatcattgaggtgacatcttctgggaagtgttttctgaaagcacaaagaggctgtgttccagagatggccaaggttgtactcctgctgcagcaggacttggtaatatgtaagggtcacccaggtggtactggttttgaaggcatgaaggggtcacgcaaagcagctgaggctcggcactgtgagaggccatggaaggccattggtgaaggtgcagcctcagttgcaattgaaggcccaggattgaaggggtcatgcagtgttttggagatgccagtaccatgagatgaccaccaagagcagcagcagcagtggagtacaggcatctggagcctagaggatgacgtgtgtgctacaaagggcctggctggagaagtgacccaagcccttggaggagcccagaagatcgtgagttggatcccagacattggacggttggagattgacttttgcttttgattgtgactgtgtcctgatattttccctcttgaagaaagaaactgttttagtggagcccacagttaagagacttttaattgtaaaaagactttggattttaaaagagatggatattttaaagagattgaaaatttaagaatatgtaaagactgtgggacttttaaagttatttagaatggggatgaataagattgtaagggttgaggcttagtagtgatgtttttgtgtgtcaagttgacaaggggtcaattgtactggctagttttgtgtcaacttgacacagctggagttatcacagagaaaggagcttcagttgaggaaatgcctccatgagatccaactgtaaggcattttctcaattagtgatcaagggggaaaggcccttgtgggtgggaccatctcagggctggtagtcttggttctataagaaagcgggctgagcaagccaggggaggcaagctagtacagaacatccctccatggcctctgcatcagctcctgctccctgacctgcttgagttccagtcctgacttccttggtgatgaacagcagtatggaagtgtaagccaaataaaccctttcctccccaacttgcttcttggtcatgatgtttgtgcaggaatagaaaccctgactaagacaggtatctaccccattttttgattgggttgtttggtttcttggtgtttaggttcttgagtcctgtacatattttggatattagccttctatcaagtgtggggatacagaagatttttttccccaatttgtaggttgccactttgtcctatttactatgtcctttgccttacaaaactatctagtttcatgaggtcccatttttccattcctgatcatagagcctgaggcattagaattctttctaggaaattttttcactgtgacattaagtttgggactctttttctactttatcttctattttattgattctatcttgttttatgttaaggtccttgatccacctggacttgtgctttgtgcacgtttatacaaatgtatctattttcagttttccacatacagactgccagttagaccaacatcaggtattgaagattttgtcttttatccattatatatttttggcttctttgtcaaagatcaattgtctgtaagtttgtggtttaattactaggccttcaattgtattccattgatcaatctgtctgtctctgtatcagtacatgcagtttttatcactattgctctgaagtaacctgtaacgtttacaaaaagaaatgaagtccactgttttttaaacatagcagctcctatgtagtttgcttgggtgtgctttctggttgctaaatctagatatagaggctagttttaagtgagaaattacctttctgttttttcagttccttcacagactaagtttggctgtcctggaaatatctctctggatagatcttgtacacttaggtgtgtcttgctctgtctcctgaatcctggtgttaaagatgtgtcccatgatacctggatctaacattttcctcattagaatttgatctgttccaggcttttcttggactttgaaaactgccttcattttcaaactcaaaccagaatcttaagtgggtcaaattttgtctgagatcatcactctctcacttcctggtactcctttattcctcacaccatgagccttgtttttaaaccatgcctttccctttactgactcattagtgtagctacctctgtaattttaggtacttcgagccccttatacaaatcatattgcatgtttatattttggatagttgagaaatgttgggcagtgagtgcagggaatttaaagggaatcccatgtcccaccagagctccagtgctctgggcaagtggacagcactctctatgaggcccaggtgggtgtctggccgtgggaagctatggatttccagtcattaggggtagagagggagcagtttgtggtctctgggcctcacagaggccacagacaacaggtcctctgtcatggacatcccagatgtcactctatgttgtgaaagagctgagaacaaagtgagggccctgggggtaactgggtcatcccaagggctgaagggagaagggagcaggggtataaggcactcaagtgtttcccaggatgtgagagtctttagtctggtctggtgactggaaacactgagaggctttgctgctggaggtgatacgtggctctttagagtcagccctattccaatcattgaagaacagctggtcttaatgagtggagagatggtccctggttttaaggtgtttattgtaaaaagaggaagaggaaggagtagggaagtagaagccagccatgaccatgtggagagagggaggagaggatagggaggaggagagctagagatgagaataagagatttaagagcttaagagagagaggaggggccaaacagccccttttatactgggctgggttacctatctagttgttgcaacataactgtggggaggagcataccttgctattgtcaggtaactatgagggtggagtttagccagaatgccagggacttgggacattgtcaatatgacagatagtcacaggattattgagttgtggggctccgtgttgtcagacacctgtgtctgggaacatagctcactgttctatcccttgtagagttttctactgggtctccaaagtaagctttgctcaattagaacacaggctgcctttcacagtcccacagagaaaagctctaaagaatagcttttattttaaattatataatcttcaactcatgttttcatagttctttcccaaggccatagcattaccattttcctgagaaataacagacacattgttgcttcatggaatcttactgtttctggttatgtagacataaaccttggctgggagaacattccctaagaacataggcagggaggacaagccttatgcctacaggagccatctgaacctgagaaatcacacatactgttgaacctactccattcgatttctatgacagaccttgcagacagacttttatttatttttttaaacttttatttaactataggtgtgttcttctgtatatttttctatgtcctgcatgcctatatgagaccagtggagcccagaagtcatcacaaaatgcatcacacaggagtcagacaaaaatcataccttgttttgtgtgtagaaagaattagtctgtgtttcttttcatgaacagcaagtgccctttacctctgagtcatctctccagcccagaggtttacatttctgctacagtttttttttaaatttatttattcattatatgttcgtacactttagctgtcttcagacactccagaagagggagtcagatctcgttacggatggttgtgagccaccatgtggttgctgggatttgaactctagacctttggaagagcagtcgggtgctcttacacactgagccatctcaccagcccctctgctacagttttatgatagaacctgaatataaccctgagttctattttttgttaaaaaatgaaggaagaatcagaaatgatagtaatctgtgccacccataatcatgttagatgaatgagctcaaataataaagataagaatagtgatcaagtcaaagaatcataaatggttctgatccttgcagtctataatcatgttagatgagtgagcttaaataataaatcaaagaatatttctggagtcaaaagactcagactttaagttggacagtcatagatttatgaacaataatgtatccataattaatgacaaattagtataattcttatacaacttaaaacgttcctttccattataaaaaaacactctacattatcattgtgttgtcacataacccatttatttacaaatatacttctaactattctgaaggtaaacctgtgtggaatttatgaaattattatctgttttgattttgtcatgtattagaaaatggcacatgatattaatgctatgaaatgttttttttttttctgagacagggttttctgtgtagccctggctgtcctgtaactcactctgtagaacaggctggcctccaactcagaaatccgcatgcctctgcctcctgagtgttgggattaaaggtgcgagccaccacaaccggcttaatttttctatttattttactaaatatcctcaaattaattgttcaatacatatttcaattcttcatgaaaatatgcttatggaattggatcacaaggtattttattctatgtcttgcttctaatggtggttttatactctgattttacagtttttatctgcttagatacaaagaaaattatttcttttaagtaatccttgaatttttactccctactctatttcattggtctagaaaggatacagcattgtatataggccttaggatctcaactgagcattttagactagagtctagctgttgacacccaactgcatacaggatagatacagggtccacatttgatcaaagctgacagttgtagatttttttagtcaccatcatttataatctgagatgtgatactgtgatcaatattgttattaaaaactgttcttaaagatatctataaagtgttcttaaagatattcctgcatccagacctcacatgtatactttattatgtctcagtatttgctgactgtgaggccattatgtcacctaccccttcctaaaacaagaagacacaatatacactatgatgattttagatgatatcatttcttaaaatggcctcataattcttatgacctaacgtatattctgttcttgattagcttccagaatatgacatgattttttttcctctgaaagggaaccttaaatccaatcataatatgtttttctatattttcgtctgatgctttcctaaagcaccatgatcaaggaaagtaatagaagaaaaagaccactttgggtaatgcttccagaggataactatccaccatggtaaggaggcctgacagcaaataaccatgtttttgaaatagatagctgagagatcacatcctcacctccagtcactaaggaggaaaagagaactaaggtggctttggtctactgtttttctcagagcctactaccagtttcattctttattcagtaaggttccacagctaaatgttttaaaacattgtgaccaactggggttccaacttcaaaagtgagacatattcattcagaactatatcggcagtcttctaacattctttcacattttagccagttttgatatcaacatagtaaatataactttaatttctcgtttgggtttcctgtttggtttggttttttgtttgtttgtttgtttgtgagacagaatctcactctgcagacttaactctcatgtatcctgatatagatacaggaatggcttctagttcacataaatttacctgcctgagcacccacagtgctaagatgaaagaccttcccccactgtattatgcttgaatcaaacatttatcttttaatatttctgctaacatgcaacaagaattttgttcatttgtgtcatctaggacttacttgattgagctagctccttcagcttccattggaacattgatatttgtgttctgcatgctctatctttttgaattggccctccattgagttaccatccggcttagagttcatttctcatttcattcagattgaggattccttagatgtttatatgtctggatgcaatgtcaacatcctgcattatcaaaattatttccttagccacttgcaggggttctcttgtatttcattcagttagttcctgtcctctttgagttcctgtgcttgtttcctctttatgtccgttgacctcattgaatggtgttcaaattgtactttttgttctgtctcttgagtttgtttcatcattcttcttgtcatgagcaatggtattgcatttgtgatttggggtaggtaaattctatcaccattgtcaaattgttttagttccagcctctcagtttccttttgctgtgtggcattaggtcagttggcagggatatccatatgagatgttatgtttaatcattgaaaatctgagatggtggacaggaacttggttacagcttcttactaagtccagttctgttctatgcaggtagcaaacatgcattgttgtagagcaggccttgaacatcctggcagctatttggaagactgcttgagcctgagtgggaagaatagttctgggtgtgctgtgtaaaattggtttgttgaatttcctagtctgcgtagagttagagatgaaacataacctcaagcacagacattttgggttgtgcttgtagagtctctttgccctcaaagtcttgagggacttaaaaaagaatctctcctgaggaacgtcgaggatcctcaagctctgcctctgtctccagagtgtagcgaatcaaatcctgagtctctatgcccagttttgtattcattaccaggattccttatcaaactttgttcatatgtgcatgctgtgtatgaattaattttgtgttagatggcgtacagtgaaattctgaaaatataaaaaacacttcatgggaaagcgtgagccagaaggacactgggcaactctgttctttgcagaggaaaatcaactaaatgtgggcaaaaagatcctaagaagctgagaggcaaaatgtcctcatatgcattctttttgcaaaccttttgggtgtagcacaagaagaagcacctggatgcttcttcaacttttcagagttctctaagaagtgctcagagaggtgggagaccatgactgctaaagaaaaggggaaatttgaagatatggggaaggctgacaaggctcgctatgaaagagaaatgaaaacctacatctcccccaaggggagaccaaaaagaagttcaaggaccccaaagcacccaacaggcctccttcagccttcttcttgttccattctgagtactgcctcaaaatcaaaggtgagtatcctggcttatccatttgtgatgttgcaaagagactaagagagatgtggaacaacacttcagtgtgtgacaagcagccgtacaagaagaaggctgccaaactgaaggagaagtgtgagaaggatattgctgcctacagagctaaaggaaaacctgatgcagtgaaaatgggggtggtcaaggctgaaaagagcaagaaaaagaaggaagaggaagatgaggaggatgaagaggaagatgaggtggaggaggaggaagaggaagaagagttagatgaagaagaagatgatgatgaataagttggttttagcagttttattttcttgtctataaagcatttaaccccctgtatacaactcactccttttaaggaaaaaaattgaaatgtaaggctgtgtaagatttgtttttaaacggtacagtgtctttttttgtatagttaacacactaccgaatgtgtctttagatagccctgtcctggtggtattttcaatagccactaaccttgcctggtacagtctgggggttgtaaattgacatggaaatttaaagcattttatggttggtgcacagcacgtattagttatatatgggttcagtagtttgggttttttttcttttggttttatttttgtgtttaattttttttttatcttcagttgtgtctgatgcagtttatacaaagataactgttgttctgttaactgattaccactctgtaattaaaaaaccttgcggctgttttgttgacattctgaatgcttttaagtaaatacatttttttttattagtattgttgtccttttcataggtctgatagttttcttcccgaggggcagctagtcttttgcttttgcccattttgggtcacatggattattacagtgtgtatcttttcatctagttagctggaagaaagctttgatccacagaccctgctattgtggtaggggtaacattttcatccatagttgaagaatctcctaaatcatcaccagttggataagagatattatataacctacttggcaaagcaaggagtggtcaattctgtcacaccgtgggattattagaatcaagcaatctgaaagtttgtccttgaacactaatagaaaagtatgttctaatccttacaggagcactctcctttaactgccattactgtgtatattttgcagtttcccctactaaagaagacctgagaatttatcctcaacagtacaagcttaaaatacaagactgtcgtactatttgttgaccttagtcccagcgaaggctatcacaagaatgctggctgtaatgcctttgcccatctatctaaatacagattgctcaggaaacttgactgtttaaaggtgtttttaattagttgagtcagcttttaaaattatgccacatttaatatgaagggtacattttcctatattgtggtttgtccctttataaatcagatataagggaagaggataaactttgcataatagtagcagtggcccaatccaattgctttttctttataaaatccaaactcattaattaatcatgtttaatctgcaacattttggcagtttgtgggttgttttttgagattatcattctcttaaagtgccagtgttttaaaatagcgttcttgtaattttatgtgcttttgtgatggagtgcttttatataattctgacttgggttgtttacatttgcatttgttaatgtaatttgaggaggaatactgaacatgagtcctggatgatactaataaactaataattacagaggtttaaaaaaaggaacatttcaaggaagctatggtgtttttcttaatgtgtatccttttagaagttgttagactcctttcattgttgttccatgattaattcagaaactgagcagggtaaaatattatcaccattaacttaaagattctctatgcctctgagatttgagtgatctctgattagaagtgggtctcatgatatccaacctaaaatgctacctaaatatcagtcttaattgtatcactcttaggaaagtgtttctagtattctcaatcttttctttttatctactgagaacagtactatgttagaaattcaggtcctttctgaagattgtcaatcatatgtgtgtgtgtgtgtgtgtgtgtgtgtgtgtgtgtgtgtgtatacatatatatatatatatttacagtgattcaggattttaaatcataaattcttcaatgtcaaagaatttgacaagaacaaagattctgcttgtttattaatgcaatcataccatcattgaaaaggttaaatgaaatatcttccttttctattgtatctgttttctttgtgtttttcaaatgtttgtagctagttgttttctttcatgtttttttgttgttttcttgttcttttatgaatatgagtgttagtctgcattcctgtctgtgaatcacacatgtgcagggtatgcagagtatggaagaaggcattgaatactctggcatgagagctgccatttgtgtgttgttatgagactccagtcacctggaagaaaacacagtgctcctaaacagtaatccttactccatcccctgtaggtagattagaaatatattaagttcaattgagaagactgtgaacctttgtcttgttatgctatctgtttgtttttggacattttcttcttcctgaactgaaaaccaggattcacaaatagtgcagttcattacatacatatatgtttcattgaatctgatttgtagtagggattttatagtgaagtttttagaggatgctgaatgaagtaatgatatttctgagattttattccttgggatttgtaatctataagatgtttcttgcattgtgggttttatattatatttcacattgttctctctattctttatatatatagctttcctgtgttgtacttgagttctattacattcatttattccacataagaattttcttatttcctgtgcgctcatagaaaatttatatctacttcttttgtgcatattttcatatatttattatctaagttggttcttcactttaaaacttgtcttaatttactacattcacgtgttccttaaacacagtcaatatgagtagccactttttcagaaagtaacactagagtttgcaggcattttcattcagggcttgaaaaatgtcattccctactctactgattttaatcaatgaataagcatttattagtactgtatggcatcacaatgtagcccattttggtgataaggaataggacaagacaactggaataagatgcacattgtttcagcacttagatgtgacactatctgggtacatctgggagttgcagaaccaaatttatagagacattcctcaggaacactagatgagtgttgggaacaaaataaaaaggggggggccctgcggaagaatggaaggaaaaagatgcccacaccccaccagagtttccctattctctggtcagtcaggtgtaggaggactgctatctaccctattcactcatccctgggtgggtattcctctctcccactcttcagggggtggtcaaggggaaggcctacctggggacgcccccccccccagctactttgctaaagccagcagggttgtgggagagagggaaaagggaagaatttctcaacactgtccacagtgcccagcggaactttaaggagcagagactctatggtttaagagctttattagagaaatgcagggggaaagagagaagggagagggagagagagagaattggaggggagggaggagaaggatagtagaggagaggagagagcaaagatagagagagaagacaaagagaaagggaaaagaagagagaagtgagaggttagaggacaaaggagtgagagagagcaaggtgggggctgagcatacctttttatggtcttcactgttgctaggtaactggggaggagtttagcctgaaggtcagaagcttgggccattgcttacttgactactgaccatgcttctcttgtgggggctgtgggaggttgtgccttatgcaggggcctgagttccaggagcatgagggaacgcctactgtgtcatgtaggtgaattatgaccaccggggttcagacctcagctcaactggagaccagcctgcaattccccacagatgagaaggttatggccttgtctgaccaatacatatagctatttgacctttgtctactttaaaaatatttgatatagcaagtgatagtaagccaggcggtggtggtgcatgcctttaatcccagcacttgggaggcagaggcaggcggatttctgagttcaaggccagccaggtctacagagtgaattccaggatagccagggctatacagagaaaccttgtctccaaaacaacaacaacaaaaacaaaaagcaagtgatagtaaattaactggaaggctaaaaagtgcagacttatgcctattcagaaaaaggtgtgtattggaggaaatgtcagtttcaagttttaaagtagaagctgtattttttctggtgacttcatggaggaagcatgtaaaaccatgggtgcactggtagacatacactgtcagacagacagtttggtatttcagaacacaggataagcatgtagggagagcgatcgactccttacgtctagcagacaagagaggtcttttattagtttttatgttacagcagcatatccaagacctttttagacactaaggggtcttctgatatctcagattattctttaggaatgtataaaaccaagtgatattttcttgtattttcagtagcttattaagtgtattatcagattggagtgttctctttaaatatttgtatttcttgagttgaagaattatgttccttgtaatttgagaaaatgtaccttctctgtatccttatttgacacattgaaaatattccaggtcttaatttgctctttgtaagcactactgtactgtgaaaaggtattgtggtggctttgcacatccttgtctctctctagaaaaaaggagtagaatgatgacagctgtctttatcttttgtagtgagaggtgtaggatgttggctattatcttccttagactgaggaatattccttttgttctcaaaatacccagagctttcacagtgatcccctgtgatatttttccctaggctttttgtaactatatcatggttatgagccctctctcactgtacatacattgtgctgtgacttgttttgtttgtgcctgttgaaatagtctttcatctctggcatgaaattaagtagagtttcctttctgcatccacagaaaaagtctttgtttaatgtactttggtgcactttgttacttttttcactgtacatattttatggtcatttttttgggaatacaaataaagtcatttttttgtgaggagtctacaacatacccctttttctgttttctgcaatatactttatgcaatattattttggtgttttctaaagcaacttgcgaattcagtggtacatctatttagttcttatgcagtctttgaagaaacacttgggacccgagtaggctttttcttattacatagcctagtgttatgacctagaaagtttacttgtttctaagaaatcattattttcctcatcaattctcattaattggcctccactagccctttgtctttgactctagtccagaaatattagttttcagtaataaccctgagtatcagtactttacaacaggtatccatgtgctctgtgtttgtgcctgatgactcctgaaattagaaatcatcctcagattgtactcatactctttatcagtcaaaatgtatcatgtcggtagaaacattggcaagagccctggtattactttgctttatttgttttttaatgtggtttagcattgtctctaatggcatttcatttatttcattgttcaatccttgatgtgaaatttaagaagaacttgaatgtttgctcctcaccaagaatctgggagaagaacaactaaaagaatgagtgcttctctggaaaacactgcacaggtcagtatcctgtcttcatttcttttttaaatcccttttatattcaaaacattcaaaagttctatcatatgtatgtgtaatattacctaggaggattattttctatgctcttcattttcctttgtgatgatgaaaatataacaatttggtttctcatgtatacaatagctttatattttatttattttatatttatggtatgtatactatgaagacatgtaattcccatagaactgtaggtgtcaaagagcatctattggaagtgatgcctcaaaaatatattgatgactatttcctatgtttgataaggttatatatatccttttatattagtatggaggaagtaaggtttcttgtcacacataaattgcacttcagggatattcaggtttccagacacaaggctatgaatgtggatatggaaatatatagaaactcatatcagtaagcaacacatatcagagtagaatttgtaatagagtaaaattatatgaggcccactgtcttgaatcctaataataagtgtatcagctccctagaagcacagatgatggaagggaattgtctctcattttgtctttgatgtgattattagctgatgcagatttcagtattctgacaattctttttaacattttaagtcacacagtactcattgaagtgttgacacctgcaatatgacttgagagatactattcccgagatacatactcaatgtagacatgcttattttcctttcatttttgtttcagtctttagaagtagtgtaggccctgtggttttcacctttgtattttatcacatgaaatatatttgtaacatttatctaaagaggatagccttggtactgtgcataatccatcaattttcaagcataaattaatatccttcctattttctgtctccttttttttagaaggaagacagtttgatatagcctatgttattcctcttcagccaagcaatgcattacatagggaaagctgaagggttgtggcaatgtttctatttttttattgcaatactattttctttaggtatatatgtgctcatctgaatgtttttatgtgtatagaattacacattatgcccctaaaacattgagttcagcgccaaaccttggagactgaagtcaggcacaatagtgagctgcaatatactttgagagaattaaattcggtttctatgcagaaacagcaagcacctttacatgttagtaatttttttttcatgccccaggtttacaattttaggctcatttgtaaaatagacagtatataacctgtgtattttagtttttgataaacaaaggaagaaatagaaatcatgcttttctatgcaagctacaactctgatacacaaatggttaaattctgatgaaaagaaagttaagattagaagattaaaaatttcaattaagatgataccatgaggaataaattattaaatattcatggagagttagaataattcttcatcaatttgaaaacacagtttgagcaaagaaaatgattgtagttcattggaatgcattgccacctatgacatttgcttacacacccataactaatcattcttcagtgaaaggccatatggcagttatgaaattgttatgttgtgtattgctcatgccaacttacataaaatgttcaggaattttaatgctcacaaatactggttttcttactttatggttttggaaatgttttcctaaaatatcttcccaaagcattggttctgtgttatacagaacgttcaatgctctgatgttgcagttttatgttttttaacaccaaaactctgacattcaatccatccattaattctgcatttcatattctacctgtttgctctagagaggatgtagcattttgcataggcatcagattgtcaaataaatatattataataccgtcatggaagacacagctgcacacaggactcagctcgtgtccatatttgagaaagatggacactgtaaaattttaaagcatattttttctcattataattgatgatttatgattcttttttatatcagtccatatttcataaatattcattattgcatcttgacatcaaatgtacatcttatatgtgtttactgtttttgagatggttatatcatgcattctcagagaaatagaaatctaaacaagtctgagtattttagagtgtatctgttaataaagttaaactttatttttcttcagtatatgttggttacatgtgcctgaatgtatgcatttgtggtatgtatttctcctgcctgtagtgttaagtagagatcattggattttaaagaactggatttaacaatccattgtgtagtgccatgttggtgctgggaaacaaattccataatagaggccttgaaaagatattatacaatccaaactgcacacaaaacttttgtaaatggtgatggtggcaaatcttttttttttaaagatttacttactcattttatgtatttgagtacactgtagctgtacaggtggttgttaaccatcatgtggttgctgggaattaaaatcaggacctctgcttgctccagctctgctccctctggcccaagaatttctttattcttatacataagtacactgtagctgtcttcagacaccagaagagggtgtcagatatcattacagatggttgttagccaccatgtggttgctggtatttacactcaggaccttctgaagagctcttaactgttgagccatcactttagcccaatggtggcaaatctttcatttgctgcttaaggtctcagtaaatcaaagaaaattggttaagacaagagcctttctgaatgtaagcattatagtaaatcattgtataggttgtctatggaagagcagcaattcatgtcttgaaacacaactccataaactttaagaaaatatcattcaatattcttgcctcatttatatcacgaggtgtatcttaattagttctctttaacataataaatcatttttgtctagtaacacctaggtagtttttcattacagtgtctattaaccttcaaggacgtgtttttggacttctcatcggaggaatgggaatgtctcaattttgctcagaggacattgtacatggatgtgatgttggagaattacaacaatctgttgtttgtgggtaagaatgtactttttgttgaattacggatactttttttaaattttcctaatttgtataaactctctgaaatacttagagacctcaaatgagggaaataatgcttaaattcataacttttcctttacatttctctgattactttggaaagataaccagtgctatattctctgagatctctctttcctacttatctagcttcagtcaagacttttaatttcaaaaaaatttaaacattcagaataaggaattttatttctgtacatataataattggagtatttcttcttaccattgctttaaaagtctcttatttatgattttagaaagtggacaagggctggtgagatggctcagtgggtaagagcacccgactgttcttccgaaggtccagagttcaaatcccagcaaccacatggtggctcacagccatctgtaacaagatctgacgccctcttctggagtgtctgaagacagctacagtgtacttacatataataaataaaaataaatcttaaaaaaaaaaaaaaaaaaaaaaaaagaaagtggacaagattcaagtggacacagtgccgttggtttggagggttttttattaagtgtttgacatttggtctctgtttttttctggggcaacctgatctttatcctatattttggatgttgaaacaaaactatttaatgatttctcatgacagtttcagttacatcataaatttatacctgaccaaagctatacaatgtcactctaaatccaattgtaattttaaaattagagctatattgttcagagatctactttctgacatttcactacagatcaatcacttagaagttctagattctacaaagtagaatattcttttttttcttttctaaattggttattttaattattatatttcaaataatatagaactttccagttccccctccacaaaccccttattctattccccctaccccatgcttctatgagggtacttccccacccacccacatctgcttcactgctctaggtttcttctctgctggggcattgaggcttcataggtctaagtgcctctcttccaattgatgaaagttaagacagtgctcttttacctaaacagctggagtcattggtccctccatgtgtgtactctggttggtggtttagtccttgggagctctggggtatctggtttgttgatgtttttctttttatgaggttgtaaacacctttagctccttcagtccttcccataactttactttggggtctctgtgcatagtcagatcgttgcctgcaagcatctgcatctgtattggtcaggctctgcagaaactctcaggagaaactatatcaggttcctgaaaacaagcactttatggcatcagcaataatatcagtgtttggtgtgtgcagatggaatggatgcccaggtttggcagtctctggatggactttccttcagtttctgctccactctttgtccctgtagataaagggacactctttatttcctttagataggagcaattctgggttaaccttttttatatgggttggtggtacaatcttagaaggctattatcacttttgccatttgatatagatcagatttgaggtacttctgaggatccatgcaatgattaaaaaaaggaaaaacctctcttgagagtatgaatacatagaacagtgattattggatcatacttactcctcatataagtaatccctgttatccctaattccccctttttttcagaaaatcactgcatatgtggaaactatgagaaggagaaggtcgtggaacaagacacacagcacattttcaatgagcatgggcatatccaagagaagtcttttaaatgtaatgagtctagcaatataattcatgaatcctccgaaagtacacctcataaaactaaccacagagatgccactctccaatcctcaaacctaaaaagacataaaactgggaccactaaacaagtttgcacatataaagactgtgtaaactgtttaaaggggtcttctatcattagtctcaatcaaggaacccacgtagagaagaaagaacacaacagaaataaaaatcttgatgaggttttggtttctaaacataaacccattgtgagacaaaacaatagtgagatgaacacttacacttgtggtgaatttgacaaatgctttactcagagtgacaatcttcaaagtcagcagagaatttatccaggaaagaaatcttacaaatatagtgaaagtgacaaatgctttacccaaccttcccatcttagtattcatcatacaattcattcaggagagaaaccttacaaatgtagtgaatgcgacaaatgctttactgacaaatgcactctgagaaagcatcagagaattcatacaggagagaaaccttacaaatgtaatgaatgtgacaaatgctttactgacaaaggcagtctgagagttcatcagagaattcatacaggagagaaaccttacaaatgcagtgagtgtgacaaatgctttacccaaacatcccatcttagtattcatcgtagaattcattcaggagagaaaccttacaaatgtagtgaatgcgacaaatgctttactgacaaaggcagtctgagagttcatcagagaattcatacaggagagaaaccgtaccaatgcagtgagtgtgacaaatgctttactgacaaaagcagtcttagagttcatcatagaattcatgcaggagagaaaccttacaaatgtagtgaatgcgacaaatgctttactgacaaaggctatctgagagttcatcatagaattcatgcaggagagaaatcttacaaatgtagtgaatgtgacaaatgctttactcacaaaggctctctgagagttcatcatagaattcatgcaggagagaaaccttataaatgcagtgaatgtgacaaatgctttacccgaaaatcacatcttagtattcatcagagaattcatacaggagagaaactgtacaaatgcagtgaatgtgacaaatgctttacccaacaatgccatcttagtattcatcagaaaattcattcaggagagaaccttacaaatgcaatgaatgtgacaaatgctttactgacaaacacagtctgagaaggcatcagataattcatacaggagagaaaccttacaaatgtaatgaatgtgacaaatcctttactgaaaatggctgtctgagaattcatcagagaattcatacaggagagaaaccttacaaatgtagtgaatgtgacaaatgctttactaaaaaatccagtttgaggattcatcagagatttcatacaggagagaaaccttacaaatgtagtgaatgtgacaaatgttttattcaaaaatgcagtctgataattcatcagagaattcatacaggagagaaaccttacaaatgtagtgaatgtgacaaagctttactgagaaagtcagatggcatcagagaactcatacaggggagaattcttacagatgtattgaatgtgacaaatgttttgcccagaaatcctatcttgtttttaatcacagaaatcatacattaaagaagccttacaaatgtagtcaatgtgacaaatgattttcccacaaacttagtctgagaatgcatcagagaattcatacagtagagaaaatttacaaaaatgcagtgaatgtgataaatgctttactaataaaggcagactgagaattaatcagataatttatacatttaaaaaaaaaccttacaagtattttgtatgtgataaatgcagtacccacaacatcagtctgacaaatcaacaaatatttcaaacagtagagcaacattataaatgaaatgaatgagataatcctttaacaagaaatatcatcttaaaattcactggagaattcttccaaaagggaaacttttcaaatacattgatggtttgaatcctttattttggcctatctcttagaatgtaacagataatttatacaggcaagaatcttaacaaatataatatatgctgaaatatctttgacttcatttcagtgcagaaaaaatatgtaaaatatttttttatgggaaaaaaagttctcctggggaaatgtggcatatgttttacacgggtaatattcttttcaacagttagtgctctaaactagagaattatgaatctgaaaacttttgaaaaccttcatgcaatgttcaaatcttagataatgtcaactattatgctggcagtaactctgaatatatgataatgaagaaacattttcattaaacttttacttgttcaccctcaaatattatatgatgaagtcaggtgtgaaagccagaagaatatgatgttgtgcaacaattcatggagatagaaatgatccattccaaaaggaaactaaataaagagtgtactatcgccttcaaaatgtctaataaaactggcagcattttgtatatttaattcaaatgaagaaattgacacagattgtacttgatagtgtatttgacaaactgagccaccaagactgcatgttcttaatcctataatatgcctacagatgtgaagtgtgctttgagtatccagtattcattattcttatcacgtcaatgtgacaaatgatttattggtttcacgtttcaggatagtgactgactatgagtcccttatgctctgtcaacatctccttcctcattgccctgtaaataaagctgaatattttaacaaggttgacttggctgttttcagtttgcacttataattagatgaataaatgttgcatcatcgctggaactatttctcataaagtatttgctgaagtcatgaatattttctgtaaacctgtaacttaaacttaatatttgtgattgtcagctggtcaataacaaccttgacccacatacgaataatatgaattgtatataagtgtttagcattagaaaatttagcaacagtgtattagagatgatgatttgtgttaactaaaacagggatgattctatgcaatattccaggcttactgctcaattagtactagtttattaaaacaaacacacaatcaaacaaagacaacaacaaaaaacaaaaccaaacaacaacaaaacaggaaacagaaaacatgtaaaggcatttagaacctcaacagtaagtctggtctctctctctctctctctctctctctctctctctctctctctctctctctctctctctcttttgactcaagggaatatgagataaaatactaccaaaaataaatgaaaatatagcttcatagttttcagggatatccatcctaactgtgctatgtccctgcacaactccaaagctctctccagggacaggtataacaagtccttatggtgtcctgtcctattgttcctcatacttcactctgaaccttcatactccactctacctcaaggactgactaagatttccattcttgtcctaaatcatttagggaatgctcacattttacacaccttagaatgtacattttggagaaaaatacaactcactattaaggtattaatctcctttttatttcatatctgagtttatccatacaaatagcatgaatctgtaaatcttaaaagaagtaccctttgtatggtagatgaggtaaaatctcatgcacagtttagaaatccaaacatccaggaaatacatatggaaatactgaaaaaagatgaaaaatatttatgccaagcaaaagcattttattagaatatttatagtaaattcaggaagactcagaaaattaggatctaagaaaatgttatatgttaaaatgaacaaatctatttacacattttccttgatataaaaaaaataaggacaaatttcaacttgtgagaaacttagtgataacattatgttattctcagtagtggaaattgttgaacaaatctattatcactatacatttttccttgatttaaaaaaataaggaaaattctcaacttttgagaaacttagtgataactaatatgttattcttagtattggaaattgttgacctcttccttagtaggatcaaactactaatagacactttagaggcccttgttttcaaatgatcattagtattttctatcaagtgctgcatcatggatgctgatgctcacacaccaggcaatttaaatttaggcttctgaaataacccttaacagtcaggaaattacaaccacctggacagtctctggatattccagtttcttatgttgcatgattctaggccccactgcctgatgacttagagatcattatcccaagtcttcagatatttccagtgtcagtgaaaagttccaaattgtgcacagcaaatacacaacttaccttttgcccctcacacaatatgattgtcttcattctataaacatttatacacctgcttcttgtctatggtacaacaagaatatggtgagggtgtacaacatagattcaggtagactcactgttagaattatgtggaaggtatcatgtgcagattgaaaaagatgaaagtcattggcttagggaaattaataatatcatgtttgaagaccaagaaaacaggctcaccaaatttggaaacattcactatttgtggatgaacattgtaagatacacaattagagccacactacagaagactaatgaacattcccagaagatcttccagtggctacaattttagtaacccagcaggactagggcagtaccttgcatggaaagaaaatatctctttagcagcaagacaactggtgggagaacatggggatgggaaacattaggagtaggtaggaagactcatttcttgattgaaactgcttttttagcaggaggattcctaagagaaactgagggcctgaaggaagtggagtgggatcagaatcccctccttgtcaggagtctgcaagctgcaaggtgtggaactaggagtagagcacgctgccatgggtctcacaacaatggaaaaattcccttcatctgcactgttgccagtttaggccttaggaatctttttcagtcactagagcagtggcaggaactgtaaccaagaagtcatggaaactcccaggtcaaaggaattgctaggctagtgggcagaaaggaattgtaccaagattgagacgactttctctgctgctcataagaactctgaccctcaaattctactgggcatttcttaactgtgttggtaaattactgactatgtatgtttgacttgtcctgatattttttattgtgaggatatttccagagtaatttctaagaggatgaacttgtcttttttttttttcattttttatcatggttatatttccctggttgttggaacaaagcttgtattattcacatctatccatggtttctaactcttctattttatcactttcctagtcaagattattggagattatggagattatgcatccccatgatgtctttaaatattattctcttaaagactgtttgaattttgattgaatctcaagcaatattttagcatttttttttaaattttacatgtctttaagttgtggttgtataaatatggcttaaacagcaaaacactcctggacttcagctcaatggttgactctacgtatctgcaacagtgtcaataagctcctgatagagtctgtcagaggacagtcatgtcaggctctttctgagcacaacatggcttcagtaatagtgtcaaggttttgttttgttttttttttttttttttttttttctgcccataggatggattgatcaaggcagtggatggcattttcttcagtctctgctccacttttgtcactacatatcattagatatgaacaattctgggtccaagttttgaagatggtcagatgcccccatgactcaaatgggggccatgcactctgctggagatattctatttaggttctgtctacccactcttggacatttcggctaaggtcattcccaatgaggtttgggagacttccacatccatcttgtctgggactttctagatatttgccctgctcttcattcccacacggttgtatgtttctattaatactcctggccctctggccttctctcctgtctccccatatacctgatcctgccaccgattgtccctgattctccctgttttatccacatccctcccttcttctgcctcctgggattattttgtttctcctactatgtgggttgaagtatccacaatttggcattccttctaattaaattttatgtgatctgtgagttgtgtataatggtattctgatctttttgcgaaataactacttatcaatgaggacataacatgtatgtcctttcgagcctgggttcctaactcaggatgacattttctagttctctccatttgcctgcaaatttcatgatgtcctcagttttaatagatgagcagtattccattgtgttattgaaccacattttttctacatccattccttggttgaagaacatctggattgtttccggcttctagctaatacaaatatggcagctatggacatagtggagcatgtgtccttatgttattgtgtatcttcttttgtgtatatgcccagtagtggaatatctgggtcttcatgtagaattatttccaattttctgaggtactgccagattgatttccagagtggttgtaccagtttgcaatcccaccagcaagaatggagtgtaactctttctccacacccttgtcaccatgtgttgtcacttgagttcttgatctttgcaattctaattggtgtatggtagaatctcggggtcatctgatcttactagaaaagcatatacgcaacaacactgcagcaatctagaagagacagatgatattctagatagatatattgtgtccagttaaatcaagatgaggtaaactatctaaacagtccagaaacccctaaggcattggactctgctgccctcagaactaggacacacctataaccatgacagtgaccccttctgtgaggtcagagaggccaagcctcactctgtttaggaaagctcaaagggtgtccaggcacacaggtgccttttggactggtatcaaattgattgaaattttggcctctaacctgtcccttcaccaccattaaacacagcttgtagtaggatttcccagaaagcagcatttcaggaagtttccctcccgggcctcatcgtgatagtcgatgacttctgagaatgtcactaaagaaacaactgatatgatcctacacacacacacacacacacacacacacacacacacacacacacacagattcattcacaaatacattaacagccataaatataaatatgttaagtagatgaagaagggatgtgatatcaatgtctgtggccatgcaggaaagggcctgtgagttgaaaataaagatttctaggaaggttcacatgtttaaaagaaaacacagagaaggtcctgggaaagcacttccttatgaacctgtgtaacatatgttccctgaaataatggcatagggggcaatgtaagtagttgatcacttatgagcgtgagttttgggtcttaaaagcaggtactgacttgacagtttcttccagaggcctcccttcctggcacatgtatggtgtcttctccctgagtctatatatagcataccattcggcaggcacccttgtatttactgctgttctggcttaacagaactcctgttgtgttaaacaaggaacacctcaagaacttcacagagcccttgtcactgccattcgggtccttgctcctgttctttcctgcatgcctttatacctgaaggcacatgtactcccatatatacactcccagaccatgcacactaacatacaatttaaatataattatgtatagtgtgcagggttatgtagagtgctgaaataatatgccctgtttgtgggacaatgggctatacacagacagtctggtctccagtcaagctgaggtctgaactctgggacccggtggtgataattcacctacatgagacggaaggagttctctcatgtctcctggaactctggctcctgtcaaagttaccgtcccctcagcccccacagaagcatggttagtagtcatataggcaatgtcccaagcttctgaccttcaggctagactcctccctagttacctagcaacagaaaagataacagcataccataaaaagggctgtttgacccctcctcactctctcacctctcttgatcttaatccccctactctcctccctcctttcctctctctctctcttactctctagactttcttctctatctccctttcccctttgtctcctcttggccatggccggtctctctctcttttaccttctatcctttctccctgcctttctataataaagctcttaaaccatagagtgtctctgctcatcaaggtccactgcacagactctcacctgtgtgggaatctctctccctcagccctcactcccataaccccagggctacagggtgtcactctgggaccccctgttgggggctgtcccttgtccaccccctattgagtggggtcagtggcttagattcccacctggggctgagtggaaagtgtctggcagccctcccatgtctgcctgcccagagcataggtggaactctggctgggtgtgggctatcttctctccctcctcttccccagcctcccttttagttcccacacctgttgaatacctgctttcagtcatgctggagacaacccctggacatacaagacaagattattactgtgaagaagcaaagtcccttcagaagcccagacagtaggactctgcaccatctcctacctgccctggacacaatgggctgccatagctgatagttgtccatggtttagggcacaacagcagagcttcatcctgcactagtctggaggctggagtcttttcatttggtacaagctgggtgtgaccattccctaggcttattctctggtgagttgtaggtgttgtctccctgagtacttgtttggcaagttctttagcatgtgcatatgcacacacacacacacacacacaccctgctgatacttactgcaacagtttctactgctttagcacaggccctgctaaaggtcacttcaaggaccacattaggcttcatatacttcctcactcctatctcccagtatagcacaatgaggtttagtcaggacttcatcacggggatctgtatatatttctcccaacatacagcccaacaaacctgcagtttcttccagatcccagtccatccctgagctccctcacaccaacacaacagcctttaaccatggcaacaggctatatgaggtaacagagactgaccacacctctctccagcttcttcccatgtgcctagatgtaacatgaggaacgaccgtgctttctctcttaacataaagtaccctgacttgtgtaactacaactggtgagttatagttgttgtctccctgagtacttgtttggcaagttctttagcatgtgcatatgcacacacacacacacacacacacacacacacctttctgatacttacagcaactgtttatacatacttgtagcaagatatgtggcatcattccatgtcctcctcatgcactttcacacatatggatgtggacctgcagacatgagcacaaacataagaacatatacaacacacctacaaaatgaaaacatgtatttgagtatagaatgagaagggaaggtgctgtcatggcatttcccatgatactggcatggctgtttgactcatattgtggtagctctctgagtacacatgcaaagattgctactgccagggactgaagtcaccagggaagatcagacaccagtgtcagggatgctctgcctccttccctggacaagctatgtgtgatggtcaaatgtgggcgtggcaaaagcactgttccctccttcctggcctaggctgggggctcaagtcctggtccatatatatatatatatatatgtgtgtgtgtgtgtgtgtgtgtatatatatatatattgtatcatgggggactttcttccttgcaaatatttccctaacccataggaagggtgccaccctatatcctgcatcaggatatgtcgagaagtaggtgaagattcattggtaagtctcaagcctaaatcttttaatagatctcttccccataaagaaatggggagctccagcacgtaaggctgaatttcccctgaatggccctcagcatctttccatttcagactccgtgcattcatatccggagcttttgcataccctaggcctcgaagcttctgattagaattttgcactggccatccctggggccaatccttctgtgctatgatgctgcgatcagctccagtatctaggagccctaggatggcttggccatccaccttcaactccagaactggacgctggtccatctggagagagagacatgtcaggtctacgcccgaggcaccaaaccctccttttcctctttgtttaccagcggaggggaagagcccatgaaggctaggtaaaagtacaatttgagctactcgatccccaggggagatggacacaatacctcgtggtgatgagaccataaccttaactaccccttgataatcagggtcaataactcctggatggacaatgagcccacgtaaagcagacaaggagtggccaaataacaatcctaccgtgtctttttgtagaggacctttaaaatctgtctcaatcacctgtgtgcccatctggggagttaatacgagtctggtggtggaatggaggtccaatcctgctgaaccttcagtggctctccgcggttgtggggatgtctcaatgttggccaggtctcctcttccccctggaaattgtccactgccccatatatttgcgggccctggaagcgagggccccgctgcccgttttttgaccacacactttcatttccaggagtaagaggctggccatggatgtttctgactgatctgcattcactagcccagtggttccctttcctacactttggacacaaagggactctagggggggcgagtcccgcttcccctagagccacttcctttttcaggacaattcttcctcaagtgtccctgcttgccacacctaaagcaagctctgagaggcacatccctctttctcttttgcaactgcatgacagctgcagcaagaccagcattggtcaatggcccatatatcagaacaaacaaaaccaaaactatcagacctacctacaaagggtcaatgggagaaaaaagcataactatatagcgaggatctattgatcactacactgaggttatcataattccttaatctatcccaaaaccgtgaaccttaacttgtcccaaagccgggaactttaacttgtcccaaagccgggaacctatcgttaccttgtgccggcttcctggcaactttatgcttgcctctattttatccgaggtccttcccaaactcctggggtcacaagtttcactcaccgtgaacttaccctgccggcaaccactgactgctgaaagttctgaactcggtgggggagtcggttccccctacaggccaccaattgtcgcttctgctctcgaccacaagaacgacaggaccaccagtcagtccttctaacagcagtttattcagtcctgtttcttcttgtttatatctcccccaaccctgggcctctcactcttttatactctcagttcccatccacacacagcaggccacgccacctcaccaggcatgcagcttcagctaatcagggcagcaaggggcatatctccatcaaaatggattcaccagtatcctggtacatctgcgcagctctcaagatgtttgtggcttatatgaggaagtcaggtgcaagtcatactacttagctgcagtccctgacgcctttgggactgccaccacacccgctcctcacagagggggactactggagagatggcacagcagttaagagcactgattgctcttccaaagatcctgagttcaattcccagcaactacatggtggctcacaaccatctgtagtggaatccaatgccctcttctggtgtgtctgaagacagctacagagtatccacatacattaaataaataagtaaataaataaataaacaaataaataaatctttcaaaagagagaaagagacagagacagaggaggtaggggacattgaaaaaacaagaccctgtaaactaacaatgtctgcacacatatgaactcacagaaactgaggcagcatgcacagggcctgcagaggtctgtaccagattgggtcctagagctgaaaagaaagtgaacacatgaccccattcctaagccactactagcaacctccagtggataaccactttaaaatgaaagtttgttttttttccccaagggaatctcaccggggaaacaaactactctttaagagtaatctgcatgcccaggagtaaatgaccaacagaaaaaaaattcaaaggcatctttggaggttccttgtctcataaagttgtattggagactttccatgtttcttctctaggtccttttatgcatatattatgacttccagtttagtgtttttatgggattcctgagtatgtgatgtgtgtatatctatttcttgtgctatgccttttcttggtctctttttttttttttttttttttggcttgtttgttttaccctattcttatccattagtcttgttttctcattaaaataatacaatacaatacaatacagtacagtacagtacagtacaatacaatgcagtacaatgcagtacaatgcagtacaatgttattaccctttagatgactgttatctgttaaaagacaaaaaggaatatggatgtgaagggagatggggagaaactgggaggagtagaggaaggagaaattataatcatgatatattatgtaagaaaaatgtatttttaataaaaggagaaaatgattagtatactgtctagtttttattgtcaagttgacataggctatggtcaacttggaagtatgaatataaattgagaatttgcctatacagattggcttgtggcatatgtggggcattgtctttattgctggttgacataggaggcccaggcccaccatttgaagtactatgacctgggttttataaaagggtagctcagcaggcctaggagcaatccagcaagcagcattcctcggtggcgtctgcttcaaactcctaccttaaggtctggccttggcttccctcagtgatagactggaatctgtcagatggagtaaaccctttcatctccaagatgcaacagaaactcgacgagagcctgtcgcctctctgtctgtctctctgtctctgtctgtctctgtctctctctctgtccctctctgtttctctctgtctctctgtctgtctgtctctctaaggctgtctgtctgtctgtctgtctctctctcatcaatccaaggaatcctagacatgacgattaatttcatataaactattataggaacaaccatttcttcatctgattattttttttctgggcaagaaactgctgctatatacaagacaccatgtttggcttaatttcaacactgcagctgaaaggcaatgcctgggccagaagacggggatttaagaaaggatttctgctttcttgattgctttcttccctcaaatgaacatatttgcaatctatgtatgagaacatgactcaaaagtagaataggacaggatcatgattgggacaactggagtggccaacccatcccttcctcattgccccacttcagttcctgccatgagtcttacacaaagaccctaggccagcagtttgctggtgccctgcttctcaggacctcttgcttcgttctctaaagctcacatctataaactgacaacaaactcctttttgaactcttcttcctgtgaacaagagctcctgaaaagactgacggagcctggatgtggtggcagacccttttaaactgagtattcgggaagcaaaggcaagaggatctctgagtttgatgccagctccatctatagaacccgttccaggaaagccagggttacacagagaattcctgtctcaaaaaaaacaacactcccagccccctccaaaaaaaggatgattgcttacagaaaggggttgacatatcagaactccaatactctggagagataggaatgctacaggactagaggactagaggctaactaatttgtctacctgggccaggtttgcacaaggcccagaccttcaggtacagaatttagtattaaatacatagtaacagaccaaacctcaagagagagcaggagagctgattctgccccttgccagctgcagcacggggtgagctggccagggcagtgctggagagctcaccctggtggtgtgggtgcaggagagctggcaggctgactaactcagctatcccctaggttcagatccagggctttgagttgggccactccaacatctacctcacctctgaactgctggagcttgtgaaagggctggtcctgtagatcaaagctgtagcttacacaatgagatgttttctgtgctgtatttattattattattattattttattttatttaagggaggaggttgcaagggtagaaagcagatatgaagagatgagatgagtggaattggggtacatgatgaaattcacaaagaatcaacaaaaagtttttaaaaacaataataatatatttggaaatgttaaatgtttcataaaccttaaaatgcttattgttttaaaataataacatttttaaaaactttaaaaaaaagaagtgggagaaaagaaaaaataacatttgttgggtcaagatttcattaagctataaaagttaatgtcatatacataaaattgatcaggatttccttccaaaacagaagctaaatatacatactatttcatctcatatatatatatatatatatatatatatatatatatatatatataataacataaaattcatattatttcttcaaaatactcttgtttattttttaagtctaagtttgtttaatgaatgctacaacgttgagccagaggattctccctcccatctgtctatgcttttgaccattatacgcagctatcttgcttgaggacattgtggcagttttgcataattcataaattgttttgatggttatcccagtggtgacttatcttatttcttttttttttaagatttacttatgtattatatgtaagtacactgtagctgtctttggacactccaaaagagggtatcagatctcattatggatggttgtgagccaccatgtggttgctgggatttgaactcaggatctttggaagagcagttagagcgcttaactgttgagccatctcaccagccacccttattgtttctttaacgttctaagtcactttcctacatataatataaaaagaataattgagtaggccacactattcttagtataaaactgttaagtgtatttatgtttgtatgtatgtgtttttgtttgcttgtttgtttgtttttgtactgggccatctataaattaatagatttacatgtttactgaagatctctattttgtttccttttcacaatgaggattataggaaatgtaatacaaacaaataataatgttgaaaattttttctttctttttttgtggttttgatttttttttttttttttgagatagtttctgggactctgccttctgggtgctgtaattagaaaccatgcaccatggctgaccacccagctattaaatgtctattatgtatgaatatatatatggttatatgttttattgttgttttcataatacatgtcgacataaaagccagagtactcgtcttaaagggaccatatcttaaagggagatgattaatatgagtttttatttttatttttttttgcaatttggtcaacaaatattgagtactgtgcccttgcctcgtagctctatgtcaaaatatggctctatgtcaaaatacatgataaacaaaacagcaatcggccttgggcaaggagtttctaaaacagctccgctgcatggttctattttgccggtttttttttttttaatccacctattgattttgaggattatattctagcctaaggaatcgatttagacccaaatagttggttctgatctaacgacagcaaagtctaggcgccactggggcactgttgtatctcctaacagctaatcccaaataaagactccaggtgtttgggtccaagctgactccctcccccctccctcccccccccaccccccaccccccatggtaaacttcctaaggttgactggggtccttggatggagaacctccaaacgaatggacagcatatccaccagagggtgctgtgaggacaggtctgtggtgggaggggagctcgcccagtgaccctcaaacccaggtaggctttattagttggtttttctttcttcttcatgtttccttcctacccgctaaaaccgtcgttacccctccccccactcagggtctcgttttgaagatagtgattcgactttcgccgcgactacagcagagctgtgttccagaggaagtgttatctctgtcgcggctggagacgtcctgtccctggaccgcccggggcgcaggcggtgggtgggtggggacctccgaggccgcagctcgccgttgcgccgcaggggccgcgaaagggttaacccggcggggggggggggtgcgagaggagggagggggcgcgggccgcgcgtgcgctctgccgccctccattgtctccacagcggcgaggagcgccggcgaacgcagcccgggacggagcagggcggcgcggctggctggcggggccggcggcggctggagccggagcacgacgccacgcgaccgcggcttccagagctccgcctggctaccccaccgccgcgagccctcccgaagcctggaggagtgagggccgccggcgcgggctgtggagtcctgagacgggggacgcgaacggcgcggcgcctccctcccttcgctgcggctccttaggctcctgagcccggggggcggcctgtggcgcgaggcgccggctctggaccccgcttcttcggacctgggctccggagcctcgctggcggatgctctacctctgcacatcgcacccaggtggttcagctcgcacctaatatgagtttttaaataaaacattttcaaatctgcttttagggtaagatatacatactcccactgtactggtctagatgctatctctttgatccttatcccacttctggcctgtattgcttgaggatatacattaacttgtcccatatttcttgaggacctacattaactttaagagatggttgcaccttctgtaggatatgatcttcctgtgcactcccttgaaatactaaactctattccaaagattaaaaggatgatttatgcctgtgctttcgtatacatatcacatatatggcaatagacatatgaatatgaacgctttgaagatgtttatgtgattttcttactacttctgcctctttaaagtcaaacgaatgcgcttttcaagaactatgtaagagataactctaaataactttttaaattattatttaagaacctactttaaggcttatacagatattttagagtttacagatgattaatatattgcaacataatgatatatttttaaaaattagttatccttgttattagcttaaaaatgaataattaagtcaaactctatcctgatctggatgtcttatcatattttgttacctcttaagtacaataaaagtaaatgctgtttctaacaacaaaactccatgtcctcttacactgcataatggcttaaattttaacacatacttaatttaaatttggtcacaaaactactaatgtattttaactacttataacagatatctaaaacactatgttttatgtgttttagataaagcctcttggtcttccatttttaattaactcattaaaattgttttctaaatttcatgataacaagaagaatgaagtatattgtaaaaaattatttaaactggatatatttgttaataagttaaaaataataaagagtttctggtttccatctgctcctggagctgaccctgtgccacagctctccaaacccaaattcctctgggagaaagctggtcttccaggagtgctgacacacctgagagcacaggtaagaccaccacttctgctcaaatacccagcccaagaggaccctcctagagccctcaggacacaggaaccaagaagcagcctgggaccagatccttctagaatctatctgcactcggagctgaccttgtgccacagctctccatacccaaatcccaccataagagaactggtctcccaagagtgctgacacacaggcttacaggagggacaagccacagtcagagacagaaagaccagaaaacaccacagaaaaccagatggcaagaggcaggcacaagaatataagcaacagaaaccaaggctacttggcatcattagaacccagttctcccactacagcaagccttggataccccaacacacaggaaaagcaagactctgtttaaaatcacatctcatgatgatgataaaggaatttaagaagaacataaataactctcttaaagaaatacaggagaactcggataaacagctagaaacccttcaagaggaaacataaaaatcccttaaggaattacaggaaaatacaaccaaacaagcaaaggattgaacaaactcatccagattctaaaaatggaagtagaaacaataaagaaatcacaaaggaagacaaacttggagacaaaaaacctaggaaagagatcaggagtcatagatgcaagcatcaccaatagaataaaagagatagaagagagagactctcaggtgcagaagataccacagaaaacatggacacaacagtcagagacaatgcaaaaagcaaaaagctcctaaccaaaggaaaacaaaacaaaaacaaaaaaacaaacaaacaaacaaaaaaccccaggaaatacaggatataatgagaagaccaatgttagggataataggtatagaagagagtgaagattcccaacataaaggggcagtaaatatcttcaacaacattatagaagaaaatttccataacttaaagaaagagatacccatgaacatacaagaagtctacagaactccaaataggttggaccagaaaagaaattcctcctggcacttgatagtcaaaacacaaaatgcacaaaacaaagaaagaatattaaaagcagtaagggaacaaggtcaaataacatataaaggcagacctatcagaattgcaccagacttctcaccagactatgaaactagaagatcctgggccaatgtcatacaaacgctaagagaacaacaatgccagcccaggctactatagccaccaaaaatctcaattatcatagatggagaaaccaagatactccaagacaaaaccaaatttacataatatctctccacaaatccagccctacaacaggtaaaagatgaaaaactccaacacaagaagggaaactctaccctagaaatagcaagaaagtaatctttcaacaaacccaaaagaagttaaccatacaaacataattctacctctatcaacaaaaacaactggtagcaacaatcaccactccttaatatctcttaacatcaatgactccattccccaataaaaagactcagactggttactcctccagagagccaaataaccctattttttaaaaaatggggaatagaactaaacagagaattctcaactgaggaaacatgaatggctgagaagcacctaaagaaatgttcaacatcagtaatcatcaggcttatgtaaatcaaaacaactcacctcacaccagtcagaatggctaagatgaaaaactcaagtgacagcagatgcaggcgaggatgtggagaaagaggaacactcctccgttgctgctgggattgcaagctggtacaaccactctggatatcagtctggaagttcctcagaaaattggacatagtgctacctgaggacccagctataccactcatgggcatatattcagaatatgctccaaggtttaataaggacacatgctctactatgttcatagcagccatatttataataaccagcagctgaaaacaacctagatgtccctaaacagaggaatggatacaaaaaatatggtccatttatacaatggagtactactcagctatgaaaagcaatgtcttcacagaattaacaggcaaatggatagatctagaaaatataatcctgagtgaggtaactcagtcacaaaagaacacacatggtatctactcactgataagtggatattaggcaaagattgtggaatacctatgatacaactcacatgaagttcaagaggagggaagaccaaagagtggatgcttcagtcctatttagaagaaggaacaatataatcaagggacatagagagtgggaagaacttgggaggaagagaagagagggagggggaaagaggtgaagaatcaagtatgggaggagatggagaagatgtacagagggtcaggaaattgaacagaagtatgtagcaatggggagtggggaactggggtttagcaactagaaagttccagatgccagggaagcaagagcctcccaaaaccccaagggaatgattttaggtgaaataccccacaaaggagagggagaacctgtaggtcgaaaccatatccagaggttaggcaagccccccccacccccccacccccccggttgagtgatggggccacccacctatctgcaaaattttaatccagaattgctcctgtctaaaggaaatacaggcacaaagagcagaacagagactaaaggaaaggccatccagaggcggccccacctggggatccatcccacatgcagacaacaaacccagacactattgctgatgccaagaagagcttgctgacaggagcctgatacaacaatctcctgagaggctctgccagatcatgaccaatagagatgcggatgcttgcagtcaaccatcgaactgaacacagggaccccaatggaggagttagggaaaggactgaaggagctgaagggactttatctgacatcaatgtgaggggaggcccttggtcctgtgatggcttgatgccctagggtagaggaatgctagggtggtgaggtgggatgggggtggggcaccctcataggagaaaggttggggtggggataggggagtttcagcggggaaaccaggaaaggggataacatttgaaatgtaaacaaataaaatatccaataaaaaaaaagaaaaaagaaaagtcttttctaagcatgtcataagataaaggtggaacactccatgaaaaattagggacaatttgaaaaccttggagaaatgccctataacaattcatagcaaaagtgtcaatttcttctatatataagaaaatcaatagggaaaaatcgatataaagaaaacccagtacaaagtactatggtaaagataaaataaacaatacatttccgcttatcattaccagtaacacagggaataaaactgaaatattaagaattaaatatccattttctatgttaaaaaaatatagaggttgtaaaatttaatttaatccaaaaccctaagataaagttaatgcttgattttttgcattcatattcttaaatattaatttgttcttagtaatatttaccaaaaacaaaagaactttaaaaactgttattttatccttttactaaatggtcatttaaaacctgtgtctcaagttagcttttcttatccaaattatacagaagacatcagtctaaaagtctagtagcaatattcacaatgttttataacttaagtagtgatgtttcttgatttaattagtatctaagctgtcctataatacaactagctaagattaaaaagttaaacaatttgtatcttactaataagaaagggggaaggataatgctatactgacttctcccaaagtgcttttctaaccatctaaatatgttagttcatatattacaaataattataaatacaggggaaatataaagtcaatctggttacaaagtttggttttagacatgtttcctttttgaccttcactccattttatcaaactgtgttgttgatttcttaatttaggtatagtcatcttagctcacacgttatgtcaggtacagagagtataaaaaataattcaggtgcggatcctgaacgaatggattgatatgatccaggattttgtttcttaatggcctttaccagctattctctctcctgaagatgctgtcctgcccactattcagcctcatctacatcaggtcctatgaatgagcttcctagttgtgagggaacttacgatatttaataagtaacatgtggaattgctcctgaccaaaatgtgatgtttgtagacaagggaattgtgaatgacaactcctgaggacctgacatctacatcaggtcctatgaatgagcttcctagttgtgagggaacttacgatatttaataagtaacatgtggcattgctcctgaccaaaatgtgatgctttgtagacaagggaattgtgaatgacaactcctgagaggaggctgtgtctgagcagaccgatttgatctgcaataccatggagagagtggaatggtgcaggctaattaccttgtcttgggctagttttagcgagccctcctcccagtagccataccttacctacctctgtgtcagaactaacattctgtgactaatagataaaaaccttttgaaatttactaacttagcagactgctagcttctaccaaccccaaagctacaaatgtcatccaactaaatttgccttgattttgcctttctttgttctgtaaaactgtgaaattgcttccacattgggacatagagttgggtaacttcaatctgtgttcctggacaatggtcacttgaaatggcttcagaataaactgtcctcttatttcctttaagatgagagctgtggtgtttttgctttaccattttctcattatctgtgaatttcatttttttaattgaagagataagaactcaggggccactgacttagtggaagttttgtgtgaccatgggtgtctgagaccttaaatcctgaattaaagtccatctgaggaaagcttgcttctatcaaactcaaagtgtatctatccacttttctgaatcagcagcaagcttcagccttttcctacctcaacatgagatcctgggggagattccatttccttgataaccatttcttcaatagtctggtattgaagatacctagaataggacatgtgtttctctgtagaagatctttgcttcttccaggactgccacattgctgcatgctcccagacaaaaagctctttctttctttctttctttctttctttctttctttctttctttctttctttctttctttctttctttctttctttctttctctctctctctctctctctctctctctctctctctctctctctctctctctttttctcttctcttttcttctcttctcttctcttctcttctcttctcttctcttctcttctcttctctctcttctcttctcttcttttttagatcattcgagacagggtttctctgtgtagtcctggctgtcctggaactcactctgcagaccaagctggcctcaaactcagaaatatgcctgtctctgtcacccaagtgctgggattaaaggtgtgggccaccactgcccatctaggtttttttcttccttccttccttccttccttccttccttccttccttccttccttccttccttccttcctttctttcttcctctctctctttctttctttctttctttctttctttctttctttctttctttctttctctttctttctttctttcttttttctttctttctttctttctttctttctttctttctttctttctttctttctttctttctttctttttaaatatatttttacttattgattctgtgtgcatatgtattggtgtgcacacaccataatgcacgagtggagtcagaggacaacttgcgagagtcaaatctttttccaccatctgggttctaggtatggaactttagtcatgtagcatgaaccttgaaccttggacaaagtccactgagccatctcatcagtgccccatcttttaaaataaatattttaattaatttatttatttggtatgtgtgtgtgtgtgtgtgtgtgtgtgtgttagagcacatgcacacatctgtgcttgcaccatccatgggttgcggtcagaacaaaacttttaggaggtctccctttacatagcttgaggcagggtctctcttgtttcttatttatttatttatttatttatttgtttatttattttttattacgtattttcctcaatgacatttccaatgctatcccaaaagtcccccataccctcccccccacttccctacccacccattctcattttttttggccctggcattcccctgtactggggcatataaagtttgtgtgtccaatgggcctctctttccagtgatggccaactaggccatcttttgatacatatgtccagaaaatcaaataaccccattaaaaaatggggctcagaattgaacaaagaattctcacccgaggaatactgaatggcagagaagcacctgaaaaaatgttcaacatccttaattatcagggaaatgcaaatcaaaacaaccctgagattccacctcacaccagtcagaatggctaagatcaaaaatttaggtgacagcagatgctggtgaggatgtggagaaagaggaacactcctccactgttggtgggattgcaagcttgtacaactactctggaaatcagactggtggttccttagaaaattggacatagtactaccagaggatccagcaatacctcttctgggcatatatccagaagatgtctcaactggtatgaaggacacatgctccactatgtccatagcagccttatttataatagccagaagctggaaagaacccagatgcccctcaacagaggaatggatacagaaaatgtggtacatttacacaatggagtactactcagctattaaaaagaatgaatttatgaaattcctaggcaaatggatggacctggagggcatcatcctgagtgaggtaacccaatcacaaaggaactcacacaacatgtactcactgataagtggatactagcccaaaacttagtatacccaagatataagatacaatttgccaaatgcatgaaactctagaagaatgaagaccaaagtgtggacaatgtgccccttcttagaattgggaacaaaacacccatggaaggagttacagagacaaagtttggagctgcgacaaaaggatggaccatctagagactgccttatctagggatccaccccataatcagcttccaaacgctgacaccactgcatacactagcaagatttgctgaaaggacccagatatagctgtctcttgtgagactaggcaggggcctagcaaacacataagtggatgctcacagtcagctattggatggatcacagggcccccaatggaggagctagagaaagtatccaaggaactaaagagatcttgtttcttcttatatacaatgcttgatttgtattaaacttgtctgaaaggtttggggtttggaatgtaagggggtcactgagggagactgtccttgggatggataacagacttatttgaagaattattaattacatgggtaggaagacaaaacagcagcatggcaggagttctgagcaagctccttgccccagtgtcataggaagacacacacacacaacatgggtgggttctatgagagttcaggatcatgaagcagaactggagtcccttataggtctcagtgggagggaaaggtctcatgtcatatgcttaatgagtcatcctcagtgtgagccaagctgtccttgattcccaggtcacaagggaggtggccctgcattctggagaaggattgcatgactctgagaatgctgaaggggaaaagaacatctagttgaggtggatccattatacccgtagccctctgatgtcctaggagtctggtaaccttggggaagtgtgaatgacacttgccattctcctgagagctgggcacctgggaagtctgctacaggattggagaattagagagtcattgacagctgtggctgtaaggaggaagcttctgcctgtaaacacaatcagcttatacttataaagctagcattgtctccatgcagaagggacgctctttgatgcccagccagtgcgttcccttcagctcacttggaacttagtggtttgtgtaaggatatactgttagatcccagcctctgcagactcctctcacagatactgacagtcaggcttctggtactttgtgtgtctcttgctaacaggttcacctgggaagtgcaactacaccaaagacttgtcacagtttgtcctccaccccttcctctgcttcctgcctgggaatctgagagcctgactgtaaactcttgttgtgaaccccacttcctaaaaatgtatgggaagagactacctcttctgcgtgtagggctcttattctctgtagaaacttccccatgaggtcactagtgtttgagacccaaactcttctgagagcccctggcattctgctgctcctgtctgtgtgttcacggcatgaataactctcataataaactcctcagtccccagtcatcgatctgtgtcccctggaatcaccaacctcaaatccaaaacctatcagtttgtggacttggtggggagaagtgtacagaggcggtaggatttggtcataaagacgacatagtattaaagctgaccacagagacttggttaaggctttttaactgcattgaacattttttcctttgctttggattatgtatagttttgatgctgtaaccaggaatgcctggcaggaagaggatactttaaagacacttgtgcctgcccttttggctgtcagactattgaaacaatagccccaaagaaattacaatttacccaagaatctctcatgctgggagaaagaaaaagctgagaggaagccaggaagacatttcagcttgacaaagaattatccccttgagcaagatttacaacttctcagatgacccaccagaaagcttggatctcagacagcagtgattggccagaccattaggaacctgaagcttgaggatggctggggttggggggggggggcgggggcgggacgggggggggagtagcggggtgtgtgtatgtgtgtgtgtgtgtgtgtgtgtgtgtgtgtgtgtgtgtgtgtgtgtgtgtgtgtgtgtgtgtggtgtcccctccatccgtctgtggatttctttgccctcctttccacggtatgattgattctcctttgcttttttacgttaggtttttaaatatagactttctaagaacgaatagctgaccgtcagtgccaaggctctggccctaactgtgatagcaatgcgaggccagattaagcagcttcgtgttgtagtgaatgacctttggctttctgtaccgccgctataaaacattctgtttattctctgaaaagaaaccgttatctctttcctcccaccacagtctgaggtatgtaagtaacttcagacatttcagaattctgtcatcacagtttaggaaaggacagtgtggcatcgcacattacacatacagcccgcctttcctctttaaatccccggtgggccttgcactgaaacctaactctggttttgctttggtttttgttcacttccttttcaaatgtatcttcttcctgctgacttttttttttttttttaaaggaagcgcctgcgaaaggagaacccccttccataggactaagagacaggaaatttacgcggggatgggtgcggggactgggaagcactgctcaaataggtttactctctcggttctgaaatacagttgctgttaaggctggagatgctgctgcccagagcacaagatataaaaagatctctctgtctggatttcctcttttccagtctccttgccagcaactccagaaaaaaacttcaaagctgataagaggggttaggttgtcttgagttggaacccacatttctttcttgattcaggataaccagctaacagatattcactactgtcgtcctgaaattaattgaggatattcattaatttcctggaagctagatttttggaaagtcttgattttgcttgtctcttgaggcaaaatttatcaactttggggattgataaatcttctgtcttctgaaagagtagtaaactcagggctccaagatatgctaatcataaaacagatagcgacattccttcatccacccacccacttcctgggttcaaagagtgttcattcaaagaaagtcaccctgaccattgctggaacccactatgcaaaggtgctattgctaggggctcttagattgttagtggctcttagaaactgtcttgagagataacctgacacttgtgactttgtacttccttgtgactcttaactggtatttttggtattttccaacaacgtccttcccacctccttgagttgtggttccttcctttaaatacccccttactcagctactcagggcgccacggtcctctacccttgcgtggtgtatgaccgtgggcccgagagcgctcttgaataaaaatcctcttgcaatttgcagcaagaccgtttctcgttggtgattttgggatgtcgcctctcctgagtcagaacgtgggggagtcctcacgttgtgggtctttcacttcctcgtcttctccctgctttttctcaactcccctgcaagcgagagtggacacactcttagggtggcttttgtggcagacatggatcctagctgagctctttctccagtgtacagcattgctgcatctcactgaggcctgaacagttctccttttaacacctcatcacacatagctgaggaactcaaacgacctacctcttagctcttctcccagacctgtcttgtttttatatcttcatgctaaatggaggattgtttttgtttttgttttgtttgttttgttttgttttgttttgttttgacttgtgccttgacaaatgtgcgattagatctatactttctacactgtactatgtgaatgagtcactggaggatcttattaacatataggatgagagtatgggggtttaagagtagtcagaatgtgttgcatgcatgcatgtaatcagcaaagaatgtatttaactagttaaagaaataagaacaagaactggagatgtaactcagtagttggtcacttgcctaacatatttaaggctctgagttcattcacagtgccacaaggaactggaaattaagagccctgctattaccctgagattctatttttttaattagtttattttgttttaaagacatggtctcactgtgtagccttggttggtctccaactggctatgtagaccaggctggcctcaaacttgatctgcctgtcctcacctcttgatgctaggattaaagtcatgcaccactgcatttgccttagaatttttaaattttatcaggggttgaaatcaaattcaaattgtgataggctagccagtatcctacctctaagctgtatccctagccctcagattctgccttttaacaacctacaagtttgtattccagccgtgagtaagaaacaagtgcttgcgtaactctctagagattttgctgtttaagaatgggctggaaggcacagacaggactggatttggctgagcgcgtgattaaagagctgaggaaaacaaaatcaaacaacatccctgccctggttgtctttcattctgatgtgttgtctttaaatttagaagtttctctcaaggagttcctagatgctgtaagccaggttagggtgtaggtgtctcctttactgtatgttcgttcatctttgagcaaagcctttctttcttctccacacatcacacatttagttagcagcccattctgcttttatgtcacaacaccagagaggagtggtgagaacagaagctacatgctcagaagtctgaaatgtcttctgttagatcttttacagcagaggtttaccaagcatccatgacgtaggcagaggtactctttactctccaggtcagtccggctatgactctggcactctttttggcactggtgatagaagacagaaccagaaatccctacttgttggaacttataataaagaagaggaaaataaatgtatgaaacagtgtataaaagttattcagggaggcaaaaaggaggtttaacaacaaagtgttatggacagctatttgaaggcagtctgaagagacagagagagaggcaggcagtggagaaaagcatgggtgaagcagaagaccagtgtagatggagtaatcactttatggttcccacagctgggcatttgtagtcaatagttattgctgggttaaggcgacagcttacactgcagtttaatggcaccctccacaggcccattcactgttctatgaagtcagctctttcatcataataggggtatgtagtgaattttgggaacatgtgggtatctccaaacctcagatgccgtatatatatgcctgtcgtgagaagcaacattatgtcaaatacatgacaataaccttgttcttagttgcaaggaagtgatgtgcagtgtgatgctagataaagtattctttagtgtcatgaaaataatgcagagggtctgcaggccagacaattaaacttccaccatgagtgtgagattatccttggaaggattaagttgatcttccttggattggaaaagtgtacatttattgaagctagggggacacctggtcatcctgggtaattgtttcacaacaattgcttagcattggctttgtttgttggtagactggagacactgcaagagcgataggcagagcaccctgagaaaggtgaaaagcatgctttaagtgcaactgtgttatccttgtatgctgccagagccaatttgtgacatggaaccactgatggactctgagaaagcctggagaaaaatgttatgggcattcccagagtcagttatcttagccatctgatattttaaaatctccataatggtgtgcttcagtggacatacaaatatccttatattctgtgtcagttgtcagattttcagttaggaaatatttgttaggttagtgactgcatactgggtactagatgctatgttgtctatattaaaaatcttagtcttgtgctgccttggagattggcatttcaatctgattgaggctgtaatgatctagcaatctactttgtttttgtttcctctaaggagatgacttaaataggaattaggggaaggttttggctatcctctctatttttggaattaatctctgcacttctcttagggacacagtacaggctgagcatcccttgatccaaaatagttggggccataagtgattcagacttgagaatgtgtgcatgtattccttaaagtcttatgtcagacccaaatctaagtgcaaaacgtgttcacacttccttattcacatacactttgcagtacagtctgcaggtaactgtacctgcatttttactgtgatgtgtcacagaaggccacttgtacaatattcaacattttattactccaaatgtttcagactatggaatacttcagttttgggacttttggatttggggttcatacttgcattgtttctgtgttcttgggagtagaagggcatgttcaagagaaccccgtttaatgctcgctcccatcacagctgccactctgcaaggcctgcaacctacatactcctctgcaaggctcagtctttgaatagttcaggtcaggtggacaattttagaggccatatctaataacccctgtaagtgtggactctttccttgaccaagagtcgcccagagtagatctcgttggggcagcattatccaaagtgtatttctagaccagcactaattgacaaacttatggtgattattactgggtattaattgcaaatccacagacattatcctaatcctattaaatcagaatcctggagagcggtttcttaaatcagtattttccttatggctctgtgaggggtggtgctgctgtacttgaaccagggttgtgaggatgtcttcctactgacctacaccctgctgatgagctaatataccctgagaattgacatttactaaggctcaccacatgtaactattgataaatacttgtttctatcagtagttctcaaccaggatcaattgtgcttcttatgtaagattcttaaataaaacacactttttaaacataataattataatctaagactcaggttccatttgtatctgtttataatcccctccccgccatgcaagcaatcctaattaaatacaatgggacacatatacaccacacacgcgtgcacgcacacacacacacatacacacaaaaataaccagaagggggaagacaaaatttagtggagagtgggagtaaaggaggataatgaggagaaagataaaaaagtatattttatatgtgtgtgtgttcaaaattgaaaaataaaaagaatcactatagaaaaataaaaacgaaaaacttccaatatatgctcctcagagggctctcagcctctgcatggacttagtgctgagtattgggcgtaaggcatgctttggccccctaagtttctgcttccctgtgtatgtcatgaagatctcagtcccatgattattgtgctcttgccatagagtacaacaacgggtcagagaagtctggttacctctcatccctctagcttaccctggaaattgtaccacattctctctaacagtgaagctgtacctgctggcctttgaggtcactgctgtcgccctgaggttagggtatccatttccatgtcaatcacacctaccattctgtctgacctacagagttcttcagatctaagtcatctattattatgtcttctttgtgtctggctcaccaaagcatttattagatgtgagccatagctaccagttttaaaatatgtatgtatgtatgtatgtgtgtgtgtgtatgtatgtatgtatgtatgtatgtatgtatgtatgtatgtatgtatatatgtgtctgtccaagtgtatgcattcttattgtaagtacacacatttgtctacatacatgaaggccagaagagagagtcaacatacccacctttattaccctgtgcctacttctttgagccagggcctctgcctgaatgtgaaactcatttccttggtaggatggatgcaatccccagtcattctcttgtctctggcccgtctcagagtgggggttacaggcatacatgagacgtccaacttgtaacatagatgctacaattcaaactctgactttcatgattacacagcaagcactcttaacagctaagccagttctctagttccagtctattcatttttaaacatttatttggttaggggttcatgcaatgatactatagagcgtgtgtagaggtcagagaacaacttggagaagttgattctccccttccaccatatgggtcctagtgattgatctttggtcgttgtgcttaacagcaagtgtctttagcttctatgccacctgctgactctcatcagtgaatttttaatgtactgatggaagtattatcccagagagtcaagttgaagatggacatgccccatcccctagctgaacataatgggcccattatttctgtaaatgttgctatcttttgtcaaaattttcttagagattttctgatttttcaattgcagactctagaatgttattagctatccttttcaaactgttactgccaccttcattattccaccaacatgctatattctaaatccttggggtctaattccttgggaattgtgctctcatcaatgactttgatttaatttctttgggtgattgggattctaaggctggccttaaacttgctgtttgctgttcatctgactcagcctccttagtggtgggattacagatacgagaggccatacttagctttgatgattacaacccccaggagccacacatccccagctcttcctaagtggacagctcctaaagcagcatggttttaggatgagatcgctccctctggaggaggccaagttactgtctctgatcgttagtccagatatctatctattgctgcctacaaaaccatctcacatttaagtcagcaatttattactaatctctttgtttgagtagagtgggtttgaaagagaacccaaggacaagactagagagctgatggaatttgaggggatttttgaagagtgttgttgtaaaagagttcagagcaatagaacaattggaaggaaatgtgggattaagagaaggactgaaaaaactgaaaataaaaaaaaagagagaacgactggagatggggtaaataaataccagcatgtttatgctgtgccaagtgatccggaagacttcatatttataagatgacacagaggagaaagaggaaagggctgtcactgagcaaggaaagaaatggaatttgatacaaagcagctgctctggtctttacttagaaaggtagactgctcctctcattacaataaggtgggcactgccagtaatctcaaagttcccctttgcttcaattttctcagtaaagcaggaaatgatattatcactcgagaatgatacacacatgtgcatggggggagggcgaatatgattgggagaatgaatgaatgaatgaatgaatgaatgaatcagatgactattgaaatagaaaaataaggacaatgacaggagtggtgtgacacatagcaagaatttctctttctccctcttccccctccctccccccccagagagagagagagagagagagactgcaaaaggctgaggctagccaccatacagtatcagctggataccaatgagacatcagaattcttgaccctgaatttaaaatcagatgagtcattattttttatgttttccccagtttcatgcaggatggaaaaaaaatagagaagttagagttagtgggttttgtctagagtctgcctaggtaaaagagggagtttaggtgctctcagaggtgtgaatacaacaaaagattgtggactttcagcaggcgtgggaacatgagaactaaagaagaccacataggatgcagcacagtgagggagtggtgtgcagcttcttgaggggtctcgaggaagaattgggttactaatggtgacttgaaagggagagaaattggggtggcaacccccaagacattacctgggagaactttgcagaagcagggaagagtgttgggaaggtcatctgtgtactgagttactgagatctgagacaaaaggcatgctggacagtgtcaaagatggcagtggtggtgagactccgatagtgacaacgtttaaggatgtggaattcaaagctgaggttcagtgaggactgttagatggtccaatttggaatgttaatagtttgtgttactttcccctctaggaataagcaatatcagaatgtgaatgtcctaatgcttttaggaaaacttgtttgtgtaaagatgtttcatgctttaatcaccagagggtgccagagtcaagcaaatgatttttcttctcttcatatgtgtatacaatataggttgagtatatacatactctactgggcccccctccagccccttgagaactcacccccagcacattttcccctcaacttcatgaaataaacacacacatacacacaagcgcacaaacacacacttctgaaacaaatatccaataagtgctgcttgtatgtatttgggtacttttagttttcatctgtagctgagataatcttcaagtagtggaaggaggcactatttatattggagaggggaagtgtgtaagtgagaatttgccacataaactaggacatgtgttcttctctccatacaaatctccaacttcttatatttttgtttgtgaacctagtctttagtggctcggccatctcttcggctccaaagctctaattcctataattaaaatgaaaacaggagaaagtggacaaactggccttcaccttgatggtggggaaaccctctcctctttactccacctccctaactatctttactgcacacttcatgtttccctttgatataatgagacaatgtttcaaataagagaattgttgcattcagaaaagtaggtagggcttccaaaactagcctgaagtattctttaaattctaacagctttggtttttgtcttctatggcaattcttctgaacttgtcttagttttagataagccttccatgctaagtacattaaaacccatatgtccagacccctttggagtggtggggggtgagggagggtcctgcctggcacttctgtaggtcagaggacaactctaaggtatagattctcctccttccaccttgtgagatccacagatcaaactcagattgcaagtcctgtgattgtttgcctctactggctgagttatctcaagactcgaaaatgatttttctatttaagtatttctattaaattttttatcttttaattagccaaaacattctcattctctttctgtgtctctattcctctgtctgtctctgactgtctgtctctgtctgtctgtctgtctgtctctgtctctctctctctctgtctctctctctcgcctgaataaggagaaagcaagctaggcatcagcacccatctctttctgcttcctggatgcagatgcagtgtgaactgcggtcaaatgtcccggctgccagaattgcctctctatagtgcaatatgccctcaagctcagagacaaataaaccctttcttcctagtttcctttgttaaagtattttttcaccatataagagaagtagctaatacatattttttatttcaagcagaggatatttagtttgtatgtgatttaacattttaaacatttgaagaccttcacacggtgtcacttatgagcagtgtttagattttcagaacagacatgtttcagaaataaaggacttatcaccaaggcagaaacgcaggcaaccctttcagtcttcttaaaacccaggcaaaaaggcatgtataattagtgaaaatagcaaataccagaagttactgttttgcccttaagttatctgtggcaaagctgtactgctatattctctcatcttctccttctccctctcctcctctaccttccccactctcctgcccccactgcatgagaacacttgccatttgcttgagtaaactagctttgcttacacttttactttatttttattttcactttattttattatgcaagaacactatggtactggaaacacaaataccctgtggcccacagtctttccacagaattggtcagtatgtgtatcatttgtttctttccacatccttaattttgctctttcttttctgtaaggtctgcctttatttgttacttgacctttttcccttacaagttttaatattctttctttgttttatgcatttgatgttttaattattatgtgacaggaggaacttcttttctggtccaatctatttggagttctgtaggcttcttgtatgttcatcggcatctctttctttaggttagaaaacttttcttctataattttattgaagatacttattggctcttttagttgggaatcttccctctcttctatacttattatccttaggtttagtcttctcattgtgtcctggatttcctggatgttttgggttaggagctgtttgcattttgcattgtctctgactgttgtgtcaatgttttctatggtatcttctgcacctgagattctctcttctatctcttgcattctgttggtgatgcttgcatctatgacacctgatctctttcctaggttttctaactccagggttgtctcccctttgtgctttctttatttttctattttcatttttagatcctggatggttttgttcatttccttcgtgtgtttggttgtgtttttctgtaattctttaagggatttttgtgtttcctctttaagggcttctagctgtttacccatgttctcctgtatttctttaagggagttatctatgtccttcttaaagtcctctctccccatcatgagaagtaattttagatcagaatcttgcctttccagtgtgatggtgtatccaggactagctatggagggagaattgggttctaatgatgccgagtaactttggtttctgttgcttatactttgagatttttaaattgactccagactctttaaaataaaggtttagctcaaagaacagaaaagaaaacaatgtctgttttcttctgcagctttgataggttaaatttgtagctacgcttgtttcaccaatcgtatttaaatttggtagagtggaggagtttgtatagaagtaagtttgataacaagtcccaagttgttgcagtatgtgcccgttaaatgcaaaatatgattgcaagttccatgaaatcaggaagataagttgggcttgaacgatgctggtgggtcactgaaggtgggcttagctttctcacggttgctgcctccttggccagaagctctttgctttttcctgaggcacagccagtagcagggacacaaaaggaaatgtccaaagagtccctggagttcccttttcttcagctcgcactggcaggaaacccgaaaaccttctcacttctctaaagtataattaccaaagacatttcaatttgatttttttaaaaatcatttaaaagtcttcacaaaacaccagcagggtacaatgtttgacttcaccaacatgtacattttcccaatggctatctgaattcatgactctcaaacgctttatttggtaaagtcaagattctaatcttaaagattaaatgatatttatgccaattatatttctagttatagtttcttttctctcttcaaacagaagagaccaaactttcagccactcttcctaaatgcacactgattccaatccagttgctgttaaaaataactaaaaatataagtaacacatacacacacactaattttaaaaactacacctcttctgcttgcaaaaagataatattatcttttgcttatgttcagcagtctcatcattcctcccctacaatgttcatggggacccagagtctgctaagaatattctttcctcacagctgactatagagttccaagtctacaaccagcctatatacctaaggttaaaagattatcatgaaacaaaaattggaaagcttgtaaaatccagagagtcagaatgtctgatgtgagattgtgtttactacatgttatagcagtggttatcaacctgttggtcacgacctctttgggggcaatcctttcacagatgttgcctaaagccatcataaaacacagatatgtacattattacagttcataacagtagcaaaattgcagttatgaagaagcaacaaaaacaattttatggttagagatcaccacagccatattgaagaactgcaacattaggaggggtaagaactactgttcgagatatatgccaaggtctttgaaacagggcttacttaggaaaatggcctcagacaaacctactctgctaattttttccctacactctaaggtactaacatttttaaacataaaatcaagccttttctagtactcaaataactgatataaggtaagcaaatcgaaggcatatcagtgtagtgccacacacctctaatgtccatctttaagaagtagaggcagaaacatcaggttattcattggcagcctgagccaaagacaatctcaaaataaatgactaaattagttaatcaataaaaactaaaataaataaattataaatatggttaatctaagttctcagtgtcctacactagtatagcatatgctaccattcctggatagaagtgaatggttactcacttcagatagagagctaatgacagaacaaactgaagatgtcaccaaaatttaacttggtaaaccactgacttttactgaggttgcttacagaaatatggatgaggggttacttacagggcagaaatgactcaaagacaaccatttctccaaaatatcatccctcatgtaatctggaaaattctagtatactgtataacctaaaggtaggtcagtatgtcagagagtatcctttcctgttatatcccttggtctcagcctcttccagatggctcagtttatatgagagtcttttaagcagcttgattggtctctgtgtctctcaggtggcctggctggtctgtgagtgtctctcagcagttttcagtgcttctatatgcttcaagagggtgggaccttgtgtgtctagttagtttcagggacttcctgaaacctattgtttatgtcctgggcttaatgagctttcctgcaggatggaaggttttgacctaccttgagaatatctgtgtcttaatgagggtcctaagattgaagttcctatgattaatcctaaatcttcctagaatgaaaagtgcttctccatttcagaaactgtatgttaccactgagacttttgacagctggcttagaagctgactgagctagtatggcttttcttactctaacctcaacttgtgcttatgagcagtgcaatagtgttaggtttatggtacatgccacctaagtgtgattgctggccaaagactacaatttattctccattagttattattaaagtctcattttcccccatgagaaaataaattctactgttattttgtgtaaatgttgaccatccccaacagatttatcatttatttgggaaaccagagtctttttcagaattttcatgtgcaaattctgaaaacatcaaagcttttggttgattctttctgaaaccctcaaccctgccaacaccgctttaacatttatggtcctctaagggtcttaggcccagagactatatgaacaatctctagctcctaaagggcaagaaagcactgttaacattctagagtttctctgaacttctagacctggttgataaagattctagttaccgcgcacaaaggaaaatccagagaagcagtgagaaattgtattctggggcttaggcacctctgcatccatttgcttatgtgcatcattacactaaatgtaaggattccagccagagttctggaagtttagggataccacagtctgactccaagacatggcctctgaataggcatctgcacaagctggttcagccatggcgctgggagcaaatgtgcagaatgcatggctgatatgtccaggcttcctcttctccagaaatcattttatctagggagccagaaagccccatggaagacctgaagcacaggcaggtatcctccacctgtccctgacaagcatccccaccacatttctgtttgaaactctcatctagttttttctgtactttgtggcaccaaagtgcatggaaactcacctcctagaatctaaatggctgatacttcttggtatttcatgtgacaaacaccaccttcttcctggccaaagaacagacattgtgagccagtgttaagccttccatctttgatctccttccttgttttgtagtcttgcccagtgaccgtattgcacaacttttgtacataaatgttatctgattcttagtcagtccttgagagtctgggagaggtgtctaggactttaccttaagtagagttggtgttataagactgagatttcctcgctgaagggaagataggtgtaagggaagtggaaggcatgtgcaggacctgtgatactttggtgatttgcagaggatgggtggagtcactagtgcatctggtgtctgttcattgcttagggcagtcctccagtcacagcaatgggtagagctgacaagaaggagttgaggtgggaatctaagtttcccagatatggatgggacaagggtactaggcagcggtggatagagttagtggttcaaattgaacctccctgtgatagggaggcagaaagggacttaggaagataggctgggcatgtgttccttggcaggtcacaggaatgggaagagctgctggtgtgattctagtaacattcctggaaagaagcagttctcaggtggtggggatgggtgtaactggtatcatgagtctggtgtctagctagataatgtaccaggctcccacagaatggaggagtggagctgatggggttcatggatttagtgtagggggtgtgtgggtgccttgtctagggatgggcaagagctctgagacagggagacctttaattccaggacaatctgtgctgtttagggaagtctattaaaaaaaaaaaaaaaaacaaagcaaggcaaagttgatcaacaaaagtgcaattatattacatatattaaataggtgacgtataaaagaaaactgggtgggtgtatattgtctgatatagtcttctccttggcatgagtgccaggtctgcctcaatatggctctttacatacagacgtgcaagtgctgtgccagcctctttgccatccagcctgtggcacagactgatttctgcctcccagaacacacatggcaagcctatggaagtcagaaaactgatgggggttggttttctcctttcactgtgaggctcccagggattaaactcagatctacaggcttggcagcaagcacctttacccactgagctatttcatcagcctgtttttatgtctttgatccagtgcctcgcgtaccctggctgacctcaaacttgttatataactcaaggtgaccttgagctcttgatttttctgcctctgtccaccaaggtttatgctatcacactgagtttatgcggagctggcagttgaactcatgctgggcaagttctataccatatgagctacaccctagcctgccctagttttaaatgctaatttttattctcaataaagcagaaaaacacttattttgatgtctaaatcaattcctgataaggtgttgattaatcagaagtactttgtccttgatatacttacaaatcaatctacgtaaaaggcaggctgagcctcacaaagcaagtccagaaagtgatttaagtatacttgggctaattaggttcatggtttccaactggtcataactaaggtcataggaaattaaggttgaatcagagtggtaattagttggtttcatgtggtacactcctaagagacactcatgttctctacacaatctcttccaggtaacagtaaaaaagagtagacatgattggtaatgacaaatacttgtatcatctgtttctccctaggaaaaatgtccttggtaccaggaaatgtcatagttccccaatatctcaaacactggtagttggaattattattaactgaaaccatccagaaggtgattattctttgctaggagatctatgcaagcacagaacttctaaatagttatgttgtgcttcataaaacagcagtataatggggcaggagagagtaccacggtggcctagccaaggtgtttccctgaggaatcaccaccatgtgacaggcctagtataaaaggaagtttattgggtgaagggaaggggactggaaaatgggaagaggcagagaaaggaggggggacagagtaggacagaaagagaacagaaagaagagaggaagaagctggccagggacacacggagaagagagagaaatggatatgagagctggagtagcctagcagttcagttcttatacttggcccccacctagaaggcaactatgcaagctgttgctaggtagttattgggcagagcctagaggaattgccaacaagttattttcacaaaatacttggagatgaataatttgataggatagaaagtttgaataattttttagtcacctccacagtagtaaaacccaaaggagtattcaaactcagaagtctttgagctgatcacacactatctcaactctgtagtttctgtataaaccaaaaaaaaaaaaaaaatccctttgtgttagtacactatttttttttaaaaaatgttattttttaaattatttttagctgggctcacgcctttaatcccagtacttgggaggtagaggcaggcagatttctgagttcaaggccagcctggtctacagagtgagttccaggacagccagagctacacagagaaaccctacctcgggaaaaaaaatttttttttaaatcatgtgtctgtatggatatgtactagtgtacatgtgtgtccacaatggtcaaaggcatcagaccccttggatctggagttagagatgcttgcaaacgtcctaatgtgggtgctggaaaccaaactaggctactttgcaagagctctaagtatactctttattcagctagggtattgcaaaataactgtaaatcttttaattgtggttaaggccaactaataaaggtaactgtgatacttttcaataaagtgttatcatgtaaggatcactatgtagctcaggctggtcctaaactcagggattggcttacctctgcctcctctgccaacctctggtggaattaaaatgtgtgccactatgcctggtttatatgagaatttctgtataaagagatccttttaggatataaaaaggcaggttattttcacctaagaatttgagaccagtctgggaaggatagcaagttatattgtaatcaataacataaagtatcttaaagtccgtatggactgtcagaacctatatcacccaccatcactgttcctcttcttcatttattcatttattcaaagtattcaagtattttgtgaaaataacttgttggcaattcctctagcccctgcccaataactacctagactcaggagctgactacgcccccaaacattcatcttagaaattatttaaacagaaaaacaaacaaacaaagaaacaacaacaacaaaaaccatgagcatctgtgccaagatttagctacaattttccaccattcagcatcatttactcttttgtggttaggaatcatcattatgttttggcaaacaaaacgaaaggaagaaagaaagaaagaaagaaagaaagaaagaaagaaagaaagaaagaaagaaagaaagaaagaaagaaagaaagaaagaaagaaagaaagaaagaaaaagaaaggaaggaaggaaggaaggaaggaaggaaggaaggaaggaaggaagggaaggaaggaaggaaggaaggaaagaaagaaagaaagaaagaaagaaagaaagaaagaaagaaagaaagaaagaaagaaagaaagaaagaaagaaagaaaggaaggaaggaagaaagaaagaaagaagtagagaaagagaaaattggtgggtcattttaggtagaaagtcccctagagccttctacctctctttctagattttgaatttactttcaccttatgatgaaaatgaagtctgaaaacagcttctgtcattgacaggtcaggttttgctgcccaattcaagtaaatagcatgctttgtgtgcactcttctccagctttggttgtgttggcagtacttaaggtacttaagcctcatttgatctgtgcagtactatctccatgtctccttaaggtctactcttaattctgctctcatcattcctttctaacttaccattacagactccagataaatcactcattttttcttttatttttaactaactaactaacttatttatttatttgtttgtttgtttgtttattattacactccataatttatcccccccccatcccatacctcctccccaccccctgtctccatgtggatgtctccacccctccatgccacctgacctctaaactccctggggcctccagtctcttaagggttaggtgcatcatctctgaatgaacacagaactggcagtcttctgctgaatgtgtcttggtggatatatgcttcctgtttagtggactagtgtttgagagatctggagggtccaaattaattgatcctgctggtcctcctacagggtcacactcctcctcagcttctttcagtctttccctaaatcaacaacagggatcaggtgcttctgttcactggttgggtgcaactatcatcctctgattctttcagctgcttcttggatcttctggagtgcagttattcgaggtccctctttttgagtgttccacagtctcagtaatagtgtcaggccttgggacttgcccttgagctagatccctctttgggtctgtcacaggaccttcttttttttttttttttcctcaggctcctctccattattaaccctgtcattctttcatacaggaacaattacaggtcagagttataactgagggatgcacccgcttcctcatttgatgccctgtcttcctgctggaggtgggctctgtaagtccccgccccccactgtccacttttcctcccaggtccctcccttactcccccccttgtggttgctttcttctctcccaagtgtgactgagacttcctcacttggccacttcagcttgttgacctttttgagttctgtggagtgtaacatggaaattctgtactttttttttctaatgtccacttattagtgagtacataccatgcatgtcattttaggtctaaggtacctcactcaggatgatattttctggttccatccatttgcctgcagaaatcaggatatcctcattcttaatagctgagtagtattccattgtgtaaatgaatgacactttctgtatccattcttctgtcaggggacatctaggttgttttaaggttctggctatcatacaaaaggccattataaacatagtggaacacaggcccctgtgatatggtggggcatcttttgggtatatgcccaagattggtgtagctgagtcttcaggtggatctatttccaattttctgaggaagccccagattgatttccagagtggttgtaccaattttcaattccactagcaatggaggagggtcttctttctcgacatcctctccaacatgtgttgttaacttaagttttgatcttagtcattctgattggtgtaaggtggaatcttagggtcattttgatttgcatttctctgatcactaaggactttgaaaatttccttaggtgcttctcagccattcgagattcctcagttgtgaaaactctgtttagttctataccccaatttttgattgggttgtttgtttttttggtgattaacttcttgaagtatttatatattttgaatcttagctctctatttatgtagggttaatgaaaaaaatttccaatctgtagttggccgatttgtcttactgactattccctttgccttacagaagctttccagttttatgagatcccttttatcaattcttgatattagagcttgagctattggacttctgtttaggaaatttacccctgtgccaataaattcaaggatctttcccacattcttatgtattattttcaatgtatctgtttttatgctgtggtcttgataaacttggacttgagctttatgcaaggtggcaaatattggtctatttttattcttctacatacagacagccagttagaccagcactatttattgaagatgctttcctttttccattgtaatttttggcatctttgtcaaaaatcaagtgtccataagtgtgtggttttatttctgggtcttcaattctattccattgatcaacatgcctgtctctgtaacaataccatggagtttttttttatcactattgctctgaagtaaagcttgatgtcagggatggtgattgctcaagctgtctcacccaagaggaatagaaggcaggaaatagtcaaactcagggcagaaatcaaccaaagagaaacaaagaaaacaatgcaaagaatcagaaaaccaaaagctggtactttgaaagaatcaacaagattgataaatccctagccaaactatctaaacaggcccatactgcacaaggaaatagaagaagttattaaaatcctcccaccccagaggcagtatccaaattaccaaaatcagaaatgaaaagggagacataacagaaatggaggcaattcaaaaaaaaatcttcagatcctattataaaagcctatactcaccaaaactagaaaatctagatgaaatgggtggtgttctagacagatgacacataccaaagttaaatcaagggcaggtaaactatctaaacaggcccatactgcacaaggaaatacaagtcattaaaatcctcccaccccaaaaaagcccagggttagatggattcagtacaaaattctattagaccttcaaagaagacctgataccaattttctcaaactatttcataaatcagaaagagaaggaacactacctaactcattttatgaagccacaattactctgacacgtaaaccacacaaggacctaactaaaaaagagaactttataacaatcttgcttatgattatcaatgcaaaaatactcaataaaattcttgcaactgaatccaagaacatatcaaaaccatcattcaacatgatcatgtaggcttcatcccagggatgcaaggttgtttcaatatacgaaaatccatcaatgtaatccactatgtaaacaaactcaaagaaaaaaaatcacattatcatctccttatatgcagaaaaagcatttgacaaaatacaataccccttcatgttaaaagtatgggagatatcaggaattcaaggcccatacctaaacagagtaaaagcaatttactgtaaaccaacagccaatatcaaattaaatagagacatacttgaagcaaacccactgaaattggggataagatatagatgtccactctccccatacctattcaatatagtatttgacgtgttagctagaataataacacaacaaaaagagatcaagagaatacaaattgacaaagaagaaataaggttatcactaatggcatatgatatgatagtatacataagcgaccccaacatttatatcagagaactcccccagctgataactcacttcagcaaagtggctgtgtataaaattaactcaaataaatcagtagccttcctttatacaaatgataaacagactgagaaagaaattaggggaacaactcctttcacaatagctacaaataatataaattatcttgcagaaactctaaccaaacaaatgaaagacctgtatgacagtaacttcaagtctctcaagaaagaaattgaaggttctatgccctagtataggggaataccagggccaggaatgggagtgggtgggttggggagcagggggagggggaaagggataggggattttcgcagggggaactaggaaaggagataacatttaaaatgtaaataaagaaaatatctaataaaaaagaataaatacaaaaaaggagaaagaaattgaagaatatctcagaaaattgagagatctctgatgttcatggattggcagaattaacatagtaaaaatggctatcctaccaaaggcaatctatagattcaatgtaatccccatcaaaatcctaacacattccttcaaatgtatggaaagagcagttctcaaaatcatttggaaaggtgaaaaatccagaatggcaaaaacgattcttaacaataaatcattcaaatgtaaccattaggatttacttttgagaatggacacatgccattgatatttgtcacttagtataaattttctgatagttccatacattttcttgccaattttctcatttcagttttctttgtagctaaatacaattccacttggaagtgcattactttttcataagccatgtttcatttgatagatcccaattctggctggtcattgcacctcctttccctcactctcttctctatttttgtctcttctgttcttttacagaaactactttgggtcagaatctttgactgttggatggcaatcccgtctgtccacttgatgctgtctttttactggagatggactatttgagtttcctctacccattgtacagtatttcatctaaggtctctccctttgatttttgagattctctcacctccaaggtcttcagaataccctagaggctcctttctggctacaggagatggcctcttaagaaatcatatccccaaagaagtgagtcacagctaaagtcacctccactgattcttgggggccttccttatactaggtctctgtctcatcctgaacatgccccacacctcctcaccatagtcagttgcagatttccattcattttcatggacatctggccatctcttctgtctttccgaacacctgattatgaattgccctccccaacccctctccatcccagcacccttcctccatcttcctcttatgactattttattcctccttctaagtgagattcaaacttcttcccttggtcattccttcttgtttagtttctttggttttatggaatgtaacatcttacctgtattttttggctaatatccacttttaagtgagtacatgtcatccatgttgtttttggactaagttacctcactcaggatgatattctcaagttacatccatttacctgcaaaattcgtgatgtcttggtattaatagctgaatagaattccattgtgtagatgtaccacattctccttatctactcttcagtgagagacatctttccagtttctgcctattatgaataaggcttctatgaacatagtgtagcaagtgttttgtgggatattggagcatcatttgggtatatgctcattagtggtatagctgggtctttaggtagaacttcttccgtttttctgcgaacacacacacacacacacacacacacacaatttatttttccaagtggttgaataagtttcactgccaccagcaatgaaagagttgttccccttgctccacatcctcagcagcatattctaacttttttttatcttagcaattctgatgggtgtaagatggagcctgaaaaggacttgcttttgacaaaaatgtcaaacccaaacaatggaaaaagaaagtatcttcaaaaaatggtgctgacttaattgaatgtcagcatgtagaagaatgtaaatagatacatatctgccaccatgcacaaaattcaaatccaaggggatcaaagaccttaatataaagctggatacactaagtctaatggaaaagaacgtggggaataatcttgaactcatgggtataggagacaactttctgaacagaacaccaatggctcaggttgtaagacaaactattaataagtgggaacctttgaagctgaaaggcttctgtaaggcaaatatattgtaaataagacaaaacaacagataacagaatgggaaaagaccttcaccaaccctacatatgacagtgggctactatccaaaatatataaagtacccgagaagtcagccaccaacaaaccaaataatcaattttaaaaatgtgatacagagctaaacagaattctcaacagaggtacaacagtgcacccacgaggaagacccagctctgctgtgctcatgccattgagattacgtcacttgcaagccccatatgcagggacagctctactgtgctgtgagatgcagggcctgctgtctcagctgctaggaaggtgaggatcacaatcagctctgctgctctcatgactcccttgaagccaactcatctgcccccagctagtatcaagggacagtctcctgccaccttctgatccaccttccctttatctgcccagttatcagctctcctttattttacaaatttaggtggggagctggtttacaagaaatcacctgagtcagactcattccttgttcacaaatcacaggagaatggaattaacatcaaatataattagctctggggctattcataacatttcctcctttctgtccaattaaaagactattttatctcagatataattgaacataactattattattttgtaatttataaagtactagagacctaacacccagtccatcatctttgttaattaaacagaacctctgtcatgtatctttacttaaaagacttataattctacatctgcatatatcttggctttatattgaatgccatcttaaaaccatcctctcagaactgttcctctcaaagaaaaaaacctgggttggctaggagactacgcagtttttcaaccccatcagaaatccaagaatgactgatattaactgaaaatataaagaaagcctaacacagcttccaaaacttagccaatttacagagatcacggatcacttggacagtcccttacttcaacatgttggagcactggtattcagcttattgccccggggtcatctgacagacttagagaaacagaaatattttttaatattttttattagatattttccccattttcatttccaatgctatctcaaaagtcccccataccctccccccgagaaacagaaatattaaggagtagcttactaaggggacccacttagccaactcaggtagcttactagaaagctcacttgaggagtggatctggattaaggggccggaggcgggtcctgggcactaacggtttcgaccccgcaccccgccctccgcgccgcacccgagtggcccccagtcgagcgggcccccacttctcggcccgacccagacccttctgcgcctcccttggcctttgtccggctccaggaggccggccccgcgccccctggcagccgccggtgcccgagcacgcatcagcctcctggctacatacgcgagctcggggaatctgtggcctccgtgacccctctccccagcccgccttgttgtggagcccggcggggcggcgactgccagggccgggtttgcggcgctcaggagaggccccggctccgccccgggcctgcacagggggagagcggagcggtcagcagccgggtcgggtcggggcccctcccgagaggagagtgaagcggcagcggcggcagaaaagatggaagaactgcatagcctggacccacgaaggcaggaattactagaggccaggttcactggagttggtgtaagtaagggaccactcaacagtgtgtcttccaaccagagtttgtgcagcgtggggtccttgagtgataaagaagtagagactcctgagaaaaagcagaatgacctgcgaaatcggaaaaggaaagctgagccatatgacactagcaagggaaaggcacttctagggggacataaacttagtgattcctttgagtttgctgggggaagcgggccaggaaccagccctggcagaagtgttccaccagatgcatgatcctcacggcaacattccttatccaatcccttaccgcttcgagtagaaccgcctctgtatggtttagatggcagtgcagcaaaggaggcctcagaagagcagtctgctctgcccaccctcatgtcagtgatgttagcaaaactgcgacttgacacagagcagttggcaccacagggagctggcctctgcttcactttcatctctgctcaacaaaacagtccttcttctatgggttccagtgtttgaaagtgacctgtgattgtggaagctgcaatgaggatactgtctttttgttgttgttttgttgttctttgtttgtttgtttggtttttttttgtttgtttgtttctttgggttttttttgtttttttgagacagggtttctctgtatagccctggctgtcctggaattcactttgtagaccaggctggccttggactcataaattcccctgcctctgcctcccaagtgctgggattgaaggcgtgggccaccattcccagcggtgataatgtcttttctccatcacatgtttattagtgcgtgaagtgttcagaggattggcacaccatcacagagcatagattactattgcatccatacacctttgacatctctggcctatggagaccctttgagaatggatctggcctatatgcatctatgtttccctgccttcagaggtctgattcttgggatttttgtgactcacccagcaccttccatctggaaagccagtaagcactctctcatctacattctgcccatttctctcatcttctctttccttggcttcataatattcacaggccattcaaactcagttatttttatcgtgaggcaaaccatgttcataggttcatagactgggatttttttccctaaacttttggccaagtagatcttggttctggatttcagagtggttttgttttttgtttttgttttttgttttttgttgttgtagttttgttttgttttttgagacagggtttctctttatagccctggctatcttggaccttactttgtagaccaggctggcctcaaactcagaaatccgcctgcctctgcctcccaagtgctgggattaaaggcgtgtgccaccatgcccggctgagtctttctttaaagttggattctgaaactaaagagcctagaggaggatcaagcatactgtgtaaacgacaccaagctgtaaggtacatgtcctatatcccccaagtatggtttgtactgatggagaaacaatgatctaggatgattgtctgggacaatttaatagtctgggacttccaggtgtggtctgccactacaatctaccacaggtcaccaaactgcttactacatccattcttttacttctggtttaaaaaaaaagtgtacttctcttgcactgaagagaaaacgctgtggttttacatccctggttaacttagagcttattcttgaccataatttccttttgccctctacagaaaaaatatattttatggttgtttctggttcgtaggatgttaatgttgtgttagtgtaaatggaaagacagtcaaaagatgttttctagaatataaattatgttgtggagatatacaaagtgtgattacattgcttgactctatagacataaaacttgcaagtgctgctggcataatcccagcaatcagaacattgtggcaggtgtattcctcttcatttgaggtcagactactctacatcaaagtgacattccaacctgtggtccccaatttcctcttctggcctgcttggattctccacatgtatggaggtgaatttcctaaccttttcagtgggtgtgtctgtattttcaaatttttattggcagagaactagcaggatcttgatattgtcatttctatggcccttcaccagctttacatttgtaaatactcctcccacccctgctgagatacttgaatggcaagcagctctctaagccttgaggcaatccagagaagttctggtgatgttttacacctgattgcttctaagaaaaaaacctgacatccaattcctgggacaagaattggagggtggaatttctggatattaaaagagatgtagagaggagaatgcagatgtaggagatttagtgggagacagagaagataacagatagatgagaacgacgcaggagagaggttaagaggtatctatgtatgaggtcataggcttgaattgtcttaattctaaatgatagctgggagactgctccaatgaaagttttatgctttacactatatagaaacctttttaactatttataacactggtgtgtccacaaacactcccagtatactcatgtccacacacacttgtgtatatagatatataacatttaaccagagtgcttttggtatttaagtcaaattagacattgattggttattcccagtaaattcatgacatcattgccctaagcctattttgctggaaggaaaaattatagatcaacgtctattttggttggttctgtgtatatatttcaccttgtgtacgtttcaaagcaccttccataaggaggacactggaacataagagtcaatgttcttggcaccagtttgaccttttcatatacagtgttttgtgtcagccctgtctttagcaatgacgacttaatgtcagtttgtgaaaagcaaccccttttgttgtcagtggccagcattctttggatatttttatgaaaccactttggctagcaactttcttgatgtaacacagtggaaaagacaagatcaactggaactccatctctttcagaattcagagatttcatttgaaacaccttcatacacttataagctggtactttaaaaaaaatttttttttgttttgttttgtgaacatcttactaagactacatccagcaggactccatggagtcttgctccatggtgctttcctatgcattggcagaactgtacgtgtgacaatgtattatataaaacatcttaacttgtaatagatggggaattttcctggacctcacaaccagaattaaggaaacttgaagaaatttaagatttaaagctgtgatcctactgtttattcaacttgagggtttagtacacttttcaaagaacaacgtaaaaactaacattattctcctttgacttctcttgatatcaacttttaaaacctaacttgatgcatagatacaatggtaatttatgtactttttcaagtcctgctcagaaactgcatgagtgtcacttgatgaaagcatgaaatacagaggcttaaaacatagttcaaaaatgcatatacagttatgggtattggttgataaaagtcatgtttataaatgtctgttgtcttgaccacttgaccacttggagccagttacctaatcctttataaaatattactattcactatcccattctttccccatgtgatggatcccttgatgttctagaagcactccaaagctctctctcaaggccagtcagagagatacaaatagacaacagattacacagacaccaacatggagacaaaaggcagacagaaagggagagctatacaagcagccttcaggaagttacagatttaaactaactgaacagatacacagaggatggaagcacagggaacatgaagtagagaattcaactttgtactcacactcagttaaatgcctctgaggaaaaggctttcatttctttccttaactcaacacagatgcattattaatcactagtatgtttaatctattcacatatgaggaatcaattagcttgtgacttttttttagcataagtacaatatgggaaaaactaaaattcaccccaatgggaaacaagtagccctgtcatctgaaaggtgtccatgggcacagaaccctgttctttaaagtcagacccccaggtttgggtttgtgcttctgagctctcacctccatgctgagctagaatccattttaacctctcataatcatcacaacaggttttgaacctaagaggtcacatgagaattctggaactcattataatcatgaaaacagttgacttcctagcaatagtctaatgagacttgggtaaatctcggttctcctttcccccacttatactgacatgcatgggtgtcagagtgttacagggaacaatctaaccatgtatgaacaaacagtgcagtatgtattgtaattttgttcctgttttctttctttctttctttctttctttctttctttctttctttctttctttctttctttctttctttctttctttctttctttctctctctctctctctctctctctctctctctctctctcttctctctctctctccctctctctctttctctctctttcttccttcttacttcctttccttactttttttttttttttgacaaagatcaggacagtttttcgaaggagtttctctttattgcctcatccttcaagcagtaaataatattgtgccttgacctaacatcattttaattcaccattttctttgattgaggcatccacctcctctactttttctttaagtctgataatctgtctcccacaggttctctatgtatcaattttatttgcctcagtgcattttctcttcaggatttttctttttttagcatttctaaccacctattgaactcaattttaatattttatattgtccttatttccttcaggcatctggtattattttcttacccaagattcattttgttcctgtctgagtggattcacatggtttacaaactttaatgcccttgatcatgactgtgggttttcaattctttgtcttgggtatcacataaattgtgctccttattggatacctctatggtttgtggtttgagccaaggacattttatctacgtttttgtttgttttgggtatctgttctgagcatcagagttcaaagggactgcttaattttttgcatttatagcccagaaggctacacgcacaatatgagaagttagacaggatccattgtatctgaagggttcagaacccaggtgcagtgtcctactacatccagctctggtctagtctggcagcaactttgtgaagaagctgtgcagagtaggtcctggggagttgtgtggaaggcaacagagttggaggagtggttcctgatggggagtgtgggattcctgcacgattagatgagtttaagaaaaagaaaaattaaaagcaaaggaacaagcaagcaagcaaggaagcaagcaagcaaaaatccaaaaaaacaaaaattgctgtgaagaagtgggaagctaattaattaaaaggtacataagtaggtgggcttagaagaattccaggaagctgttgaattttgggcgggtccagaaggcggggttaggcagaatgagggaaaattccgcggtttaacctttcttcttgcatctctgctgcctcatggtcaggaagtcctggcgggagactagtgcctagtatttgcggtgcctgaaaactttcttaaggagcagttgttttgctggcctcctaggacatattggagctggtcctgtcatcttccaggtcagaggagctgttggactgggaaacgggcaggagcttggcaggcctgtggagcaggggtgcattttctgccgccattctcacaattcagtgtttgcggaccggaaaacttccttaagctgcagttgctcctcctaggacactgagcagctggtcctgtcacctttcaggtcagaggagctgttggactggggaacgggcaggagctgagcaggggcgtggagcaggggttcattttctgccgcaactctcataattctgttgtggatatcttaccattgtcaagaagtttgagatcctgtgaattgggttcatgattggtttaatcaattttatggttgccagaatatttttctaaaatatcctcggagatccttggctgcatctggagttggtataccgggaggtttgcctttgcaaaagcctttataaaactcctgtaattcaaattcgttcatgctttcttaactcccctgttcctccatttgccatttaatttccctttctccagggaactgagtaggcatcccgagagagctttgtaagtatttgtcatatagggaccagtgcagatttgattgaattcgaaaatattcgttataaagtatctttgaaagacccaaaacgtgaggactctcccacgttctgactcaggagaggagacattccaaatcacttgcaagaaagggtcttgatgcaaattgtaagaggacttttatttcaagagaactctcaggtccacattcatataccatgcagggctagaggactgtggtgtgcagagtagctgggtaagggggtatttaaaggaagaaaccataagtcaaggggatggggagggcgttgttggaaaataccaaaagtaccagttaagtggaaagtcaagacagttgtctatgagtctcagtaacaatagcacatttgcacagtgagttcctggagtggtcagggtgggtcaaggtgactttctttgccagaatatttttctaaaatatcctcggagatccttggctgcatctggagtttgtatacctggaggtttgcctttgcaaaagcctttataaagctcctgtaattcaatttctgttttatggttagcataccttgggggcattgagtcacaaagatcttattattaagcctgtccctaaaggcctactttttgtttttatgtttcactttttaattgtcatgtcgctgtacatattaatattaacctagcaaagttataatctctgttagtttaacactgaggtatatgcagtctttgatgtaaatacagcattgagaaatgtgtcttcataggctcagttattaatgttacacgttaggtttgaataaaacatgaagacaggattgcagcaaggtacagctgaggagaagatacatagtaggttctgtcaacccagagtgtcgccagagaaaaactaattgtaccatgtgggcaagttttataaaataatacatcctgaccaagagatggatttggtcacatgctacaggcagtttaataggccactgtagtttcccgtgaggctttattattttcctaagacatgcaacttgcagcaatgcacaaagatacctggttcttgtgctggtggtgcagttaatttttggcttttcagtctgagggagaaagcattcagagatatctggctggttccaaactgcaccaggccatcaggtggggggaggggaattgaggatgagatggaggacagaggggcaggccaagagataaacaggagccaagaaaacacctacccaactatgactttattgatatgttaacagacaccccagttagccattcctcctgaatttctttgattccttccaaggttctgcccagcatgctgtgagagaatgatttcaggcaaagatattttaataagtggaaaacttactatggattaagacaaaattaaacagcacctttggaatgattatggttgctcacttacagaagaaaaatgactccttacttcatgaaaagcccatgcacattcatggtttgttgagttctgcactgtggacttcttgcaggtgtgggaatgcttagaccctgaacttagggctttttttcacagacctcgtgttggtgaagtctaactgtctggattgtgtggatcagaataattttcttccagtcttcccctgcttttcttccttgttacttggaaaaaggactctgtatgtgtgttaactgtgtgactgacttacacatctctagggtaaactgaaatactcagagaaaaagagacattttcataatttcttctctttccctcatgtttatccttttatcatgtattgacatctctcatttgtgttccatgaaaagttccaggttcagtctgaataatattttcccatttacaggtattcatatgctcagccaaatgtgcataactgtaaatcaacactaagggcacctgatggttaaggtcaaggagattctcgcgaaggatccaggtatgttagaggtattgaacaaggggtggagtggggctcacctgtgagtagaaagaggacatgaatttgattttgccagattctatttccttaatgattctggaaaagaataatagatatgatgatgtggatttcccgtggtaggcagtgctgtcactccactcgacacttgatgttaatattaaattaattttgattctgggaaatcactgttgcccattgtaattaaagtttcttttacccagattgaaagcatcatcaggctatggttgtgacaagggcaatttatacataaagcaaatgtcagcagtagattccctcctagggcctgtgaccttccttatgaattttcaggcagattttcactgtaacctatgtatttttttttcttgtggagcttgaaccagaaaaccttctgttacccacagatagtcttgccactgtcataaaaatttccatgccttgtctggcagattcagattgtagcaagcagcttgcaaacctgagtatgatatggattagctctgcttcctgccccaattttcctagcagtttttgtcactatggaagttcccaccatggtatgtaagatgtctgctgagagtgaatggtctgatatgaggtggttttctccagaaggtctacttgctttctgaatcacctattctgtccactctaaatgttttcctgtccttgacctgtgttcttattgatgttctgtgttgcattagtccccattagagtggaataattattgttgaccttctctgtactgtttgctttagttttgagtctgtcttatttctgaggtatgtttcttctcttatattcttgagagcttttatactgagcagtgtctactttttaccacagggctgtataagtaagtttcattctcctattgtcactgtaatttgggaggattcctgcctgcatctattaacctaggcctagtcatgtaagcttctactctacatacagtattatctaggcctggtgtgttttcagcctctgaaatttgctgctgaataagcccccaccttttcttattccttctcaatgcttacctggctgattcaattctgtttttccagctcacactcctctcccagctgagttcttctctcagacactgaattgttctactaggccttaaattaactgtcgaaatcttttgtaatcctctggctctttctcattctcctgctcattctgtctttgcccatgcctagcatgttctatcttcaatctgactctgtaaaactctcccagtaaaactgtgtccttctccctctctgtggatctactctctcaactgtactgtactgcagcccatgcactctactgtattcctttattattctcttctttgtgtaatgtctttctctgtctcaagtagcttctctttcctctctcattacagcaaagttgggcatatcctattctgtcagatctttctctaatattccatattttctgtcattcaattagacattgctttcaaacacaggtgtgttcttctacatataaactgtacctttgttattttggattaaagtgaatactaaggtcttgcctgtactaaaaccagagcgattaatgttgtgtcttgggctgaactgcaccctaagtcacaacaggttcaagtatcgctacacagtgtgatgtcagtttacttctgtacaattttttccttctgaaatgaaaaccaagatccacatatactattcttcaatatgttgatacctatttcattttttctgacttctacttgggattttattataatgttctttgaagatcggtcgatgatattctgttccttgtgagattgtattccttaggatttttaatctggaagattttgctggcagtttaggtggtaaagtatgtttactttgttctcaattccttgtgtgggatagagctttattgtgttgtatatgagaaatacttactacttctcctgtgtttattcattcttagcaagaaatttcttatttcttatgaccttatgaaaaatgtatgcgttattttgtgcatactttcatcaattcattttctaagtagtttttttgtttgtttgtttgttttctttttgtggtttttgtgtggttttacgagacagggtttctttgtgcagtcctgactatcctggaactcacttcatagaccaggctggcctcaaactcagaaatccacttgcctctgcctcccaagtgctggaattaaaggcatgctccaccactgcccagctctaaccaggtttttgactaaaaaacatgtcctaatgaattactacattcaaatttactttatgtactgtgaatactagtagccacttactttggattgctagttattttctctcagggtttgaaaaatattatttcattcactcttgcttttaacctatgtataactatttattactactgtatgctacttttatgtcaccacactaatggtaagggacaggacaagacaaaaggaaaagagatgtacattgttatagcacttagatgtgacaaaagccagatacatctaggagtagaggaagccaatctgtaatagccttccctagggaatgctaagcttgtatgctatgttattcttctacttaagaatcccagtgtctgaacacactacccattactattatagtttgtccactttcaaaatattgggatgaaacaagtgatagtaaaaattgaccacaaggctgataaggacagaattaaatctcttcagagtcaggtatatacttgaagaaatgccagtgtcaagttttaaagtcaaagtcctactgttcttattgacttcttggtggatgtaataccatgggttattctttccatcttagaatgagctcttgttcagtctccataagatgaaaaatgtacttttcatgttatacacacagacaaaaacaattccatgatatatattcattccatgtatttactgttattgaaactaaagcctaacttacatcaattgtgcaggaatttaagattgttgctgaaatgttgacaacaatactcaccctttatgtcacaggcaagattcataaagtgacatgctttgtaaaaatgtcctgattattccctgaatatttatgcattcctttgcccagtttttctagcccatttgatgttgtcttcaaatgcctgggtcatagagatttacatatcataaatttatgacagcattatatttttccctatatctacatttccgttctacagaaagtcctcttaccactcaatttcccatcacatgagttagggattatcctcatttctttcatgcatattacagctgttagaatatttacagagaaacattctggtagagtatttgtactatccattttctttgctaattgaggtatttcaaagctcctaaagttttctttaatttgtgctatttaaatctcctggtgctagcattttcaggtgaatggcctttgtagaaaattagtgtggaggctttgcacatccttgtctctctctgcttagtagaataggaggatgacagatgtctttggtttttgtagtgataagtttaggatgatggctactatgtttataagactcagtcatgttctttctttctttcttttttttaagatttgtttcttttatgtatgtaagtacactgtcactgtcttcagacacaccagaagaggacatcggatcccattaaagatggtttcctgggaattgaactcaggacctctgagtgatgttctttctcttccacattcttcagagctttcatagtgatccactgtgatatttttctctcaggcctttcttagatatactgacatggttgagagtcttctctcactgattgtatgtactttgtgccttgagttatttggtttgtgcttcttgaaacagtcttgcatctatggcatgaaatcaagttgagttcattttctatatccattagagagaatttttttattattttattcatgcatatttttatggtcatttgcttttgcatcccggtacagacagctttgtgtgatgactgcaccacattccctactttctgtattctgcaatgttctctgtgcaagatgattgagggattttctaaagaaatttgtgaatttggtgctacatctatttagtctcagacagtgttaaaagataccctgcaggccttgatttccatacttgcttattgttgggcctagtgttaagacatagaaagttttcttgttcacttgttcctaggatatcattttttcccctgttagttctcattaattgtgtatgactttttatggtactccatcatctgctacttcccagtttcaatataaactaatgaggcaggggcatcaaaagagaccacctgtatacctgctaaaagctaagagaaatatttgacatgagagaactataaggtcaatgtaatacaaaaacatgctgaatatttgcttataccatggtcatgacaactttgtgtagtaatagtatcttgatgttcagaaagagttcttatgtttttattcatgaacaaatatgtttgtgtgtgtgtatgtatatatgtatatgtggatatatatatatgcattagtatttatttcaggagaccctgtcatacattcttactttattttttttccttttccttggtttttttgagatagacattcttactttcatttggaactacaacatagttaccatgtagaatctttgtctatattccaagacaatagggcacatatagtacatagatacactgtatctgcctgcgagaatgaaatggaatcttatcatagggttaggtgtggtattctagtaatgaaacactattcaactcgaggcatcattcatggtaggcactagccatttgtctttgactctagacccaggaagatatgttctcaataacaaccctgataatagtgttttacagcctggatgcatatgctcactgtttatgccaggtgcccattgaagtcagaaagagtcctcggattatattcatatttcttactacactaaatatgtcactccatgctctcatgtctgtagaagtgttgacaagattccttgtatcattttgctttttattgcatttcatgtggtttatcattgtccattacattgttgtagtaatttcatttttttatttgcaaaccctgttgtgaaactgcaagaagagttccaatatttgaaactgggaaaaaaaaaagaaaaaaaagaaaaaaaaaaaaaaagagttttctctggtaaaactccaggtcagtgtgctgtccacatttctttgaaaattcctttttcactcaaagcattccatatttctgttatctatatgtggtcatgttatgtaaagggattattttctatggtattcattttcttctgggatgaggagaatttaagttaggtcttttcacatatataataccattatattccctgaatttttaactgtgaggacaaacaatttccatggactgaagacctgcaaatctcaaagataatctaatgtaaataatgctcaaatttaatcgattgctaatttctactgtggatggagttgtgtccttttatattagtaaggaaggaagttctcatgtgtcacttaatttgcattgcagtccctgtgctcagtctgatggttatatgaaagcaccacaaaagcatttgtattggtcagactctggcatagcctcaggggatagctataccaggctcctgtcagcaagtgcttcttggcatctgcaatagtgtctggggttggtgtctgaagatgggatggatccctaggtggggcagtctctggatggccatttcttcagttgctgatccattctttgtccctgcatttcctttagaaaggaaccattctaggttaaaaatcttgagatgggtgggtggcccctttcttcaactgtggtccttgcctatgcactggatatggctctacaggttcagtccccaatttgttgaatatttcagctaatgtcatcagagttgggtcctggggaactcttgctttcttggcatctgggactttctagtggctacagccagttcctggctacagccagttccacaccctgaagtgctacacacctccattcaattttctgactctcagtacttctcccctgtctcctcccactcctaattcgcctctccccacccatctcccccccacccccctctcaggtccctccctttacttcccttcataatttttctcctaagtaagactgaagcttccacagtccttcttgttaggcttcatgtggtctgtgagttgtatcttggctattccaagctttggggctaatatccacttatcagtgactgcatataatatgtatccttcttaggatgatattttttagatccgttcacttgcttgcaaattttatgaaggtgtgtgccaccaagcccggcctagagctcatttttgaccataatttccttttgttctctacagaaaaaaaaaattttatggatgtatctggttcttagcatgttaatgttgtgttagtgtaaatggaaagacattcaaaagatgttttctagaatataaattatgctgttgagatatacaaagtgtgattacattgcttgattttattgacataaaacatgcaagtgctgctggcataattccagcaatcaaaacactgtggcaggtgtaaccctaactcatgtccacacacacttgtgtatatagatatataacatttaaccagagtgcttttggtatttaagtcaaattagacattgattggttgttcccagtaaattcatgacatcattgccttaagcatattttctgggaaggaaaaattatagatcaatgtctttttggttggttctgtgtatatattttactttatgtacctttcaaagcaccttccataaggaggacactggaatataagagtcaatgttcttgcaggcaccagtttgacctttttatatacagtgttttgtgtcagccctgtctttagcaatgaagacttattgtcagtttgtgaaaagcaaccccttttgttgtcagtggcctgcattctttgggtatttttatgaaaccactttggctagcaactttcttgatgtaacacagtggaaaagacaagatcaactggaactccatctctttcagtattcaaagacttcatttgaatcatcttcatacacttataaagtggtacttttcaatttttttttttttgcagacatcttactaagaatgtatccaacagaactccatggagtcttgctccatggtcctttcctatgcattggcagaactatgagtgtgacaatatattatataaaagatcttaccttctaatagatggagaattttcgcagacctcacagccagttacctaatcctttataaaactgttaaagattactgttcattatcccattctttccccatgtgatggttcccttaatgttctagaaacactccaaagctcttatggccagccagaaagatacaaacagacaacagattacacagatagacacaaacaaggaggcaaaaggcagacagaaagggagacatacacaaggcagccttcaggaagttacagatttaagctaactgaacagacacacagaggatggaaggcacagggaacatgaagtagagaattaaactttggactcacacttaattaaatgctctgaggaaaaggctttcatttctttccttaactcaactcagatgcattattaaccaccagtatgtttatttaatctattcacatactaagattcaattaacttgtgacatatttttttgcataagtacaatatgggaaaaactaaaagtcaccacaatgggaaagtagtagctctgccatctgaaaggtgtccaatgggcacagaaccctgttctttaaagataaccccaggtctgggcttgtgcttctgagctctcacctccacgctgaactagaatccattttaacccctcaggatcatcacaacaggttttgaaccctggaggttacatgagaaacctggaactcattacaatcatgaaaagagttgacttcctagcaatagtctaatgagacttgggtaaatctcgagtcttctttccccagcttatactgatatgcctgggtgtcatagagtgtttcagtgaacaatcaggaaaccatttatcaacaaacagtgcaatgtgtattgtaattttgttctagttttttctttctctccttcttactttctttcttttcttcttcttctttttttttttttttttttttttacttttttgacaaaaatctggacagttttccaaaggagtttctattaattgcctcacccttcaagcagtaaataatattgtgccttgacttaatatcattttaattcaccattttctttgactgaggcacccacctcctctaccttttctttaagtctgataatctgtctcccacaggttctctatgtttttttttttttacctcactgcattttcttttcagttttttttttttttttggcattcctgagcacctattgaactcaatcttaatattttatattgtcctcatttccttcaggcacctggtattattttcttgttcatggttcatttttgttcctgtctgagcggattcacatggtttacaaactttaatctccctgatcatgactgtgggttttctattctctatcttggatatcacgtaaattgtgctccttataggatacatatatggtttgcagtttgagccaaggacattttatcatagtttctgtttgttttggatatctgttcttagcatcagaattcagagggattgcttaattgtgtgcatttttagcctagattgctagactcacaatatgagaagttagacaggattagttgtatctgaagggttcagaacccaggttcagtgtcctagtacatccagctctggtctagtctggcagcaaccttgtggggaagctgtgcagagtaggtcatgggaagttgtgtgagaggcagcctgcaacagatttgggggaagggttcctgatggagagtgtgagattcctgcatgaattgatgagtttaaggaaaagacaccttaaaagcaaaggaaaaagcatgcaagtaagcaaaaatctaaaacaacaaaaattagtgtgaagaagtgggaagctaatgaattaaaagttactgaagttggtggtcttagaagaattccaggaacctgttgaatattgggcgggtccagaagtgggggggctaggcagaagtgaaggaagttctgaggtttcatccttctctttgtatctttgttgccttgtggtcaggaagtcctggagggagactagtgcctagtatcagtggaacatgaaaccttccttaagcagtagctgctgtgctggcctcctaggacattgagcagctggtcctgtcaccttccaggtcagaggagctgttgtagtggttaatgggcaggagcagggcaggaatgtggagcatgttgcattttctgcctccactatatcaattctgttgtggatatcttatcattatcaggaagtttgagatcctatgaattgggttcatcatgatgttttaattaatattatggttgccagaatatatatatatatatatataattattattcatttaaataaccccatagatccttggccgtctctggagtttgtgtaccgggatggttgtctttgcaaaagccttaatagagctcctcgaattcaaattcattcatgctttcttaactctcctgttcctccatttgccatttcatttccctttttccagggaactgaataggcatccctagagagctttgtagatatttgtcatatgggggaccagtgcagatttgattgaattaggaaatattctttttaaagtaccttcatgtggctgtaaatataaacattaactagcaaagttatagtctccgttaaacactgaggtatatgcagtctttgatgtatatacagcattgagaaatgtgtcttcataggcttagttattaatgtgacaccttaggtttgaataaaacgtgaagacaggattgcagcaaggtacagctgagaagatacatagtaggttctgtcaaccctgagtgtcgccagagaaacactaattgtaccatgtaggcaagttttataaaataatacatcctgaccaagagatggatttggtcacatgctgcaggcattttataggtcattgtagttccctatgaggctttatcattttcctaagacataaacctgcagcaatgcacgaagatacctggttcttgtgcttggtggtgcagttaatttttggcttttcagtctgagggagaaagcattcagagatatctggttggttccaaactgcactaggccatcaggtcgggggaggggaattgaggatgagatggaggatagaggggcaggccaagagataagcaggagccaagaaaacacctacccacctatgactttattgatatgttaacagacaccccagttagccattcctcctgaatttctttgaatccttccaaggttcagcccagcatgtgtgagaggataatttcaagccaagatactttaataagtgggaagcttactatggattaggacaaaattggacagtacctttggaataattatgaatgctcactttcctaagaaaaatgactccttgcttcatgaaaagcagtctgcccatgcacattcatggtttgttgagttctgcgctgtggacttcttacgggtgtggtaatgcttagacgctgcactcaggagttttttcagagatttcttgtttgagaagttcaaaagtttggatcctgcatttcacaatggttttcttacattcttccttgttctgcagtgtttctgggaaatggaatctgtatgtgtgctaactgtgtgactgactctcacatctctagggtaaactgaaatcctcagggaaaaagagacattctcatgatatcttctctttctttcatgtttatcctttcacctggtgttggcatctttcatttttgtcacatgaaaaggtccaggttctttgtgaacgatattttcccattttcaggtctccatttctcagccaaatctgcataactataaatcaaatctaagagccctaagatggtaaaggccaaggagactctattgaaggatccaggtgtgttagaggctttgaacaaggagtggggtggggctcacctgaaattttatgtattcctatgctcattttttattacacacttgatgctgtctgcaaatgcccagggcatcaagttttacatgttgtaaatttatggcagtattgtatttttctctgcatctccaatttctgttgtacagaaaatcctgttgtcagtaaattttccatcacatgaattagggattatactcatttcatgcatattacaattgttagaatattcacagagaaacattctggtagaggatttggattatctggtttctttggtcttgcagatattacagagctcctagagtttactctaaactctgctatctaaatatactagtgcttgcattttcaggtgaatggcctttgcacatgaagtgtcccagagtgcttacacagcatctcttctttccctgtcccgtcccttgttattcatgttttcatcctatccttgtgtttcatgtacgttctgaggaaggttttggatggttatccatgctgtcatatattcataattccatgttccatgttaaatgacagcatgggtttccataactccactttctccttcttttacagtcttgcctttttcccactgctggctttttattcagcactctctgaattggcattttccctttacaaaccatgtttggctgagttatccagaaagcaccaacaatttaaatgtatttccagtatttctacatatagcagtatgtcagttataaattcatttttgggcctgtggtcattttgtttgtttttgtgttgttgtttgtttgtttgtttgtttgttttgttttttgagacagggtttgtctgtataaccctggctgccctggaactcactttgtagaccaggctggccttgaactcagaaatctggctgcctctgcctcccaagtgctgagattaaaggtgtgcaccaccacacccggcttgggcctgtgatctttagagtgacttttgaccagctgctagtgcatgtctgtatttcctttgtaggctgacctcagttcaaaccagtaaagtttctgttacctacttgtcactactacgctggtcaacatacattgttagacaggttggtattacagcacaagggtcataatctagggagaagcattaatgacaccttacacccatcagcctacagagccccttttagcagtatgtatgctaaaccagcacatccaagatccttttagacactgagtggtcttctgacttctcagattattctttaggaatgtataaaaccaaatgatatatttttttatatttttcttgtattctatagcattcatatttattactgattgggaacctgagaacttcctgtaacaatgcctcaatgcagatacatggttgttcagacagatgttccatctttgatagtattttaacagatttgttataatgagggaattattccaagggcattaccttgctaggccctggcatagtctcacaagagacagctatatctgggtcctttcagcaaaatcttgctagtgtatgcaagtgtcagcgtttggaagctgattattgggtggatcctggtcactgtaccccttcttagaattgggaacaaaacacccatggaaggagttacagaaacaaagattggagctgtgacgaaaggatggaccatctagtcatttatgttttattatatactttttttgggctaatatccatttattagtgtgtacatactatgcatgtccttttttgggtctgagttacctcactcaggatggaattttctagtttaatccattttcctccaaagctccttatgttgttgttcttaataaatgaataatactccattgtgtaaatgaaccatatttcagtatcgattcttccattgtggagcatctgggttgtttccagatcctagctatcacaagtagggccactctgaacataatgcaacacaagcccctgtgtcatggttgggcatcttttgtgtatatgcccaagagtagtatagctgggttttgaggtatatctatttctaattttctgaggaataaccagattgatttccagaatagttgaccagttttcaattccacaagcaatggaggaatgctactctttctccacatcctgtccagcatgtgctgtcacctgagtttttatcttagccattctgattggtggaaggtggaatctcagtgttgctttgatgtataggtttctgatcactaaggactttgaatatttcttttgaagtttttcaaccttccacagttgcttcattgtgaattctctgtataggtatctaccccattttttgattgggttgtttggtttcttggtggttagcttcttgaatcctttatatatattggatattagccttctatcaagtgtggggatagagaagtttgtttgtttgtttgtttttccccaatgtgtaagttgccactttgttctatttgctatttcctttgcctgacaaatgctttctagtttcatgaggtcccatttgtcaatttgtgatctcagagcctgagccatttgagttctttttaggaaatttccccctgtgaaagtcagtttgggtctctttcccactttatattctgtttccttgactgtatcttgttttatgttgagttccttgatccatttgaacttgagctttgtgcaaggtgataaatgtggatctatatcccgagcttttgttcccgccggcaagaacacactcaggacaactggaatcttctgcattgcttacttcttcaggaggcagagagcgaaaagcaaaaccccgtcccttttatggagaattgtcctctgcctcggacgtgtcgcttcctgattggctgcagctcatcggccgaattgtcgtcacgggaaggcagagcacatggagtggaaaacaacccaggcacatgtgcagattatttgtttactacttagaacacaggatgtcagtgccatattgtaatggcgaatgtgagtgtggctcctcacatctcccacttttcttttatttatgagcgataggccacccattctaatgaaagtggagatagaggtcaaatccccagtgtgtaggtaaaggaaccgtacccaaaacctcctcccaggctcatcacccggaggggtcctggtatggtcccgtgtcgtttttcctgggggaaggacactttgacactcaaccttcttgaaagatgtcatgtctccctagaataggctcatatatgccgcagagcccttctactgcagtgcttagccgtgcaactctctcaggctgctgaagcacactcactctatcccgtgcaatgagactagcctcgtggggtgcaagggctgaatggccatcgacctattgcttaagcatagataaccatatatcaggggaagcaccatgttctagtgctgcaagcgcctgggcaataaccaccttttctctcctagtttgggcctaaagcttacagaccaaccagagaagcaacactaatccacagcaaagtgtatctccaaataatcccacccccacccattctttaaagaaggaaaatgctgaggagatccaattgggtaatcctttggtcagggacaggtccaagcgcatggagtttacctgaatgatggcaagtctcaattcccgaaggatctgttcaaattcagccgtccaattctgtaacatatactgagaaagactttttgacaaattagctgccctagtaaatttctcatactgagtggaagtaacgcataatcctggaaacttttgttcacatcccagctgagctatttgccataatacatctagttgttcctggacaagatctatgcgttgattaaccagcatgagacctccctgtatcttgacattagctgaggcctgtttatccatggctgtggtcaccaaggctgacaatgtgttaatggtgtcagtcgtctggacctgtccagacagagccaaggcctaggccgtaagggaggcggaaacggccactgtagcgacaatgctaacaataatggccgatatctcaaaatcccttttttgtctgaacaaggccaaggttcccagtgtatcaaccggtaccagcacaaagcggggcatgcgagccgccaccactgtgtcaaattgactagcatctcaacataaagcataggtcagtacaactaccattatgaccgcaaagcagccataaatcaaagggattgatatcatatctccatgggtccatagtggtaaagtttccataaccctcaaggggggagaatgaaaaaatccctcttttagcccaacctgatctccgggcttgacagccggtccaagggaaaagggtatcttcagccgggatacctgtgcagaagggggccaattgaggttgtctaggaggattggaacaatcatcatctgttgagtggacacgaggccaccagccgtataagactgtggcattggcattatacccatcatcggtcttaacagtcatctccaatccagcataggagtaattaagtaacagaaggcataagtgttccaaggaactatcattggttaccctaaaacaaagactaccctccggaaatatggtcctgttctccgttacttgtgcaatatgagtgtctattggtagataggccaaacccagttctttgttagtggtaaaaaagcgggggaatacttgagcattatgcatcaccggcattgggaatggaaatatcgacattatcccccaacgctgctttctctttgttattgtcgccctggacatcaccaagaccagggacatcagtatttccttggtcagtctggatttttcgggtgagtctttctggtatccaaaatgggttgtcttcattctgtggaaaaacacaaacagctcccctggatcttatcaaaataggatccggtcctttccatttgttacataaaacatctttccatttaaccatctcattgggcctatctggctctgaacaatgacgttcagccgcagtatggccatgagcatcaagatttaaaaaattgagtgtaaagagtgccatagacacagacactcttggtactcggggtagagcctcctcaactccccctttctgttttattagataggatttgagggtgtgatgctcatgctcaacaataccctgtccttgagggttgtatggaagtccagtcaggtgggtcacgtccatctgaaggcagaactgctggaatttttgagatgtataagctggtccattatcagtcttaaggagtttgggtttcccccaagcactccatgcctcaaggcaatgttgaatcacatgtgaagccttttctccggttaagggagaggcaaacatgatgccagagcatgtgtcaatggacacatggagatattgaagttttccaaaggaagaaacatgtgtaacatccatttgccagacctgtagaggtcgaataccgcgtgggttaattcccacatgaggaactggcaagaactcacagcagctttgacattaagtaacagtgtcacgggcttcttttctggtcaaggagaaatgacggcgtaatgtttcagccgccacatgaaaattgttatgaaaatttcttgcagcctctattggggatgatagggcagcagccaccactttagtggccttatctgccaaatcatttcccagagccatgggtccaggtaggcctgacttggctctaacatgagtaatataaacaggaaatcttctagataacaaaactaattgtatctgctgaaaaatattggcaactttgctggaaggcttaatcactccagccacttctaaaagatttactgcattaaccacataacaggaatctgacacaatattaaggggttctaaaaaggtttttaaaacttccaaaaccactaaacattctaccacttgaggtgaattttcattatattgtttggatactactttaccattagccacataggcacctatgccagtttttgatccatcagtatataccacaatcccatttttaagtgggtttcttactgttatttgtggaaacacacagattgattttgggcaaactgtaaaattggatgttttggataatggctatctatttgtcctgaaaaggaggtaactaaaactgcccaattattagatgtggcttccaaggtttgaacctgtgcagcggtataaggtacaattaaaagatagggactttgtccaaaatgggtgattgctgcttttaggcctttaagggcaagctgtgcaattgcatcaggataccaatctattattttagctggggatatgtttggatggatccacaacaatggcccattctgccacaaaactgcggttggcaattgtgctgtcttaaagacacacaaactaaaaggttgcgaatcctcaatacgttgtaattgtgcattctgtaaggcattatccaccttttgtaaggcctggttagcagctagagtaagggccctaggggaggagatatgagaatctccttctaaaatatcaaacaaaggctttaactcagcggaaggaatcttcgaaaaaggtctgagccaattaatatctcccaacagcttctgaaaatcatttaaggtatggaggtgatctcttcttatctctaccttttggggcacaatcttatttcgggacaccacagagcccaagaattgtcctgtatcagaaatttgaaccttttctgtggctatctgtaaaccccactgacttaaagttttaagtagaaaaggatatgccttttgtagcatggtaaggtttttatggcacaggaggatgtcatccatgtaatggagcaaaattaaagaggggaattgttccctcactggcaaaagagcttcttgcacataaagttggcacattgtaggactattggacactccctatggtaagaccttccattgatacctcttatcaggttccatgtgattaatagaagggatggtaaaggcaaatctgggcctatcccttggaaactaaggtatagaaaagaaacaatctttaatatctataataattaaattccaaccacgtagtaaggcggaaagtacagggagacccctctgtaccaggccaaataagttcatttgctcattaatggctctgaggtcatggagcagtctccactttcctgactttttcttaattacaaaaattggagtattccaaggtgaggtagatggttcaatatggcctagttgcaattgttcctttaccagttgaatcacagcttccagtttttcagaggataggggccactgaggaacccataccggatcccctgttttccatggtatgggtcgtgctgccccaatggcccctagaaaaaacccagaccctgtctgtcttggtttccattaggtgagatgggctctgtccttccttgctcttgacgtcctaacccttttccttctttataacccatctttgccatgatatttcttgctttagctgaataccctctcgatggggcattctcattggacaaaataaggcccaaatgctgcataatatcccttccccagaggttagccgggagtgggagcacataaggtatgaatttcccttgctgcccctcggaggattcccatgtcaaggcaacggagcttatagtgggacatgattgatatcctaggccctgtaatgaatgagatgactctgtggtgggccatgctttgggccaccaatgtgtagagattatacttttatctgctccggtatcaaggatgccttcaaactcttttccgttgatcttaaggcggagcttaggtcgatcattcaaagatacaaccaaataggtagaatcatttctggaggagcccattttctttatctcaggtcctgcagatttctccctggtattatcagggaggagcagcagctgagctatcctatctcctttgctaatagaaaaaaaatgcccttacggcttgagcacaggacctgtatttcaggggaatgttgacaatccataactccagggtggactactaagccctgcaaggtgagtgaaccccggccgagaataaggcccatggttccaggggggcaaggatggtataggctccactggcaccggctgaatactcatttgagccattaataggaagtcggaggcggcacgcaggtccacccttgtgggtcttcctgggtcgcctctctgactgcttcctgggtcctgacaaaccggttcccatatctttgagggccctgggaccgagggcccgatggcccgttttttgacacatcagctgattggttatcaggcgggggaaggagtctgccctttatatccctcacagagcgacactggtcggccctatgataacccttgcctcacttagagcaaagagtgatggtccccccctttttatctggagctctgcaatctgtcttaagatgcccaagcttcccgcagttaaaacatgtcctctgatcatttctgtctatggagcgtttttgggattggaggattgcggccgctaagcccgcattggtgagaggttccccgagctcccgacaaaccctgagccagtcttgtaagcctttgttctttcttggggctatggccactcggcactcctgtgtggcttgctcataaatgagctgttctaccagaggtgtggtttgctctgaatctccaaaaatacgctctgctgcctctgtcattctggccacaaaatctgaggactcctggggtccctggatgatctttgttagttatccagtggcttcgcctgttcgggagagcgccttccaggccttaatagccgtggaggaaatttgggcataagctccccagtgatagtttgtttgatcagcggtataagctccctgacccgttaacaagtcaaaagtccaatctctctgctctggagtcaaagcagcagcgtttgctcgagcctgcgtttgtgcagcctcttgccatagagctctccattccatatattgcccatactggggagagcggcttttgcaatcatttgccagtcggcaggagttagtgccatgccggcaagcctgtctaactgcaccaaggtaaaattagcactggctccatatttacggaccaactcggcaagctctttaatctgtatatactctaccggagcgtgaacacgcccaccctgggctccttcaagtgatcggaaatgcctgttgcattttcctttgttcctctcttggaatgaaggagtctgcgcattgcctctctgtccattgcctctctgcccagggctgacgcattacacagggccggggctccacatagggcggaggtccactatgaccttgaagccgactgcccggaggccgagcagcaagttggccttcaccagccgcttttggctttttttcttgaccgattagctcacattttatctggctggtacttttctctctcataacgagctgcttcctcctccaagtctgtttcctcagaggggctaagttcttcatctgattcagagctactaagagctggctccttaaactcatctagtgatgggtataggctccttctcctagaaacctctgctgattgatcttttttcttttgtttttttctcctctttccttccaatctctccccaggtattcttccctgacattaacttttcctcgggttcaagacccgtttggaaaggcctgtatacttatttggtgcaccatgtttcctctttgctcctactctctcttcccgctttacttctgatagactgtcttgaatttcgtccagaattctccgccctgccttaaccacttgttgacatatgaaaaggaacaaaaaggcttctaacactggagaaagttcaaggccagacataccttgtaaagctgtaacgtgtcccgcagttttggttccaccctgcgaacgagggatcttccttgcgccggtgtgatggtagttcccgggtttctcggcgccacttatcccgagcttttgtccccgccagcaagaacctgctcaggacaactggaatcttctgcggcaaaagctttattgcttatttcttcaggaggcagagagcgaaaagcaaaaccccgtctcttttatggagaattgtcctccacctcggacgtgtcgctccctgattggctgcagcccatcggccgagttgtcgtcacggggaaggcagagcacatggagtggaaaactaccccggcacatgcacagattatttgtttactacttagaacacaggatgtcagtgccatattgtaatggcgaatgtgagggcggctcctcacagatctattttcatttttatacatacagactgccagttagaccagcactggtgattgaagatgttttcttttttccattatatatttttggcttctttgtcaaagatcaattgtctgtaagtgtgtggtttaatttctgggccttcagttctattccattgatcaatctgtctgtttctattcctataccatgcagtttttatcactattactctctagtaacacttgaggtcaaggatggcgattccttgttgagaataattttagctattctgttttttttggtcttctacatgaatttgagaatttttatacaactttgaacaattgtgttggaatttggatggagatttcattaaatctgtagatggcttttggtaggatgaccatttttactatgctagttgtaccagtccttcaccatgggttatctctccattttctccattttttgtaacttttataaaaagaaatgaagtacactgatttttaaacatagcagctcctatgtagtttgcttgtgtgtgctttctggttgctaaatctagatatagaggttagttttaagggagaaattacctttctgtttttcaactccttcacagactaagtctggctgtcttggaaatatctttgtggatagatcttgtacacatagttgtgtattgctctgtctcctgaatcctggagttaaagatgtgttccatgatacctggacctaatgttttcttcattagaacttgatctgttccaggctgttcttggactttgaaacctgcctgcattttcaaactcgaatcagaaacttaactgggtgaaattttgtctgagatcttcactctctcacttcctggtactcctttattcctcacaccatgagccttgtttttttaaaccacccctttccctttactgacttgttaatgtagctacctctgtaattctaggtacttggagcctcttatacaaattatattgcatgctcatagtttgcgtagttgagaaattttgtgcagtgggtgcggggaattaaaggggatcccacgtcccaccagagctccagtgctctgggcaagtggacagcaatctccgtgaggcccaggtgggcttctggctgtgggaagctatggatctccagtccacaggggtagagagggagcagtttctggtctctgggcctcacagaggccacagaccacaggttgtcagtcatggacatcccagatgtcactgtatgttgtggaagagctgagaacaaagtgagggccctgggggcaactctttcagccccagagctgaagggagaagggagcagggggataaggcactctgttactcccaggatgtgaaagtctttgttctggtctggtgactagaaatgttgagaggctttgctgctggttgtgatatgtggctctttagggtcaggcctattccatcattgaagaacagcgggctttgattagtggaaaggtggttcctggttttaaggtgtttattgtagaaagtcagagagggagaggtgtagggaattagaagccagccatggccatgtggagagagggaggaaaggatagggaagaggagagctagagatgagaataagagatttaagagcttaagagagagaggaggggccaaccatccccttttatagtgggctgggtcacctagcccttgcagcattaatgttgggaggagctggtaactgtgaggttggagtctagccagaataccaggagcttgggacattgtcaacgtgacagatagtcacaggattattcagttgtggggctctctgttatcagacacctgttttgggaatgtagctcactgttctgtcccttgtagagttttctactgggtttccaaactaagctttgctcaactaaaacaaaggctgcctttcacagtcctacagagaaatcctctaaagaatggttcttacattaaattttatattcttcaactcatggtttcatagttctttcccacagccttaaagtctgtcctgaaggtcataacattaccattttcctgagggatatctgacacattgttgcttcatcgaatcttactgtttctggtcatgtagacataaaccttggccgggagaacattctcccataatcttggcagcgagaacattccacttaggaggaacttgtagtacagtgtatatgttatcatttgagcaagccttatgcctacagcagccatcagcgctgtaggcatatatagtcacatatagtattgaccctgctctcttctattgctatcccagacctggaagacagacttttttctttaaagttttatttaactataggaatgttattctatatgtttttattttcactgaatgcctatatgaaacccgtggaaccatgaggtaatcacaaaatgcatcacacaagattcaggtaaaaatcataccttattttgtgtgtagaaagaaagaattagtctgtgtttcttttcatgaacagcaagtgcccttaaccccagagtcatctctctagctcagaggtttacatttctgctacagtttcatgatcgagcctgaatagaaccctgagttctatttttggaaaaatgaaggaagaatcataaatgatagtaatctttgccacccataatcatgttagatgaatgagctcaaataataaagataagaatagtaatgaagttaaagaatcataaaaggatctggtccttgcagtctataatcatgttagatgagtgatctcaaataataaagcaaagaatattgctgaagtccaaagattcagactttaagttggacagtaatagatttatgtgcagtaatatatccacaattaatgaagaattagtataattcttatgcaacttaaaacattcctttccattgtaaaaaatcattttactttttcattttgttgttacatgtaacatttatttactcaggttctcttaactattctgaagggaaaccactgtggaatttatgaaattattatctgtattggttttgtcatgtataagaaaatggtacatgacaataaggctacctaatgctaattttttgtttcactaaatattctcaaactaaatctataatacatattttaattcttcacgaaaagattttcttttaagttattcctgtgttttacattccatactctattttcttgttctagaaaggatgcaacattatataggccttaggatctcaggtgagcattttagactaaagtctggctgttgacacccaactgcatacaggatagatacatggtctccatttgagcaaaggtgacaggttttagaatttgttagcacagtttcacttaccatcagttaccatctgagatgtgatactgggatcaacaaagtattcttaaagatatattcctgcatccagacctcaaatgtatactttattatgtctcaatttttgctgactgtaagaccaatatgtcatttactttttactgaaagaagacacaatatagactatgatgatttttagatgatatcatttcttaaaacgacctcataattcttatgacctaacatatattctgttcttgattagcctgcagaatataacatgaattttttctctgaaagggaaccctaaatccagttataatatgtttccctataattggttttcatctgctgctttcataaagcaccatgatcaaggaaagtaatagaagaaaaagaccactttgggtaatgcttctagaggataaccatccaccatggcatggaggcctgacaacaaataaccaagttttgaaactcagtcactaaggaggaagagagagaactaaggtggctttggtctattctttctcggagtgcatacccccagtgtcattctatattcagtaatgttccatcaactaaatttccccaaacatcatgacaaactggggatccaacttaaaagtatgaaccagtaggaaacgtattcattcagacctatataatcagtcttctaatatccttgcacattttctttgaagattcatttattattatgcataagtacactgtagctgtcgtcagatgcaccggaagagggtgtcagattattatgggtggttgtgaaccaccatgtgttttctgggatttgaactcaggaccttctaaagagcagtcagtcctcttacccactgagccatctcaccagcccatccttgcacattttaactggttttgatatcaatgtagaaagtatagctttagtttcttgtttgggtttcctgtttgtttgtaagacagagtctcactctgtagaccttactttcatgtatccggatatggagaccagaacggcttctagcttacacaaatctgcctgtctgagccccatgagtactaggatgaaagacttacgccactgtatcaggcttgaagcaaacttttatctttaaatatttctgctaacatgcaacaacaattttgttgatttgttcacctatgccttccatgattgagctaggtcctcagctttcattgaaaccctgatatttgtcttttgcatcctgtatcttcctgaattggccctccattgagttaccatcagggttacagatttcatttcttgtttcatttcagattgaggattccttagaattttatatctcttggttcactgtccacagcctgcattatcataattatttccttaggcaattacaggagttctattttctatcattcagtttgttcctgtcctctttgagttcctgtgcttgtttcctctttatgtcctttgaccgcattgaatggtgtttgaattgtattttgagttctgtctcttgagtttgtttcataattcattttgccatgagcattggtatcacattagtgatttggggtagggaaattctatcaacgttatcaaattgcttgagttccagcctgaggtctccctatttaggctgaaatgctcagaacaagataactgccaggcagatgaggatattagattttactaaaatgtgaattcctagaacatcacagtatcccagatcacttgttgcagaagaagtacataatgttgcaatccctgctacataacaaactcagaagagacatgaagcaaaccttcaaagaaaacatatagaaataatccggtgatgtggcacataccacaactttaatcccagtacttgagagggtaagacagtaggatctggatgtcaagttcaacagtggcttctacaaataaaagaatagaaaataaaataaatgaaatgaagtaaatgttggttaaacaaaatatcaactaacctgtcctacaatccaacttccaaatatgcaagaagttgtgagtaaataatgtgtattccagtcttcttattatctagtctccttccctgcctctatgcataataaacttattttctttcaggaaatataattattaaggaaattctcacacattataccatggatgaaacttatatatacagtgaactaagtttatgaatgaagtatagatgtggctagacagtgctggattttgcataaccttgattatgaatgattgtgagccaccatctaggtactttgaacagaattctggccctctaggagaagttagcatcttaaccacatcagcacccaagtcagaaaaaaaatgtttcttaagtaaactttataattgtactaaggaaattttagatgtaaaagtgggcaaattcaagactgatcccaaggcatagcttgacttattaggctcatgaggctcccatttacaaagataggaagaggggctacactgaagatgggggggggtacaaatgaggaccttggctattggtgtatgattaagacactttcaatattccattttacttatatatcttggtgactaatttttttgtatattttatttatatttcaaatgttatcccctttccgggttcccctccagaaaccccctatcacttccccctgcttctttgagtgtgctcccacatgccccctcctactcctgtctcccttccctggcattaatgtacactgggccatcaagtctacacaggacctaggacttctcctcccaggcatgcccaacatgacatatgttacatatgttacatatgtagctgaggacatcggttgctccatttgtactctttggttggtgatttagtccttgggagctctggtgtgtctggttgtttgatattgttgttctccctatagggttgcaacccttttcagctccttcagtcctttctctaacttctcccatatggaccctgtgctcagtccattggttggctgcaagcatctgcctttgtattttttaggcactgccagagcctctcaggagacatctatatcaggctcctgtcaacaagcactaattgtcatccacaatagtgtctgcaattggtatctatatatgggatgaatttccaggcagagcagtctctggatggccttcagcatctgctccacactttgtttccatatttcccttagacaggagagtggggtgaaacaaatttaatctttgaggttgtgaggtctgatcccaagaggacttatatatcacatgtaattaattggaagacatatgtgagcaaacaaactctagtgtgagttttcactgtgtagttcatatatttcttgggtttctttgttgtgcttttattgtcattttagatagggtctcactaagaagtatgtctggacagacacttgttatatagaccgggctggtcttcaactaagagtcatctacctacatgtgctactagtagtgctgggaccaaaagcaagtgtacccaccacaggtttccatcttattttacataggtctccctaaatattctgtgctagccaggaaatgaagattccccatgcttcagccaagataccaagtgtgagcagcggcctactctttgcctttaatttgattattttttttaaacaggatcttattaggtttgtcttatcaatggttgttggtggagtaatgtgctaccaaccactctcagacagagtagatgagatgagtggcctgttttcccattctgttctcagtgttgttcttgaagcccaggtgaagaaaaatgttaatttatacaaaggcctgaggagagatgactcaatcacttagagctgtggatatttttgtagagaacctgtgtttgatgaccaatacctacaaggcacccaatgctgtattatgatagcgcaagcaagacaatgccaccagtcctccatcttgtgttgttgctaaggccatttcaggtttaatttgaatttgatcttcttgatgaatcctatgggaattactaaacttcatttctagaaacccaagttcaagatatcctagatgacttatcccagcctgtttgtgctggaatcccctctggctaactgcttatcttagattgtatcagacactacttgcttctgtgaggatcccacttcagctgcctcttgtgaaaatctggtgctcaggaaactcagcgcccttgctagcttagcccccttacctaggataatgtttaagaagcaattattgtgtatagttgtctccctaaagaggtctgtatggtttttttgttcgactttttattagatattttcttcatttacatttcaaatgatatcccgaaagtcccctataccctcccccaatcctgctcccctacccacccactcccagtttttggccctggcgttcccctgtactggggcatataaagtttgcaagaccaagttggccatcattgggaagagaggtctgtatgtttaccctgatatttgctataataaatttctttccttaacacatctcagagtcattattaatcatcaatgtgtttaatctattctcataggcagcatctattagctggtgctatcactttttttttttttttttgcataagcttaatgtgggaaagtatataattcaccacgatggaaagcaaggagccctgccatctgaacgatgtccaagggctcagaatcatgtactttaaggacagacctcctggtctgggcttgtgtttctgagctttcacctccatgatgagctagaatctatttcaaactgtcaaaatcatcacaacagtttttgaacctcagaagtcttctgagacacctgggcctcattataatcatgaaaagagttgatttcctagctagaatctctaaagagacttggataattctggagaccccttccccctgcttatgcagatgtgcatgcatgtacattgagaattatagagaacaatcagcaatctatttatgagaaaattttaaacagtatctattatagtcctaagtgtagttgttgtttccttatttttttttagaaaactctggacagttttcccaaggtgtttctctattttactccaccacacattacaaacaggatatggtactgtgccgtacccaacattatttcagttcatcatttctttgactgaggtgttccagcaactctacaatgtgttcaagcctggtattttgtttcccacaggaactcttatatttttctttgactcacaacatttttcatttcatttttgtgggtatttctaactacttattgaactcagttttcatatcctaagttgtcctcatttccttcaggcacctgctattatttcttattcttgaatcattgtgttcctgtcctctctgagttgattgacatgctctacaagctctacaatctccttgatcctgactctgggttttcagttctgtatcttggatatcatataaattgccctccttaggggatatatattatactttgagagtacgacattttaacatcataatttagagggactattttcttttttgagtttttagcccaggagtctggtatctcaacgtgagaaattagtcagcataacttgattttgattggcccagaacccaggtgcagtgtcctactgtgtccagttctggtgcacaatggcagcaaccatgtggggaagctgtgtagtgtaggccctgggcatcctgacagctgcagttgtgtggaaggcaccctgcaacagagttggttgagtggtacctgaggggagggagagcctacttgccttattgggtgcatttaggaaaataacaaaaaacaagcaacgaagtaagcaaacaaggaaaaccaaccaaccaaccaaacaaacaaacacagctgagaggtactgggaagtaaattcattaaaagggtcctatgggttcaaagaaacatgtaacaggaagctgctgtatactgggtggatccagaaggaattgccccaaggaactaggccatagtgacaggaaattccaccacttcagtttctgtgcatattctggatgtcctcgtggtcaggaagtcttggggtgacactaaagccaactattagggaaactcaaaaacttccttaggctacagttgctctgtgggcattctgggagagtcactagagataagtctgtcctggaacctgccatgtaagaggaactggcgggagtaaagcaggtgtgtggagcaggggtgattttctgcagccactctcactattgtgttgtgaatatcttataattgtcaggaagtttgagatcctattgaggtatgaaaatggaagcccgtagatgtaattttagacaaaaaaaaaaaaaaacgggtctcaaggttagacatgtccagccagctgcagctactgggagttactagcactactacatattttttttttctgccttctttcccctgaagaaataaaattcctgttcagtcacctaacatgctgcatcagggacggtttgcatactaagctggaatatacactggtgtgaaatggttcagagttgagccctggtggtctttgtggtttcaatatctgggcataaaactatgaactggggttcactataatgttttaataaattttatggattccagaacattcttctaaaacagcattgtagatcctatgcagtatctgtagtttgtacatggagattctctttggtaaagccttaaagatctttttgaattcaaattcatccattctttcttaacacttgttttcctccatttgccattttaagagagtacatttttgccaggagaatgaattcatatgcctcctcagagagctttgtagatattaatcatatgaagatacagtgcaggtttgattggattagaaagtttacattataaagcaccatcatatgggttgtgactattaatatttactgtgtgaagttatattctccattaaacatgaagataagatagcagtaagatattgctgaggagaagatctattgtaggttctgttaaccctgaacgtcaccagagaaaaaccaactacagcatgtggccaagatttattaaatattacatcctgagaaaaagacagactttggacacatgctacagggagttttaaagataatcacatagttcattgtggtttcccatgagtctttatgattttcctttgtcttgcacatggcagcattccagtaaagtacctggttcgtgggcaagtggtgcttattggttaatttggggctttacagtctgagggagaaaggagccagagttttctggctgggtctaggcataaccagcccaggagaagaggggaaggggtatggaggaagtgaagagaggatagaggcctgggcaaaagagcaaccaggagccaagaaaccacctagccaacaatgtccacatggatatgttaattgacacaccagttatcgttttatccagtgagagggtcactggcaagagactttggtctggtccatggctggagcccaggaaggccttcaagctggaggttacacaggactatttagaggacagcctatcctgtttttttaatcatggagggccttgatgaacagagacagtctatagttttagagctttattgtagaaaggcagagagaaagaagatagaaagagagaaagagaggctggccatggccatgtggaggggggagaggctcggagagagagagagagagagagagaaggacagctagagatgagagtaagaaagttagagcttaaagagagagaggaggggacaagcagaaccttttacagtgggctgggctatatgctgttgtcaggtaactgtggggaggaacataccttactatagccaggtaactgtggggatagagtctagccagaatgccaggagcttgggacattgtgtgacttatagttacagaattatggagttgggggctctgtggtgtcaggcacctttctctgggaacgtggctcactgttccatcccttgtagagtttttttactgggtcacctgagcaagcctcaatcaaccaaaataggctgccttccacagcacctcacttggctgttgtcaggtaactgtggaggtgtaatttagttgcaaactcatgttttgcacattattaatgctcacaaccctaatttgagaggctgaagtatgctcatgtcattgtggacactttcagaacaattccccttatgtacattgatgcaaaatactcaaatactgaatccaaatactaagaatctatccaaaatgatgaagattgttttctcatccaatatatctggaggagtttccattccctctagccttctcagttcctgtccactttttctcccttctggatctaacccctttctgtctctcagtaggaaaacaaacaaacaaacaaacaaacaaacatacaaaaatccatagactcactaactgacaaatctgtccccaaaaagctaaaagttataatatatttcaaaagaactgttccaggcattagtatttgtacatcaccaattctagtctcaaatttctaatctatatttgtgcaatttttgtgtgaaatattttgctgattgctaaaaaagtatattttctatggctcattataagtgaagatatcaaaaagctaaaatttcaaaggggaagaaattttttggctcagctatgagttcattagtcaggatgaaagactattattgatgtttactggataggtgatataaatgtgggagtctctgcaaacactagttctggtagagtaacaacccattagacaaaaaagaaatctagttcaatacctctctgtaattatttcagcactggttgtgggtatgctgtgggttattgccaatgaaattcctacagcactcagagaaaaatctttcccagtgcctgtgttaacatctgaagtaaaaagtctcctggtagttgaaagacccacaacgtgaggactcactcaggagaggcgacgccccaaatcacacaagaaacagtcttgctgcaactgcaagaggatttttattcaagagcgctctccggcccatggtcatataccacacaggggtagaggaccgtggtgccccgagtagctggataaggggctatttaaagggagaaaccacaactcaaggaagcagggagggcattgttggaaaaaaataccaaagataccagttaagagtcacaaggaagtgcaaagtcacaagtgtcacaaggaatacctggtaattgttccggttaactctcaagacagtttctaagagcccctaacaataccacctttgcatagcgggttccgggttccggcaatggtcagggtgactttctttgaatgagcactctttgaacccaggaagctggtgttttatgattagcacaccttcacaaaggccacattcccaagcctgggcctaaaggcctagaattctgtttttactttgttatactttcattccccccttctacttgttagtagttctaatcttagaactagacaccatctcttccctgacatacttgatcctttagggcatggtactgttgtctcaaaactaaaatctacactgcactaatttttgttctaataagggtgacttgcctatttaacacacatggacctataattaaaagcagaagcaaaatcaaaggggtcccataaagaaagaaagtagggtggtcaagagtacaagataagggcctttccactggagtctcaaggttttctgcttggagacgtctaatgtagcaggtcttcttttcttgagtaggccttctggagctgctttttcgctcgctgtctcactcactggagcaccttgagactagagaacaaaggctaggaaagcagcatgtcagcactatgtacagaaagctatttttaccaatggagggggccccctgtagagtaatttatagtggggtcagtctaaactgtccaggggtgtttctatccctgaaaagcacaaagggtaggagagctatctaatcattagcgccagtctccgctgtcaatttggtaagggtatcttaatggttctattcattctctctacctgtcctgacctttggggcctgcatgcacaatgtaacttctaaccaatctctaatatcttggccagtccctgatttacctgggcaacaaaggcaggtccattaccttgggaagatttcttttaggatcttcagtcctggtaggaaaagcttctatccattttgaaacggtgtctataaacactaataagtacttgttgcaatatctagctggcttaatttctgtaaattctactttgtcatagcacaggccttgcagcttttggctatttcttctgccaagtcagagagtcctgtaacatcgtagtcaaatgacctaaccacaccttttaattttttttggcccctaggtgggtcaaatactgtccataacttgatagtgctcagcggtgtatctaaagctggtttccctgatgtcataataatctttaggttccttgactgccaggattattgctccttgggccacctgtttggccgttagatctgctatctgattttctttagccacagtatcttaggtctttctctgccgatgtcaacagccctctttcacaagttcagctttctgggccgatgtcccttcagggaggctgctggcctagatcacttgctttatgtccaccaccgtactgctgtccccgccttctgcttacctttaacctcgaggctactgtgatccgtgtaccagctcaaaccctcaggccacggctgatctgatccttcagatcatttcaagtaccagtttctcagcgcagtgatgagtaggtgcagtctcaggcagtgggacagcaggcggaatgaagcgaaggtcactcattcagtcaacaaaaagttctgatgtgtcacaggagcgttggtcgccatccatcagtcaggggactttcagataatgctttcaagagcgtggggtggggtgccactacagctagttactgtcccagagtgagcttatcagcatccttgacaagcagattatggcaacaatagctttcaggcaagaaaaccacccactggcaacagggtgtaacttcttggatatttaacccactggcctttttcaaggtcttaaagtctgagtaaggacttctctggcgacccctgatctctcttccacataaagagtgaaaggcttggttaagccaggcaaaggctggccatcagtagggcctttttaatctcttcaaaggctttctggtgatctggggtccacataaacacttttccttccttggttaggtggtacaacagggcagctaaggttgccaacccaggtacctagagtctgtagaagccagcagtacccaagaattctcttacttgccttggtgtagttatagtctttttctggcttcttttagccactgttttctacctcgaagggtgtatctcaaatagataacttgagtctgacacagctgagcctctttagctgaggctcggtctttagttgcctaggtttcctgtctagatcctgtcttttttttttttttttctcctaccactgtggcaaatttctttcttgtctacgatctctcctgttttctctttcttttgcctcccgcctctctctctctctctctctctctctctctctctctctctctctctctctctctctctctctctctctcacacacacacacacacacacacgttctctgcctctttcactagatcgagtaactgcctttctctcttgtaatacaccttctaatctctgaagtttctttctgatatctggagctgactgccttatgaaaggccatggccactgaggccttctgggcttctgaggtaagatcaaagggagtgaaccgcctgaaggaaccgcctgaaggaacattgagggaggttcgatcccctcctgcattacctcttaccttagccaaattagttggcccatcttgaggcaccttggagaccggagcctggcgttagattttcaagctctccttaccttcagccatgtcgcagtcgcaactggggtgagtcaaaaggaatcccatgtcgatctcattttgtagctgtgtaggccgccccttggctcctgggctatttttctagcctctatcagaattctctctcaatcttcggttgttaagagcatctgcaacagctgttgacaatcatcccaagtaggctgatgagagaacataaggaactccaccaaccctgtgaggcgttggggatcctgagaaagggggtgcttagttttccagttataaagatcagcagaggaaaatgaccagtactgaaggtttaacgtttgggcgggtccaccagagtccgcccagacactgtgctctgcggctccatgtacccacagccgtccgcctctagattttggaggagctgatgggtttagctggtggctcctattcgggagaagccttcaatttctcttgtaacatgaaagtacaaccacaattttgagaagcaaaacccaattttaacagtgtaaacaacctattttttttaaaaaatgaactccaaaaacattacttgctacaaagtttggctgcacacaaacacaaaaagacacaaccctaaatcttatctgttataaatcgggtttctaggataagaattacatagaaaattacccaatttaggcgtatctttagagacctgttcccatgggttggctcatgctgcttgttgtagttctaaattactataacccagagttaccagttttaagccaactttttgttaccaatgctacaaaattttaatcataaccaataacttatgagccactaatctataaccaagacatataaaacatatttatactttttaaactatttagaaacaaaaatgaaatggccgtatacatttgcccatttaaaccaaacaaaattcttaatttttctagctgtaatttcaagagaggagcaccttgtcacccgatgaatccaataatcacaagcacagaaatttttgtaggaaaaacagccatctgttcccttaccatagaacttgagaagctgctggtccctataagagcagcgtttataatcagcacctagcagggcttctccagccacactagattcctaactacaggtgcagggctccaaagaccaattgatactgtttattttattttattaccaaattattcccagatagtcggagagtactgcttttctcaaaacctattctctcacatctcacgtgtaaactatctctagtcagggtataaagcacctatgagaattacctttgcttttctagattttcacatagctctaaactcatacacaaaaccacataaaacagaaaccaacagatccagacacatttgaccctttcttgtcctccacaagcaggcaaaagaattagacgattttggagggggaagcttccgcttcaacagaactcggtccctctgaccgatctcccgagacagccaggcgtccctggctctccttacttcccagggtggcagcctgtggtcctcctagcatgtctgccgaccacagtcctttggtcctttcagcccaaaaggacagctgcaaatacagactgcgcgcatttcagaaaaccccttcactccatcgtctacaaacactgtcatccacttctacctagacgacccaaaccagagaagcacactcgttcctcactctgccagatgtaaaaccaaggcacaaggtgggatttgaacccacgatctcgtaaccctgaaacgaagacacaaattcaataaactcagatggatccaaactcagacttcgccgtgcttcagaaacataggacaagacaaaaacaacccaacacaacaagcacatgttcaaatgttcgtttcagaaaacagacactcaaaacagagacaccggccggcacacacacaagaggggatccccatacctccaagtcagttctcgggagtaaggggtggtcgcgtttcccggccaacacaccaaatgaaagacccacaacgtgaggactcccccacgttctgactcaggagaggcgacaccccaaatcacacaagaaacagtcctgctgcaactgcaagaggatttttattcaagagcgctctcggtcccatggtcatacaccacacaggggtagaggaccgtggtgccccgagtagctggataaggggctatttaaagggagaaaccacaactcaaggaagcagggagggcattgttggaaaaaaataccaaagataccagttaagagtcacaaggaagtgcaaagtcacaagtgtcacaaggaatacctggtaattgttccggttaactctcaagacagtttctaagagcccctaacaataccacctttgcatagcgggttccgggttcctgcaatggtcagggtgactttctttgaatgagcactctttgaacccaggaagcaggtgggtggaggaatgtccctatctgttttatgattagcataccttctcaaaggccacattcccaagcctgggcctaaaggcctagaattctgtttttactttgctatactttcagtactcagaagtcaagataaactacaaagccccatgggacaattaaccacacacaagataatgactgggaagaacactggagggaggctgcctctgctcaggtgagaagcagaagagaaatgagtgggaggcaggctttatatagggtttagttgtgggtgatggatttttcaggatttgaaatatctgtggttggagattgctggtattttatgtcctgagcttgagcaaactcagggatttctgagtagttaaaaccagtaagtatgctatccattctttctgtagacaatgttgagtgtaacttttagattctgatcccagggcggtttattttaattcatcattttctttgactaaggtatccagttcctctaccttttgtcctagtctaacaatctgtctctcacacgttctctatgtgttattattatttgccttactgcattttcttttcaggatcttttccttgtttatttctaagcacatattgaactcaattttcatattctacgttatcctcctttcctttaggcatttgctattattctctagcccgtgattcagtttgttcccgttctctttcagttgatatatgtggtttacacactgtaatctctttgatcatgacttagggttttctattctttacctaggatatcatgtaaattgctctctttataagatacatacacagttgatagtttgagccaaagacattttatcttagttttactttgttttgggtattgagcatcagattcagagggactgcttaattgtgtgcatttttagactagactcacaatgtgagaagttaggcaggatctattgtatctgaaggattcagaacccaggtccagtgtcctactacattcatttctggtctagtctggcagtaaccttgtgggaagctgagcagagtagatcctgagaagttgtgtttccacaacatagttggaggagtggttcctgatcggcagggtgggcctcctgcatgattagataagattaagaaaaagacaaaataaaaacaaagaatcaatcaatcaatgaat

SEQ ID NO: 228 - DNA, 278212 bp, Mus musculus
  modified_base (140021)..(190020): a, c, t, g, unknown or other
aaaaacctccttctcattatttataacactggtgtgtccacaagtactcccactacactcacatccatatgcaatatgcatatatatatacatatatatatatatgtatatatatatatgcacacacatatatatgcacaaacacacatacacacacatatatatgtaaaacttttcacaagggtgctttgggtatttaagtcaaattagatattgattggttattcacaataaattcatgacatcattgacctagcatattttggaggaaggacaaattttagatcaatgtctttttggttggttctgtgtatgtatttcactttttgtagcttgcaaagcccttcccataacgaggactgtggaacgtaagagccaatgttcttggaggcaccagcttgacctctttatacacagtgagttgtgcaagtctgctcgttagcaatgaagacttattgtcagtttgtaaaaagcaacaccttttgttgtcggtgccctgcagtgttcgtttatttttatgaaaccactttgtagaacaactcagttgataaaacacagtggaaaagacaagatcaactggaactccatctctttcagaattcagagacttaattataatcaccttcatacacttataagctggttctttaaaaaaaaaaaatccaaacatcttactaagaatacagccagccgaactccatggagttttgtaccatggggctttcctatgcattggcagaaccacaagtgtggcaatgcagtatacaaaagttcttaccttctaatagatggtgacttttcttggaccttacaaccagagttaatgcaacttgaagaaatttaaaatttaaaactgcagtcctactgtgtattcaaatttatggtttagctttctttttcaaagaacaatgtaaaaacaaacattattttttccttgtatttctcttgtgatcaacttttaaaacctaacgtgatgcattggtacaataataatttattgatacaatggtaatttatgtactttttcaagtcatgtccagaactgcctgagtgtcatttgttgaaagcatgaaatgcagaggctcagtgcaaccttctaaaatgaatatactattatgtgtactgactgataaacagtgatgtctgtaaatgcttgttgtcttgatcacttggagccagttacctcatcctttttaaaactctgttaaagatttctgtatactataccattccttctccatgtaatggggttttcttggtgttcccaaaaatattgcaaaggtctttcttaagaccagcaatggagatacaaaagccaacagacatacatacagagtacacagatagacacaaacagggagacagaaggcagacacacatgtagagagagatgcacaaggcagtattcagcatgttacagatttaaattaactgaatagacacgcaggatggaaggctcagataagagaaagtagagaattcaactttggactcacacttagttaaattaactaagtttaatatgttcacatatgcacaatcaattaacttgtgacctaattttcctatcttttttttttgcataaacacaatatgggaaaatataaaactcaccacaatgggtaacaagtagccctgcattcttaaaggtgtccgtgggctcagaaccctgttctgtaaagaaagaccatcaggtctgggcttgtgcttctgagctctcacttccatgctggcctagaatccattttaactctcaccgtcatcacaacaggatttgaacctcagaggtcacaagagaatcctggaactcattactttcattaaaagagttgacttcatgccatattctctaaggtgacttgggtaattctcgagtctcctttccccagcttatgaagatatgcatggatgtacatagagtattatagagcacaatcagggaatcttctatgaacaaatggctaaacagtgcagtatgtattgtaggtctctgttttcttccttccttccttccttccttccttccttccttccttccttccttccttccttccttctttccttccttccttccttctttcctttctttattctttctttcttttgccaaaaatctagacactttttcaaaggaatttttcttaattgcctcaccctccaagcagtaaataatattgtgcctaaacctaacatcactttaattcatcattttctttgactaaggtatccagctcctctaccttttgtccaagtctaataatctgtgtctcacacgttctctatgagttattattattcgccttactgcattttcttttcaggctcttttccttgtttatttctaagcacatattgaacaaaatttttatatcctatgttgtcctcctttccttcaggcttttgctattattctcttgcccacgaatcattttgttcctgtcctctatcaattgacatatgtggcttacacactttgatctcttttatcatgactctggattttctattctttacctaggatatcatgtaaattgctctctttataagatacatacatagttgatagtttgagccaaagacattttatcttagttttactttgttttgggtattgagcaccagaattcagagggattgcttaattgtgtgcatttttagcccaggagtctagactcccaatgtgagaagttaggcaggatccattgtatctaaaggattcagaacctaggtgcagtgtcctactacattcagttctggtctagtctggcagcaaccttgtaggaagctgagcagagtaggtcctgagaagttgtgtttccacaacagagttggaggagtggttcctgatggggagggtgggcctcctgcttcattagataagtttaagaaaaagacaaaataaaaacaaagaatcagggctggtgagatggctcagtgggtaagagcacccgactgctcttccgaaggtctggagttcaaatcccagcaaccacatggtggctcacaaccatctgtaacaagatctgactccctcttctggagtgtctgaagacagctacagtgtacttacatataataaataaataaataaataaataaataaataaataaataaataaacaaacaaaaaaaaaaccaaagaatcaatcagtcaatcaaaaaatcaatcaataaattaaatatgcaagcaagcaaggaagcaaaaatccaaaccaacaaaaattgctctgaagaactgggaagctaattaagtaaaaagtcctgaagtaggggggcttagatgaatggcaggaagctggtgagtattgggcgggtccagaaggagtggctctgaggaaccaagaggaagtgactggaagttccgccatcccatcattttcgatgtatctcggctgcctcgtggtcaggaagccatggaaggagactagtgcctagtatttgcggaacctgaaaacttccttaagctgcagttgctgtgctggcctcctaggacattcagcagctggtcctgtcgccttccaggtcagaggagttgttgggctgagaaacgggtaggagcagggcaggcatgtggagcaggggtgcgttttctgttgctactcttacaattctgttatggatatcttaccattatcaggaagtttgagttcctgtgaattgagtttatgttttaattgattttatggttgccagaatatttttctaaaacaacccagtagatccttggccctctctggacccttggccctttctggaataccggaagggaaaggagaaggggaaggggaaggggaaggggaccctgaaaagaaaatgcagtcaggtgaataataatcattcatagagaatgtgtgtgagacagatgatcagacttgaagatatatagtaggttctgttaaccctgagtgtccccagagaaaaaccaatttctccatgtggaccagctttatcaaataatacatcctgaccaagagatagactttggtcacatgctacaggcattttataggccattgtagtttcctatgaggctttattattttcctaagacatgcaacctgcagcacttcaagaagatacctggttcttgtgctggtggtgaggttaatttttggcattttactctgaggttgaaggaatgaagagatatctggttgggtccagactgaaccgggccatcatgtggtgggaggggaattgaggatgtgatggaggatagaggggcaggtcaagagatcaccagcagccaagaaagtacctatccaaccatgacttcattgatatgttaacaggtaccactggtagccattcttcctgaatttctttgaatttttccaaggttcagcccaccatgctgtgctgtgatgatttcaggagtagatattttaataagtggaaatttttctatggatttttttttgtttgtttgtgtttggtttttgttttttttttttttgagacagggtttctctgtttagccctggttgtcctggaactcaccaggctggcctcgaattcagaaatccgcctacctctgcctcccaagtgctgggattaaaggagtgcactaccagcttttactatggattaagacaaaattagacagcatcttttgaataattttgaacacttacttactgaattactgtctggattctggatcagaataattttcttccagtcttctgtcctcctcttctgtattgcttggaaaaagactctatgtgtgttaactgtgtgactgactctcacatctttagggtaaactgaaatactcagaaaaataggcattctcttgataacttctcttcatgtttatccttttctcgggtattgacatctttcatttttgttccatgaacggtttcatgttcattctaaacaatatttacccattttcaggtctccctatgctcagtcaactctccataactgtaaatcaacactaagagcactagaaggttaaaggtcaaggagactctcacaaaggatccaggtatgttagaggtattgaacaatgggtggagttgggctcacctgtgagtagaaagaggacatgaatttgattttcccagattctatttccttaatgattctggaaaagaataatattagaagtgatgatatggatttaccatggaaggaagtgctgtcagctgtcacttgatgtcaatatttaattaattttgatcctgggaaattgctgttgctcattgaaatcaaagtttcttttatccagattgaaagcaacatcaggctatggttgttataagggcaatttatacataaagcaaatgtcagcagtagattccctcctagggcctgtgaccttacttatcgtattttttaggcagattttcactgtaatctatggatttttgtttcctgtggagcttgaaagagaaaacctgttacccacagatattcttgccagtatcataaaaatttccattttggcagattcagattggagcaagcaggttgcaaacctgagtatagacattgataactctgcttcctgccccaatttgcctagcaatttttttcactatggaagttcccaccggggtgtctaagatgtctgttgagagtgaatggtctgatatgaggtggctttctccagaaggtctatttgctttctgaatcacctattctatccactctaaatgttttcctgtccttgacctgtgttcttaattgatgttctgtgttgcattaatccccattagagtagaataattatttttgaccttctctgtactggttgctttagttttgaatctgtttgccttatttctgaggtatgtttcttctcttctatccttgagagctttcatactgagcagtgtctactttttgccacagggctgtataagtaagtttcattctcctattgtcagcataatttgggaggattcctgcctacatctattaacctaggcctagtcatgtaagcttctactctccatacagtattatctaggcctgttgtgttttcagcctctgaaatttgctgctgaataagccccccctccccccaccttcttattccttctcaatgcttacctggctgattcaattcagtttttccagctcaaactcctctctgagctgagttcttctctcagacactgaatttttccacttggccttaaattaactgtagaaatcttttctcatcttctggctccttctctttctcctgctcattctgtctttacctgttcctagcatgttctctcttcagtctgattctgtaaaactctcagaacccacgtgcagtgtcctagtacatccagctctggtctagtctggcagcaacattgtggggaagctgtgcagagaaattccagagaagttgtgtgaaactgcaacagagttggaggagtggttccccaacagagttggggagggtgggcttcatgcatgattaaataagtttaagaaaaagacaaaattaaaacgaagaatcaaccaatgaatcaatgaattaagtaagcaagcaattaaaaatccaaaacaataaaaattgctgtgaagagctgggaagctaattaattaaaaggtcctgaagtaggtgggcttagaagaattgcaggaagctgctgaatattgggcgggtccagaaggaggggctctgaggacccaggcagaaatgacaggaagttctgccttttcagcattctccttgtaccttggctgccttgtggtcaggatgtcctggaggaagactagtgcctagtatttgcagaacctgaaagtttccttgctggcctcctaggacattcagcagctggtcctgttgccttccaggtcagaggagctgttgtactaggaaatgggcaggagcagggcaggcacgtggagcaggggtgcattttctgtcgctactctcacaatctgttgtggatatcttaccattgtcaggaagtttgagatcctgtgattttggttcatgatgatgttttaatcaattttatggttgccagaatatttttctaaagtatccttgtagatccttggctgcatctggagtttgtataccaggaggtttgtctttgcaaaagcctttataaagcaactgtaattaaaattcgttcctgctttcttaactcccctgttccttcatttgccatttcatttccctttctccagggaactgagtaggcatcctgagagagccttgtagatatttgtcatatggggaattggtgaagatttgattgaattagaaaatttacgttataaagcaccatcatatggctgtatatattcacattaacctaacaaagttatagtctccgttagtttcacactgagttatatgtagtcattgatgtaaatacagcatccagagatgtggcttcatagtcttagttattaatgttacaccttaggtttcattgaagcatgaaaacaggtttgcagcaatgaacaactaaggagaagatatatagtaggttctgttaacccttaatgtcgtcagagaaaaaaaaattctacaatgttggaaagctttttaaaatattacatcttgaccaagagatagactttggtcacttcctacagctggttttatatgcccttgtcattttctgtgaggccttattattttcctaagacatgcaacctgcagagctgcaagaagatacctggttcttgggcttgtggtggggttaacttttggtatttcagcatgagggagaaagcattcagagttatctctttgggtccagactgaaccagttcattagatggggggaagggaattgaagatgagaaggagaatagaggtcaagccaagagttaaccaggagccaagaaagcaccatcccaatccctgtcttcattgatatgttaatagttaccccagttagcctttcctcctgaattcttctaatcctccaaggttctgcccagcatgctgtgaaaggatgactctaggctaagatatttttataaatagaaaacttactatggattaggacaaaattaaacagcacctttgaaataattatgattgctcactttcttaagaaaaatgactccttgtttcatgaaaagcactttgcccatacacattcatggtttgttgagtgctgcactgtggagttcttgcaggtgtggtaatgcttagaccctgcattcagggtttttttcagcaatctcttgttggagaagttcaacagtttggatcctgcgtgtcacaatagttttcttacattcttccttgtttctcagtgattctgggaaaaggactctctgtgtgttaactgtgtgactgactcaagagtaaactgaaatcctcagggaaaaagagacattctcatgacatcttctctttccttcatgtttatcctttcacctggtgttggcatctttcatttttgtcacatgaaaaggtccaggtttttttgaatgattttcccattttcaggtcttcattttctcagccaaatctgcataaatataaatcaaatctaagagccctagatggtaaaggccaaggagactctattgaaggatccaggtgtgttagcagctttgaaaaggggtggggtggggctcacctgccagtacagagaggacatgaatttggttttgccagcttctgtttcattaatgattctgaaagatttcactaagaatattagatgtgatgatatggatttcccatggtaggtagtgctgtcagctgtcacttcatgtcaatatttaattaattttgatgctgggaaattgctgttgcccattgaaatcaaagtttcttttacccagactgaaaacagcatcagttaatgtgtttgaaaagggccatttacacaggaagcaaatgtcagtcttggattcgctcccagggcctgtgaccttctttattggattttagccagaatctctgtttagtctatgtatgcttttcctgaggagccggcctcagcttgaacaggaaagccttttgttacccacagatagccttgccactatgatactggcggccatgccttgcctggcagattgaaattgtagcacacaggatacaaatctgggtatggccattgatagctctgcctcctgccccagtttgcatagcagtttctggactctgaatgctaccatcagagagtccatctacaatatttgttgacagagtggatggtctgatctgagttgttcttctccagaagatgcacttgctctctgaatcacatcttcggtccagtctacacgagtttaagtccttgaattgtgttcacactgatgcagtttgttgaatttggccttattttattgtggatacaaacaagagcttgctgacaggaggctgatataactgtctcctgagaggctctataagtgcctgacaaatacagaagtgggtgctcacagtcatccattggacagtgcacagggtccccagtgaaagagctagagaaattacccaaagagctgaaggggattacagccccatagtaggaacaaaaatatgaactaaccagtatacctagagctccttgagactaaacgaacaaccaacgaaaacacatggtgggactcatggctctagctacatatgtaggtgatgatggcctagtctgtcatcaatgagaggagaggcccttcgtcctgtgaaagttctatgccagaataaaacaccagggccaggaagccagagagggtgggttggttagcaggggtggggcaataggataggggatttttggagaggaaagtaggaaagtgcttaacatttgaaatgcaaatgaagaaattatcaaataaaaattgaaaaaaaaaaggatggaataatctctttcctgccttgtctggaccgtttggtttagtttcaagtctctttccatttgttttctgaggtgtgtttcttctctttttacattctagaaagcttttatagtgagtggtattagattttccacaggactgtaaaactaacctttattctcctattataattattgtctgggaggctgactgcctctgtctaattatcatggcctagtcctgtaagcctctagcctctaaataatcttatttagtcctagagtgttttcagcctctgagatttcctgctgattaaactccccctttcttgtttgtttatttcaactccttttttaaaaatattttatttttttggttttcctgacatggtttctctgtgtagagttctggctgccctggaactcactctgcagaccaggttggcctggaactgagaaaagtgctgggattaaaggcatgcaccaccactgcccagcctcatttcaactcttacctggatggttcatttcagctgttcaggctcaaactactttccaagctgactcattcagcctggttctcagacactgaattgctctgcttggccttaaattaactgtagcaatctttttttaaatcttctggctccttctctttctcctgctcattctgtctttgcctgtgcctagcatgttccctcttcaatctgactctgtaaaactctcccagtaaaactgtgtccttctccctctctgtggctctactctctcaactgtactgtactgctgcccatgcactctactgtattcctttaccattctcttcttcctgtactgtctttctctttcttaagtagcttcccccttcctctctcacctcaggagtgttgggcatatcctgttctctaagatctttctctgatatttcacattttctgctattcaattagacaacactttcaaacatgtgcacctccttctacttagtaaatgtactttcgttgtttgggattaaagcaaatcctaaaggcttgcttgtattcaaccacagtgaggaaagctgtgtgccttgtgctgaaccacaccctaagtcagaacaggcttgaatatccctacacaataatttagtttggcagaatttcttcctgaactgtaaaccaagattcacaaataatagtcttcattatgtagatagctgtgctttctattctgccttctaccaacattttcattgtgaacttctttgatgattggtcaatgaaaatctgttgtaaatgaggaaaatacctaataaaaaatgaaaaaaaaaaagaaaatctgttctttgcgagactgtattccttagcatttgcaatctaggtttgcgggcattgtaagtggcaaaaatatggttcctattgtctccattctttgtatgagagagagctttactatgtaggacatgaggaatatttcctacttttcttatattcattcattcttcacaaaaaagatgtgttattcccgacgttctcatgaaaattttatgtcttattcttttgtgcatatttttattagattattttctatgtaggtttttgagtaaaaaggtgtctaaacttatatatactaagttcaaatatatgttttacactgtcaatacttatagccacttttctgaatttaacattacagttgccagttattttctctcaggacttgaaaaatatgattccatgctctcctgattttaagctatggataaatatttagtactactgtatgctaatataatatcacctcttttgatggtaagggctaggacaagacatctggaaagagataaacattgttacagcacttagatgtgacaataggcagatacaccagagagtacaggaatccaatatctgagagactttcctagggaatgctaggctagaatgctatggccttctagtactcaagagtcccaatgtttgcacactgcatgttgctatttgagtttatctactgtaaaacagatgtgatgaaacaagtgatagtaaactttgactggaaggctcaagcgtttggaattgtgtctattctggatcaggtgtgtatttgaggaaatgtcagttgcaagatttaaagtcgaagccctagtgttcatattgacttcatggtggaagtaggtaaacccaagggttattcttcccattctagaatgagctcttgttcagtctccatgaaatggaagatgtgcttttcctattatacaattagacaaaacaatcccaggacacacatttattttatgtattacttacttttgaatttaaagtacaacatctgtcactggagcaggaatttatgatctgttgctggtagaaatgacgatactcaccctgtatgtcaaggtaagaatcataaagtgacatactttgaaaaatgtcttcagtactccctgaaaattcatgtattcctatgcccattttttattacactcttgatgctgtctacaaatgcccagggtttcaagttttgagtattgtaaatttatgacagcattgtatttttccctgcatcttcgatttctgttttacagaaattcctgttgtcagtaaattttctatctcatgaattagggattatattcatttctttcatgcatattacaattattagaatattcacagagaaacattctgttagaggatcttcattatctggtttctttggtgttgcagatattacaaagctcctagagttcactttaatctgtgatctctaaatcccctagtgcttgtgttttcaggtgaatggccttcgcacatgaccgtgccccagagtgcttgccaagttaacatctcttctttccctgtcccatcccttgttattcatgttttcatcctatccttgtgtttcatgtatgttcttaggaaggttttgaatgggtatccatgctgttgtatattcataattccatgttccatggtatatgacagcatggatttccataactccacttcctccttcttttacagtgttgccttttccccactgctggctttttattcagctctctctgaattggcagtttccctctacaattcatgtttgtttgacttaggctgaaagcaccaacaatttaaatgtatttctgtatttctacatataacagtgtgtcagttaaaattcacttttgggcctgtgatatttagagtgacttttgaccagcttccagtgctatgtctgtatttcctttgtaggctgacctcaattcaaagcagtaaagtttctttacccacttgtcactactacactggtcgacatacattgtcagacaggatggtattacagcacaagggtcagcatctagggagaaccattaatgacaccttacacccatcagcctacagagccccttttagcagtttgtatgcaaaaccagtatatccaagatcctttagacactgaatggtcttctgacttctcagattattctttaggaatgtataaaaccaagtcatatttttcttgtatttttctgtagcttattaaatatattattagattgaattattctctggggatattgccagctcttgagttgaagtattatgtttcttgtaatgtgagaatatgtgccttccttgtatccttatttgaacattaaaatattctaagtcttacttgctctttgcaagcattgctgcactgagataagttagtgtggaggctttgcacatccttgtctgccttctgagtagagtagaatgatgacagctgtcttcagtgtgtgtagtgataggtttacgatgttggctattatcctcattagactcagtaatgttccttctgttccacattcttcagagctttcatagtgatccactgtgatattttgccctaggcctttcatagatatattgatatatatctatcagtgagctttctcccactgatgatacatagtttatgtcttgagttgtttggtttgtacttgctaaaacagttttgaatctctgtcatgaaatcaagttgagtttactttctgcatctattagagagaaactttttaaaagttgccctgtagcacccatacttttattattttctgtgtgcatgtttttgtggtcatttgcttttggacccaggtaaggtcagctttgtgtgatggctgtaccatattcccttactttctgtgttctgcactgttttctgggcattttttttgtgggatttttcagaagaaatttgtgaatttggtgcagcatttgattattcctgagaaagtgttagaaggaacactgagggtctgggtttctgcacttgattattccctggcctagtgtttattgttcctaggaaatcaatatttccctcgtcaattctcattcattttctgacattccatggtacttgataatctgctttttctcattgtcaatccatacttctgaggccagggcgttgaaagagatcattcatatacctgttaaatgccaagagaaatatctgacatgagagaaatataaggtcaaagaaatacataaaaagcactgaatatttgctgatatcatgtgtccctgtgtctctgaatcttgccggcaagaacacacacacaggacaaactcggatccttctgcagcaaagctttaatgcatctcgagagatagatgatcagcttctggggaggaggagacccagagcaccggaaaatcggtccttttatagaccacgaagagcggttggagacgtgccttgccctgattggctgctcaccatcagcccagatgacgccatgggacaggcagggcacaaggaatggaaaaataccccagcacatgcgcagactacttgtttaccagttagaacaccgaatgtcagcactatcttgtaatggtgactgcaagggcggctcctcacaatcatggtcatgacaactttcttcagcaatagtatcaccatgttcagaatgaattcttatgtttttatttatgcataaacatatgtatgtatgtgtgcatatatgtgtatgtatgtgtattggtatgtatgccaggagaccattatcacacattctttctttcatgttaacctttaagagtggtggctagagatgaaatctgtaacagctaggctccgaagagtgtcattacattcatatttattactgattgggaacctgagaactgcctggaacaatgccacaattcagatacatgcttgttgaggatgatgttccaatggtgatattatttaacagatttgatataaggagggaatccttccaagggcataccctcaaatgattcattttatctctgtgcatatatattctccctggcagccatcagtgagtttctaccatgtcttctccttgattttgtatgtcaatatattttatgaaatatgctctcaacatgaaatataatcatagtaacactattcataaaattgcatatgaagttatatacaagtcaaatgtcatttttacactaaagacacttaacttgattatttttaattaaatttataaaattttttccacaccccatcccatcccttctcccctccctccaagaggatgtctgcatgccccaccatcccaccaggcctccccaatactaggtgcatcttctttcactgaggtcagaccaggtagtcatccactgtttatttgtcatggtcttcatgtcagctgctgtatgctgcctggttgttggccctttttctgagagatcttgggggcgggggtcccgttcagttgagactgctggtatatggatggggccaccctcctcctcagctccttctggctttcccccaaatcaaccataggggtcattggcttccatccattggctaagtgctagaatctgcatctgactcagctgtttgttggacctcttagagggcagccatgctagcctcctgtctacaagcacaacacagtatgagtaacagtgtcactgctctttgcctcccctggatatggatcctaatttgggtttgtccatggacctcctttctctcatgtgcttctccagttttgtccctggagatccttcaaacaggaacaattgcaactccatcactccacttgaagctagacagcactttatccaaggtctctccctttgagtcctgggagtctctcacctcctaggtctttggaacatgtgagatggacctccatagcctacttgctgaggctgtctatttccattttttctactggtcctcagggcttcagtcctccccctatccctcataatgtctgatcatgtttccccttcccttctctgtccctactcccactcaggtccctccctccttctccacccatgactgctttcttctctctcccaagtgggattgagacatcctcacttggaaccttgaacttattaaccctcttttgtcatttacattttattatatactttttttggctgatatccgtttattagtgtgtacatactatgcatgtcctttctgagtttgagttacctcactcaggatggaatttcctagttcaatccattttcctccaaacctcttgatgtcattgttcttaatagatgaataatattccattgtgtaaacgaaccatatttcagtatcgattcttccattgtggggcatatggattgtttccagctcctggctatcacaaataaggccactctgaacatagtggaacacaagcccctgtgtcatggtggggcatcttttgtgtatatgcccaagagtggtgtagctgggttttaaggtatatctatttccaattttcttaggaatctccagattgatttccagaatggttgaccagtttgcaattccacaagcaatggaggagtggtcctctttctccacatcctggccagcaagtgctgtcacctgagtttttgatcttagccattctgattggtggaaggtggaatctcagtgttgctttgatttatatttttctgatcactaaagactttgaacatttcttttgaagtttctcagccttccacagttgcttcattgtgaattctctgtttaggtattgtactggctagttttgtgtcaatttgacacaactggagttatcacagagaaaggagcttcagttgaggaaatgcctccatgagatccaactgtaaggcattttctcaattagtgatcaagggggaaaggcccttgtgggtgggaccatctcagggctggtagtcttggttctataagaaagcaggctgagcaagccaggggaggcaagccagtacagaacatccctccatggcctctgcatcagctcctgctccctgacctgcttgagttccagtcctgacttcctttggtgatgaacagcagtatggaagtgtaagccaaataaaccctttcctccccaacttgcttcttggtcatgatgtttgtgcaggaatagaaaccctgactaagacaaattggtaccagcagagtggggtattcctgtgacaacctgaccatgttttggggaggactgtggaaggactttggaactttgggcttgaagatccatccgttgttaagagctctgtcagatgttgtgtaggagcttggaagataatgttgagaacactgcagaagatggaggtctggtttgtgaaatttcagagggaaaaattaaagactcttttcagggccattgctgttttgaatgtgaagattctgtagttctggttagctggggctgaagaatcagttgtgattaacaagataccagaactactaaagcaaaaactttgcatactgggactattgatgctggttagctggagctaagaaattagtggtgattaagaagagaccagcatcattgaggtgacatcttctgggaagtgttttctgaaagcacaaagaggctgtgttccagagatggccaaggttgtactcctgctgcagcgggacttagtaatatgtaagggtcacccaggtggtactggttttgaaggcattaaggggtcaggcaaagcagctgaggctcggcactgtgagaggccatggaaggccattggtgaaggtgcagcctcagttgcaattgaaggcccaggattgaaggggtcatgcagtgttttggagatgccagtaccatgagatgaccaccaagagcagcagcagcagtggagtacaggcatctggagcctagaggatgacgtgtgtgctacaaagggcctggctggagaagtgacccaagcccttggaggagcccagaagatcgtgagttggatcccagacattggacggttggagattgacttttgcttttgattgtgactgtgtcctgatattttccctcttgaaggaagaaactgttttagtggagcccacagttaagagacttttaattgtaaaaagactttggattttaaaagagatggatattttaaagagattgaaaatttaagaatatgtaaagactgtgggacttttaaagttatttagaatggggatgaataagattgtaagggttgaggcttactagtgatgtttttgtgtgtcaagttgacaaggggtcaattgtactggctagttttgtgtcaacttgacacaactggagttatcacagagaaaggagcttcagttgaggaaatgcctccatgagatccaactgtaaggcattttctcaattagtgatcaagggggaaaggcccttgtggttggggccatctcagggctggtagtcttggttctataagaaagcaggctgagcaagccaggggaggcaagccagtacagaacatccctccatggcctctgcatcagctcctgctccctgacctgcttgagttccagtcctgacttccttggtgatgaacagcagtatggaagtgtaagccaaataaaccctttcctccccaacttgcttcttggtcatgatgtttgtgcaggaatagaaaccctgactaagacaggtatctaccccattttttgattgggttgtttggtttcttggtgtttaggttcttgagtcctgtacatattttggatattagccttctatcaagtgtggggatacagaagattttttttcccaatttgtaggttgccactttgtcctatttactatgtcctttgccttacaaaactatctagtttcatgaggtcccatttttccattcctgatcataaacctgaggcattagaattctttctaggaaattttttcactgtggcattaagtttgagactctttttctactttatcttctattttattgattctatcttgttttatgttaaggtccttgatccacctggacttgtgctttgtgcacgtttatacaaatgtatctattttcagttttccacatacagactgccagttagaccaacatcaggtattgaagattttttcttttatccattatatatttttggcttctttgtcaaagatcaattgtctgtaagtttgtggtttaattactaggccttcaattgtattccattgatcaatctgtctgtctctgtatcagtacatgcagtttttatcactattgctctgaagtaacctgtaacgtttacaaaaagaaatgaagtccactgttttgtaaacatagcagctcctatgtagtttgcttgggtgtgctttctggttgctaaatctagatatagaggctagttttaagtgagaaattacctttctgtttttcagttccttcacagactaagtttggctgtcctggaaatatctctctggatagatcttgtacacttagttgtgtcttgctctgtctcctgaatcctggtgttaaagatgtgtcccatgatacctggacctaacattttcctcattagaatttgatctgttccaggcttttcttggactttgaaaactgccttcattttcaaactcaaaccagaatcttaagtgggtcaaattttgtctgagatcatcactctctcacttcctggtactcctttattcctcacaccatgagccttgtttttaaaccatgcctttccctttactgactcattagtgtagctacctctgtaattttaggtacttcgagccccttatacaaatcatattgcatgtttatattttggatagttgagaaatgttgggcagtgaatgcagggaatttaaagggaatcccatgtcccaccagagcaccagtgctctgggcaagtggacagcactctctatgaggcccaggtgggtgtctggccgtgggaagctatggatctccagtcattaggagtagagagggagcagtttgtggtctctgggcctcacagaggccacagacaacaggtactctgtcatggacatcccagatgtcactctatgttgtgaaagagctgagaacaaagtgagggccctgggggtaactgggtcatcccaggggctgaagggagaagggagcaggggtataaggcactcaagtgtttcccaggatgtgagagtctttagtctggtctggtgactggaaacactgagaggctttgctgctggaggtgatacgtggctctttagagtcagccctattccaatcattgaagaacagctggtcttaatgagtggagagatggtccctggttttaaggtgtttattgtagaaagaggaagaggaaggagtagggaagtagaagccagccatggccatgtggagagagggaggagaggatagggaggaggagagctagagatgagaataagagatttaagagcttaagagagagaggaggggccaaacagccccttttatactgggctgggttacctatctagttgttgcaacataactgtggggaggagcatacctggctattgtcaggtaactatgagggtggagtttagccagaatgccaggagcttgggacatagtcaatgggacagatagtcacaggattattgagttgtggggctccgtgatgtcagacacctgtgtctgggaacgtagctcactgttctatcccttgtagagttttctactgggtctccaaagtaagttttgctcaattagaacacaggctgcctttcacagtcccacagagaaaagctctaaagaatagcttttatattaaattatatattcttcaactcatgttttcatagttctttcccaaggccatagcattaccattttcctgagaaataacagacacattgttgcttcatggaatcttactgtttctggttatggagacataaaccttggctgggagaacattccctaataacataggcagggaggacaagccttatgcctacaggagccatctgaacctgagaaatcacacatactgttgaacctactccattcgatttctatgacagacctggcagacagacttttatttatttatttaaacttttatttaactataggtgtgttcttctgtatatttttctatgtcctgcatgcctatatgagaccagtggagcccagaagtcatcacaaaatgcatcacacaggagtcagacaaaaattataccttgttttgtgtgtagaaagaattagtctgtgtgtcttttcatgaacagcaagtgccctttacccctgagtcatctctccagcccagaggtttacatttctgctacagttttttttttttttaagatttatttattcattatatgttcgtacactttagctgtcttcagacactccagaagagggagtcagatctcgttacggatggttgtgagccaccatgtggttgctgggatttgaactctagacctttggaagagcagtcgggtgctcttacccactgagccatctcaccagcccttctgctacaattttatgatagaacctgaatataaccctgagttctattttttgttaaaaaatgaaggaagagtcagaaatgatagtaatctgtgccacccataatcatgttagatgaatgagctcaaataaaaagataagtatagtgatcaagtcaaagaatcataaatggttctgatccttgcagtctataatcatgttagatgagtgagctcaaataataaatcaaagaatatttctggagtcaaaagattcagactttaagttggacagtcatagatttatgaacaataatgtatccataattaatgacaaattagtataattcttatacaacttaaaacgttcctttccattataaaaaaacactctacattatcattgtgttgtcacataacccatttatttacaaatatacttctaactattctgaaggtaaacctgtgtggaatttatgaaattattatctgttttgattttgtcatgtattagaaaatggcacatgatattaatgctatgaaatgttttttttttttctgagacagggttttctgtgtagccctggctgtcctgtaactcactctgtagaacaggctggcctccaactcagaaatccgcatgcctctgcctcctgagtattgggattaaaggtgcgagccaccacaaccggcttaatttttctatttattttactaaatatcctcaaattaattgttcaatacatatttcaattcttcatgaaaatatgcttatggaattggatcacaaggtattttattctatgtcttgcttctaatggtggttttatactctgattttacagtttttatctgcttagatacaaagaaaattatttcttttaagtaatccttgaatttttactccctactctatttcattggtctagaaaggatacagcattgtatataggccttaggatctcaactgagcattttagactagagtctagctgttgacacccaactgcatacaggatagatacagggtccacatttgatcaaagctgacagttgtagatttttttagccaccatcatttataatctgagatgtgatactgtgatcaatattgttattaaaaactgttcttaaagatatctataaagtgttcttaaagatattcctgcatccagacctcacatgtatactttattatgtctcagtatttgctgactgtgaggccattatgtcacctactccttcctaaaacaagaagacacaatatacactatgatgattttagatgatatcatttcttaaaatggcctcataattcttatgacctaacgtatattctgttcttgattagcttccagaatatgacatgatttgttttcctctgaaagggaaccttaaatccaatcataatatgtttttctatattttcgtctgatgctttcctaaagcactatgatcaaggaaagtaatagaagaaaaagaccactttgggtaatgcttccagaggataactatccaccatggtaaggaggcctgacagcaaataaccatgtttttgaaatagacagctgagagatcacatcctcacctccagtcactaaggaggaaaagagagtcactaaggtggctttggtctactgtttttcttagagcctaccaccagtttcattctttattcagtaaggttccatagctaaatttttaaaaacattgtgaccaactggggttccaacttcaaaagtgagacatactcattcagaactatatcggcagtcttctaacattctttcacattttagccagttttgatatcaacatagtaaatataactttaatttctcgtttgggtttcctgtttggtttgtttttttgtttgtttgtttgtgagacagaatctcactctgcagacctaactctcatgtatcctgatatagatacaggaatggcttctagttcacataaatttgcctgcctgagcacccacagtgctaagatgaaagaccttcccccactgtattatgcttgaatcaaacatttatcttttaatatttctgctaacatgcaacaagaattttgttcatttgtgtcatctaggacttacttgattgagctagctccttcagcttccattggaacattgatgtttgtcttctgcatgctctatctttgtgaattggccctccattgagttaccatccggcttagagttcatttctcatttcattcagattgaggattccttagatgtttatatgtctggatgcaatgtcaacatcctgcattatcaaaattatttccttagccacttgcaggggttctcttgtatttcattcagttagttcctgtcctctttgagttcctgtgcttgtttcctctttatgtccgttgacctcattgaatggtgttcaaattgtactttttgttctgtctcgaatttgtttcatcattcttcttgtcatgagcaatggtattgcatttttgatttggggtaggtaaattctatcaccattgtcaaattgttttagttccagcctctcagtttccctttgctgtgtggcattaggtcagttggcagggatatccatatgagatgttatgtttaatcattgaaaatctgagatggtggacaggaacttggttacagcttcttactaagtccagttctgttctatgcaggtagcaaacatgcattgttgtagagcaggcctcgaacatcctggcagctatttggaagtctgcttgagcctgagtgggaagaatagttctgggtgtgctgtgtaaaattggtttggtgaatttcctagtctgcacagagttagagatgaaacataacctcaagcacagacattttgggttgtgcttgtagagtctctttgccctcaaagtcttgagggacttaaaaaagaatctctcctgaggaacgtcgaggatcctcaagctctgcctctgtctccagagtgtagcgaatcaaatcctgagtctctatgcccagttttgtattcattaccaggattccttatcaaactttgttcatatgtgcatgctgtgtatgaattaattttgtgttagatggcgtacagtgaaattctgaaaatataaaaaacacttcatgggaaagcgagagccagaaggacactgggcaactctgttctttgcagaggaaaatcaactaaatgtgggcaaaaaagatcctaagaagctgagaggcaaaatgtcctcatatgcattctttttgcaaaccttttgggtgtagcacaagaagaagcacctggatgcttcttcaacttttcagagttctctaagaagtgctcagagaggtgggagaccatgactgctaaagaaaaggggaaatttgaagatatggggaaggctgacaaggctcgttatgaaagagaaatgaaaacctacatctcccccaaggggagaccaaaaagaagttcaaggaccccaatgcacccaacaggcctccttcagccttcttcttgttccattctgagtactgcctcaaaatcaaaggtgagtatcctggcttatccatttgtgatgttgcaaagagactaagagagatgtggaacaacactgcagtgtgtgacaagcagccatacaagaagaaggctgccaaactgaaggagaaatgtgagaaggatattgctgcctacagagctaaaggaaaacctgatgcagtgaaaatgggggtggtcaaggctgaaaagagcaagaaaaagaagaggaagatgaggaggatgaagaggaagatgaggtggaggaggaggaggaagaggaagaagagttagatgaagaagaagatgatgatgaataagttggttttagcagttttattttcttgtctataaagcatttaaccccctgtacacaactcactccttttaaggaaaaaaattgaaatgtaaggctgtgtaagatttgtttttaaacggtacagtgtctttttttgtgtagttaacacactaccgaatgtgtctttagatagccctgtcctggtggtattttcaatagccactaaccttgcctggtacagtctgggggttgtaaattgacatggaaatttaaagcattttatggttggtgcacagcacgtattagttatatatgggttcagtagtttgggtttttttttcttttggttttatttttgtgtttaatattttttttttgattcatctggttgtaattgtatatttattcatttgtatatacattcttgacaatttaaaaaccggtgaatttgagaggaagcagagaaagtgtgactggtcagagataagaaagaagggaaagtatatactaataagtttaaattaaccataaagaaaaaattaattaaaaattttaaactattataaaaatgattaattttttttttatcttcagttgtgtctgatgcagtttatacaaagataactgttgttctgttaactgattaccactctgtaattaaaaaaacttgcggctgttttgttgacattctgaatgcttttaagtaaatacatttttttttattagtattgttgtccttttcataggtctgatagttttcttcccgaggggcagttttttgcttttgcccattttgggtcacatggattattacagtgtgtatcttttcatctagttagctggaagaaagctttggtccacagaccctgctattgtggtaggggtaacattttcatccatagttgaagaatctcctaaatcgtcaccagttggataagagatattatataacctacttggcaaagcaaggagtggtcaattctgtcacactgtgggattattagaatcaagcaatctgaaagtttgtccttgaacactagtagaaaagtatgttctaatccttacaggagcactctcctttaactgccattactatgtatattttgcagtttcccctactaaagaagacctgagaatttatcctcaaaaaatacaagcttaaaatacgagaatttaaatacaagaatgtcgtactatttgttgaccttagtcccagcgaaggctatcacaagaatgctggctgtaatgcctttgcccatctatctaaatacagattgctcaggaaacttgactgtttaaaggtgtttttaattagttgagtcagcttttaaaattatgccacatttaatatgaagggtacattttcctatattgtggtttgtccctttataaatcagatataagggaagaggataaactttgcataatagtagcagtggcccaatccaattgctttttctttataaaatccaaactcattaattaatcatgtttaatctgcaacattttggcagtttgtgggttgttttttgagattatcattctcttaaagtgtcagtgttttaaaatagcattcttgtaattttatgtgcttttgtgatggagtgcttttatataattctgacttgggttgtttacatttgcatttgttaatgtaatttgaggaggaatactgaacatgagtcctggatgatactaataaactaataattacagaggtttaaaaaaaggaacatttcaaggaagctatggtgtttttcttaatgtgtgtccttttagaagttgttagactcctttcattgttgttccatgattaattcagaaactgagcagggtaaaatattatcaccattaacttaaagattctctatgcctctgagatttgagtgatctctgattagaagtgggtctcatgatatccaacctaaaatgctacctaaatatcagtcttaattgtatcactcttaggaaagtgtttctagtattctcaatcttttctttttatctactgagaacagtactatgttagaaattcaggtcctttctgaagattgtcaatcatatgtgtgtgtgtgtgtgtgtgtgtgtgtgtgtgtgtgtgtgtgtgtgtatatatatatatatatatatatatatatatatatacatttacagtgattcaggattttaaatcataaattcttcaatgtcaaagaatttgacaagaacaaagattctgcttgtttattaatgcaatcatacatcattgaaaaggttaaatgaaatatcttccttttctattgtatctgttttctttgtgtttttcaaatgtttgtagctagttgttttctttcatgtttttttgttgttgttttcttgttcttttatgaatatgagtgttagtctgcattcctgtctgtgaatcacacatgtgcagggtatgcagagtatggaagaaggcattgaatactctggcatgagagctgccatttgtgtgttgttatgggactccagtcacctggaagaaaacacagtgctcctaaacagtaatcctcactccatcccctgtaggtagattagaaatatattaagttcaattgagaagactgtgaacctttgtcttgttatgctatctgtttgtttttggacattttcttcttcctgaactgaaaaccaggattcacaaatagtgcagttcattacatacatatatgtttcattgaatctgatttgtagtagggattttatagtgaagtttttagaggatgctgaatgaagtaatgatatttctgagattttattccttgggatttgtaatctataagatgtttcttgcattgtgggttttatattatatttcacattgttctctctattctttatatatatagctttcctgtgttgtacttgagttctattacattcatttattccacataagaattttcttatttcctgtgcgctcatagaaaatttatatctacttcttttgtgcatattttcatatatttattatctaagttggttcttgacttaaaaacttgtcttaatttactacattcacgtgttccttaaacacagtcaatatgagtagccactttttcagaaagtaacactagagtttgcaggcattttcattcagggcttgaaaaatgtcattccctactctactcttgcgcgcgctcgactggccaggaagaacgacgctgcaacaggatccttctgcacacgtttattgggagagcttgattgtagaggcgaaaagacttcgagcccagaactggtgctgcttttataggcctaggaggggcgtgtctcacacccggattggttatgcactaagcctcatttgcatgttcctcatctgattggctaccctctctcagtaccttacagaacctcattatcatacctcatttgcatgtctcacatctgattggttatactctcagtaccttacagaacctcattatcatgcctgggccaggcagtgtctttgcaaaaaactttactgcatatgtacacattggttgtttgtccaatcttatgcgtggtggccagcagtagtcagtgccactctgcaacggcacatgtggcttcccacatcttcccctgtttgttttaataaaatgaggctggactaggcctgtgcaattatgcccatccgccgtggctcctgttttaggtcgttcctctaatgtcacagccttacccgtcataggataaccctatcgccaccgggccccatgtcttaggttggactgtgcacgaggaaagttgcccgtctctggataccgcagtgctgtgtgacaataactgctaaatgacctagggcgaactctgcaaaagaggccagccaaaaaatgaattagtggggaaatcatgatcaccctattgatgagcaagggctgatcaatgatcgttgagtctctctcatctaatctcatgctgactaattcttgagcatagataaccaaatttcaggggaggagccgttttcaatagctaaaagtgcctgagttataatcaccttgtcacgttttttgttgagttctgaatttgcataccaatcagagcatgaacaccagtccacagcatatggcagcaccaaacaaaatcactcccacccattccttaaagtaagaaaaagcagaggtaagccaagaggtaaagtctccgagggtcactggttccactctggtcccattaaggttcaggatctgcatctgcagcctcatctgcaacctttccagctcctgcgaccagttccccttcaggtaatttgataggtctgtacttttaataaaagaattattaatgtacctattgggaataatgcacacatgcaaagtggatgccacacaactcatttgtatgacatccatcatctgttccatgtcatgttgtaaaatatccactctctgattcactaacattaaccctgaggtgatatgagaatccaccctttgcagggtaagcaatgcctcagacgttttttctgctatctgacttatagtgtcagcagtattaatttgatctgcccaattagagataatctttttcttaaaaaatatacagggtgtaaaaggtttatccacattatgcacaaagcataatgtataatttaaatgaaaactagtactcttatacacccgtggctcttgaggagtttgtcatgcataaggcacatccaaaaaacattcctttgcaaaaaacaaaggctaggtagaagaattggaatgtaccggtaaaggtactagccatgatcttactatggcccataaaggtatacttatcctggtttcaatcatcaggagcaggagaatcatcttggggttcatcttgctctttcagggtccttgtcagtcgcgtcgggacccaaagtggattttcttcaccctgtggaaaaacacaaatagctccccgggacctgattaagataggatccgggccataccatttattatcaaggacatttttccatttgaccatttcattgggcgattgaggccattgtccatgcctttcagctggtgatcttctagcatcatctaattttagaaaattaagagtaaatattgcaagggatagagccatctttggcgtcatagcctctatttcccctttctgtttttgcaaatattgtttcagagtgcggtgggctctctcaatgatgccttggccctgtggattatagggcaatccagtaatatgttttacttgcatttgtttgcaaaattggctaaatttagaagaagtatatgcaggaccattatctgtctttaacactaggggcttgccccatgcagcccaagcctctaagcagtgagatatgacatgaactgctttttcccctgtcaagggagaggcatgtaggacaccagaactggtatcgatggatacatgtacataatatctactactataattctccaatccttaggtagagctgagagtagggggagtcctctttgtacaggacccataacttgcatttgtgcattaatggctcttaggtcatgtaacaatctccatttacctgacttcttctttacaacgaaaataggggtgttccagggtgattgagtgggttccacatgtcccaggtctaattgtttttgtcctaattctttagctgcttttaacttctcagagggtaaaggccactgaggcacccacaccgtgtcctccgtatgccatggaatgggcaaaggctcctcagtggcccctagaaaaaactcagccctttcttatctactttttctgtggctttaactggtgaaattctaccttgtaagttttttccaagacctagtccaggtatatatcccattcctttcatcatttccttgcttttcggagagtaatcattagtcaatataaagttcatggctgacaacacatctcttccccataagtttacaggtaaagggagtacataaggttgaaaaagccctgttcttccttctttatctttccattgtaaggattttgcacttatagttggggtagcctcatatcctaatccttgtaagctatgtgacgattgattaacaggccaagaagcgggccaccaattactggatataatgcttttatctgctcctgtatccattataccttgaaaggtttttccttctatttgtaattgtaaagtgggacgattatccaaatctaaagatatgtaggccacattagttcctgtagaaccgagtcccttatctccttgggaatcctggctactaggaagaatcagtaattgagcaatgcgatctccaggagaaatggctacaatacctcggggtgcagaacacataatcttaacttgtccctcataatctgagtctataactccaggatgtatcatcaatcctttcaaagcagaagaggacctacccaacagtaggcccactgtatcctttggtaagggacctctaaagtctgatgaaataggttggcaccccatttgaggtgtaagaattactctggaggtggcacagatgtccaatcctgctgaacccggagtggctctcctcagtctctgggtggcctcatggacactgtggtctgaaatgccccatacatttgggggcctggggacgggggcccctcaccccgttttttggctgttgcactttaaactgaggtattggccttcctttgatatctctgactgatctacattcatttgcccaatgtcttcctttcccacattttgggcaagtacctggttctgttttttcaaatctattctttctaccctttgtacactgcttttgcatatgacctgtttgtccacaattatagcagcttatttcttttgcttgtgccatcaaaactgcggcagccagccctgcatttgaaagaggtcctcctatttctctacaggctttcatccatgcttgtagccctttccctttccatggtgtgatagcatttctgcattctttggtacattgctcataactaattgttcaattaatggcattgcggcctcagcatcaccaaatatacgtcctgccgcttccatcatgtgagccacaaattcagagaacggctcattagttccctgaataatttttgtcaagttaccagatacctctcctcgattaggcaatgctttccaagctttcaccgctgcctgattaatttgatcatagacctgcactgggtatcctaattgattgtttgtccatataccctgacctgtaagcatttcaaagctccatgcttgttgccctgcagtagcattagcacgggcctgactcaaacacagatcatgccatatagacttccaatctagatactgtcccatcgtaagacatgcctttaccacactcatccaatcaaaaggagtcatggcattgtgagccaatctatcaatttgggactgagtaaatgaggcattaactccataggtccttactgactctgctagctcttttacttgtttatgcgatattggctcataatatcgctgttgagcatgatcctgaaaaacaggaaaagcctgacatattttttgcaaccctttaggagtgcaaaaagagtgaccattgccaattgctttcttatctgcataaggcggagtaggtgggggagcactgaaactcctccctattggaccagatctttctgcctcatactccgcagcagcctccttcaaatcttcctcctctcctgttgataattcggaatcctctgagctagacaattctaatgactcagagtcctcgagaggagggtaaattgacttaattttctgctttttactattttttatactattttttgtatctttacattttgggagttgacaattaaagccatgatataagatcaaggcaagaaagatagcaaccccagcaacaattatcagatctatttcgtaggagagcatgcctctcacattaatttctttctacttaccggtaccgccgttcctcagctgaagagttctgaatccactccggatccttctcagcagtctgttttgcaggaacacttcattaccaccgttccccagctgaagagttctgaatccacgctggatccttctcagcagtctgttttgcgggaacctttattaactgctccttccccgtgatgcagttctgaatcctccctgtagcagggggtcttcgctcgtgcctgaagatgtttcttgtcccgggttttcggcaccacttcttgcgcgcgctcgactggccaggaagaacgatgctgcaacaggatccttctgcacacgtttattgggagagcttgattgtagaggcgaaaagacttcgagaccagaactggtgctgcttttataggcctaggaggggcgtgtctcacacccggattggttatgcactaagcctcatttgcatgttcctcatctgattggctaccctctctcagtaccttacagaacctcattatcatacctcatttgcatgtctcacatctgattggttatactctcagtaccttacagaacctcattatcatgcctgggccaggcagtgtctttgcaaaaaactttactgcatatgtacacattggttgtttgtccaatcttatgcgtggtggccagcagtagtcagtgccactctgcaacggcacatgtggcttcccacactctactgattttaatcaatgaataagcatttattagtactgtatggcatcacaatgtagcccattttggtgataaggaataggacaagacaactggaataagatgcacattgtttcagcacttagatgtgacactatctgcgtacatctgggagttgcagaaccaaatttatagagacattcctcaggaacactagatgagtgttgggaacaaaataaaaagggggggccctgcggaagaatggaaggaaaaagatgcccacaccccaccagagtttccctattctctggtcagtcaggtgtaggaggactgctatctaccctattcactcatccctgggtgggtattcctctatcacactcttcagggggtggtcaaggggaaggcctacctggggatgcccccccagctactttgctaaagccagcagggttgtgggagagagggaaaagggaagaatttctcaacactgtccacagtgcccagcggaactttaaaaagcagagactctatggtttaagagctttattagagaaatgcagggggaaaaagagaagggagagggagagagagagagagagagagagagagagagagagagagagagagagagagagagagagagaaaggaggtgaggggaggggaggggaggggaggggaggggagggaggagaaggatagtagaggagaggagagaactaagataaaggagagagaagacaaagagaaagggaaaagaagagagaagtgagaggttagaggacaaaggagtgagagagagcaaggtgggggctgagcacacctttttatggtcttcactgttgctaggtaactggggaggagtttagcctaaaggtcagaagcttgggccattgcttacttgactactgaccatgcttctcttgtaggggctgtgggaggttgtgccttatgcaggggcctgagctccaggagcatgagggaacgcctaccgtgtcatgtaggtgaattatgaccacctgggtttagacctcagctcgactggagaccagcctgcaattccccacagatgagaaggttatggccttgtctgactactacatatagctatttgacctttgtctactttaaaaatatttgatatagcaagtgatagtaagccaggcggtggtggtgcatgcctttaatcccagcacttgggaggcagaggcaggcggatttctgagttcaaggccagccaggtctacagagtgaattccaggatagccagggctatacagagaaaccttgtctccaaaacaacaacaacaacaacaacaacaacaacaaaaacaaaaagcaagtgatagtaaattaactggaaggctaaaaagtgcagacttatgcctattcagaaaaaggtgtgtattggaggaaatgtcagtttcaagttttaaagtagaagctgtattttttctggtgacttcatggaggaagcatgtaaaaccatgggtgcactggtagacatacactgtcagacagacagtttggtatttcagaacacaggataagcatgtagggagagcgatcgactccttacgtctagtagacaagagaggtcttttattagtttttatgttacagcagcatatccaagacctttttagacactaaggggtcttctgatatctcagattattctttaggaatgtataaaaccaagtgatattttcttgtattttcagtagcttattaagtgtattatcagattggagtgttctctttaaatatttgtagatcttgagttgaagaattatattccttgtaatttgagaaaatgtaccttctctgtatccttatttgacacattgaaaatattccaggtcttatttgctctttgtaagcactactgtactgtgaaaaggtattgtggtggctttgcacatccttgtctctctttagaaaaaaggagtagaatgatgacagctgtctttatcttttgtagtgagaggtgtaggatgttggctattatcttccttagactgaggaatattccttttgttctcaaaatacccagagctttcacagtgatcccctgtgatatttttccctaggctttttgtaactatatcatggttatgagccctctctcactgtacatacattgtgctgtgacttgttttgtttgtgcctgttgaaatagtcttgcatctctggcatgaaattaagtagagtttcctttctgcatccacagaaaaagtctttgtttaatgtactttggtgcactttgttacttttttcattgtacatattttatggtcatttttttgggaatacaaataaagtcatttttttgtgaggagtctacaacatacccctttttctgttttctgcaatatactttatgcaatattattttggtgttttctaaagcaacttgcgaattcagtggtacatctatttagttcttacgcagtctttgaagaaacacttgggacccgagtaggctttttcttattacatagcctagtgttatgacctagaaagtttacttgtttctaagaaatcattattttcctcatcaattctcattaattggcatccactagccctttgtctttgactctagtccagaaatattagttttcagtaataaccctgagtatcagtactttacagcaggtatccatgtgctctgtgtttgtgcctgatgactcctgaaattagaaatcatcctcagattgtactcatactctttatcagtcaaaatgtatcatgtcggtagaaacattggcaagagccctggtattactttgctttatttgttttttaatgtggtttagcattgtctctaatggcatttcatttatttcattgttcaatccttgatgtgaaatttaagaagaacttgaatgtttgctcctcaccaagaatctgggagaagaacaactaaaagaatgagtgcttctctggaaaacactgcacaggtcagtatcctgtcttcatttctttttaaaatcccttttatattcaaaacattcaaaagttctatcatatgtatgtgtaatattacctaggaggattattttctgtgctcttcattttcctttgtgatgatgaaaatataacaatttggtttctcatgtatacaatagctttatattttcactggtatgtatactatgaagacatgtaattcccatagaactgtaggtgtcaaagagcatctattggaagtgatgcctcaaaaatatattgatgactatttcctatgtttgataaggttatatatatccttttatattagtatggaggaagtaaggtttcttgtcacacataaattgcacttcagggatattcaggtttccagacacaaggctatgaatgtggatatggaaatatatagaaactcatatcagtaagcaacacacatatcagagtagaatttgtaatagagtaaaattatatgaggcccactgtcttgaatcctaataataagtgtatcagctccctagaagcacagatgatggaaggggattatctctcattttgtctttgatgtgattattagctgatgcagatttcagtattctgacaattctttttaacattttaagtcacacagtactcattgaagtgttgacacctgaaatatgacttgagagatactattcccaagatacatactcaatgtagacatgcttattttcctttcatttttgtttcagtctttagaagtagtgtaggccctgtggttttcacctttgtattttatcacatgaaatatatttgtaacatttatctaaagaggatagccttggtactgtgcataatacatcaattttcaagcataaattaatatccttcctattttctgtctccttttttttagaaggaagacagtttgatatagcctatgttattcctcttcagccaagcaatgcattacatagggaaagctgaagggttgtggcaatgtttctatttttttattgcaatactattttctttaggtatatatgtgctcatctgaatgtttttatgtgtatagaattacacattatgcccctaaaacattgagttcagcgccaaaccttggagactgaagtcaggcacaatagtgagctgcaatatactttgagagaattaaattcggtttctatgcagaaacagcaagcacctttacatgttagtaatttttttttcatgccccaggtttacaattttaggctcatttgtaaaatagacagtatataacctgtgtattttagtttttgataaacaaaggaagaaatagaaatcatgcttttctatgcaagctacaactctgatacacaaatggttaaattctgatgaaaagaaagttaagattagaagattaaaaatttcaattaagatgataccatgaggaataaattattaaatattcatggagagttagaataattcttcatcaatttgaaaacacagtttgagcaaagaaaatgattgtagttcattggaatgcattgccacctatgacatttgcttacacacccataactaatcattcttcagtgaaaggccatatggcagttatgaaattgttatgttgtgtattgctcatgccaacttacataaaatgttcaggaattttaatgctcacaaatactggttttcttactttatggttttggaaatgttttcctaaaatatcttcccaaagcattggttctgtgttatacagaatgttcaatgctccgatgttgcagttttatgttttttaacaccaaaactatgacattcaatccatccattaattctgcatttcatattctacttgtttgctctagagaggatgtagcattttgcataggcatcagattgtcaaataaatatattataataccgtcatggaagacacagctgcacacaggactcagctcgtgtccatatttgagaaagatggacactgtaaaattttaaagcatattttttctcattataattgatgatttatgattcttttttatatcagtccatatttcataaatattcattattgcatcttgacatcaaatgtacatcttatatgtgtttactgtttttgagatggttatatcatgcattctcagagaaatagaaatctaaacaagtctgagtattttagagtgtatctgttaataaagttaaactttatttttcttcagtatatgttggttacatgtgcctgaatgtatgcatttgtggtatgtatttctcctgcctgtagtgttaagtagagatcattggattttaaagaactggatttaacaatccattgtgtagtgccatgttggtgctgggaaacaaatttcataatagaggccttgaaaagatattatacaaaccaaactgcacacaaaacttttgtaaatggtgatggtggcaaatctttttttttttaaagatttacttatttattttatgtatttgagtacactgtagctgtacaggtggttgttaaccatcatgtggttgctgggaattaaaatcaggacctctgcttgctccagctctgctccctctggcccaagaatttctttattcttatacataagtacactgtagctgtcttcagacaccagaagagggtgtcagatatcattacagatggttgtgagccaccatgtggttgctggtatttacactcaggaccttctgaagagctcttaactgttgagccatcactctagcccaatggtggcaaatctttcatttgctgcttaaggtctcagtaaatcaaagaaaattggttaagacaagagcctttctgaatgtaagcattatagtaaatcattgtataggttgtctatggaagagcagcaattcatgtcttgaaacacaactccataaactttaagaaaatatcattcaatattcttgcctcatttatatcacgaggtgtatcttaattagttctctttaacataataaatcatttttgtctagtaacacctaggtagtttttcattacagtgtctattaaccttcaaggacgtgtttttggacttctcatcggaggaatgggaatgtctcaattttgctcagaggacattgtacatggatgtgatgttggagaattacaacaatctgttgtttgtgggtaagaacgtactttttgttgaattacggatactttttttaaattttcctaatttgtataaactctctgaaatacttagagacctcaaatgagggaaataatgcttaaattcataacttttcctttacatttctctgattactttggaaaggtaaccagtgctatattctctgagatctctcttccccacttatctagcttcagtcaagacttttaatttcaaaaaaatttaaacattcagaataaggaattgtatttctgtacatataataattggagtatttcttcttaccattgccttaaaagtctcttatttatgattttagaaagtggacaagattcaagtggacacagtgccgttggtttggagggttttttattaagtgtttgacatttggtctctgtttttttctggggcaacctgatctttatcctatattttggatgttgaaacaaaactatttaatgatttctcatgacagtttcagttacatcataaatttatacctgaccaaagctatacaatgtcactctaaatccaattgtaattttaaaattagagctatattgttcagagatctactttctgacatttcactacagatcaatcacttagaagttctagattctgcaaagtagaatattctttttttcttttctaaattggttattttaattattatatttcaaatgatatagcactttccagttccccctccacaaaccccttattctatcccccctaccccatgcttctatgagggtacttccccacccacccacatctgcttcactgctctaggtttcttctctgctggggcattgaggcttcataggtctaagtgcctctcttccaattgatgaaagttaagacagtgctcttttacctaaacagctggagtcattggtccctccatgtgtgtactctggttggtgatttagtccttgggagctctggggtatctggtttgttgatgtttttctttttatgaggttgtaaacacctttagctccttcagtccttcccataactttactttggggtctctgtgcatagtcagatcgttgcctgcaagcatctgcatctgtattggtcaggctctgcagaaactctcaggagaaactatatcaggttcctgaaaacaagcactttatggcatcagcaataatatcagtgtttggtgtgtgcagatggaatggatgcccaggtttggcagtctctggatggactttccttcagtttctgttccactctttgtccctgtagataaagggacactctttatttcctttagataggagcaattccgggttaaccttttttatatgggttggtggtacaatcttagaaggctattatcacttttgccatttgatatagatcagatttgaggtacttctgaggatccatgcaatgattaaaaaaaggaaaacctctcttgagaatatgaatacatagaacagtgattattggatcatacttactcctcatataagtaatccctgttatccctaattcccccttttttcagaaaatcactgcatatgtggaaactatgagaaggagaaggtcttggaacaagaaacacagcacattgtcaatgagcatgggcataaccgaaagaagtcttctaaatgtaatgaggttagaaatgtgatccatgaatcctccgaaagtacaccttataacactaaccacagagatgccactctccaatcctcaaacctaaaaagacataaaactgggaccactaaaggagtttgcacatataaagactgtgtaaactgtttaaaggggtcttctatcattagtctcaatcaaggaacccacatagagaagaaagaacacaacagaaataaaaatcttgatgaggttttggtttctagacaaaacaatagtgaaatgaacacttacacttgtggtgaatttgacaaatgctttactcagagtgacaatcttcaaagtcagcagagaatttatccaggaaagaaatcttacatatatagtgaaagtgacaaatgctttacccaaccttcccatcttagtattcatcatacaattcattcaggagagaaaccttacaaatgtagtgaatgcgacaaatgctttactgacaaatgcactctgagaaagcatcagagaattcatacaggagagaaaccttacaaatgtagtgaatgcgacaaatgctttactgacaaatgcactctgagaaagcatcagagaattcatacaggagagaaaccttacaaatgtaatgaatgtgacaaatgctttactgacaaaggcagtctgagagttcatcagagaattcatacaggagagaaaccttacaaatgcagtgagtgtgacaaatgctttacccaaccatcccatcttagtattcatcgtagaattcattcaggggagaaaccttacaaatgtagtgaatgcgacaaatgctttactgacaaatgcactctgagaaagcatcagagaattcatacaggagagaaaccttacaaatgtagtgaatgcgacaaatgctttactgagaaattcactctgagaaagcatcagagaattcatacaggagagaaaccttacaaatgtaatgaatgtgacaaatgctttactgacaaaggcagtctgagagttcatcagagaattcatacaggagagaaaccttacaaatgcagtgagtgtgacaaatgctttaccaaaccatcccatcttagtattcatcgtagaattcattcaggagagaaaccttacaaatgtagtgaatgcgacaaatgctttacccaaccatcccctctcagtattcatcgtagaattcattcaggagagaaaccttacaaatgtagtgaatgcgacaaatgctttactgacaaaggcagtctcagagttcatcagagaattcatataggagagaaaccgtacaaatgcagtgagtgtgacaaatgctttacccaaccatcccatcttagtattcattgtagaattcattcaggagagaaaccttacaaatgtagtgaatgcgacaaatgctttactgacaaaagcagtctgagagttcatcagagaatccatacaggagagaaaccgtaccaatgcagtgagtgtgacaaatgctttactgacaaaggcagtcttagagttcatcatagaattcatgcaggagagaaaccttacaaatgtagtgaatgcggcaaatgctttactgacaaaggctatctgagagttcattatagaattcatgcaggagagaaaccttacaaatgtagtgaatgtgacaaatgctttactcacaaaggctctctgagagttcatcatagaattcatacaggagagaaaccttataaatgcagtgaatgtgacaaatgctttacccgaaaatcacatcttagtattcatcagagaattcatacaggagagaaactgtacaaatgcaatgaatgcgacaaatgctttagtgacaaacacagtctgagaaggcatcagagaattcatacaggagagacaccttacaaatgtaatgaatgtgacaaatgctttacctgaaaatcacatcttagtattcatcagataattcatacaggagagaaaccttacaaatgtaatgaatgtgacaaatcctttactgaaaatggctgtctgagaattcatcagagaattcatacaggagagaaaccttacaaatgtaatgaatgtgacaaatgctttacctgaaaatcacatcttagtattcatcagataattcatacagaagagaaaccttacaaatgtagtgaatgtgacaaatcctttactgaaaatggctgtctgagaattcatcagagaattcatacaggagagaaaccttacaaatgtaatgaatgtgacaaatgctttactgacaaaggcagtctgagagttcatcagagatttcatacaggagagaaaccttacaaatgtagtgaatgtgacaaatgttttattcaaaaatgcagtctgataattcatcagagaattcatacaggagagaaaccttacaaatgtagtgaatgtgacaaagctttactgagaaagtcaatctgagaaggcatcagagaactcatacaggggagaattcttacaaatgtattgaatgtgacaaatgttttgcccagaaatcctatcttgtttttaatcacagaaatcatacattaaagaagccttacaaatgcagtcaatgtgacaaatgattttcccacaaacttagtctgagaatgcatcagagaattcatacagtagagaaaacttacaaaaatgcagtgaatgtgataaatgctttactaataaaggcagactgagaattaatcagataatttatacatttaaaaaaacccttacaagtattttgtatgtgataaatgcagtacccacaacatcagtctgacaaatcaacagatatttcaaacagtagagcaacattataaatgaaatgaatgagatagtcctttaacaagaaatatcatcttaaaattcactggagaattcttccaaaagggaaacttttcaaatacattgacggtttgaatcctttattttggcctatctcttagaatgtaatagataatttatacaggcaagaatcttaacaaatataatatatgctgaaatatctttgacttcatttcagtgcagaaaaaatatgtaaaaaaatatttttatgggaaaaatagttctcctggggaaatgtggcatatgttttacacgggtaatattcttttcaacagtcagtgctctaaactagagaattattatgaatctgaaaacttttgaaaaccttcatgcaatgttcaaatcttagataatgtcaactattatgctggcagtaactctgaatatatgatagtgaagaaacattttcattaaacttttacttgttcaccctcaaatattatatgatgaagtcaggtgtgaaagccagaagaatatgatgttgtgcaacaattcatggagatagaaatgatccattccaaaaggaaactaaataaagtgtactatcgccttcaaaatgtctaataaaactggcagcattttgtatatttaattcaaatgaagaaattgacacagattgtagttgatagtgtatttgacaaactgagccaccaagactgcatgttcttaatcctataatatgcctacagatgtgaagtgtgctttgagtatccagtattcattattcttatcacgtcaatgtgacaaatgatttattggtttcacgtttcaggatagtgactgactatgagtcccttatgctctgtcaacatctccttcctcattgccctgtaaataaagctgaatattttaacaaggttgacttggctgttttcagtttgcacttataattagatgaataaatgttgcatcatcgctggaactatttctcataaagtatttgctgaagtcatgaatattttctgtaaacctgtaacttaaacttaatatttgtgattttcagctggtcaataacaaccttgacccacatacgaataatatgaactgtatataagtgtttagcattagaaaatttagcaacagtgtattagagatgatgatttgtgttaactaaaacagggatgattctatgcaatattccaggcttactgctcgattagtactagtttattaaaacaaacacacaatcaaacaaagacaacaacaaaaaacaaaaccaaacaacaacaaaacaggaaacagaaaacatgtaaaggcatttagaacctcaacagtaagtctggtctctctctctctctctctctctctctctctctctctctctctctctctctctctctttctctctctttcttttgactcaagggaatatgagataaaatactaccaaaaataaatgaaaatatagcttcatagttttcagggacatccatcctaactgtgctatgtccctgcacaactccaaagctctctccagggacacgtataacaagtccttatggtgtcctgtcctattgttcctcatactccactctgaaccttcatactccactctacctcaaggactgactaagatttccattcttgtcataaatcatttagggaatgctcacattttacacaccttagaatgtacattttggagaaaaatacaacaactcactattaaggtattaatctcctttttatttcatatctgagtttatccatacaaatagcatgaatctgtaaatcttaaaagaagtaccgtttgtatggtagatgaggtaaaatctcatgcacagtttagaaatccaaacatccaggaaatacatttggaaatactgaaaaaagatgaaaaatatttatgccaagcaaaagcattttattagaatatttatagtaaattcaggaagactcagaaaattaggatctaagaaaatgtcatatgttaaaatgaacaaatctatttacacattttccttgatataaaaaaataaggacaaatttcaacttgtgagaaacttagtgataacattatgttattctcagaagtggaaattgttgaacaaatctatatcactatacatttttccttgatttaaaaaaataaggaaaattctcaacttttgagaaacttagtgataactaatatgttattcttagtattggaaattgttgacctcttccttagtaggatcaaactactaatagacactttagaggcccttgttttcaaatgatcattagtattttctatcaagtgctgcatcatggatgctgatgctcacacaccaggcaatttaaatttaggcttctgaaatagcccttaacagtcaggaaattacaaccacctggacagtctctggatattccagtttcttatgttgcatgattctaggccccactgcctgatgacttagagatcattatcccaaatcttcagatatttccagtgtcagtgaaaagttccaaattgtgcacagcaaatacacaacttaccttttgcccctcacacaatatgattgtcttcattctataaacatttatacacctgcttcttgtctatggtacaacaagaatatggtgagggtgtacaacataggttcaggtagactcactgttggaattatgtggaaggcatcatgtgcagattgaaaaagatgaaagtcattggcttagggaaattaataatatcatgtttgaagaccaagaaaacaggctcaccaaatttggaaacattcactatttgtggatgagcattgtacgatacacaattagagccacactacagaagactaatgaacattcccagaagatcttccagtggctacaattttagtaacccagcaggactagggcagtaccttgcatggaaataaaatatctctttagcagcaagacaactggtgggagaacatggggatgggaaacattaggagtaggtaggaagactcatttcttgattgaaactgcttttttagcaggaggattcctaagagaaactgagggcctgaaggaagtggagtgggatcagaatcccctccttgtcaggagtctgcaagctgcaaggtgtggaactaggagtagagcacgctgccatgggtctcacaacaatggaaaaattcccttcatctgcactgttgccagtttaggccttaggaatctttttcagtcactagagcagtggcaggaactgcaaccaagaagtcatggaaactcccaggtcaaaggaattgctaggctagtgggcagaaaggaattgtaccacgattgagacgactttctctgctgctcataagaactctgaccctcaatttctactgggcatttctttactgtgttggtaaattactgactatgtatgtttgacttgtcctgatattttttattgtaaggatatttccagagtaatttctaagaggatgaacttgtcttttttttttcattttttttatcatggttatatttccctggtagttggaacaaagcttgtattattcacatctatccatggtttctaactcttctattgtatcactttcctagtcaagattattggagattatggagattatgcatccccatgatgtctttaaatattattctcttaaagactgtttgaattttgattgaatctcaagcaatattttagcatttttaaaaaattttacgtgtctttaagttgtggttgtataaatatggcttaaacagcaaaacactcctggacttcagctcaatggttgactctacgtatctgcaacagtgtcaataagctcctgatagagtctgtcagaggacagtcatgtcaggttctttctgagcacaacatggcttcagtaatagtgtcaaggttttgttttgttttgttttgttttgttttgttttgttttgttttgttttgtttttctgcccataggatggattgatcaaggcagtggatggcattttctttagtctctgctccacttttgtcactacatatcattagatatgaacaattctgggtccaagttttgaagatggtcagatgcccccatgactcaaatgggggccatgcactctgctgaagatattctatttaggttctgtctacccactcttggacatttcggctaaggtcatccccgatgaggtttgggagacttccacatccatcttgtctgggactttctagatatttaccctgctcttcattcccacacggttgtatgtttctattaatactcctggccctctggccttctctcctgtctccccatatacctgatcctgccactgattgtccctgattctccctcttttatccacatccctcccttcttctgcctcctgggattattttgtttctccttctatgtggagttgaagaatccacaatttggcattccttctaattaaattttatgtgatctgtgagttgtgtataatggtattctgatctttttgccaaataactacttatcaatgaggacataacatgtatgtcctttcgagcctgggttcctcactcaggatgacattttctagttctctccatttgcctgcaaatttcatgatgtcctcagttttaatagatgagcagtattccattgtgttattgaaccacattttttctacatccattccttggttgaagaacatctggattgtttccggcttctagctaatacaaatatggcagctatggacatagtggagcatgtgtccttatgttattgtgtatcttcttttgtgtatatgcccagtagtggaatatctgggtcttcatgtagaattatttccaattttctgaggtactgccagattgattttcagagtggttgtaccagtttgcaatcccaccagcaagagtggagtgtaactctttctccacacccttgtcaccatgtgttgtcacttgagttcttgatctttgcaattctaattggtgtatggtagaatctcagggtcatctgatcttactagaaaagcatatatgcaacaacactgcagcaatctagaagagacagatgacattctagatagatatattgtgtccagttaatcaagttgaggtaaactaaacagtccagaaacccctaaggcattggactctgctgccctcagaactaggacacacccataaccatgacagtgaccccttctgtgaggtcacagaggccaagcctcactctgtttaggaaagctcaaagggtgtccacacacacaggtgccttttggactggtattaaattgattgaaattttggcctctaacctgtctcttcaccaccattaaacacagcttgtaataggatttcccagaaagcagcatttcaggaagtttccctcccgggcctcatcatgatagtcgatgacttctgagaatgtcactaacgaaacaactgatatgatcctacatacacacacacacacacacacacacacacacacacacacacacacacagattcacaaatacattaacagccataaatacaaatatgttaagtagatgaagaagggatgtgatatcaatgtctgtggccatgcaggaaagggcctgtaagttgaaaataaagatttctaggaaggttcacatgtttaaaagaaaacacagagaaggtcctgggaaagcacttccttatgaacctgtgtaacatatgttccctgaaataatggcatagaggacaatgtaagtatttgatcacttatgagcgtgagttttgagtcttaaaagcaggtactgacttgacagtttcttccagaggcctcccttcctggcacatgtatggtgtcttctccctgagtctatatatagcatgccatttgacaggcacccttgtatttactgctgttctggcttaacagaactcctgttgtgttaaacaaggaacacctcaagaacttcacagagcccttgtcactgccattcaggtccttgatcctgctctttcctgcatgcctttatacctgaaggcacatgtactcccgtatatacactctcagaccatgcacactaacatacaatttaaatataattatgtatagtgtgcagggttaggtagagtgctggaataatatgtcctgtttgtggggcaatgggctatacacagacagtctggtctccagtcaagctgaggtctgaactctaggacctggtggtgataattcacctacatgggacagaaggagttctctcatgtctcctggaactctggctcctgtcaaagttaccgttccctcagccctcacaggagaagcatggttagtagtcatataggcaatgtcccaagcttctgaccttcaagctagactcctccccagttacctagcaacagtaaagataacagcataccataaaaagtgctgtttgacccctcctcactctctcactcctcttgctcttaatccccttactctcctccctcctttcctctctctttgtctctctccctcttactctctagactttcttctctatctccctttcccctttgtctcctcttggccatggccagtctctctctcttttaccttctatcctttctccctgcctttctataataaagctcttaaaccatagagtgtctctgctcatcaaggcccactgcacagactctcacctgtgtgggaacctctctccctcagccctcactcccataaccccagggctacagggtgtcactccgggaccccgttgggggctgtcccttgttcaccccccatttagtggggtcagtggcttagatgcccacctggggctgagtggaaagtgtctggcaaccctcccatgtctgcctgcccagagcataggtggaactctggctgggtgtgggctatcttctctccctcctcttccccagactcccttttagttcccacacctgttgagtacctgctttcagtcatgctggagacaacccctggacatacaagacaagattattactgtgaagaagcaaagtcccttcagaagcccagacagtaggattctgcaccatctcctatctgccctggacacaatgggctgccatagctgatagttgtccatggcttagggcacaacaccagagcttcatcctgcactagtctggaggctggagtcttttcatgtggtacaagctgggtgtgaccattccctaggattattctctggtgagttgtaggtgttgtctccttgagtacctgtttggcaagttctttagcatgtgcatatgcacacacacacacacacacacacacacacacacacacacacacatacacacaccctgctgatacttactgaaacagtttctactgctttagcagaggccctgctaaaggtcacttcaaggaccacattaggcttcatacacttcctcactcctatctcccagtatagcacaatgaggtttagtcaggacttcatcccagggatctgtatatatttctgccaacatacagcccaacaaacctgcagttccttccagatcccagcccatccctgagctccctcacaccaacaccacagcctttaaccatggcaacaagctatatgaggtaacagaggctgaccacacctctctccagcttcttcccatgtgcctagatgtaacatgaggaacgacctggctttctctcttaacataaagtaccctgacttgtgtaactacaactggtgagttgtaggtgttgtctccctgagtaattgtttggcaagttctttagcatatgcacacacacacacacacacacacacacacacacacacacacacacacacacacacctttctgatacttacagcaactgtttatacatacttgtagcaagatatgtggcatcattccatgtcctcctcatgcactttcacacatatggatgtggacctgcagacatgagcacaaacataagaacatatacaacacacctacaaaatgaaaacatgtatttgagtatagaatgcgaaggaaggtgctgtcatggcatttcccatgatactggcattgctgtttgactcatattgtggcagctctctgagtacacatgcaaagattgctactgccagggactgaagtcaccagggaagatcagacaccagtgtcagggatgctctgcctcattccctggacaagctatgtgtgatggtcaaatgtgggcgtggcaaaagcactgttccctccttcctggcctaggctgggggctcaagtcctggtccagatagatagatagatagattatatatatatgacttctttccaaggcctctcctcctggtgagtgagggttcttcttcccacagtcttgagtggccattcccactgctgtgagacttctgatctgtttctagctctccttagtctcttgaagacagtcttagagctgtcttcaatcagaaacactttaagtccctctccctatttctgcctcccccgcttaagacctcagtgaagaagtgcctcgcactaagtgagctactcatgcgatgaatttcaggtagtccatcccagaaaacagcccaagccgaggcaggcacacgtgctcagtgtgaatcccagccctccttgctggactctgagttatcctcagtctaagcactctgctattactaaggcagggatttaccctgtgatgtcacagagggctcacctcatagccctctgagaatcacaagggtcatccagtgctcagtcatctcccagtttggtccatcctgttctctacacaactgtttcaagcatctttggaaacacttagctttgggaaagtagctgaaagtgtttctcagacacctccctgggaatcacctacaagcatcttctgtcagccctccatcttcccacattacctacatccttgagaggaggaacacagtggatagcactgcttcctcagctcaagtgtctgtcctcatcatctcagatcctctattgccatcatggtttattgctgcccctcagcccgcagggtgccatcatctggcccttttctttgactccaactgtaaccatacatgcataaatacatgcataatacatttaattaattttactcttattttaaactacccaatccacatttgttaaagaaaattacttatcttgtatactagagaaatggctcagtggctaaggtcactcgctgctcttgcaggggacctgagttttaaccacagcaaccacatggtatggctcacaaccatctgtaacagcatctgaacaggatgtaacaaacatctgaacaggagattcaatgctcttttttagccttcttgggtacttaagtgcacaaacccacattcaaatatatacatagacatataattttaaaaataagcagccagggagaagcacctgaaaaaatgttcagcatccttaatcatcagggaatgcaaatcaaaacaaccctgagattccacctcacaccagctagaatggctaagatcaaaaatttaggtgacagcagatgctggcgaggatgtggagaaagaggaacactcctctattgttggtggtattgcaagcttgtacaaccactctggaaatcagtctggtggttctcagaaaattggacatagtactaccggtggatcccgcaatacctctcctgggcatatatccagaagatgttccaaccgttaagaaggacacatgctcaactatgttcatagcagccttatttgtaatagccagaagctagaaagaacccagatgcccctcaacagaggaatggatacagaaaatgtggtacatttacacaatggagtactactcagctattaaaaagaatgaatttatgaaattcctaggcaaatggatggacctggagggcatcatcctgagtgaggtaacccaatcacaaaagaactcacatgatatgtactcactgataagtggatattagcccagaaacttagactacccaagatacaagatacaatttgcaaaacacatgaaactcaagaagaacgaagaccaaagtgtgaacactttgctccttcttagaattgggaacaaaacacccatggaagaagttacaaagaatggagctgagacgaaaggatggaccatctagaggctgccatacccggggatccatcccataatcagcccccaaacgctgacaccattgcacacactagcaagattttgctgaaaggaccctgatatagctgtctcttgtgaggctacgcaggggcctagcaaacacagaagtggatgctcacagtcagctattggatggatcagagggcccccaatggaggagctagagaaagtacccaaggagctaaaggggtctgcaaccctataggtggaacaacaatatgaactaaccagtacccccgccccccagagcttgtgtctccagccgcatatatatcagaagatgacgtagtcggccatcagtggaaagagaggcccattggtcttgcaaactttatatgcctcagtacaggggaacgccagggccaagaagtggaagtagtgggggaggggaatggggtgggagggtttggggacttttggggtagcattggaaatgtaaatgaagtaagtacctaattaaaataacaataaaaaattttttaaatggctattatcagaaaacaaaaatatcaaatgtcagcaaaactgtaaaagcaaagttaaaacattgctacatgcctattcttggtggaaacttaaaatgttgttgtctctgaatgaaataaaaatacagtcatagcagggcagtggtggcgcatgcctttaatcccagcacttgggaggcagaggtaggcagatttctgagttcaaggccaacctgttctacagagtgaattccaggacagccagggctacacagagaaccccagtcttgaaaaacaaaaaccaaaacaaaaaacaaaaacaaaacaacaacaacaaccaaaccaaaaccaaaaaaaaaaaaaaaagcagccaggagatggcagcacatacctttaatcccaaaattcgggagtcagaggcaagcagaccttttgagtttgaggacaacctggtatatgcagcaaatctcagaacagccaaggctacacagagaaaccctgttttgaagaaataaatcaataacaacaacaataataatttcaaaaagaaagtggtttatcttgccacttctctgttataagatcctagcaattgtaaagagctaaacaactagctataagaacagtatgaagactaactaatgcccaagacgtttacagttagcctaatactgccacagtgaattagagatcagcctgaaaagggacagtctcaggcagcataagaacctgaggctcctgggactctgagagccagccatgtctgtgcagctgaaaacacagggaaaccagaagactgaaatggtaggcagagttcagttctcttgttctaggttctttagactgtaaatgaaaagaaaactcagttcagaattaatccactggatagagatttctagactatattgtagaattatagaacttaagagaaaaaaacaaaacagtatggtaatttgaataggaatggcccccataaggctcaaatatttgaatgcttggtcattagggagtgccactacttaaagagattaggaggtatggccttgctggaggaagtgtgtcactaggggtggacattagggtttcagaagcccaagccaggcccagtgactctctattttcccgatgcttgtggacctgaatatagaactctcatttttcctgtaccacaatgtctttgcacaggctaccatgcttcctagccatgatgacaatgaactaaacctctaaaactgtaagccagccacaattaaatgctttcctttttaagaattgttatgatagtggtgtttcttcacagcaatagaacactgactaagacacttaggaagattaaaattatagaaacgtcattgggtctccctaattattttttcctccctcctttctttttctctcttcccaactttccttagccatacctactctatccttcctcatctctctgctgttgtacctctcaatgaggtgaggggttaatccatgtgccgtctttcatgtattataggttagacttggcggtagagccctggactcatgccttcccaatatttctaccagaaaaaatagggggtcctattttcttggttcttattttaaccctccagagaatccatttgagcctggcttggatccagtgctcattgcatggtggggaaaagaacaagagaagtgagctgtagtcaagtcctactgctagggcagggggtggggaatctcccccagaacagaatacaattccagtgaaagtcagggaggcatgatggctatgagaaccctgaaagagccatgaacttagaagaggaaggcagattttagaagcattttgaacaacaaagaaaaaaatgtacataggaattgcacccatagatgctagaaagacgtgcctccagctatcccctatcatagaatataacacagttgccatcaatgattagaacagccctgccttccctgagggaagatggaagaaaagctaaaaggtagtatagaaagaaaagacagtattcctcctcacagaaagtgagttccaagattcatcaccccagaagtacacattctcttaggcagaaagtccttactgtgccaagaggatcccggtagagctccaaaagccactcactgtctgccttatagccatctactgatccatcttgagaagttctgtggccttagcaatgtgtgggaagagataccttgaaacaatctgtcttagtcagggtttctattcctggacaaaacatcatgaccaagaagcaagttggggaggaaagggtttattcagtttacactttgcatgttgctgttcatcaccaaaggatatcaggactggaactcaagcaggtcaggaagcaggagctgattcagaggccatggagggatgttctttactcgcttcccctggctcgctcagcctgctctcttatagaacccaagacatccagcccagagatggcaccacccacaaggggcctttcccccttgatcactaattgagaaaatgccccatagctggatctcatggaggcatttccttaactgaagctcctttctctgtgataactccagcttgtgtcaagatgacaaataaaaccagccagtacaaatggtatatctactagtaccagttttcataagccacaccacctgattttagattttattcatcttctgagtttcatttcccctcatacatttgtttttattcccaaatcatcaaaacgggtttgccttgagctcttcagggaaaacaggacagaaattaattaattgatgcttatgccagtcattgtctaaaatgttccttatgtatgatgacttcagtcaatagctatttaagttaatttaaattctaagaaagaaatagtaaatatattagacactggtcagacatcattgcttcaaactctgtaaatagcttctgagttttcgtttgcaagtcaaagacacaaacctaaagacattcattttttttctgactaatttctttgcatttatgtaatgtttggcatattcatgctacacatgtctttgaagctaatgctattaaggaaatgctactaaatcaactataaagtaagaatttatcctctcatttatggatatttatttttttaattgtatggatttgttgatgctagacagtcttcttagttttaaactatctggagtcttaaatactatgtagtgtttctccaggaggtggagtgttagactagagaaagcaaagccatgggtgaagcctaatcttttcctttttttttctattttgagaaattttttatagaaaacataaaccacctaatgggctccctaattcttttaattgcatcaattcagcagaatccaattacactagacctcaagaggcaggtatattttactgattgcattaccataataatgatgccatagtgacaatggcgagcgtttataattcctctcattctaacatggcttatcaagccaagccgtacatgaagcctcctggcatctctgaaggagaaatcatgcacacaaacagcaaacaaagagctgcctctgaaagtctccacctcccaggagtcttctgcctcatggaaaagaatgtccttcctgactttggtaataagtcaagagccacatgaccacttccagcctgggaactggtcagattgctaatgtcctcccagggacaccaactcctgctttacacatctgtctctcaggtccctccctgctttaaaagccctggttggacctggccttgagagaagcatcctcttaagccctagtgctgggatcaaatttgctgagatcatttggagcatatggcacagacaactcttgatgcacactctggatctcaaaactgcgaggtacagaacagcagcctagttgggtagactcctcttcccaccctctatctactgttggttggctgcagtgctagtgtcctgaaaggtcacaatttaggtgacatcccagagctgggtctcagcagaagtctgctcaaagccatcaaggagcctaggagagtactgctcctgagatgcacagaatcatccgtccatcttcctcttcactcttcaaatgagaaagttaaagcctaggaaggctttgtgacttgttgacatcacacagatgttcagttgcaaaaatgaggatatccctaattactctcccacctgtcccttcttcacactggacatccagagctagtttttaggagactcctaatgatcatcataaagagaaaaagaagacaaagttctgcccatgactctagagaacggatgaggttgcttcagaatggtattgtagcaatcaaagcatagccctcagaggactgattgactggctggctagcttgctgacttcttgcatttttataacactctgaattggttttggggaaagcacctctttgccacacattttcacccttagaaatgcatgatcaagagatggacattctactatgaccctggccacctctggcctcatttaattaatataataattagaataagcattaatgaatttgcagcatgctggaagcatatttgagaaatcatggcgcatgtgaaggactaagaggagctcagccaaacacaggcgaggagaagggggagacagtctcatacctctcctgactctagaatgctgtccctctcctttctagccccaagtctttcgttctctcctgtcttgtccacctgtggctagctgcactgttcagtgagtgtttcctgcataagacaaacaccaggtcacatattcaagcagctgccttagcaacctcattgccaaccctatcacacacaaaggttctgctgactctcacctgttctgaaggacataaggttttcagctatgtggttccaggagctgttcatgttgagctcagatttctcagggcagtgagaaatagaccaaggcatgaagatacagagacctaggaggagcatctgatttcttttttgttgtcttcagagccaggcttcctcactccaacctgattggcttgacagtctacagtgcttcagtcaatggaattattcatctaacactccctcaagatggcctggtagtccaccagtgggagaagaggctcttggtcttgcgaacattatgtgccccagtacaggggaatgccagggccaggaagtgggagtgggtgggtggggagcagggcaggggggagggtatagaggactttcaggtttgaaatgtaaatgaagaaaatatctattttaaaaaatgctcccttaaagaacaaaagttctaaaggaagaactggagtacccatagtttcacacgcatgcatgcgtgcgcgcgcgcacacacacacacacacacacacacacacacacacacacatacacacatacacacatacactagcagaccaacattgttcagccaaaggttcttttaataattcttatatgaacacccattaaattataagcccatttcccatggatcagagacagacagaaaagactgcagaaaaagaagaagacaggagtctagagatctggtggtaactcaagggctccaccaccaggaactgttttctttctgcctgctatgcccagcgaccaacactaaacaagcaggagttatcttcaactacgtagtaaatccaagcccaacctggggtacaagagacataaggtgctctccagtaagcagcacgcctccatggcctctacatcagctcctacttccaggttccagccctgcttgaggtcctgcttgagtcctgatggactatgttgtggacatacatctaagttgaaataagccccttcttccccaagttgcttatggcattggggttttatcacagcactggaaatcttaagtaaaacagtgcccgcagctgcccgggatgcctctatagtcagacttggcaatactagactttttaaataccaggggagtgaaaatctcactattccacatctgttatacaaaaccgtacaagaagagcttagcacaacgccttgggtactacagttgcttaacacctgctcttgtttttctctgctgataccacaacaccccattccctgtaaagacctctagaaccaggttctctaccagactaggtttatcataccttacacgataaaggcacagcagtctgagttcaaacgaaggacagaattcacatggccaggtaaacacagggtgtaaaaataaaaagggaactctggtaaaggagagtagaagatttagacaccccaaagctgagaaagcatagcccagggagaacagatgtggagggtttccaaatgctgaatgctagggataaaactttcttccttatgccacctgggcctggagagtaagttgccccaggacagagttactactagacaagattgcttgggtaagggaacgtttgctcagatttgaggttgcacagggtcttttatgaacttgaacttgaattcaacttcttactacactgtacaatgcatatttatagatttaaagccacatagtcttgtagtctgtacagagtctggcatctgagtgactggctgaagcaaagggctcaaaggtgccacctcctggaaggatgctcccctgcatccctacatctactctgtcttctgaatgactagttttcttatcttgtgtctgataagaaaactagttccctttccttgttcagctgcctcattcctcaacccttcagaaccacatcattcctgctgatttctttaatgtcagagtgccttctcttcactccgcctccctcccacaggggctcctgtgattccctgagatctccatagatagttcaaaataatctcccacctcttccatacatcttcacagtccctcttgctgtgttcaggtcagcagagctagacagtgggtgtctctggggtcaccatctgtccaccatatctctgttctggggtaattccagcactgtctctgacatccatccatagccatgaagaaatctggtgtaacattgttccactgagaagttcttcatgcttggatagggacaccacggtcttgcggcaaaccatcagcaagaggtactgtgaagatgcacgtaagagctgccacttcccttctgtgctgccacagcatagcctcttcaccacttctgtgccagcccatctaccaccagcttccttcccagagcaggccgaagggtgagcgagcagagagggaaagaaagcagtgaagtagggggcatctcactcctggtggggagaagtgggaagagttctcttctctcccagcatgccttctgctggtcttcattgaagaatttcctcctacctcccagcttaactccgtgctgttaaaggtcaccatttgccacattttacctgttgtaaaccacttccctagcagagtagataatgtggactggaatgatctagtattgccccgagatgtctgtcccttttgttgtcgctattgttgtttgcttttaagactctcacactgtcatccaggctggtcttgaactcaccatgtatcctaaactgatctcaaactcacagcaatcctctgcttcagattctaggactccaggtataagccaccatgcctgactatttttaattactttattaatgaattaaaactagatatagttgtattatatctttagatatgtggttttcaacctccctaattttgcaatactttaatgcagctccttatcttgtggtgacccctaaccactaagttttcttgttgctacttcctagctgtaatcctactactgttatgaatcataatgtaaatatctggtatgcagaatatctgatatgccacaccaaagaggtcatgacccacaggctgagaatcactgcctagctaggtaaccattagttgactaaaccaaaacttttgagggagccattattgtttcaaagcagagggaataaatttcatttaaaaaatgtgaatcttagtacctttatccaagctactggcttcatagatattgatgataaatacaggggtttctttagccttgagctcagtacaggtactatgaaatgactctcatgaaagccaagtccgtctagtctgaacccttagaaacagctgagaagaagagggggttccatggtgtgcattcagaaggtatcttgagactaacttcacttctatgaccatggctttgagaagagcactgtcaaacgtcaacatgattgttctgagcacctgtcacgtgctgggaatggtatagaccctttgtgaacatattattctctctctctctctctctctctctctgtgtgtgtgtgtgtgtgtgtgtgtgtgtgtgtgtgtgtgtggccactctacatgcatgtggaggccaaacatcaaaaattgacatagatccctccatcactctccatcttttttttttttaaaggtagggtctctgttgaaggaaatatctaaaaagtagagccgacacgctcccacggttgtgcctctgccctggcagcctggctggccatgcactggtgggcaaaggctgacctattttatctcctggagattctctggcctggcgctccgtaatgtctccacccagctcacaactgtcaggttgcgaccatgccaacctcgtgcttcaccccccccccagcctttgtggtgcacatctggcaaaccgatgctttgccactgtacctctctctcttgaacccagctgagctcctgcctaaaagaaaatgcaacacagacttagttcagaaacaatggtaactcaatctccccagacactaaacactaaaatttgatatttttaaaggatgaacttatttgctctatagagcatgcatataaacattgttatattgtgatctatatatatccaaaaattgaatgataattatccggaaactgacaagtgattcaattatacatttactatagacagagaaaaagttcacaatatactgtgaagttaaaagagggcagggcaggactggagagatggctcagtgaccaagagcactggctggttgttcagaggacccaggttcaattcccagtacccacatgacagctcacaatcctctgacttcatccctagtgtatctgatgccctcttcccacttctgtgggcactaaatgcacatggcacacagacatgcatgcaggcaaaacacccatacacataaaataaaataaaataaaatactaaaaatagttggtttctactcatttttgaataaatgaaaaaatataattatcattaattgtcatcctatgctatttttccagaatgtttacattattatttttctgtgacagatatatatatatatatatagagagagagagagagagagagacagagagacagagagacagagagacagagagacagagagagagttttatccagttttaaagcattagcaaaatataagaaaatttgagtgaaatccactctatgtatattaaatgaattttaattttttttaatcctgacttttaaaaaaatgaagcagttaatgggttttacaagggagtgctgcagttacccatgtacgccatgagagggcgtcaaaactggccactgatacttagctgcagaaatgatgtcgctagatcccaaggcatttctagcttaaaatgggcaaaagtttctctgaatagagtaagcgtttgttagtgatatattttaggacactttttcagtgtacaaaaatttaacagtaccatttccctaaggtgagattctcaaaatttctggaaatatgtacactaacacttaaccctgactgttcgatgatttaagttataggggaaggttccagacaaacagtaataaggaatgtctgtggtggccagttgtgaatggagcgtaccagtttctagtgtagtgcactcttcagacaagtccgaggttcccatgtgctcgaggacgctgaacctgacatttgacccccctgtcccgcgaccctgagctggaatggaaggttcttccaaagaaagagtgtgtcaggctcagtatcccccattactaggagtcgtctctggggtcatccttggtagattccagagagtttctctgcacttactttacacacacacacacacacacacacacacacacacacacacacacacacacttccaagcatctctttcagtattttcccaatacagtgagttcccaagcagaaaagtccaggcatgctggaaatgccacggcacctcaaccccagtatctgaaatggaacttgtacccaacttgctccaaatgtctatatacaaaaatgtctgtgcctcccattcagaccttccagggaaacccgggcattacagaatgaggactaccacgcctgcctacttgttaattttgatcattcatattgcattagtatcttttcctatttctatgaccaaatatctgataaacaacttttaaagaaaaaacatttttctcatattatgattattgctgttattctcacttataccttaaaaaatacagtctatcatttcagggaaagaaaggcacgttacatcacattacagccacagccagaagatgaatgctgctgctctgcccactttctcctttttgttcgacctggagccccagcccagggctgcccacactcaagctaggtcttctcttctcatttaacctatccagacaaacctaaacatgtgggcctgggtaccagaggttttccacagagacctctggccagtcctgctgcgagggttcctgtgaagggaagtgagtgcaggaagggagatgaagtctctgccttttcttccaggtcgttcagtaactccaagctggccatgcactgagtcttgtctggctgagcctacgagaagccaaaccagtgaggcctgtggaaggacctcagggagatcttcttcgggagagaagatctcttcccaagtgttacagctcttggaacaaaaaactcaagggacagaatagttctcgctcacctttaatttcctggatagaatttatatgctgttttggggggtgattcaagcttagacagcaggtacctctcattgggttggactgagagtttgggggaaaccttacttgcatatgggaaggcttggtggtgctcctacatggctgatagccacacacctctcttgtgggggctgtggggagggtaacttcgataggagccgagggtccagaagacatgatcgaatgccttccgtcccatataggtaggaatcaccacacatcggttccccccagggttcaagacctatgctcgactggagaccaggctgtctatgtgcagtccattgctccacataaacatactttgtttccatgatgattctaaaaccaatcaggtagactatgaagattaaccattgtaataatactgtgtgccaatttacaacacattctagctgttaggtaactgattatttctcatttttacatttgatttcgttggtttgttggttgtgctagggatataacttagagtcccaacatgttagacaagagtcccagcactaggttacacccctatccttcatctttactatttttaaattgctccttactttataccactttctctgccacaagaggtatacacaaacatttaaatgcattattaagtaaatatacaaaatagtatattctaatttatatcttcagccccatgagacagtaatcaaaatgaacatagcatcaagtagtacttgccctcctggtacactccattttctatcatgctgattctgggcatgaatcagaaactacattgtggccttgatgtttcaaagtccaaccacttataacaccaacgctcatgttctgccctcaagcagcttgtccaccacttcaaacactattagtctcagagttaacaagaaaaacatcccagggcctcctgttcagttctgatgtctggctatgaaaacttcaaagaaatcccaaagtttgtggaacatgccagcaatgctagtacttccaagggagaggtagaaagctactgtgtttgaaggcagtctgggacccatactgaaacgttgtacccaaaaataaaacaactgcaaagaacccaaaataataaaaaattagaaattttctatttaaataccttgatgaagacaccatgtagatgagaaacagggttcagaggcccctgagttgaaactgacctgaaagtctcctctctgaggactagctttcatgatgtcagaagtcatcatacaagcttccaaaggatggaggcaaccaattgtccttcccagccatgacacctatgaaccacataaacaaccagcataacatgataactgcaatggtgaagtagtgccacacatagcttggtggtagccaacagctctctaatttgatttaggacttgctcaacaaggaggccatgttggtgctggaaacttaactaacaccttagtgctagtaaagtcctggttaccagaggataatctatacaaccaaagatttactaaaccagcataatctctaataatttatgaacatttatttttaccctcattagagaaacttctctttgcaacatacagacactgccacattaaaacacaacctatcaaaaccccgagttgtggagccttgtctcattggatacacctacaaaatgttcccaatctgaaagtttaggaaacactacagaagaaaggtcagggagtttgctatgagattgtgtctcctagtaacatcagaatctacacctataatctcatcaacatgactctccaaattgaaaccaaaccaggataacacgtacaaacatgccaaacaggatggagacaaaaaaagcccatgaggcttcaacactgagtgctacagtcaactggatataatttatatacagtttagggggtgattcaggattcgatagcaggtgattcaggagttggagagattgtcttttccaggcaagagcaccccaaatgctagtctagttctaaactgaaaacatatatgcaggtgcatgtgtgcgtgtgtacacacacaaatatatagatagagagatgatatagagatagactgggctatactacaccccactcctacagggtttgctgtatttggattagttagtttcagaatcagaatgtgatgtggccttgatggttgatcttcaacatatagacaaagaaaaaagggtcagctttgtttgtttttcttgattgagtcagcttgaagctgtgtgttaagataaaccactaatttcactgcttttggcttacttagcaaaaaagacctaggcctggtagctcacagacctgcttcagattcctaagtagcttgcaccacaatgccaggttatattggagattgggtttttttgttttgttttgttttgttttgttttgttttgttttgttttgttttgtttgttttttttaatattggcaatgttttactttcctgtttggtgattttttttccctttagtgcaaagtctgagatatctagcaatgaagcattgtgaaattccagaaacttgcactgtgtttacagacctgattgccccaccgtgccactgcttttgatgttaacagagtttaaggtacaaacctgggccctagcagccttaaaaagcaaggtttgcatgccagtcctcagtataccaactacaggcacatgcactagtgaaaatcagagaaaagggatttattcagctagacacattgggaagggaacaaattcaggagtccacacacaccatatgaataccttctagatcttgagatatacatacatgcgtacattcatgcatacgtacatacatatacatacatgcatacattaacacatgcatacatacatacatgcatacattcacacatgcatacatacacacatacatacatacatacatacatacatacatacatacatacatacatacatacatacatattgcacacacacattcagttctgtgactccacacatcattattccagctcccatgtctcctgcaaggtcatctgagataagctgtcagacctacgtgtcaccaatgtgaaatctctttctggttggcattattaagtagctagactgggattaggagcctgggaggttgttgaggagagacccctccccacaggctttggacccttcctcctatttccctggtaaactagaaagataaacatcataaccagtcttccttaggcatcctagtcaaaagtgtggaatacctgtgactctaaatggagatgtaacattctgaagcgacccatgattaaaacataatgttcttccctcccttaagagttaattcactgtcaagcatctggcatggagtcctctccacagaatatctgattcatgtgaagacatgcttgggaaaggggaggagtagttaccctctcaatgacataagtagttaccttcccttcctacagtcattacacagcttccctctgggcaacactgtccaggttatctaatatctgggtcaacatttcttttttttttttctttttccttttcttttcttttgagtaactgtctttcagatattgtccaaaagcttaagtatgcttttccagagactctgggttctctctctctctctctctctctctctctctctctctctctctctctctctatctatctcttgtatgtgtgcaagctctcgctctcatctcaacacccccttttattagaaatatactttgtctatatatcctcaccaaagacattagagcgatggttctatgcaggcaccagctcaccctctccaagtttaatgagttgtgtaggtgttgtcttcagcaataaggcttgctgtcagtttgcagagagcaacctactgtcttggcaacacccagggttatttgggaatttctgtaggacccttttggccaacaactcaacaggatgtattcccagaactggaagcttcatttggtgtcaagacatggctagttgggactccttttccctcatcatttgggaatttttttaggatggccttcatatattttagaaagtcactgaactgggttcgcatactgtccctcaaatgcctgccaattctagctgtctctcactggattcctttcctcaaccccatttcccctcctcaaaccccgtattcctctctgggtctatgattagcatttatttgatggctaatatttacatataagcaaatacataccatatttatctttctgggtctgagtaacttcactctgaatgacttttttcgagttctatccatttgcttacaaacttcatgatgtcattttttaatatacattattttattacaaatttaaaaaaaaaacaaaaaaatgcaacatcctaaaaaatttttttactggtaatacaaattcctatgaagttttttttttttttttgctagcataagaaattaaaaaagccattaaatatttagaaacattcaacatcaaaagctttaaatctaactgtagttgtagcccctgaaaaagctacaaactcttcttaaaaagtattttctctacaaagaatctcatcagctatacaaaaatctgtacagtttttatactgaagctaatgttgagctgcacttgaatttcacattcttagcaaaataattgcctgagcaaatatactccacactttaggacagccacttattcttcatcctcctcttcttcctcttcatcttcctcctcttcctcctcttcttcctcctcctcatcttctggttcgttcttctttgagcctgttggcctaccaggacccttctttcctgcttcacttttgcccttggcacggtatgcagcaatatccttttcatacttctcctttagtttagctactttctgctcatacggttgtttatctttggcagattgctcagaccacatctcacccagtttcttcgcagtatctccaatagacaggcctgggtgttcaattttgatctttgggcgattttcagagcaaaacaggaagaaggcagacggtggtctcttcggagcattggggtcttttttctttcctttcttatcccctttgggaggaacatagttcttcatctccctgtcataacgagctttgtcgctcttggccaaatcttcaaacttggacttttcctttgaagacatggtcttccatctctcggagcatttcttggagaactcagcgaagttcaccgacgagtcgggatgcttcttcttgtgctcctcgcggcaggtctgcacgaagaaggcgcgtacgaggacattttgccccgcggcttgttggggtcacctttatccatgatgacggctcggcgtctgtctacctgctgcgagcgctgcttccctcagacctccgcagagagacttccttccccaagctccggcgagaactggtttcttgctaacgcaatccccagcctcttgttttgcagagttctccgcgccacggcaacttgaccatgatgtcattttttaacagctgaataatgctctattgtataaatgtaccacattttatttatccattcatctgttgacatctaggttatctccattttctggctattatgaataaagatacaatgaaatggttgagcaagtgtccttgtggtaggatgaagtgtcctttgggtatgtggctgaaagtggtatagctgggtcttgagatagattcccatctttcagaggaacccacatgttgatttccataatggctgtgcaagtgtgcactccaccagcaatggaggctcctccaagtttctcttgcgccacatctctgccatcatatgctctcacttgtgttattgatcttaaccattctgacaagtctaagacagaattttaaattagttttgtgtttgttctttaatggctaaggatgatgaacatttctttaggtgtttctcagacatctgagatctctctattgagaattctgtttagatctgttcctcattttttaattggtttattttttttaaaaagtatatggttccttgagttctttatatattttagatactagccctctattggatgtggaattggtttaaaaaaatcttttcccattacataggctgttacatggtctgattgatggtgccctttgtcttacagaaagttttcaaatttttgcggtcctgtttattaattcttgatcttagagcctaaactaatggtgttctggtcacatagtcttctactgtgccattgactttaagggtagtccccattttctattttattatattcagtgtaactagttttatgttgaagtctttgaatcatttagagttgagttttgtgaaaagtactaagtatggatctattttcattcttctacattgagctttctaaatcttctgaatccccacctgatctttggccatgcagctgcttgctgacatccttgcttaatttgaaaggtatgactttctctcaatctccctctccctggcaactgctaagatttgcaacttgcttgactgttattttcctctcaagatctaataaagggccctttcttttcctaataagtccacttttaattcattttattaataagactaagaactttgaaaagaaactcagtttctccagtaacatgaacaaccataaagggacattaaaacgtttctcaggggatacagcaggtgatcttgttccaggactttaggtgggtaagcacttgctggtgggtcaaacctacagtgaatactctctgaataagctttctctaggagggattcaatctccaggctttatcactctgtcttgtctcaggcatataagccttttgaactgactctgtctcctgtgaaggagggaaaaggttcctattttcgcccatccctgcctccctttagtagcgataagagcaaactatggagtatatatgcaatgcctccctccaccctaccctctctgctctgtcaccattccccatgctgccccagtagagcagcacaaagtactgggtatatttcctattcctcctcatttccttcagtgtttccattgccttggattatcttcatgttctttatggtatggacctcattctcgtggatgattccttgtttccttctgattcactgcttagctattttagacatatatttccaaccacctgcccctgctccatgcacacatgtcttctgttacatgcatgctaacctaactcaggtgttcttttattaagaagaaggatgaccaagaaaggagctacagagacaacgtttggagctaagatgaaaggatggacaatccagagactacccgacccggggatccatcccataatcagccaccaaccccggacactattgcatatgccagcaagattttgatgaagggaccctggtatagctgtctcatatgaggctatgccagtgcctggcaaatacagaagtggatgctcacagtgtgatggaacacagggcccctaatgaaggagctagagaaagttcacaaggagctgaaggggtctgcaaccctataggaggaacaacaatatgaactaacaagtacccccagagcttgtgtctctagctgcatatgtagcagaagatggcctagtcggccatcactgggaaaagaggccccttggtattgcaaactttatatgcccgagtacaggggaatgccagggacaagaagtgggagtgggtgggtaggggagcagggcagggagagaatatagggaactttcaggatagcatttgaaatttgaaatgtatataaagaaaacatctaattaaaaaaaagaagggtgactatatttatgaaatgtattctggattttcctatagtcatgtgataaagtaaatgcatatctttttaaaaaatatacatcccaataaatgccccctcctcctagtccctcccccataaagtcacttcccttcatcccccttccccttctcctttgagagggtgcccaccattccctgagtatcctcccatccttatatcaaatctctgcagagttaggctcatcctctctcactgaggccagacaaagcagccctgtagaggaacaggttccacaaacagacaacagctttagggacagcctctgctctagttgttcagaaacccacatggagacatctgttacatgtgtgtgtatggggtctgggggacttggtcctgcccgtggaagctctttggttagtggttcagtctttgaaagctcctaagggtctaagttagtttgctgtgtttttcttcctgtggagttcctatccccttcaggaccttcaatccttccccaactcttccataagagttcctgacctctgtccagtatttggctgttggtatctgcatctattttagtccactgctaggtagaacctctcagagaacagttatgccaggttcctatctgcaagaatagcagactatcattaatagtatcaggaactggtgcttgcccatggatggggctcaagttgggccagttattggttgactatttcctcaatctctgctccatctttgtccctgcatttcttgtaaacggtagaaatttggtgggttggtgcccttagccctccactgggggtcctgccatatacccattgttatacttctaaactaaggtcatctgactaactcctgggagcttccactatcccaggtctctggcacatacttgagattctgcccactctccaatctctactactggcagctgcagatttcaagtcattctctgggtgctccggccctctctcctgtctctccctacatttaatcctgaccctcccattttcctgcaaaaccacccccaagttccctcccttcctctgcctcctatgactattttattccccattctgagattcaagcatcctcacttgggccttccttcttgttaagcttctttgggtctgtggagtgtatcctgggtatcctgtactttatggctaatatccacttattagtaagtacatactatgtatgttcttttcggtctggaaaactaggtcactcaggataatattttttttagttccattcattaaaaattcatgatgtccttgtttttaatagtggagtagtattcagttgtggaaatcgccacattttctttatccattctgtgttttagggacatctgggttgtttccagtttctggatattacgaataaagctgctatgaacatcatggagcatatgtctttgtggtatggtggagtatcttttgagtatatgcccaggagcagtatagctgggtcttgaggtagaactacttccactgccagattgatttccagagtcattatacaagtttgcaatcccaccaacaataaatgagtgttccagtttctttaaatccttgctagcatgtaatatcacttgagttttagaactcagtcattccaattgctgtaagatagaatcttggtgtcattttgatttgcatttccttgaggactaaaaatgttgaacatttctttaggtgcttcttgtccatccaagatttccttgtttaaaattctgtttagatctgtattctatttttaaattgggttatttgatttgttacagtataactacttgagttccttatatattttagatattagccctctgtcagatgtagggttagtaaagatctttttccaatctgtaggctttacagaagattttcagcttcaccagttcccatttatcaattgttgatcttggagactgagcaactagtattccgttgaggaagtagtctcctgtccagtttgttaaatgctatttccgactttctcttctatttgatgtagtatatcctgttttccattgagattcttgatccacttggacttgagttttgtgtagggtgataaatatggatctatttgcattcttctacatgcagacattcaggtagacaagcaccatttgttgatactttctcttatccattacatagttttggcttccttttcaaaaatcaggtgtccataggtgtgtgagttaatttctggtctttgatttgattccattaatcaacctgtctgtctctgtactaataccgttcagtcttttgttttttatcacaattgctttgtagtacagcttgagatcagggatggtggttattttattgttcaatattgtttagctgtcctgggtttttttctttttccatacaaagttgagaattgctatttcaaggactgtaaaaaacattgtgttgaaattgatgggaactgcattgaatctgtagattgcttttggtaagatgatcattttactatgttacaatcctaccaatccatgaaaatggagatttttccaccgtctggtatgttcagtttctttcttcagaaactttaagttctttttctacaggtctttcacttacttggttagagttacacaaagatagtttatattagttgtggccattgtgaaaggtgttgttttcctaatttctttctcagactgtttatcatttgtataagagaactctactgatttctttgtattttgtatctagcccctttgctgaaggtatttatcagctgaagaagttccctggtacttcaatgggcaggggttgggtgtgcttatgtatactatcatatggtcagtgaataatgatactttggcttctttctttctgatttatattcccttcatctatttttgttgtcttatggctctagctagaacatcaaatactatattgaatagatagtgagtgggcagccttgtcttgtccctgattttagtgggattgctttaaggttttctccatttaatttgatattagctattggcttgctgtatcttgcttttattatgtttcagtatatatcttgtattcatgatctctccaagacttttaacatgaagggctgttatattttgtcacagcctttttcagcatctaatgagatgatcacatgatttttttctttcagttattgcatccatgttcataaaagaaattggtctgaaattttctttgttgagtctgtgtgttttaggtatcagtgtgactgtcacctcatagaatgaatttggccatgttccttttgtttccatgttatagaattgtttgaggagaattggtattagctcttctttgaaattctggtaaaattctgtgctaaaaccctataaccctgggattttttatttttcttgtggaacttttaatgactgtttatatttccttggggcttataggactggttagtttacctgatcttgaattaactttggtaaatggtatctgtctagaaaatcatccatttcatttagattttccaattttgtggagtacaggcttttgaaccttgtgtttttgttttttggtttttctttaatttcctcagtttctgttgttatatctcccttttcatttctgatcttgataatttggatactgtttcttctttgccttacagttggtttggctaagagtttgtctaccttgttggtttttctcaaagaatcagctcttagttatattgattctttgtattctctttgctactaattgattgatttcagccctgagtttgattatttcttgtcttctactcctttttagtgtgtttgcttctttttgttctaaagctttcagctttcaggtttgccattgttagttgagctttctccactttttaaatgaaagcatttagtgctatgaactttcctcttagcattgctctctataagtttggataggctgttccctcattttcattaaattctagaaagtatttaatttacttctttatttcttccttgacccagtaatcattcattagagagttattcagtttccatgagtttgtaggttttctgttgtttctattgttgttgaagttaggctttaatccatggtgatcttaaaagatgtaagggatgcaatagcgctccatagccaaatacctgtgggaaagcactggtctatcaggagtgtggaaacacccgtgagcacaagtaagaccaccacttatgctcagagggacaagcccagagccctcatgacacgggatccgaggaacggcctgggacaggatccttccagtttccatctgcactgggagctgatcctgtgccacagtgatgcatacccaaataccatcaggaaaaaattgaactcccaggagcaccaatgtacttgtgagcacaggtaagaccacaacttctgctcaaaatcctggcccaagagcgacccagccagagcgatcaggacacaggaaccaaggcacagcctgggacgggatccttctggcttccatctgcatcccagagctgaccctgtgccatagcccttgttacccaaatttttcccagagagaactagtctcccaggagttacacaggcttgcaggagggacaagacacagtcagagacagaaagaccagctaacaccagagataaccagatggcaagaggcaagggcaagaacataagcaacagaaaaccaaggctacttggcataattagaacccagttctcctaccacagtgagccatgaataataccccaacacacaggaaaagcaagactctgtttaaaatcacatctcatgatgatgatagaggactgtaagaaggatataaataactaccttaaagaaatacagaagaacacaggttagcaggtagaagctcttaaagagaaaacacaaaaatcccttaaaaaatagcaggaaaacacgagcaaatatgggaaggaatctaaaaatggaaacagaaacaataaagaaatcacaaagggagataaccttggagttagaaaacctaggaaagagatcaggcgtcatagatacaagcatcaccaacagaatagaagagagaatctcaggtgtagaagacaccatagaaaacattgacacaactgtaaaagaaagtgcaaaaagcaaaaagctcctaacacaaaacatccaggaaacccaggacacaatgaaaagaccaaacgtaaggataataggtatagaagagagtgaagattcccaacttaaagggccagtaaacatcttcaataaaattatagaagaaaacttccctaacctaaagaaagagatgcccatgaacatacaagaagcctacagaactccaaatagattggaccagaaaagaaattcctcccatcacataatagtcaaaacaccaaatgcacaaaaccaagaaataatattaaaaccagtaagggaaaaaggtcaagtaacatataaaggcagatgtatcagaattacaccagacttctcaccagagactataaaagctaaaatattcagggtcaatgtcatacagtccctaagagaacggaaatatcaacccagctactatgcccagcaaaactgtcaattaccataggtggagaaaccaagatatttcatgacaaaaacaaatttacacaatacctttccacaaattcagccctacaaaggataaaagattgaaaactccaacacaagaagggaaactacaccctagaaaaagtaagaaagccatctttcaacaaacccataaaaagatagccacacaaacacaaaaacaacattaaaaaacaacaggaagcaacaagcacttttccttaatatctcttaacattattggactcaacttcccagtataagacatagaataacagactgggtatgtaaacaggacccaatattttgctgcatacaggaaagtcacctcagtgtcaaagacagatacttgctcagagttaagggctggaagacaaatttctaagcaaatggccccaagaaacaagttggagtagccattctaatatcaaataaaatcaactttcaaccaaaagctatcaaaaaagataaggaaggatacttcctacttgttgtattagttaaggttttacgctgtgaacagacaccatgaccaaggcaagtcttataaagacaatatttaattggggctgccttacaggttcagaggttcagtccattatcatcaaggtgggagcatggcagtatccaggcaggcatggcacaggcagagctgagaattctttgtcttcatccaaaggccgctactggaagactgacttccaggcaactagggtgaggatcttatacccacacccacagtgacacacccattccaaccaggtcatgcctattccaacaaggccacaccttcagatggtgccactccctggtccaaggatatacaaaccatcacacttgtcaagggaaaaatctaccaagatgaactctcaattctgaacatctatgctttaaatgcaagggcactcacattcataaaagaaactttactaaagcacatattgcacctcacacaataatagtgggagacttcaacaccccactctcagcaatgggcagatcatggaaacacaaactaaactgatacacagtgaaactaacagaagttatgaaccaaatggatttaacagatatctagagaacattttatcctaaaacaaaaggatataccttctcctcagcacctcatggtaccttctccataattgaccatataattggtcacaacacaggcctcaacagatccaagaagattgaagtaatcccctgcatcctactagatcaccatggacgaaggctggtctttagtagctacaaaaccaacagaaagcccacatacatgtggaagctgaacaacattctactcagtgataacttggtcaaggaagaaataaagaaagaaattgaagactttacaatttaatgaaaatgaaggtacaacatacccaaaacttatgggacacaatgaaagcagttgtaagaggaaaactcatagctctgagtgcctccaaaaagaaactggagagagcatacactagtagcttaacagcacacctgaaagttctagaacaaaaagaagcaaatacacccaagaggagtagaaggcaggaaataatcaaattcagggctaaaatcaaccaagtagaagcaaaaagaactatacaaagatcaacaaaaccagaagctggttctttgggaaaatcaatgagatagaggttttgtacattatcatggtggagattctggtggcatacaggcaaacatggtagctgagagttcattatccagttctgcaggcagtaggtagaaagagccaatgggccttccttaggttttttaaagcatcaaagcctatctccaataatacactttctccaacaaagccaccctcctaagcctttcagataatgccactgactggtgatcaaatattcaaatctaagagcctatcaagcctttctttttcaaccactacatttagcatagggcttctgattttgatggattattttacttaatatgtctcctgtgctctaagggaaatttaggggattatctttcagccataggtcagaatagatagtttttttctttttggaactccacttgatagctccaaatccttacagaaaaaaaaaattgatgccatatctgaaatagacaatcatatttttgttatgtcaaggaataaatttttttttaaagtaaagcttgacttctccagatttagatcctttgagggactgaccttgcctgtcaggaagttgagtccttgccattaaggtatatctggaataggatgctagttcccaggaagctttcaattggttcttacaaaccaaagtaattcttgaattgaggagtgtatgctactgctgattctcagctctattgattttcctggctattccacatttctcaatatttttttaaactcaaacctggcatgaagtctaatctttgatgtcaatgtgactgcatctgaaagcaactaaaatccaaggttctggacattccgatgagggatttccttaatcagacaacttgaattcagaagacctatcataaaccttctggtggtagctcatcttaaaaaacatggaagtgggaagctttgcctctttccagctggccttcactttcactggcaagtttatctatcctgttcctgagccattcagtctccctttttagaacctacttctttgggattccagagtagactgaaaactggcagctctgtaggacctccctgggattccagccctagactgagactgcacagacatctactctcagggactgaacaaatactgcatgtttgacctttcaattgcagacatggaaatatgtattgatattatattatattacatgtttactatagtgtataaactcttctcagttagaaaatcatggcttatattgccagtaaataagagaagaaaatgtttaaaagtatttaagtataaaattgggggggggtgttgttgtttgtttgtttgtttgtttgtttgtttttgagacagggtttctctgtgtagccctggatgtcctagaactcactctgtagaccaggctggccttgaactcagaaattcacctgcctctagctccttcaatttctcatatggtaagtgttcgtccaaaatcaaaaagttaggaagcctaaagacgtcatggaaggtcttagtaagttacatgaggtatataaataatgaaacagatgatatgtataatattttctgagatcaaaactgaacttattaatagcaaagttctatttaaatcagtatatttctcttatgatctattttttgtaacatttacaaggatttaaaaactgtctaatcaagataatgaaaaactttcttaacaaaatcaggatttacttgaaatgtttggttctacttaagctttatccaaatgttacactacagttgaaagtacaagattgatgtaactgatgttctcagtgttgattagacatgcttggaagctttaatagtttgaacaaggatgacctctgtataagcggaacaaggatgttccaacacttggtctccagttggtgatgctgtttgggaaggtttgggaatggcgaccttgtgggagaaaatgtgttactatagactggagagggatttgagattttaaagattccatgccacacgtggctttgtgttgcagttcaagatgtgcatggtcctcttcctgctgctgccatgccatccgcaccattatggactccaaacttgagggccataagccaaaataaacatttatttgtgtttggataagttgccacagtcatggtgtggcgtgtgtttgaaccaagtgttcaaacctctgatctacagaggccatcctcattcaaactcttacagcccccaaatctgtttattcaacatccagaaggctacatcaatcttttatttttaactttagtgttccatttaggtaaagcttaagtaaaactaaacgtttaaagtaaatcctgattttgttaagaaatagtttttaaatgattacagaaatataatataggaactcaacccagagaatagatcgctgctgtaatgaacctaaccatattaggttctggaggaatgaagaaattttggaactctggaaaataaaagcagttgaatgatgtaagcagtgcttattgggccatccttataggaaacagaaagacagtaatattggtagcaatgtggactatggaggcccaatgaggtttcagagggaacaagttcagcagcagagctagagacaacacctgtgagatttggcaaagaatttggctgccttttgcacttttcctaaaaattgtctgagagtaaatttaaagtaacacactatgtttttttttatggaaacaatttcaagaaagcataatatttagtctgcaacatggttattattagcaataaatgaaaaagagcaagtggaataaaaggaaatacaaatgtagttttgaagagaacatgatcaccactgaactaagcattacagccaagagctgagcataagtgctattaacaagagcatctctggggctggtgagatggctcagcagttaagagcactggatgtccttcaaaggactggggttcaattctcaccaaccacatggaagctcccaaactgtaactctaacaccttcacatgggtatatatggaggcaaaacacccatacaactaaagtaagaaatgaataaacaaacaaacaaacaaataaataaatgagcccctgctctgccctggaacaaagggaaggctgtcctcagagcaaaatcccacttagctaagcatacaacttgtgaaacaaaaagtgttgaggaatgttctgctcctagaaaacattatgatatggccaggaagtggaatacagtagtttgaatagcagtgtcccccaaaggctcaaatgtttggatattctcagttactggttctgtttggggagttctaagatatgacatgggaggcagaatatgagtgtttaaaatctccatgttacttatggttcactcactgttttgttgttcaagatgtgagctctctgcttcctgctcctgctgccctgcctgtcaccatcatatggacatttaactttcttagttacttttctattgctgtgaaaacacaccatgaccaaggcaactaataagagagtttattgggagcttacagtttcagagggtgagtccattaccatcatggtgcagaaaacagcagcagcaggcaaacatggcactggagcagtagctgagagtttatatccttattcatcagcatgaagcagagagaagggggggctaactatgatagtgtgggcttttaacacttgaaaggctaaccctagtgacacacctccagtgaccatacctcctagtcctcccaaatagttctgcaaactggagaccaaacattcaaatagatgagcctatgtgggccattctcatttgaaccatcacattacccttctggaccataaaacaaaataaactctttttctgtatgttgtctttgtcatggtcttttattacagcaaccaaaagtaactaagtgggaggtctgtaccaatgtggacagaagaactaaatggaagtcactgtattctgatctttgccttccaaggtcaaccaggtcccaggaaatcatgaggaatctctcctaaggtcctgcagctctgtctccttggtcagagaagctgtggaaaccctgatgtttgactctattcaacattcattctccaaaggggatagtcaacatggagaaatggcttcagtgcttctaaagtgatatggtcagcgagatcccaactcatctcaacagataatacaactggtaaacaaacaaacaaaaaacaacccaatacaaaaagaacaggatccaaaactaactgatccctgagtatcatgtccctaattttgactactgcatgatcttaaagaccctctacactttttgacatttgtcttagttaaggttttattgctataaagagacaccttgaccaagacttatcaaggaaaacatttaattcgatcttataaattaaaaaaaaaacatttaatttaaatacagtttcggaggtttagtccattatcaccatggcaggaagcatggcagcctgcaggcaaacatggtgctgaagaaggaactgagaattctacattttgatccaaaaaacagccagaaggaaactcttctatgcaggcagccaggtctcatccatactggatagagcctgagcataggaggagacctcaaagcccacctacacagtgacacacttcctccaacaaggccacaactcctaatagtgccatttcctatgaaccacgcatattcaaatcaacacagcatctatactacaggaaagtcctctatactctgtcaaaagagacttgtaagcatcaacccagccacagcaccactgtctacaaaggtaccctgcttacaagatatgctagtggaatggtgacacaaaacttgtaggaattaccaagcaatatcttatttgactgacagtccactaggaaaccccatgaaagaggagacagaaagagtttaagaaacagaggggggcccgcgccccggccccctctggagactcaggaggctagtgtgaccccgcggaacttgtcagtcaaacgccttcctcaaccccccccccccccgcgaggacctcccccgggccgcggtagcgcgcacgcacgcgcacagagtcccccctcacccgagccagccaccctctcaagttgtagcagttgcttcccgggcgtgctccgtgggcggccggtaggcgcgggaggctgagcgagggcaacgctccaaggatccaaggatccaaggatcggggtgcgggtggccgccccgggcgatgaggggccatcgctgacaggagaacgagcgctcggcggcggctcgggcggacagcgcgggcggcagctgctgaagacctgtccggactccgcgcgctaaggggccgtcaggcctgcccggcgtccgcacccgcgcgctcgccccagcggtccacacttcgggctcgcctccgtccgccctcttccgggcgtcagtaacttgtgcggcccgcgcgcccccgccagccccgggaggcggcagcgcggcgcggggaggcggcagtgaggcgctgtcgggtgaggagcagctcgcggagcgcgagggcggcacggccggcccgggacgcaggggcgcaggcccgtcgtgcctgtgctccgccgattgcccgggccagccaccgggggaggcgccgagcgcccgggtcgccgagatgtcgtcgccgtcgccgcccgcaccagttgcctgcgccaccatctcggcctcggataaagtggatggcttgacccggaaatcggtgcgcaaggcgcagaggcagaagcgctctcagggctcctcgcagttccgcagccagggcagccaggcggacctgcaccccctgccccagctcaaagatgccacttcaaatgaacagcaagagcttttctgccagaagctacaacagtgctgtgtactgtttgatttcatggactctgtttcagacttgaagatcaaagaaattaaaagagcgacactgaatgaactggttgagtatgtttcaactaatcgtggtgtaattgttgaatcagcgtattctgatatagtaaaaatgatcagtgctaacatcttccggacacttcctccaagtgataatccagattttgacccggaaaaggatgagcccacacttgaggccttttgacctcacttacagtttggtgtataaattcttcttaagattcttggagagtgggctggtgaggtggctcagcgggtaagagcactgactgatcttccaaaggtcctgagttcaagtcccagcaaccacatggtggctcaaaaccatccgtaaagagatctgactccctcttctggagtgtctgaagacagctacagtgtacttacatataattaataaataaataaataaataaataaataaatcttaaaaaaaaaaaagattcttggagagtgctgatttccagcccagcattgcaaagcgatacattgatcagaagttgtccaactgctcctggagctttttgatagtgaagatccacgggagcgcgacttcctgaagaccgtcctaaatcagatttatggcaagttccttggcctgagagcgttcatcagaaagcagattaacaacattttcctcaggtttatatatgaaacggaacatttcagtggtgtggctgagctccttgaaatattgggaagtatcatcaatggctttgcattgccagtgaaagcagagcataagcagtttctaatgaaggtttttattcctatgcatactgcaaaaggattggccttgttttatgcacagctggcgtactgtgttgtgcagttcctggagaaagccacaacgctgacagagccggtgatcagaggactgctgaaatttcggccaaaaacatgcagtcagaaagaggtgatgttttaggaaaaattgaagatgtcttagatgtcattgaaccaacacaattcaaaaaaattgaagagctgctttttaagcagatatccaagtgtgtctccagctcatttccaggttgcagaaagagcactgtaattctggaataatgaatatattcttagtttgattgaagagaatatagataaaatcctgccaatcatgtttgccagcttgtataaaatttccaaagaacactggaatcagcctactgtagcactggtgtacaatgtgctgaaaaccctcatggagatgaacggcaagctttttgacaaccttactagttcctacaaagccgaaagacagagagagaagaagaaagaactggaacgggaagagttatggaaaaagctagaagagctgcagctgaagaaggctctagagaaacagaacaatgcttaaaacatgcacagtattcagagcagtaccagtgccaaataaagatcagctctccctgctgggcggtagttttgtacactttttcttggggtgggggggatataaaaacttcagagcagacctcatctgtataatataattaggaggccagtttttcctggcaagcgtaaaagcaaaagaattatggactaaaacatagccctgtgctgtatcacagccaagtatattgtaaactctgtctaatcatggattgtgtcactgtctctgttgtgtgaggtgatggtgggagtggcaagcgtatgtttcgacttgagcccggttgtgctgcacacacagatgaagtcgtcctctgcatacttcctttatcatgtgttttcaccgtgctgcacaccttggtgctgcacaccttgagtacatctgaggaaagagcctcataagataagcggaggtgttgcccttccctcacatctcctagggaggtgtgggcgggggacaagagcccagcctcattaaagacactgccatactctgggttttacaacatctgacatttccaggcttctgaagcacaaagtattaaagttgggggaaagtaaaccaaaattctgatgttcccaaatccccccttctgcagcagcaccccggagcgtgtgcggagcagcacaggccacgggtggtcccgaggctcacctccttcattcctctcctccaaggctggaggcagggccttcccagtcctcaccatgccagtccccaggcctgcctgcctgcagggtggagctctgggtccctcccacagtgtgatgcagactgctagctatcactgcctggctttatgtaagggaactgcagcaggtgtcctcagagttgactatgtagaagctttgtctgtttttacctggtcaggtgtttttcacactttttaccagtagcatcccagccacttgccttgcagttgtatggaaaactgttttataatgagagatcttcactggaaattgagcagcatttaataaagtctatgtttgtattttaaaaaaagaaagaaagaaagaaacagagggggactactggagagatagcacagcagttaagagcactgactgctcttccaaagatcctgagttcaattcccagcaactacatggtggctcacaaccatctgtagtggaatccaatgccctcttctggtgtgtctaaagacagctacagagtattcacatacattaaataaataaataaataaataaataaataaataaataaataaataaataaataaataaatctttcaaaagagagaaagaaacagaggaggtaggggacattgaaaaaacaagaccctgtaaactaacaatgtctgcacacatatgaactcacagaaactgaggcagcatgcacagggcctgcagaagtctgtaccagatttggtcctagagctgaaaagaaagtgaacacatgaccccattcctaacccactactagcaacctccagttgataaccactttaaaatgaaagtttgttttttccccaagggaatctcactggggaaacaaactactctttaagagtaatctgcatgcccaggagtaaatgaccaacagaaaacaaattcaaaggcatctttggaggttccttgtctcataaagttgtattggagcctttccatgtttcttctctaggtcctgttatgcatatattatgacttccagtttagtgtttttatgggattcctgagtatgtgatgtgtgtatatctacttcttgtgcaatgccttttcttggtctctttttttttttttggcttgtttgttttgtcctattcttatccattactcttgttttcgcattaaaagaatacaatacaatacaatacaatacaatacaatacaatacaatacagtacagtacagtacagtacagtacagtacaatacaatgcaatgcagtacaatattattaccctttaggcgactgttatctgttaaaagaccaaaagtaatatggatgggaagggagatgcggagaaactgggaggagtagaggaaggagaaattataatcaggatatattatgtaataaagtgtatttttaataaaaggagaaaatgattagtatactgtctagtttttatcgtcaagttgacataggctacagtcaccttggatgtatgaatataaatgagaatttgcctatacagattggcttgtggcatatgtggggcattgcctttattgctggttgacataggaggcccaggcccaccatttgaagtactatgacctggggtttataaaagggtagctcagcaggcctgggagcaaaccagcaagcagcattccttggtggcatctgcttcaaactcctaccttaaggtctggccttggcttccctcagtgatagactggaatctgtcagatgaagtaaaccctttcatttccaagatgcaacagaaactcaacgagagcctctcgcctctctttctgtctctctgcctctgtctctgtctctgtctgtctctgtctctgtccctctctgtctctctctctctctctgtctgtctctctctaatgtctgtctctctctctgtctctctctctccctctctctcatcaatccaaggaatcctagacatgacaatcaatttcatataaactattataggaacaaccatatctccatctgattttttttttctgggcaagaaactgctgctatatacaagacaccatgatgtttggcttaatttcaacactgcagctgaaaggcaatgcctgggccagaagacagggatttaagaaaggatttctgctttcttgattgctttctttcctcaaatgaacatatttgcaatctatatatgagaacatgattaaaaggtagaataggacaggatcatgattgggacaactggagtggccaacccaccccctcctcattgccctacttcagttcctgccatgagtcttacacaaagtccctaggccagcagtttgctggtgccctgcttctcaggatctcttgcttcattctctaaagctcacatctataaactgacaacaaactcctttttgaactcttcctcctgtgaacaagagctcctgaaaagactgatggagcctggatatggtggcagacccctttaaactgagtattcgggaagcaaaggcaagaggatctctgagtttgatgccagctctgtctatagaaccagttctaggaaagcagggttacacagaaatcctgtctcaaaaaaaccaacactccagccccctccaaaaaaggacgattgcttacagaaaggggttgacatatcagaactccaatactttggagagattggaatgctacaggactagaggacgagaggctaacttgtctaccagggccagctctaagacactgccctaggcaaggtgcggggtctgctctcccagatgctgaagccagcaaggggcagggccattagcataggaaatttatgagcatctgatcagaaagacactgaagatgagaggcatttgttactttcaaccattaatgtggaggtgtctgagagaatacctcatgatgatcaatggccttatagggaaactggagaaatgttcctctttcttgggtcaaaagtgttgactcaaaaccacatctctaaccttaaaggaataaaagatagtttttctgaaattattttgggtgaccatggcctaggaacacagactttacctcaaattcatgttcaaatgtagaaacagttttatgaagtattatagctttatagaacaaaaagtcataaatcaaagcaagtttaaaataccgtggagttatagcagaggagtaggtacatagaaattgaggaatcttttttataggcccaagatactattgaataacctgcttagttttgaggttggtagaagcttgcagtctggtaaattaataaatttttatccattagtcacagggtgttagttctgacaccacggcaagactaatacttgcccaagataaggtatttagcttctggacctaccacattccagtctttccacagtgctgaaattctagtcactcagtttctgcaaatacagctgctttttggaaactcctttgcagtcctctttgttagccaaccaaaaattttttttttttttgtttttgtttttgtttttttgagacagggtttctctgtgcagtcctggctgtccttgactcactttgtagaccaggctggcctcaaactcagaaatccgcctgcctctgcctcccgagtgctgggattaaaggtgtgcgccaccacgcccggccaaatatttttttttgagtggggtcacatattatttattaaacatcatatgttcccacatagctaagcaactcattgctaggatctgatgtagaggctgagtagagcaagatagcctcttctagaaagaataggtgataaatgtaaccttttaaattatctgatattaataccaataaagacagaagtgcaaactgaggataaagcaggctcagcaaggtaactttcttttcttaattacatacaaagtatctatttacaagcctcatcctacagctaaactgctagctctttggaagtgtctatctgtgtctttctacggagctcggagctcatctacctttcccttgagctcctccaaacccaaaagggctcctcagttctctttgttagaatagtgcttgacctgtgtcctgccagctgcttttctgttgctcttttctgagagagagagagagagagagagagagagacactatgaaaggtccaattgcatataaaagaagtctctacctcctcccctacacccttggatggggaggctccagccaagtcagtagttgctaaatcatttcaagtttatggtgggttagctctagagcacccagctgactttgtctggggtcacacatcaagaaacacaagccttctcccaagcaacttgccttaacatggacagggactttccctgcattagcattcttatctatggaggcttttagaggcacgcctaaactgcatctcttcagaacacacctaacagcaactgcataatgctatacctatttaagctttgacatttttctaataattagcatttctacatacaataatcaaatatcctgtaacaggtaaaggccactaagaaacaaaatcctggatgatgttaaaccatctgctcatgatggagatctgaatgattttcttatgctctttatctgacatagcacatgaactgggatgactatatctacaatcaaataattaaagacacaatttgacctaatggagtgaagctaacaaatgaaggaaagatgtatttaaaataaccaaaatgtacatatttacctagattgactatatttccctgtgtttatagttatttgtactgtatgagctatcttactcatatttaagtggctggaaatgacacctccaatcactttagcattgtcttccctttttatttgtaaaatacaaacattctttaatgatttttaaaaaggctggataattgcactatagaactttttagataatagttaaaattagaaacatcaatacttaatgtataaatcaacataggtgttgttatttaagattgctatcttttgtataattctaaacctttggttatctacagctagagtaaagagaattcaagttatatttaaaaactagattttaaaattttatccaaactatactgtgtaatgagtgtatataggacagtaaaaaccttggatctcttaaatgttagttttggaataatgtatgggcttagggtaagctagcagtcataactacaaggcatgattaaatgaaaggacattatatattcacttgtgacttctctaagaccaagattattttatcacttaaagatatgttggtggaacaactaaatatcataaaaaattaaatctaaaaacttaaatctaagaatataaacattgagagaaacatttggttcttgggggtactcaattgtcagctaagaggagtaccatccagctacttaaagtccacatgcctgtgttctcagacgatgagagaaagctcactgtcttctaggaaatgggttaaaattatctggatacactccagttcttttaataagaatgaaatcttctgtgtgattttatttttcttttaagtaatgaaatcctgtccaacctgcctccctgccctgccccccatcccacttccccctccctccctccctttgagaaagactctgtaggtaattttgaattttagtaaccaaagttaaaagtcttttacaatattagtttacattattagtttatttaatagaccaagtcttataaacaactttaaatatttgtccattaaaacaagttttacaaatttaattcacgaggagttttctaagtagtgttgacataaaactacagctgtaaaatggctcagtggttaagagcactggctgctcttccaaaggttctgagttcaattcctagcaaccacatggtggctcacagccatttgtaataggatctgatgccttcttctgtgtgtctgaagacagctacagtgtactcatatacataaaataatttaaaaaaaaccctacagctcttatcttaaaaggaataagtaataatttatttggatccatttgagtggctatgtctccagagaacagatctgtgttattacaaactgttccaatgtaaaagtagtttcatgacatttttatagttttacaagacaaagaaagtcatacattaaagcaagtttaaaacacattagtgggttcaaagaggcaggtacaaggagatgggggagcttaatctacaggccaagatgctatctgatatcacgcttacttctggggttggtgggagctaatgatatactaagtcaataattttaaacggtcttatttattatcaaaagatgtcagagtctgaatagggcaacagaaggctcttccggaaggctaaaactatctcagataaatagcctgtaaaactgtaagattccagtctctccacagtattgaaatttcaattggaacatcagtctctctgcaaatccagactttttcaggaatttgtcattcatagccagacacagattttttttcagaaactgtcatttacggtatgtatcattctctaaacagatcttgttgttgttgttaaagcagtgaccctccaaaaaggaaaaggctttgtccaatgagcagaaaaaaaccctaaaacttaatcataggtttttaaaatccatatacgaaaacataaaatgcagataacaattttaataaggtcattttaaaatgaaagttcagggggctttttctaaaccacacacacacacacacacacacacacacacacacacacatatcataccttgaatatgtaacaattataaacacaggtaaattatatttgtagtttttgttttcttaaataaatctaaattaattacttgttaaatgtttcaattattatgactagtaccttgaaatactttttattagaaaaagtatttgcttttattagtgtttataaagcattcaaagtaggataaagtttatcatttatgactatcattttcacttttaacctaaaaacaggagaaaaaatttaaaatatatcattgtggggttaattaggctacttaatattaagcttatttaaactctaaagatgtattagtaagcctccaagtaggtttttgaaatgacaattagaaaaatacttaagagttggcacctatattggccttgttaaaatcagggtcttaaaaaactgttaggtagggctgatgagatggctcagtgggtaagagcacctgactgctcttctgaaggtccagagttcaaatcccagcaaccacatggtggctcacaaccatctgtaacaagatctgactccctctcctggtgtgtctaaagacagctacagtgtacttacacgtataataaataaataaaattttaaaaaactgttaggtaaaaaatattcttagaataatttaatgtttgtattcacatacattttcacacacatctgaaacatatacaaaagcacagacataaattgtcttcttgacctttggagtacagttcagtatttcaaggaagtgcaattgttcataggaagaacatatcctgcagcaggagcaaccacctcttaaagttcatatatgtctcaagcaatttgggccttgtggtagaaccagaactaaaataaggatcaaggagatagcatctagaccagaactatgtgagtatgtatatcttgtccctaaaagcagatttaaaattctaactcaaaaactcaagttaattgttccccaaagagatttagagccattagttgtctctattttagctatgtggttgcattagttaaatagactttttgtcatttacctttattttgttcctttaaatttcagttttttatgagccaaaataaatctgggtcaagtttacaactttagtttacatgagcacttacttataagccaatttggtactaagtatattatgaaaaataaataaacactgctttgtttagcaagtatagtaagacagtttggaggagtaaatgtttctccagttttcccaaatacttgcaagttagtaattattacacataaaactggctagaataccagaatgtggtttatctttaaacatttccttcgttttgaacaccttctgtgatggttattcttggttatcaacctgtcttcatctggaattaactgtaactcagaaatgtctagatacaattgagagggagttttgctttgttttgttttgttttgttttgttttgttttgcttaattggatcatttgaagtgagaaggtcaaatcttcgaggtggaaagacccacctttaatttagaccacaccttctgttgacagcctgtataaaggacatagaagaaggaagctctctctctctctctctctctctctctctctctctctctctctctctctctctgtatgtatgtcccttcctagcaaatccactccttcattggcattagagcccacttcttcaggattatggtatatactgaggaccagctgagatatccagtctcatggacttgagcaactactgaattcttagaccttcagtatacagacatacacatagagccattgttgggctagatggactatagcctgtcagtccttctaataaatcatgtgtgtgtgtgtgtcagagagagtcattctataaattgttactctaggaaatgcagaataatataacaatattccttcttaaatgctccccacacatacacacacttttttttttcttttctcctgaaaaatcgcctggagatgctaggaaggaaacttgtttagaatcagtttcatgtgctacttttgggattgactttctcagcttttaccctgagactgtcttctacatgtttgtacatatataaggatgctccagaaactgggtgagccaataaacttcatcctgtgaatgttaactttagcagctgcgtctccagagactgactgactagaattttagtactgagggaagattggaatgttcctgtcccaaagggtaattagcttatgttgagctagttctagcttccaaaacaaacaccctttgtctacctctgtgtctgaattaatgccctgtgactaagagataaaaacattttagagtttattaattcagcaaaccactagcacctatcaatcccaaagctaaggagtgtcaccaaacagcatctaaggctaatagacaatgtattttaaacatgtcctgattaacctaattctgtgttcctgagctgtgttttcttagttagggtttccattgctgtaaagagacactatgactaaagccactcttataaggacaaacatttgattgggggtagcttacagtttcagaggttcagtctattatcaacacagcaggtagcacggcagaatccaggcagacaaggtgctggagaaggagcagagagttctgcatcttgacctgactgcatccaggagagactgtcgcccaggcagctagaaggagggtctcattgtccacccccacagtgacacacttcctccaacaaagccatacctcctaatagtgccactccctaggacaagcatattcaaaccaccacagttgttacgtttcatactgcggtatgattgtggtggcggtgatgggacagttagtgagcctagacaaggtatccctctgaggaatcacaccatccaacaggcctagtataaagaagatttgttaggggcagggggagggctggaaaggggcagaaaaaggaggggagaaagataaaaagagaaggagaggaggaagaggccagccgggaacatgtggggacaagaaagagagagtgaaggagagagagtgtggggtagcagtcttcttataagctgaggcacctggcttgtacccagaagcaggtgatgatgtaagctgttgctaggtcactgttgctaggctcccaggaagagcctattggaattgtctgtaagtcaataacggtcactcatacctgctccagaagaaactatctcttattccctttaagattagagctgtggtttttgcattgacaattagggatcccaatctggggttctgagaatgatctttcttttggaggaatcacacgaatggaagctaggttccagcaaggacccattcttggagtccagacagcctgatgttaccttctccgctgatattggtaagtacttcccgggcctccagacatccgttggtttcgttggctatccattttggagtttctgagctggttaagtaggatcccctttagatctgctctctaagcatggggtttaatggatctagtttgtttatttgctttgaaatgtttgctctataaaaactgttctagaaatttagtttggcttgtttgcttgcttgcttgtttttgaatctccagagacattttagattctggctgtttaagtcatttttcaggttttgtttgcttttggaactttaaagacgatttggtttttaaaaagtttgtcttagttttctttgtctttgacattcattgatttattgtttttggcctttgtctcctgactctcctcttcaaatgcatagggatgtgtttggagatgaaactgctgtctggtactccagtggcttatgcatgatagttgctgactaacttgcaagtatttgaacaaatggaaagatctaaagacaacgtaaacatttgctacctccaaactggtatatctcctgtgcttaacaatgccctagggcattggttctcaacctgggggtcacaacacctttgggtcccacatcaggtgttctgcatatccaatatttacattatgaattaaaataaaagcagaattacagctataaagtagcaatgacataattttatggctaggggtctgtcttagtcaagatttctattactgtacaaacatcatgaccaagaagcaagttggggaggaaagggtttattcggcttacacttccatactgctgttcatcaccaaggaagtcaggtctgaaaatcaagcaggttaggaagcaggagctgatgcagaggccatggaggggtgttacttactggcttacttcccctggcttgctcagcctgctctcttatagaatccaagactaccagctcagagatggtaccacccacaaggggcttttcccccttaatcactaattgagaaaatgccccacagctggatctcatggaggcatttccccaactgaaactcctttctttgtgataactccagcctgtgtcaagttgacacaaaactggctagtacagggtcaccacatgtggaactgtattaaaaggtcacagtattaggaaggttgagatccactgcccaaaggattaaaaattttaaagataaaataagaaacattctttaattaaaatgtgaaactgggtgggctgtcttgtctagcctcaataggagaagacacacctagtcctcctgcaatttgatctgccaagggagttgatatccacaggaggcctccccttcactgaggagaaagggagagggtactggggagaagggaggtgaggcagagggactgggagagaagagggagagaaagctatgattgggatgtaaagtaaatattaattaatgaaaaatgtaagtgaaccataaaaaaactaataaaattggtaattcattacaataaagaactcttttaaaactccatgtggattaagttatatgctaaaataaaaataatatctaaaaatgtttagtttataccaaaactaaggacagaatctacaatacatcctcactctctacactttctttctttctttttttttttttaaagatttatttattacatgtaagtacactgtagctatcttctgacacaccagaagagggcgtcagatctcgttacagatggttgtgagccaccatgtggttgctgggatttgaactctggaccttcagaagagcaatcgggtgctcttacccactgagccatctcaccagcccctctttctttctttctttctttctttctttctttctttctttctttctttctttctttcttccttccttccttccttccttccttccttccttccttccttccttccttttcctctctctcttatccctttctattctgacccctccatgtaactggtgtggcagatacaaggacattataaagaaactgtctgtcaatatgataattagactgttgaaagaataaaaacttgctaaggataagggagtttcctgtgactctcatcttcagggaaggaaagagcagcaaccagagagtaaacttgtctcccagaaagagacttcacacaattctaatatcttgtcaggccacattgcaggatgagacaaaaacctagacaaggaagagtcacagatggaagtgactagaactgcttagctgtggaaatccttagagatgcggatgcttgcagtcaaccatcgaactgaccacagggaccccaatggaggagttaggggaagggctgaaggagctgaaggggctttatctgacatcaatgtgaggggaggcccttggtcctgtgatggcttgatgccctagtgtagacgaatgctagggtggtgaggtgggatggggggcaccctcataggagaagggttggggtggggataggggagtttcagcagggaaaccaggaaaggggataacatttgaaatgtaaacaaataaaatatccaataaaaaaaaaagaaaaaagaaaagtcttttctaagcatgtcatagataaaggtggaacactccatgggaaattagggacaatttgaaaaccttggagaaatgccctataacattcatagcaaaagtgtctatatatatatatatatatatatatatatatatatatatatatatatatatatatataaatcaatagggaaaaatcgatataaagaaaacccagtagaaggtactatgctaaagataaaataaacaatacatttccacttatcattaccagtaacacagggaataaaactgaaatattaagaataaaatatccgttttctatgtaaaaaaaatatagaggttgtaaaatttaatttaatccaaaaccctaagataaggtaaatgcttgattttttgcatccatattcttaaatattaatttgttcttagtaatatttaccaaaaacaaaagaactttaaaaactgttattttatccttttactaaatggtcatttaaaacctgtttctcaagttagcttttcttatccaaattatacaaaagtcatcagtctaaaagtctaatagcaatattcacaatgttttataacttaagtagtgatgttccttgatttaattagtatctaagctgtcctgtaatacaattagctaagattaaaaagttaaacaatttgtatcttactaataagaaagggggaaggataatgctacactgacttctcccaaagtccttttctaaccatttaaatatgttagttcatatattacaaataattatatatacaggggaaatacaaagtcaatctggttacaaagtttggttttagacatgtttcctttttgaccttcactccattttatcaaactgtgttgttgatttcttaatttaggtatagtcatcttagctcacatgttatgtcaggtacagagagtataaaaaataattcaagtgcggatcctgaaagaatggattgatatgatccaggattttgtttcttaatggcctttaccagctattctctctcctgaagatgctgtcctgcccactattcagcctcatctacatcaggtcctatgagtgagcttcctagttttgagggaacttatgatatttaataaataacatgtggcatcgctcctgaccaaaatgtgatgctttgtagacaagggaattgtgaatgacaactcctgagaggaggctgtgtctgagcagaccgattagatctgcaataccatggagagagtggaacggtgcaggctaattaccttgtcttgggctagttttagcgagccctcctcccagtagccataccttacctacctctgtgtcagaactaacattctgtgactaatagataaaaaccttttgaaatttactgacttagcagactgctagcttctaccaaccccaaagctacaaatgtcatccaactaaatttgccttgattttgactttctttgttctgtaaaactgtgaaattgcttccacattgggacatagagttgggtaacttcaatctgtgttcctggactatggtcacttgaaatggcttcagaataaactgtcctcttatttcctttaagatgagagctgtggtgtttttgcttgaccattttctcattatctgtgaatttcattttttgaattgaagagataagaactcaggggccactgacttagtgtaagttttgtgtgaccatgggtgtctgagaccttaaatcctgaattaaagtccatctgaggaaagcttgcttctatcaaactcaaagtgtatctatccacttttctgaatcagcagcaagcctcagccttttcctaccttaacatgagatcctggaggagattccatttccttgataaccatttcttcaatagtctggtattgaagatacctagaataggacatgtgtttctctgtagaagatctttgcttcttccaggactgccacactgctgcatgctcccagacaaaaaaaactcactctttccttctttctttccttcacactagcaatggaggagggtcttctttcttgacatcctctccaacatgtgttgttaacttaagttttgatcttagtcattctgattggtataaggtagaatcttagggtcattttgattttcatttctctgatcactaaggactttgaaaatttccttaggtgcttctcagccattcgagattcctcagttgtgaaaactctgtttagttctataccccaatttttgattgggttgtttgtttgtttggtgattaacttcttgaggtatttatatgctttgaatcttagctctttattggatgtagggttagtgaaaaaaaaattcccaatctgtagttggcctatttgtcttactgactattccctttgccttacagaagttttccagttttatgaggtcccttttatcaattcttgatattagagcttgagctattggacttctgtttaggaaatttacccctgtgtcaataaattcaaggatatttcccacattcttatctattattttcaatgtatctggttttatgctgtggtcttgataaacttggacttgagctttatgcaaggtgaaaaatattggtctatttttattcttctacatacagacagccagttagaccagcactatttattgaagatgctttcctttttccattgtaatttttggcatctttgtcaaagatcaagtatccataagtgtgtggttttatttctgggtcttcacttctattccattgatcaacatgcctgtctctgtaacaatgtcatgcagttttttttttgttttttgttttcactattgctctgtagtaaagcttgatgtcagggatggtgattgctcaagctgtctcacccaagagaaatagaaggcaggaaatagtcaaactcagggcagaaatcaaccaaagagaaacaaagaaaacaatgcaaagaatcagaaaaccaaaagctggtactttgagagaatcaacaagattgataaatccctagccaaactatctaaacaggcccatactgcacaaggaaatagaagaagttactaaaatcctcccacccaagaggcagtatccaaattaccaaaatcagaaatgaaaagggaagccgggcgtggtggcacaagcctttaatcccagcactcgggaggcagaggcaggtggatctctgagttcgaggccagcctggtctacaaagtgagttccaggacagccagggctatacagagaaaccctgtctcaaaaaaccaaaaaaaaaaaaaaaaaaaaaaaaaagaaagaaatgaaaaggtagacataacaacagaaatggaggcaattcaaaaaaaaaaaaacttcagatcctattataaaagcctatactcaacaaaactagaaaatctagatgaaatggatggtgttctagacagatgacacatacaaaagttaaatcaagggcaagtaaactatctaaacaggcccatactgcataaggaaatacaaatcattaaaatcctcgcaccccaaaaaagcccaggttcagatggattcagcacaaaattctattagaccttcaaagaagacctgataccaattttctcaaactattccataaatcagaaagagaaggaacactacctaactcattttatgaagccacaattactctgacatgtaaaccacacaaggacctaaccaaaaaagagaactttataacaatcttgcttatgattatcaatgcaaaaatactcaataaactcaataaaattcttgcaaccgaatccaagaacatatcaaaaccatcattcaacatgatcaagtaggcttcatcccagggatacaaggttgtttcaatacacgaaaatccatcaatgtgatccactatgtaaacaaactcaaagaaaaaaatcacattatcatctccttacatgcagaaaaagcatttgacaaaatacaataccccttcatgttaaaagtatgggagatatcaggaattcaaggcccatacctaaacagagtaaaagcaatttactgtaaaccaacagccaatatcaaattaaatagagacatacttgaagcaaacccactaaaattggggataagatatagatgtccactctccccatacctattcaatatagtacttgaagtgttagctagaataataacacaacaaaaagagatcaagagaatacaaattgacaaagaagaaataaggttatcactaatggcatatgatatgatagtatacataagcgaccccaaaatttatatcagagaactcccccagctgataactcacttcagcaaagtggctgtgtataaaattaactcaagtaaatcagtagccttcctttatacaaatgataaacagactgagaaagaaattaggggaacaactcccttcacaatagctacaaataatataaattatcttgcagaaactctaaccaaacaaatgaaagacctgtatgacagtaacttcaagtctctcaagaaagaaattgaaggttctatgccctagtatagaggggaataccagagccaggaatgggagtgggtgggttggggagcagggcgcgggggaaagggataggggattttcgcagggggaactaggaaaggagataacatttaaaatgtaaataaagaaaatatctaataaaaaaagaataaatacaagaaaggagaaagaaattgaagaatatctcagaaaattgaaagatctctgatgttcatggattggcagaattaacatagtaaaaatggccatcccaccaaaggcaatctatagattcaatgtaatccccatcaaaatcctaacacatttcttcaaatatatggaaagagcagttctcaaaatcatttggaaaggtgaaaaatccagaatggcaaaaacaattcttaacaataaatcattcaaatgtaaccattaggatttacttttgagaatggacacatgccattgatatttgtcacttagtataaattttctgatagttccatacattttcttgccaattttctcatttcagttttctttgtagataaatacaattccacttggaagtgcattactttttcattagccatgtttcatttgatagatcccaattctggctggtcattgcacctcctttccctcactctcttctctatttttgtcccttctgttcttttacagaaactattttgggtcagaatctttgactgttggatggcaaccccgtctgtccacttgatgctgtctttctactggagatggactctttgagtttcctctacccattgtacagtatttcatctaaggtctctccctttgatttttgagattctctcacctccaaggtcttcagaacaccctagaggctcctttctggctacaggagatggcctcttaagaaatcatatccccaaagaagtgagtcacagctaaagtcacctccactgattcttgggagccttccttatacttccttatagtctctgtctcatcctgaacatgccccacacctcctcaccatagtcagttgcagatttccattcattttcatggacatctggccatctcttctgtctttctgaacacctgattatgaattgccctccccaacccctctccatcccagcacccttcctccatcttcctcttatgactattttattcctccttctaagtgagattcaaacttcttcccttggtccttccttcttgtttagtttctttggttctatggaatgtaacatcttacctgtattttttggctaatatccacttttaagtgagtacatgtcatccatgttgtttttggactaagttacctcactcaggatgatattctcaagttacatccatttacctgcaaaattggtgatgtcttggtattagtagctgaatagaattccattgtgtagatgtaccacattctccttatctactcttcagtgagagatatctttccagtttctgcctattatgaataaagcttctatgcacatagtgtagcaagtgttttgtgggatattggagcatcatttgggtatatgctaaatagtggtatagctggatctttaggtacaactcctgtttttctgcaaacacacatacacaattgatttttcaagtgcttgaataagttttcactgccaccagcaatgaaagagttgttccccttgctccacatcctcagcagcatattctaactttttttatcttagccattctgatgggtgtaaaatgaaggccgaaaaggacttgcttttgacaaaaatgtcaaacccaaacaatggaaaaagaaagtatcttcaaaaaatggtgctgacttaattgaatgtcagcatgtagaagaatgtaaatagatacatatctgctaccatgcacaaaatcaaatccaaggggatcaaagaccttaacataaagctggatacactaagtctaacagaaaagaatgtggggaataatcttgaactcttgggtataggagacaagtttctgaacagaacaccaatggctcaggttgtaagacaaactatttataagtgggaacctttgaagctgaaaggcttctgtaaggcaaatatattgtaaataagacaaaacaacagataacagaatgggaaaagaccttcaccaaccctacatatgacagtgggctactatccaaaatatataaagtactcgagaagtcagccaccaacaaaccaaataacccaattgttgcggccgccagcagctcgcaacatgaatggttcgactgagaaggctactctagctgtaagagaggaatctagacggggctaaagaagaaacagagctaagacaaattcattctgatcaaagctcaaattttattgttgtgacactagttatgaaggaaggggaaggggacccgattcctgccaaataatctcgggtccagtagtagggtgagcacgtggtggcaccaacagcaaaacagcaaggtccagcagtgggcatggcagaacgaatgagcaggaagctccacccctgagcaagcaggtttcaggctgggggaggggagactacacccaattttaaaaatgtgatacagagctaaacagaattctcaacagaggtacaacagtgcacccatgaggaagacccagctctgctgtgctcatgccattgggattacctcacttgcaagccccatatgcagggacagctctactgtgctgtgagatgcagggcctgctgtctcagctgctaggaaggtgaggatcacaatcagctctgctgctctcatgactcccttgaagccaactcatctgcccccagctagtatcaagggacagtctcctgccaccttctgacccaccttccctttatctgcccagttatcagctctcctttattttacaaatttaggtgggaagctggtttacaagaaatcacctgagtcagactcattccttgttcacaaccactcacaggagaatggaattaacatcaaatataattagctccagggctattcataacatttcctcctttctgtccaattaaaagactattttatctcagatataattgaacataactattattattttgtaatttataaagtactagagacctaacacccagtccaccatctttgttaattaaacagaacctctgtcatggatcttttcttaaaagacttataattctacatctggatatatcttggctttatattgaatgccatcttaaaaccatcctctcagatctgttcctctcaaagtaaaaaacctgggttggctaggagactacgcagtttttcaaccccatcagaaatccatgaatgactgatattaactgaaaatataaagaaagcctaacacagcttccaaaacttagccaatttaccgtgatcacggatcacttggacagtcccttacttcaacatgttggagcattagtaatcagcttattgcccagagtcatctgacagacttagagaaacagagattttttttttttttttttttttttttttggtttttcgagacagggtttctctgtatagccctggctgtcctggaactcactctgtagaccaggctggcctcgaactcagaaatccgcctgcctctgcctcccaagtgctgggattaaaggcgtgtgccaccacgcccagctcagaaattttttaaaaatattttttattagatattttccccatttacatttccaatgctatccccaaagtcccccataccctccccccgagaaacagaaatattaaggagtagcttactaaggggacccacttagccaactcaggtagcttactagaaagcttacttgaggaaccgatccggattaagggcccggaggcgggtcctgggcactagcggttccgaccccgcaccccgccctccgcgccacaccagagtggcccccagccgagcgggcccccacttctaggcccgacccagacccttctgcgcctcccttggcctttgtccggcgccaggaggccggccccgcgccccccggcggccgccggtgcccgggacgcgtcagcctcctggctccgtacgcgagctcggggatctgtggcctccgtggcccccctccccagcccgccctgttgtggagcccgacggggcggcggctaccagggcgggttttgcggcgctcaggagaggccccggctccgccccgggcctgcccagggggagagcagagcggtcagcagccgggtcgggtcggggcccctcctgagaggagagtggagcggcagcggcggcagaaatgatggaagaactgcatagcctggacccacgaaggcaggaattactagaggccaggttcactggagttggtgtaagggaccactcaacagtgagtcttccaaccagagtttgtgcagcgtggggtccttgagtgataaagaagtagagactcctgaggaaaaagcagaatgacctgcgaaatcggaaaaggaaagctgaaccatatgacactagccaagggaaaggcacttctagggggacataaacttagtgattcctttgagtttgctgggggaagctggccaggaaccagccctggcagaagtgttccaccagatgcatgatcctcaccacaacattccttatccaatcccttaccgcgtggagtagaacagcctctgtatggtttagatggcagtgcagcaaaggaggcctcagaagagcagtctgctctgcccaccctcatgtcagtgatgttagcaaaactgcgacttgacacagagcagttggcaccacagggagctggcctctgcttcactttcatctctgctcaacaaaacagtccttcttctatgggttccagtgtttgaaagtgacctgtgattgtggaagctgcaatgatgatactttctttttgttgttttgttgttgttctttgtttgttttttgagacaggtttttttgtttgtttgtttctttgtttttgttttttgtttttgtttttgtttttttgagacagggtttctctgtatagccctggctatcctggaattcactttgtagaccaggctggcctcggactcagaaaatcccctgcctctgcctcccaagtgctgggattgaaggcgtgggccactactcccagcggtgataatgtcttttctccatcacatgtttattagtgcgtgaagtgttcagaggattggcacaccatcacagagcatagattactattgcatccatacacctttgacatctctggcctatggagaccctttgagaatggatcttgcctatatgcatctatgtttccctgccttcagaggtctgatacttgggatttttgtgaatcacccagcaccttccatctggaaagccagtaggcaccctctcatctacattctgcccatttctctcatcttctctttccttggcttcatgatattcacaggccattcacactcagacatttttatcgtgaggcaaaccatgttcataggtgcatagactgattttttttccctaaacttttggccaagtagatcttggttctggatttcagagtggtttcggttattttgttgttgttttgtttgttttgagacagggtttctctttatagccttggctgtcttggaccttactttgtagaccaggctggcctcaaactcagaaatccacctgcctctgcctcctgagtgctgggattaaaaggcataaaccagcatccctggctcagagtgttcttttactgaaatttattcacagcatgaacatcatcattaatagttcatgtgtaggcattaatagttgtatctcacaaattatagtctcaaatttctggtcttttctgcatttttctgcgaaacattttgctgccttctggtaaagtatattctctataggtcattataaatgaaaagcatcaaaaagctaaaatttcaaaaagaagaaattttgtgctcaaaactgagtttattagtcagaatgaaagactatgattgatgtttactggttaggtaatataagtatgggggtctctgcaaatactaggtctggtagattaacaatccatgagaccaaaagaaatctagttcaataccactctataaatatttctacactggttgtgggtgttttgtgggttattgccaatgaaattctagcaacactcagggaaaatctttcccagtgaatatgtgaacagttctgaagcaaaaggtctcctgacagtcagaagccatgatataccacaatgacccatggaacaattaaccacacacaagaaatttattgggaaaacactacagggaggctgcctctgttcaggtgagaagcccaagagaaatgagtgggaggcaggctttgcatagtttaattttttggggtgggagtgggggaaggattttcagaattggaaatagctctggttggagattgcctggattttatgttctaatttgagtaaattaaggagtttctgtgttattaaaactgggaagtaaactataagttttcccggtagactcagttgccaatgctgagtgaaacttcaagattctgatttcagggttgtttattttaggaacaagtaagcacagtaaaattttggaaagaaattttttggtaataattgtctcaattgtctgtatacaatgaagatgaatgtgtggctacttcaaaggtcttttgcaaagtacatgtgagtctttctttaaagttggattctaaaactaaagagcctagaggaggatcaagcatacagtgtagaggacaccaagctgtaaggtacatgtcctatatcccccaaggatggtttgtactgatggagaaacaatgatctaggatgattgtctgggacaatttaatagtctgggacttccaggtgtggtctgccactacaatctaccacaggtcaccaagctgcttactacatccattcttttacttctggtttaaaaaaaaagtgtacttctcttgcactgaagagaaaacgctgtggttttacattcctggttaacttagagcttattcttgaccataatttccttttgccctctacagaaaaaatatattttatggttgtttctggttcataggatgttaatgttgtgttagtgtaaatggaaagacagtcaaaagatgttttctagaatataaaatatgttgttgagatatacaaagtgtgattacattgcttgactctatagacatgaaacttgcaagtgctgctggcagaatcccagcaatcagaacactagggcaggtgtattattcttcatttaaggtcagactagtctacatcaaagtgacattccaacctgtgggccccaatttcctcttctggcctacttggattctccacatgtatggaggtgaatttcctaaccttttcagtgggtgtgtctgtattttcaaatttttattggcagagaactagcaggatcttgatattgtcatttctatggcccatcaccagctttacatttgtaaatactcctcccacccctgctgagatacttgaatggcaagcagctctctatacctaaaggcaatccagagaagttctggtgatgtttcacacctgattgcttctaagaaaaaaacctgacatccaattcctgggacaagaattggagggccgaatttctggatattaaaagagatgtagagaggagaatgcagatgtaggagatttagtgggagacagagaagataacagatagatgagaacggagcgggagagaggttaagaggtatctatgtatgaggtcataggcttgaattgtcttaaatctaaatgatagctgggagactgctccaatgaaagttttatgctttatagtatatagaaaccttttcattacttataacactggtgtgtccacaaacactcccagtacactcatgaccaagcacccttgtgtgtatagatatattacatttaaccagagtgcttttggtatttaagtcaaattagacattgattggttattcccagtaaattcatgacatcattgccctaagcatattttgctgaaaggaaaaattatagatcaacgtctttttggttggttctgtgtatatatttcactttgtgtacctttcaaagcaccttccataaggaggacactggaacataagagtcaatgttcttgcaggcaccagtttgcccttttcatatacagtgttttgtgtcagccctgtctttagcaatgaagacttattgtcagtttgttaaaagcaaccccttttgttgtcagtggccagcagtctttggatatttttatgaaaccactttggctagcaactttcttgatgtaacacagtggaaaagacaagatcaactggaactccatctctttcagaattcagagatttcatttgaaacaccttcatacacttataagctggtacttaaaaaaattttattttttgttttgttttgtgaacatcttactaagactacatccagcaggactccatggagtcttgctccatggtgctttcctatgcattggcagaaccatacgtgtgacaatgtattatataaaacatcttaccttgtaatagatggggaattttcctggacctcacaaccagaattaaggcaacttgacgaaatttatgatttaaagctgtgatcctactgtttactcaacttgagggtttagcacacttttcaaagaacaacgtaaaaactaacattattctccttggacttctcttgatatcaacttttaaaacctaacttgatgcatagatacaatggtaatttatgtactttttcaagtcctgctcagaaactgcatgagtgtcacttgatgaaagcatgaaatgcagaggcttaaagcatagttcaaaaatgaatatacagttatgggtattggttgataaaagtcatgtttataaatgtttgttgtcttgtccacttgaccacttggagccagttacctaatcctttataaaagattactgttcactatcccattctttccccaagtgatggttcccttgatgttctagaagtactccaaaactctctctcaaggccagtcagagagacacaaacagacaacagattacacagacaccaacatggagacaaaaggcagacagaaagggagagctatacaagcagccttcaggaagttacagatttaaactaactgaacagacacacataggatggaagcacagggaacatgaagtagagaattcaactttgtactcacactcagctaaatgcctctgaggaaaaggctttcatttctttccttaactcaacacagatgcattattaaccaccagtatgtttaatctactcacatatgaggaatcaattagcttgtgactttcttttgcataagtacaatatgggaaaaactaaaaatcaccccaatgcgaaactagtagccctgccatctgaaaggtgtccatgggcacagaaccctgttctttaaagtcagacccccaggtttgggcttgtgcttctgagctctcacctccatgctgagctagaatccattttaacctctcataatcatcacaacaggttttgaacctaagaggtcacatgagaattctggaactcattataatcatgaagagagttgacttcctagcaacagtctaatgagacttgggtaaatctcgagtctcctttcccccacttatgctgacatgcatgggtgtacatagagtgttacagggaacaatcaggaaaccatttatcaacaaacagtgcagtatgtattgtaattttgttctagttttctttctctctttctgtctgtctttcttttctgtctgtcttccttcctttctttcttcctttctttctttctttctttctttctttctttctttctttctttctttctttctttctttctttctttctttctttctgtctctctctctttctttctttctttcttcctttccttacttttttttgacaaagatcaggacagttttccaaaggagtttctctttattgcctcatccttcaagcagtaaataatattgtcccttgacctaacatcattttaattcaccattttctttgattgaggcatccacctcctctactttttctttaagtctgataatctgtctcccacaggttctctatgtatcatttttatttgcctcactgcattttctcttcaggattttttttttgtgtggcatttctaagcacctattgaacataattttaatattttatattgtccttatttccttcaggcatctggtgttattttcttgaccaagattcattttgttcctgtctgagtggattcacaggtttacaaactttaatgtccttgatcatgactgtgggttttccattctttgtcttggatatcacataaattgtgctccttataagatacctctatggtttgtggtttgagccaaggacattttatctacgtttttgtttgttttgggtatctgttctgagcatcagaattcaaagggactgcttaattttgtgcatttatagcccagagggctacacgcataatatgagaagttagacaggatccattgaatctgaagggttcagaacccaggtgcagtgtcctactacatctagctctggtctagtctggcagcaactttgtgaagaagctttgcagagtaggtcctgggaagttgtgtggaaggcagcctgcaacagagttggaggagtggttcctgatggggagtgtgggattcctgcacgattagatgagtttaagaaaaagacaaattaaaagcaaagaaacgaataagcaagcaagcaagcaagcaagcaagcaagcaagcaagcaagcaagcaagcaagcaaaaattcaaaacaccaaacattgctgtgaagaagtgggaagctaattaattaaaaggcccataagtaggtgggcttagaagaattccaggaagctgttgaattttgggcgggtccagaaggcggcgctaggcagaaagaagggaagttccgcggtttcatctttcttcttgcatctcggctgcctcgtgatcaggaagtcatggagggagactagtgcctagtatttgcggtgcctgaaaactttcttaagaagcagttgttttgctggcctcctaggacatccaggagctggtcctgtcatcttccaggttagaggagctgttggactaggaacccggcaggagctgggcagcggtgtggagcaggggtgccttttctgccgccattctcacaattcagtatttgcggaacctgaaaacttccttaagctgccgttgctcctcctaggacattcagcagctgatcctgtcaccttctaggtcagaggagctgttggactgggaaatgggcaggagctgggcaggtgtgtggagcaggggtacattttctgccgccactctcacaattctgttgtggatatcttaccattatcaggaagtttgagatcctgtgaattgggttcatggtgatgctttaatcaattttatggttgccagaatatttttctaaaatatcctcggagatccttggctgcatctggagtttgtataccgggaggtttgcctttgcaaaagccttcataaagctcctttaattcaaattcgttcattctttcttaactcccctgttcctccatttgccatttcatttccctttctccagggaactgagtaggcattctgagagagctttgtaagcatttgtcatatagggaccagtgcagatttgattgaattcgaaaatattcgttataaagtatctttgaaagacccaaaacgtgaggactctcccaggttctgactcaggagaggcgacattccagatcacttgcaagaaagggtcttgatgcaaattgtaagaggacttttatttcaagagagctctcaggtccacattcatacaccatgcagggctagaggactgtggtgtgcagagtagctgggtaagggggtatttaaaggaagaaaccataagtcaaggggatggggagggcattgttggaaaataccaaaagtacaagttaagtggaaagtcaagacagatgtctatgagtctcagtaacaatagcaagcacatttgcacagtgagttcctggagtggtcagggtgggtcaaggtgactttctttgccagaatatttttctaaaatatcctcggagatccttggctgcatctggagtttttataccgggaggtttgcctttgcaaaagcctttataaagcttctgtaattcaatttttgttttatggttagcataccttgggggcattgagtcacaaagatcttattcttacacctggccctaaaggcctactttttgtttttatgtttcactttttaatggtcatgtcgctgtacatattaatattaacctagcaaagttatagtctctgttagtttaacactgaggtatatgcagtcaaaatacagcattgagaaatgtgtcttcataggcttagttattaatgtcacaccttaggtttgaataaaacatgaagacaggattgcagcaaggtacagctgaggagaagatatatagtaggttctgtcaaccctgagtgtcaccagagaaaaactaattgtaccatgtggggaagttttataaaataatacatcgtgaccaggagatgggtttggtcacatgctacaggcagtttaataggccactgtagtttcctatgaggctttattattttcctaagacatgcaacttgcagcaacgcacaaagatacctggttcttgtgctggtggtgcagttaatttttggcatttcagtctgagggagaaagcattcagagatatctgtctggttccaaactgcacctggatgggggtgcagtttggaaccagacagatggggggaggggaattgaggatgagatggaggacagaggggcaggccaagagataaacaggagccaagaaaacacctacccaactatgactattgatatgttaacagacatcccagttagccattcctgctgaatttctatgaatccttccaaggttctgcccagcatgctgtgagagaatgatttcaggcaaagatattttaataagtggaaaacttactatggattaagacaaaattagacagcacctttggaatgattatggttgctcacttacataagaaaaatgactccttgcttcatgaaaagcccatgcacattcatggtttgttgagttctgcactgtggacttcttgcaggtgtgggaatgcttagaccctgcactcagtgctttttttcacagacctcttgttggtgaagtccaactgtctggattgtgtggatcagaataattttcttccagtcttccctgctcctcttccttgttgcttggaaaaggactctgtatgtgtgttaactgtgtgactgacttgcacatctctagggtaaactgaaatactcagagaaaaagagatattttcataatttcttccttttccctcatgtttatccttttatcatgtattgacatctctcatttgtgttccatgaaaagttccaggttcattctgaataatattttcccattttcaggtattcatatgctcagctaaatgtacataactgtaaatcaacactaagagcaccggatggttaaggtcaaggagattctcacaaaggatccaggtatgttagaggtattgaacaaggggtggagtggggctcacctgttaggagaaagaggacatgaatttgattttgccagattctatttccttaatgattctggaaaagaataatattagatgtgatgatttggatttcccatggtaggcagtgctgtcagtcgtcacttgatgttaatagtaaattaattttgattatgggaaattgctgttgcccattgtaatcaaagtttcttttactcagattgaaagcatcatcaggctatggttgtgacaagggcaatttatacataaagcaaatgtcagcagtagattccctcctagggcctgtgaccttccttaagaattttcaggctgattttcactgtaacctatgtattttttttcgtatggagcttgaaccagaaaaccttctgttacccacagatagtcttgccactgtcataaaaatttacatgtcttgtctggcagattcagattgtagcaagcaggttgcaaacctgagtatgatatggataactctgcttcctgccccaattttcctagcagtttttgtcactatgcaagttcccaccagggtgtctaagatgtctgctgagagtgaatcgtctgatatgaggtttttttctccagaagctctacttgctttctgaatcacctattctgtccagtctaaatgtttttttgtccttgacctgtgttcttattgatgctctgtgttgcattagtcctgattagagtggaataattattgttgatctactctgtactgtttgctttagttttgggtctgtttgccttatttctgatgtatgtttcttctcttatattcttgagagcttttatactgagcagtgtctacttttttttttttctttttggtttttcgagacagggtttctctttatagttctggctgtcctggagctcactttgtagaccaggctggcctcgaactcagaaatccgcccgcctctgcctcccgagtgctgggattataggcgtacgccaccacgcctggcagtgtctactttttaccccagggctctataagtaagtttcattctcctactgtcactgtaatttgggaggatttctgcctacatctattaacctaggcctagtcatgtaagcttctactctccatacagtattatctaggcctggtgtgttttcagcctctgaaatttgctgctgaataagcccccaccctttcttactccttctcaatgcttacctgggtgattcaatttagtttttccagctctaactcctctcccagcggagttcttctctcagacactgaattgttccactagaccttaaattaactgtagaaatcttttgtgatcctctggctccttctcattctcctgctcattctgtctttgcccaggcctagcatgttctctcttcaatctgactctgtaaaactctcccagtaaaactgtgtccttctccctctctgtggatctactctctcaactgtactgtactgcagcccatgcactctactgtattcctttattattctcttctttttgtaatgtctttctctgtctcaagtagcttctctttcctctctcattacagcaaagttgggcagatcctattctgtcagatctttctctgatattccatattttctgtcattcaattagacattgctttcgaacatggatgtgttcttctacatataaactgtagttttgatattttggattaaagtcaatactaaggccttgcctgtactaaaaccagagcgattgatgttgtgtgtcttgggctgaaccacaccctaagtcacaacaggttcaagtatccctacccagtgtgatgtcagtttacttctgtacaatttcttctttctgaaatgaaaaccaagatccacatatactactcttcagtatgttgatatctgtttcattttttctgacttctacttgggactttattataatgttctttgaagatcggtcgatgacattctgttccttgtgagattatattccttaggatttttaatctggaagattttgctggtagtgtaggtggcaaagtatgtttactttgttctcaattccttgtgtgggatagagctttactgtgttgtatatgagaaatacttactagttcttgtgtttattcattcttagcaagaaatttcttatttcctatttcatgaaaaatgtatgcgttattttgtgcatactttcatcaattcatttttaaagtagtttttttgtttgtttagttggtttctttttgtggttgttgtttggttttacgagacagggtttctttgtgcagtcctggctatcctggaactcagttcatagaccaggctggcctcaaactcagaaatccacttgactctgcctcccaagtgctggggttaaaggcatgctccaccactgcccagctctaagcaggtttctgactaaaaaacatgtcctaatgaattactacattcaaatttattttatatactgtcaatactgttagccacttactttggattgccaattattttctctgaggacttgaaaaatattattccattcactcctgcttttaacctatttataactatttattactaatgtatgctactgtagtgtcaccacactgatggtaagggacaggacaagacaataggaaaagagatctacattgttatagcacttagatgtgacaaaagccagatatatctaggagtagagcaagccaatctgtaatagcgttccctagggaatgctaagctagtatgctatgttcttcttctacttaagaatcccagtgtctgaacacactacccattactattatagtttgtccactttcaaaatattgggatgaaacaagtgatagtaaaaattgaccgcaaggctgataaggacagaattaagtctctttagagtcagatatgtacttgaagaaatgccagtgtcaagttttaaagtcaaagtcctactgttcttattgacttcttggtgaatgtaataccatgggttattcttcccatgttagaatgagctcttgttcagtctccataagatgaaagatgtacttttcctgttatacacacagacaaaaataattccatgatatacattcattccatgtatttactgttattgaaactaaagcctaacatatatcagtcatgcaggaatttaggatctgtttctgaaatgttgacaacaatactcaccctttatgtcacaggcaagattcataaagtgacatgctttgtaaaaatgtcctgattattccctgaatattcatgcattcctatgcccagtttttctagcccatttgatgttgtcttgaaatgcctgggtcatagagatttacatattataaatttatgacagcattatatttttccctatatctacatttccgttctacagaaagtcctcttaccactcaatttcccatcacatgagttagggattatcctcatttctttcatgcatgttacagctgttagaatatttacagagaaacattctggcagagtatttgtactatccattttctttgctattggaggtatttcaaagctcctaaagttttctttaatttgtgctatttaaatctcctggtgctagcattttcaggtgaatggcctttgtaggaaattagtgtggaggctttgcacatccttgtctctctctgcttagtagaatagaaggatgacagatgtcttcagtttttgtagtgataggtttaggatgatggctactatgtttattagactcagtcatgttctttctttctttctttttttttttttaaagatttgtttttttttatgtaagtacactgtctctgtcttcaaacacaccagaagaggacatcagatcccattaagaatggtttgctgggaattgaactcaggacctgagtgatgttctttctcttccacattcttcagagctttcatagtgatccactgtgatattttgccctaggcctttcatagatatactgacatggttgagagccttctctcactgattgtatgtactttgtgccttgagttatttggtttgtgctttttgaaacagtcttgcatctatggcatgaaatcaagttgagttcattttctatatccattagagagaatttctttattattttattcatgcatatttttatggtcatttgcttttgcatcccggtacagacagctttgtgtgatgactgcaccacattccctactttctgtattctgcaatgttctctgtgcaagatgattgagggattttctaaagaaatttgtgaattaggtgctacatctatttagtctcagatagtgttaaaagataccctgcaggccttgatttccatacttgcttattgctgggcctagtgttaagacatagaaagctttcttgttcacttgttcctaggatatcatttttttccctgttagttctcattaattgtgtatgactttctatggtactccatcatctgctatttcccagtttcaatataaactaatgaggcaggggcatcaaaagagaccacctgtatacccgttaaaagctaagagaaatatttgacatgagagaactataaggtcaatgtaatacaaaaatttgctgaatatttgcttataccaactttgtgtagtaatagtatcttgatgtttagaatgagttcttatgtttttattcatgcataaatatgtttgtgtgtatgtatgtatgtatgtatgtatatatgtatatatgtgtatatatatatgcattagtatttatttcaggagaccctgtcatacattcttactttcttttttttttttttttttttttccttttcttggctttttgagatagacattcttactttcatttggaactacaacatcgttaccaggtagaatctttgtctgtattccaagacaacagggcacatatagtacatagatacactgtatctgcctgtgagaatgaaatggaatctcatcatagggttaggtgtggtattctagtatgatatctaatgaaatactattcaactgtgggcatcattcatggtgggcactagccatttgtctttgactctagacccaggaagataagttctcaataacaaccctgataatagtgttttacagcctggatgcatatactctgtgtttatgtcaggtgtccattgaagtcagaaagagtcctaggattatattcatattccttactacactaaatatgtcactccatgctctcatgtctgtagaaatgttggcaagattccttgtatcatgttgcttttaatgtcatttcatgtggtttatcattgtccattacattgttgtagtaatttcatttttttatttgcaaaccctgttgtgaaacttcaagaagagttccaatatttgaaaatgggaaaaaaaagaaaaaaaagaaaaaaaaaagaatgagttcttctctggtaaaattccaggtcagtgtgctgttcacatttctttgaaaattcctttttcactcaaatcattccatatttctgttattgatatgtggtcatggtatgtaaaggatttattttctatgatattcattttcttctgggatgtggagaatttaacggttgggtcttatcacatatataataccattatattccctgaatctttaactgtgaggacatacaatttccatggactgaagacctgcaagtctcaaagataatctattgtaaataatgctcaaattttatcaattgctaatttctactttggatggagttgtgtccttttatattagtatggaaggaagttctcatgtgtcacttaatttgcattggggtccctgtgctcagtcttattgttatctgcaagcaccacaaatgcatttgtattggtcagactctggcatagcctcaggggatagctataccaggctcctgtcagcaagtgcttcttggcatctgcaatagtgtctggggttggtgtctgaagatgggatggatccctaggtggggcagtctctggatggccatttcttcagtttctgatccattctttgtccctgcatttcctttagaaaggaaccattctgggttaaaaatcttgagatgggtgggtggcccctttcttcaactgtggtccttgcctatgcactgtatatggtctctacaggttcagtccccaatttgttgggtatttcagctaatgtcatcacagttgggtcctggggaactcttgctttcttggcatctgggactttctagtggatacagccagtttctggctacaccccgcagtgctacacacctccattcaattttctgactctcaatacttctcccctgtctcctcccactcctaattcgcctctccccacccatctccccccccccctctcaggtccctccctccctttacttcccttcataatttttctcctaagtaagactgaagcttccacagtccttcttgttaggcttcatgtggtctgtgagttgtatcttgggtattccaagctttggggctaatatccacttatcagtgactgtatacaatgtgtatccttcttaggatgatattttttagttccatccacttgcctgcaaattttatgaagtcattgtttttaatagctgtgtgttacccctttgtgtaaatgtaccacattatctttatcaattccattgttaaaggacatctgggttgtttccagctcctggctattataaataagtcttgaatgaacataatagagcatgcgtacttgttatatgttggagcatcttttggatatatgctcatgaatggtatagctgggtcctcaagtagactatttccagttttctgaggaactactagactgttttccagagtggtcataccagcttgcaatcaatcccaccagcaatgggttatcttcccctttctccacatcctaaccagcatctgctgttacaggaggtttgatctatttgcatttccttatgactaagaatgtcatttctttaggtgcttctcagccattcaagattcctcagttgagaaaactttgtttatctatataccctattctttctttacatttttaaatatattttttattagatattttcttcacttacatttcaaatgctatcccctttcctagtttcttctccgaaaatcccgtattcccttccccctccgcctgctccccaagccacccactccctcttcctggacctggcattcctctatcctgggacatagaccctttgcaagaccaagggcctctcctcccattgatggccgactaggccatcactgtaacatatacaggtagagacacaagtacaaccttgttttctttgactggtggtttagtcccagggagctctggggttactggttagttcatattgttcctcctatagggctgcagaccccttcagctccttgggtgctttctctagctccttcattggggactctgtgctccatccaattgatgactgtgaacatccacttctgtatttgctaggcactggcatatcctcacagaggacagctgtattagggtcctgccagcaaactcttgttgacatctgcaatagtctctgggtgtggtggttgttttggggatggatccccgggtggggcagtctctggatggtccttccttcagtctcagctccaaactttgtctctgtaactccttccatggatattttgtacctccttctaagaacgatctaagtatccacacttgggtcttccttctttttgtgttttgcatgctttgcaaattatatcttggatattctaagtttctgggctaatatctgcttttcagtgagtgcatatcatgtatggttttttgtgattggattatctcactcaggatgatatcctccagatgcatccatgtacctaagaattccatgaattcattcttttttttgttttgtttttggtggttttgtttgtttgttgtttcgagacagggtttctctgtgtagtcctggcttgtcctggaactcactcagaaggtcaggctggcctcaaactcagaaatccacctgcctctgcctcccaagtgctgggattaaaggcatatgccaccatgccaggaaattcattctttttaattgctgagtagtccatctgatttaggattggtaaagatcttttcccaatctgttgctggtctttttgacttatggacagtgtcttttgccttacagaagctttgcaatttttttaaaaatatttattttattttattttatcttattacatgtgagtacactgtagctgtcttcagacactctggaagagggcgtcagatcttgttacggatggttgtgagccaccatgtggttgctgggatttgaactcaggaccttcagaagagcagtcagtgctcttaaccactgagccatctcaccagcccagctttgcaattttatgaggtcccatttgttaattcttgatcttacagcacaagccattgctgatctgtgtaggaattttccccctgtgcccatatcttcgaggcttttccctactttctcctcttaatttcagtgtctctggtcttttgtggaggtctttgatccacttagacttgagctttgtacaaggagataagaatggattaatttgtattcttctacatgataaccaccagttgtgccggcaccatttgttcaaaatgctgtcttttttccactggatggttttagctcccttgtcaaagatcaagtgaccgttggtgtgtgggttcatttctgggtcttcaattctatttcattgatttccctgtctgtcgctgtacctggaccatccagtgtttatcacaattgctctgtagtaacgctttaggtcaggcattgtgattccactagaggttcttttaccattgagaagaatttctgctatccttgtttttttgttattccagatgaatttgcaaattgccctttctaattcgttgaagaactgagttggaattttgatggggattgcattgaatctgtagattgcttttggtaagatagccatttttactatattgatcctgccaatccatgaacatgggagatctttccatcttctgagatcttctttgatttctttcctcagagatttgaagttcttatacagatctttcgcttccttagttagagtcacaccaaggtattttatattatttgtgactattgtgaagcgtgttgttttcctaatttctttctcagcctgtttagcctttgtgtagagaaaggccattgacttgtttgagttaattttatattcagctactgcactgaagctgtttatcaggtttaggagttctctggtggaatttttaggatcacttatatatacaccatcatatcatctgcaaaaagtgatattttgactacttcctttccaatttgtatccccttgacctccttttgttgtctaattgctctggctagaacttcgggtaatacattgaatgggtagggagaaagtgccttgtctatagtctctaattttagtgggattggttccagcttctctccatttactttgatgttggctactggtttgctgtatattgcttttattatgtttaggtatgggccttgaattcctgatcttcccaagccttttaccatgaatgggtgttggattttgtcaaatgctttctcagcatctaacaagatgatcatgtgtttttttgtctttgtgtttgtttatgaagtggattatattgataaatttctgtatattaaaccatccctgcatccctggaatcaagcctacttgatcatgatggatgattgttttgatgagttcttggattcttttagtgagaattttattgagtatttttgagttgatattcttaagggaaattggtttgaagttctctatctttgttgggtctttatgtggtttaggtatcagagtaattgtggcctcatagaatgaattgggtaaagtaccttctgtttctctttagttgaatagtttgaggagaactggaattaggtcttctttgaaggtctgttagaaattctgcactaagtacatctggacctgggctttttttggttgagagacttttaatgactgcttttatttctttaggggttatgggattgcttatgtgatccgatttaactttggtacctggtaagtgtcaagaaaattgtccatttcatccaggttttccagttttgttgactataggattttatagtagaatgatttttttggatttctttggtttctgttgttatgtctcccttttcgtttctgattttgttaatttggttactgtctctgtggtgtcttgttagtctcactaagggtttatctatcttgttgattttttcaaagaatcagctgttctgagtttgagtaaactaaggaatttctgagttattaaaactggcaagtaaactctaaattttccctgtagactcagtggttgaggctgagtgaaacttcaagattctgatcccagggttctttattaagtataattttggaaagaaatttcttggtaataattgtcttagtcctctgtgcacaatgaaggtgaaggtgtgactacctcaaaagtcttttgcaaagtacatgtgtttcttttttaaagttggattctaaaaataagggcctagaggaggatcaagcatacagtgtagaggacaccaagctgtaaggtacatgtcctatgtcccccaaggatggtttgttctcatggagaaacaataacctaggattgttgtctgggacaatttaatagtctgggactttcaggtgtggtgtggcacaacaactaccacaggtcaccaagctgcttactacatccattccttcacttctggtaaaaaacaaacaaacaaacaaacaaataaacaactgtacttctcttgcactgaagaacaaactctggttttataccctagagcttatttttatttatttatttatttatttatttattcattcatttattttagtttttcaagatagggttcctctgtatcctgttcctccctggctgtcctggaactcactttgtagaccaggctggcctctaaatcagaaatccgcctgcctctgcctcccaagtgctgggattaaaggtgtatgccaccacgcctggcctagagcttatttttgatcataatatccttttgttctctacagaaaaaaaaattatggatgtatctagttcttaggatgttaatgttgtgttagtgtaaatggaaagacaatcaaaagatgttttctagaatataaattatgttgttgagatatacaaagtgtgattacattgcttgactttatagacataaaacatggaagtgctgctggcataattccagcaatcaaacactgtggcaggtgtaaccctaactcatgtccacacacacttgtgtatatagatatataacatttaaccaaagtgcttttggtattcaagtcaaattagacattgattggttattcccagtaaattcatgacatcattgccctaagcatattttctgaaaaggaaaaattatagatcaacgtctttttggttggttctgtgtatatattttactttgtgtacctttcaaagcatcttccctaatgaggacactggaatataagagtcaatgttcttactggcaccagtttgcccttttcatatacagtgttttgtgtcagccctgtctttagcaatgaagacttattgtcagtttgtgaaaagcaaccccttttgttgtcagtggcctgcattctctgggtatttttatgagatcactttggctagcaactttcttgatgtaacacagttgaaaagacaagatcaactggaactccatctctttcagtattcaaagacttcatttaaaccatcttcatacacttataaagtggtacttttcaaaaaaaatttttttttgcagatatcttactaagaatgtatccaacagaactccatggagtcttgctccgtggtcctttcctatgcattggcagaaccatgagtgtgacaatatattatataaaagatcttaccttctaatagatggagaattttcctggacctcacagccagttacctaatcctttataaaactctgttaaagattactgttcactgtcccattctttccccacgtgatggttcccttaatgttctagaaacactccaaagctctctcttatgcccagccagagagatacaaacaaacaacagattactcagatagacacaaacatggagacaaaaggcagacagaaagggagatatacacaaggtagccttcaggaagttacagatttaaactaactgaacagacacacagaggatggaaggcacagggaacatgaagtagagaattcaactttggactcacacttaattaaatgctctgaggaaaaggcttttatttctttccttaactcaactcagatgcattattaaccaccagtatgtttaatctactcacatatgaagaatcaattaacttgtgacctttttttttttttttttttgcataagtacaatatgggaaaaactaaaagtcaccacaatgggaaactagtagccctgccatctgaaaggtgttcatgggctttgaaccctgttctttaaagtcagacccccaggtttgggcttgtgcttctgagctctcgcctccatgctgagctagaatccattttaacctctcataatcatcacaacaggttttgaacctaagaggtcacatgagaatcctggaactcattacaatcatgaaaagagttgacttcctagcaatagtctaatgagacttgggtaaatctcgagtcttctttccccagcttatactgatatgcatgggtgtcatagagtgtttcagtgaacaatcaggaaactatttatcaacaaacagtgcagtgtgtattgtaattttgttctagtttttctttctttccttcttacttttttttcttcttcttcttttttttttttttcacttttttgacaaaaatctagacagttttccaaaggagtttctcttaattgcctcacccttcaagcagtaaataatattgtgccttgacttaatatcattttaattcaccattttctttgactgaggtacccacctcctctaccttttctttaagtctgataatctgtctcccacagtttctctatgtttttgtttttgttttttttaacctcactacattttcttttcaggtggttttttttttgtttttttgttttttggttttgttttgttttttggcattcctgagcacctattgaactcaattttaatattttatagtgtcctcaggcatctggtattattttcttgttcatggttcattttgttcctgtctgagtggattcacatggtttacaaactttaatgtccctgatgtgtgttttctattctttatcttggatatcacataaattgtgctccttataggatacctctatggtttgcagtttgagccaaggacattttatcatagtttctgtttgttttgggtatttgttcttagcatcagaattcagagggattgcttaattgtgtgcatttttagcctacattgctagactcacaatatgagaagttagacaggattagttgtatctgaagggttcagaacccaggttcagtgtcctactacatccagctctggtctagtctggcagcaaccttgtggggaagctgtgcagagtaggtcatgggaagttttgtgagaggcagcctgcaacagatttgggggaggggttcctgatggagagtgtgagattcctgcataaattgatgagtttaaggaaaagacaccttaaaagccaaggaaaatgcaagcaagcaagcaagcaaacaaacaaacaaaaaatccaaaacaacaaaaattagtgtgaagaagtgggtagctaatgacttaaaagttcctgaagtaggtggtcttagaagaattccaggaacctgttgaatattgggcgggtccagaaggcggggctaggcagaagtgaagggaagttcctaggtttcatcattctctttgtatcttggttgcctggtggtcaggaagtcctggagggaaacttgtgcctagtattagtggaacatgaaaacttccttaagcaacagttgctgtgctggcctcctaggacattgagcagctggtcctgtcaccttccaggtcagaggagctgttgtactggttaatgggcaggagcagggcaggtgtgtggagcatggttgcattttctgcctccactatctcaattctgttgtggatatcttaccattatcaggaagtttgagatcctgtgaattgggttcatggtgatgttttaattaattttatggttgccagaatatatatacataatatattattattattcatttaaataaccccgtagatccttggccttctctggagtttgtgtaccgggatggttgtcttttcaaaagccttaatagagctcctcgaattcaaattcattcatgctttcttaactcgcctgttcctccatttgccatttcatttccctttctccagggaactgaataggcacccagagagagctttgtagatatttgtcatatgggggaccagtgcagatttgattgaattagaaaatattctttttaaagtaccgtcatgttgctgtacatattaatattaacctagcaaagttatagtctccgttagtttaacactgaggtatatgcagtctttgatgtaaatacagcattgagaaatgtgtcttcataggcttagttattaatgtcacaccttaggtttgaataaaacatgaagacaggattgcagcaaggtacagctgaggagaagatatatagtaggttctgtcaaccctgagtgtttccagagaaaaactaattgtaccatgtgggcaagttttataaaataatacatcgtgaccaagagatggatttggtcacatgctacaggcagtttaataggccattgtagtttcctgtgaggctttatcattttcccaagacataaacctgcagcaatgcacgaagatacctggttcttatgctggcggtgcagttaatttttggcttttcagtctgagggagaaagcattcagagatatctgattgggtccagactgaaccaggccatcaggtggggggaggggaattgaggatgtgttggaggatagaggggcaggtcaagagataaccagcagccaagaaagtacctacccaactatgactttattgatatattaacagacaccccagttagccattcctcctgaatttctttgaatccttccaaggttcagcccagcatgtgtgagaggataatttcaagccaagatactttaataagtgggaagcttactatggattaagacaaaattggacagtacctttggaataattatgaatgctcactttcctaagaaaaatgactccttgcttcatgaaaagcagtctgcccatgcacattcatggtttgttgagttctgcgctgtggacttcttacgggtgtggtaatgcttagacgctgcactcaggagttttttcagagatctcttgttggagaaggtcaaaagtttggatcctgcatttcacaatgtttttcttacattcttccttgttctgcagtgtttctgggaaatggaatctgtatgtgtgctaactgtgtgactgactctcacatctctagggtaaactgaaatcctcagggaaaaagagacattctcatgatatcttctctttccttcatgtttatccttccacctggtgttggcatctttcatttttgtcacatgaaaaggtccaggttctttttgaacgatattttcccattttcaggtctccattactcagccaaatctgcataactataaatcaaatctaagagccctaagatggtaaaggccaaggagactctattgaaggatccaggtgtgttagaggctttgaacaaggagtggggtgtgggttcacctgaaaatgtatgtgttcctatgcccattttttattacacacttgatgctgtctgcaaatgcccagggcatcaagttttacatgttgtaaatttatggcagtattgtatttttccctgcatctccaatttctgttttacagaaaatcctgttgtcagtaaattttccatcacatgaattagggattatactcagttcatacatactacaattgttagaatattcacagagaaacattctggtattatctggtttctttggtattgcagatattacagagctcctagagtttaatctaatctctgctatctaaatctcctagtgcttgcattttcaggtgaatggcctttgcacatgaagtgtcccagagtgcttgcacagttagcatctcttctttccctgtaccgtcccttgttattcatgttttcatccaatccttgtgtttcatatatgttttaaggaaggttttggatgggtatccatgctgtcatatattcataattccatgttccatggtaaatgacagcaggggtttccataactccactttctccttcttttacagtctttgcctttttcccactgctggctttttattcagcactctctgaattggcagtttccctttacaaaccatgtttggctgagttatccagaaagcaccaacaatttaaatgtatttccagtatttctacatatagcagtatgtcagttataaattcatttttgggcctgtggtcattttgtttttttttttttttttgttttgttttgttttgttttgttgtttgtttatttgtttggtttgttttttgagacagggtttgtctgtatagccctggctgccctggaactcactttgtagaccaggctggcctcgaactcagaaatctgcctgcctctgcctcccaagtactgggattaaaggcgtgcaccaccatacccggcttgggcctgtgatctttagagtgacttttgaccagcttctagtgaatgtctatttcctttgtaggctgacctcagttcaaaccagtaaagtttctgttacctacttgtcactactacacctgtcaacataccttgttagacaggttggtattacagcacaagggtcagtcagtatctagggagaaccattaatgacaccttacacccatcagcctgcagagatccttttagcagtatgtatgctaaaccagcatatccaagatccttttagacactgagtgctcttctcacttatcagattgttctttaggaatgtataaaaccaaatgatacattttttatattttttcttgtattctatagcgtgttaagtattttatcagattggattatttcttgggatacttgcaagtcttgacttaaagaattatcttttttgtaattcgagaaaacttaccttcctcatatccttatttgaacattgaaaatattctaagtcttacttgctccttgtaagcactgctgtactgtgataacttagtttggaagcttgtttgtcttctgagtagagtagaatgatgacagctgtcttcagtttgtgcagtgataggcttaggatgttggctaacattagactcagtaatgttctttctgttccacattcttcacagctttcatagtgatgcactgtggtattttgctgtaggcctttcatagatatattgacatggttgtgagctttctcccactgattatagtttatgccttgagttgtttggtttgtgctttttgaaacagttttgagtctctggcatgaaatcaagttgagtttactttctgcatcattagagagaaactttttaaatgttgcactggtgcacccatactattattattttttgtgtgcatgttttcgtggttatttgcttttggacccaggtaaggtcagctttgtgtgataactgtaccatattccccttctttctgtgttctgcactgttttatctgtaaattttttgtgggatttttcagaagaaatttgtgaatttggtgcagcatttgattattcctgagaaagtgctagaaggaacactgagagcctgggtttctgctcttgattattccctggcctagtgtttattgttcctaggaaatcaatatttcccttgtcaattctgtttcattttctatcactttctatggtactcgatcatttgctttttttcccattgtcaatctatacttctcaggctggggcattggaagatatcattcatatacctgtcaaatgccaagagaaatatttgacatgagattaatataaggtcaatgaaatacataaaaagcactgaatatttgctgatatcatggtcatgacaactttcttcagtaatagtatctacatgttcagaatgaattcttatgttttcatttatgcatacacatatgtatgtatgtgtgcatatatgtgtttgtatgtgtattggaatgtatgctaggagaccattatcacactttctttctttctttctttcatgtgaacctataagagtggtggccagagatgaaatctttaacagctagactccaaagagtgtcattgcagtcatatttattactgattgggaacatgagaacttcctgcaacaatgcctcaatgcagatacacggttgttcagacagatgttccaactttgatagtattttaacagatttgatataatgagggaattattccaagggcattaccctcaaatgactcattttgtgcatgtgtgtatatatatatatatatatatatatatatatatatatatatattgtcccttgcagccaacagtgaggttctaccatttctccttcttgattttgtatgtcaatatattttatgcaatatgctctcagcataaaatatattcatagtaatactattcataaaattgcatatagaagttgtatacaactcaagtgtcactttacactaaagacacttaccttgagtttttaaataaaatttctaaaattttctctgcaccccatcccatccctcctctccacccctccaagaggatatccctacacctcaccattccaccaggcctccccaattcctggcacttctagtctctggagggttaggtgcatcttctttcactgaggtcagaccaggcagtcatccactgtttatttgtcatggtcatcatgtcagctgttgtttgctgcctggttgttggcccattttctgagagatcttggggggtccagttcagttgagactgctggcatatggatggggccaccttcctcctcagctccttctgacttttcctaaattcaaccacaggggtcattggcttccatccattggttgggtgctagaatctgcatcggactcaggtgcttgttggacctcttagagggcagccatgccaggctcctgtctataagcacaccacagtatgagtaacagtgtcactgccctttgccttcccttgatatggatcctaatttgggcctgtccatgggcttcctttctctcatgttcttctccagttttgtccctggagatccttcaaacaggaacatttctggatcagaggttttgtgtataggatttcaactccattactccacttgatacctgtccctccactggacagcactttatccaaggtctctccctttgagtcctgggagtctctcacctcctaggtctttggaacatgggagatggacctccatagcctacctcctgaggctgtctatttccattttttctactggttctcagggcttcagtcctcccccatccctcacaatgactgatcatgtttccccttcccctctctgtccctgcttccactcagttctctccccacttcttcccccaaaaatgctttcctctgtctcccaagtgggattgagacatcctcacttggaaacttgagctttttaaccctctgtagtcatttatgttttattatatactttttttggctgatatccatttgttagtgtgtacatactatgcatgtccttttttgggtctgagttgcctcactcaggatggaattttctagttcaatctattttcctccaaagctcctgatgtcgttgttcttaatagatgaataatactccgttgtgtaaatgaaccatatttcagtatcgattcttccattgtggggcatctgggttgtttccagatcctggctatcacaagtaaggccactctgaacataatgcaacacaagcccctgtgtcatggttggtcatcttttgtgtatatgcccaagagtggtatagctgggttttaaggtatatctatttccaatattctgaggaatctccagattgatttccagaatagttgaccagttttcaattccgcaagcaatggaggagtggtcctctttctccacatcctggccagcatgtgctgtcacctgagctttttatattagccattctgattggtggaaggtggaatctcagtgttgctttgatgtatatgtttctgatcactaaagactttgaacatttcttttgaagtttctcaaccttccacagttgcttcattgtgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcaataccaagacaatataattgaaaaatccccaaggtacaacaactttgttttggtagtgaagaatgaaaaattactggcctcttgtgagaacatgaactttcacctcggagcccaccccctcccatctggaaaacatacttgagataaaggcctcctggaacaacctcaaaatgaaccgggtacattgccaaatgataggacatgactccttagttacgtagattccttgataggacatgactccttagttacgtagattcctttggcagaaccccttgtcccttggcagaactccctagtgatgtaaacttgtacttttcctgcccagttctccccctttgagttttactatataagcctgtgaaaaattctggctgactgtcgagactcctctaccctgtgcaaaggtgtatgagtttcgaccccagagctctgtgtgctttcatgttgctgctttatttcgaccccagagctctggtctgtgtgctttcatgttgctattctattaaatcttaccttctacattttatatatggtctcagtgtcttcttgggtacgcggctgtcccgggacttaagtgtctgagtaggggatctcccctcgggggtctttcatttggtgcattggccgggaaacagcgcgaccacccagaggtcctagacccacttagaggtaagattctttgttctgttttggtctgatgtctgtgttctgatgtctgtgttctgatgtctgtgttctgtttctaagtttggtgcgatcgcagtttcagttttgcggacgctcagtgagactgcgctccgagagggagtgcggggtggataaggatagacgtgtccaggtgtccaccgtccgttcgccctgggagacgtcccaggaggaacaggggaggatcagggacgcctggtggacccctttgaaggccaagagaccatttggggttgcgagatcgtgggttcgagtcccacctcgtgttttgttgcgagatcgtgggttcgagtcccacctcgcgtctggtcacgagatcgtgggttcgagtcccacctcgtgttttgttgcgagatcgtgggttcgagtcccacctcgcgtctggtcacgggatcgtgggttcgagtcccacctcgtgtctggtcacgggatcgtgggttcgagtcccacctcgtgcagagggtctcaattggccggccttagagaggccatctgattcttctggtttcttttttttgtcttagtctcgtgtccgctcttgttgtgacagtaagcttctctggaaatcgcatgtaagatgccctgtattggtcttgcttgtgtttgtcatttctgtggtactgtgattctatagtggttgcctgaaaaacggtttctgtgtgtgtcttttgtgtctctttgtgttcggacttggactgatgactgacgactgtttttaagttatgccttctgaaataagcctaagaatcctgtcagatccctatgctgaccacttcctttcagatcctcagctgccctgcctcccactccaactccagagagcagccagcgggtcacagtgctcccgcccatggacctggagcctagggaaaaatgagctcggaaatccggagcaaatgaggagtggtccctgagaagtcagtggcctggatgttgtggctgctgaaataaaaagaagaggaggctgttcgagtagccggccaagagcgctgcaggttcccaggcagcttctcattcccctgtccctcccatcccgtctcttgttaacaaaaaaactgctttcactttaagataagtgctggttgcagccagctgtgagagctgcactcccgtctctgctctaaagttccctcatctcagaaggtggcaccaccctgagctgctggcagtgagtctgttccaagttccagtgagggaggcatccgcccacttggggcttctgtccaaggtaaggagcacctgtgagtctaactgccaggctctgatgggggtctagtctctgtgggactagaaagtgtcccaacaatctgaccaaggtaacaggaagttaagacaaagacagagaccaaagtcagaatcagagctgtgctgtgaaaaagaaagataagaaaaataaaatgctggtcacaaaagtcagggaaattagaaaacttagatagtacctggcaacaaacgaaagcttttggctaaagatcaatgtgtttaagagataacaaaaggggtgctaatacagaagctgagtccttagaagagtccggtggcctacctgttgaagcagctagaaaaagagactgtgtttcatactcctccaccgaccagtgcaaaacaagctaaaaagttcctgggcactgcgggcttttgcagattgtgaattccaggtttgctgagttaaagagataaacagtccttcgtatagagaaataaagagaacaatcttacatggccttggatgctcttgagactgccctgatgttatccccagctatgggactcctagatgtgactgagaacaaaggtattgccaaaaaagttcttactcagagattagaaccctagaaaagacctgtggcatacttgcaaaaaattagacctggtggctgtaggatggcctgcttgtctgcacatagtggcttctggtcaaggacgcagataaattgactctgagacaaaacttggcacatgtcctagaaagtgtggttcagcccccatgaccgatggctgactaacgctcttgaaagcattatccaactgttcccctgacggatagacacattgtcagagctttttgttgactgaacgagtgaccttcgctccccctgctatcctcaatctcactactgcctgagacttcacctactcatcattgtgctgacattctggcagaaggaactcatactcgaaatgatctgaaggatcagatcagccttggcctgagagtttgagctggtacacggatggcagtagcctcgaagttaaaagtaagcggaaggcggggacagcagtgcagtgatggacagaaagcaagtgatctaggccagcagcctccctaaaggaacttcagcccaaaaagccaaacttgtggctttaatacaagctctataaatggtaaaagaaaagtctacacggacagcaggtatgctcttgccactgtacagagcaatatatagacaaagagagctgttgacatctgcagagaaagacctaagatgctgtggctaaaagaaatcagatggcaaatctaaccgcccaggcatcctaaagagcaatgatcctgacagtctgaagactatcaagttatagacaaattaagattggtaaaaaaaaccctgtatgacatagtagaaactgaagaaagaaaactagtcctctcatgagaagacagacctgacatctattgaaaaatagactttactgaaaaaaatatgtgtatgaataccttctggtttttgtgaacattctcaaaatggataaaagctttttcttataaaactgagactgctcagatagtcatcaagaagattattaaaaattttccaaggttcggagtgccaaaagcaatagtgtcagataatggtcctgtctttgttgcccaggtaagccagggtgtggccaagtatttagaggtcaaataaaaattgtattatgtgtacagacctcagaactcaggacagatagaaataataaataaaactctaaacagaccttgacaaaattaatcctagagactggcacagacttacttggtgctccttccccttgccctatttagaactgagaatactccctcttgattcggttttactctttttgagatcctttatggggctcctatgcccatcactgtcttaaataatgtgtttaaacctatgttgttataataatgatctgtatactaagttaaaaggcttacaggtggtgcagaaagaagtctggtcacaactggctacagtgaacaagctgggtaccccaaggacatcttaccagttccagccagagatctgatctgcgtacacctgcgtcatgctgagaccctcaagcctcactagaaggatccctgcctagttctgtttactaatccgccttattctgtttttgttcccatgttaaagatagagtaaatgcagtattctccacatagagatatagacttctaaaattctaagattagaattacttacaagaagaagtggggaatgaagaatgaaaaattactggcctcttgtgagaacatgaactttcacctcggagcccaccccctcccatctggaaaacatacttgagataaaggcctcctggaacaacctcaaaatgaaccgggtacattgccaaatgataggacatgactccttagttacgtagattccttgataggacatgactccttagttacgtagattcctttggcagaaccccttgtcccttggcagaactccctagtgatgtaaacttgtacttttcctgcccagttctccccctttgagttttactatataagcctgtgaaaaattctggctgactgtcgagactcctctaccctgtgcaaaggtgtatgagtttcgaccccagagctctgtgtgctttcatgttgctgctttatttcgaccccagagctctggtctgtgtgctttcatgttgctattctattaaatcttaccttctacattttatatatggtctcagtgtcttcttgggtacgcggctgtcccgggacttaagtgtctgagtaggggatctcccctcgggggtctttcagtaggaccttttccctcaagaatttgagaagttgctgtttcatgcaaaacttgccatcatttatctgccttcatctgctgccattctaacagggcagcgcgtcttctgccttaacttgaacttgacaaacgccgaactctctaaatgaagccgactgaaggagcaaacacgcagactttttaattttgaggtgatatttcctctcagaagtccaacgtcacttaatgtcacgcccgttgagcgaaggcggcaggacgacgaaggccaacccaggcctttgctccttgcctaatagtcgcgagagggagccctagcccggcgggagacagcgagcccagccattaagggagcactgaagacccagctcgctttactgggaagagaggaggcacaaagcaccgctgacacgcttcctcgaggccccgcccactccgctccacagcccgctagaggcctggaggaggcggggccaaggaggagcatgcgcacgcgccctcgcgagccggcctcctaatggggaacgagcgatctcgcgagggttgagagcgggtggcgtaggtatctgtcctggttggctggagaagagaatccagtccgggagaggagaaggcgccgggaggcctctgagaaccttccgttttcctttccctttccctcggccctccgcctcctcagagtcagcccgccttccctgacctccgtgaccccactggccccgcccactcgcgtcgacgtgattcccgccgtgaggtaaacgccagtggagcagagtcccgcggaagaggacagcgaggcgagcggctcggctgggccggctcgggtcggtggcggagccctcgagcgtgagagcttccgggcgcgtctcgctcctccggcggccgggacgccagtgtcgcgctcgcccaagcggcttccctcggcgccgcgcctgcctgtggccgcggcgggtgacacagccagaacatgtcgtctgcggtggagcctccgccgcccccgcctcccgagagcgcgccttccaagccctcggcagtgggcgccggctggagcagcagcggcaacaaaggcggccccgagggctgcgcggcgtccgcggctccgtgtgctgcgggttcaggccccggccccgcggacacggagatggaggaagtatttgatgatggatcacttggaaggcaaaaagagatccaagaaccagatcctacatatgaagaaaaaatgcaaactgaccgagcaaatagatttgagtatttattaaagccgacagagctgttcgcacatttcattcagtctgctgctcagaagactccaacctcacccttgaagatgaaaccagggcgcccacgggtaaaaaaggatgaaaaacagaatttgctttaagttggagattaccgacactgtagaacagagcaagaggaggatgaagagctattaacagagagttccaaagcaactaatgtttgtactcgatttgaagattctccatcatatgtaaaatggggtaaactgagagattatcaggtgggaggattgaattggctcatctctctgtatgagaatggcatcaatgggatccttgcagatgaaatgggtttgggaaagacacttctaacaatttctcttcttggatacatgaaacactatataaatattcctggtcctcatataattttgcttcccaagtctacattgcacaactgaatgagtgaattcaagagatggataccaacacttaggtctgtttgcttgataggggataaagagcaaagagctgcatttgtcagggatgttttattaccaggagagtgggatgtgtgtgtcacatcttatgaaatgcttattaaagagaagtctgtgttcaagaaattcaactggagatacttaattatagatgaagctcacaggataaaaaatgaaaaaatctaagttgtcagaaatagtgagagaattcaagactacaaatcggctgttgttaacagggatgcctcttcagaacaacctacatgagctctggtcacttctaaactttttgttaacagatgtgtttaattcagctgatgactttgattcctggtttgatacaaataattgccttggggatcaaaagctagttgagaggcttcatatggttttgtgtccattcctccttcgtcaaattaaagctgatgttgaaaagagtttgcttccaaaaaaagaagtaaaaatctatgtgggtcttagcaaaatgcaaagagaatggtatactcggatattaataaaagatatagacatattaaactcaacagggaagatggacaaaatgaggctattgaacattttgatgcagttgaggaaatgctgcaatcatccgtatctcttcgatggagctgaacctggtccaccgtacacaacagatatgcatctagttaccaacagtggcaagatggtggtgttagacaagctactccctaaactgtaagaacaaagttcaagagtactaatctttagtcagatgacaagagtattagacattttggaagattattgcatgtggagaaattatgagtactgcaggttggatggacagacaccccatgatgagagacaagactccatcaatgcatacaatgaaccaaataccacaaagtttgtatttgtgctaagcacacgtgctggtggtctgggcatcaatcttgtaactgctgatgtagtaattttatatgattcagattggaatcctcaagttgatcttcaggctatggaccatgcccatagaattggacaaaggaagactgtccgagtgtttcgctttataactgataacactgtggaagaaagaatagtggaatgtgctgagatgaaacttagactggattcgataataattcaacaagggaggcttgtagatcagaacctgaacaaaattgggaaagatgaaatgcttcaaatgattcgacgtggtgccacacatgtgtttgctttaaaagaaagtgaaatcactgatgagggggctggcgagatggctcagtggttaagagcgccgaccgctctttcgaaggtaccaagttcaaatcccagaaaccacatggtggctcacaaccatccgtaacgaaatctgatgccttcttctggagtatctgaggacagctacagtgtacttacatataataaataaataaatctaaaaaaaaaaaatcactgatgaggatattgatggtattttagaaagaggtggaaagaagactgcagaaatgaatgaaaagctctccaagatgggtgaaagttcacttagaaactttatgatggatacagagtccagtgtttataactttgaaggagaagactatagagaaaaacaaaagattgcattcacagagtggattgaaccaacaaagagagaaagaaaagccaactatgctgttgatgcatatttcagggaagctctccgtgttagtgagcctaaagcacccaaggcacctcgacctccaaaacaaccaaatgttcaggatttccagttttttcctccgggtttatgtgaattactggaaaaagaaattctgtattacaggaaaactattggttataaggtacctcggagtcctgatctacctaatgcagcacaggcatagaaagaacagctaaaaattgatgaagcagagcccctcaatgacgaggtgttagaggaaaaagagaagcttctgacacaggggtttacaaattggaataagagagattttaaccagtttatcaaggctaatgagaagtggggttgtgatgatattgaaaatatagccagagaagtagaaggaaaaactccagaagtcattgaatactcagctgtgttctgggaaagatgcaatgagcttcaggacatagagaagattatggctcagattgaaaggggagaggcaagaattcaaagaagaataagtatcaagagagcactagatacaaagattggacagtacaaagcaccctttcatgagctaagaatatcatatggtactaacaaaggaaaaaactatactgaagaagaggatcgttttctcatttgtatgctgcacaagcttggcttcgacaaggaaaatgtgtatgatgaattacgacaatgcatccgaaactcccctcagtttagatttgattggtttctcaagtccagaactgcgatggaactccagaggaggtgtaataccttaattactttgattgaaagagaaaatatggaactagaagaaaaggagaaggcagagaaaaagaaaagagtaccaaaaccttccacacagaaatgtaagatggacggtgcccttgatggccgtggaagaaaaaaagaagctgaaactatgaatgcatttttgtcttataatcactatctagtagttctttaatttacaggtcttcataagatgtgctggacagtgctcaactgttatgtcattcagacatcaggtccatctgcttaccgagatagaaacatagtatgtagtttcactttttttaaatgcaacagctgtgctgaaatttttttatcattaacaattgaagtaataaaacaggcttcatttattaaaaaaaaaagaatttgagaagtttaatcatgagaaaaagcaatgtcattgtaacagggggcacagactgggatcaaggtgacctgagccaccgcagcttatctcagaaacattattgtaaatatttctttttgtaaaaagactgcagatatagctgatggaaataatatacgttgttagagtgaaatcactccatacacaagcagaagatgaattaagaaaagttgctttagtgactgtgtgcattcatgacaggctaattatcagactaatcagcctagcataaatctgaattcaaaatatgctgtcagtcttaagtttcttttaggttgagttcccagattatgctttgaaccagttaaatatggactggatactgcatatctaggctcttaggtagatggaaggtttacatagtacagatattgtaagactcatttcttacatagccattttcctaaaaaaaaaaaaaccccacaaagatagcagtatatagttttcgtttgtacctaagatttattattcaaattgttttgttttcctccatgttgggacgaccatatgtttgtaaaaaaaaagactatattttgatgtaattcctaaccatttttgaacatctgttagaagactcatagtgaaatgtctatagggtgcaaatcgaacaacctgaccttgatcactatataaaaaatgtccatatttcctcccttgaatattttgttccccaatctaggtaggactaaagcatccacactttgatcttccttattcttgagcttcatgtgtactgtaaattatatcttagttactctgagctgtggagcagagaatgaaagaaaagccatccacacactgacccacctgggaatccatcccatatacagacatcaaacccagatactaatgtggatgccaagaagtgcttgctgagaggagcctgatatatctctctcctgagaggctctgccaaagcctgacaaatacagaggtggatgcttgaagccacccattggactgagcttgggttcctgatgaagaagctagagacaagactcaaggagctgaaggggtttacaacccataggaagaacaacagtatcaaccaaccagaccctccagagcctacagggactaaaccaccatccaaagagtacacatggaaggatccaaggctccatctgcctacgtagcagaggatggccttatcaggcatcaatgagaggagaggcccttggtcctgtgaaggctccataccccagtgtaggggaatgtcagggtggggaggcaggtgtgggtgtgtgtgggagcacctgtacagaagcacagggagggaggatgggatagggggcttccagaggtgaaaacctggaaaggggattacatgaaatataaataaataaaatatcagcatcaaccaactttagccactgtgaaaattctctggcaatcatttacggttctgagaatgaaacaactatttagacttaagtatgagctaatacacttgaaaaatatatttgaagcataaaaaaatatccaaagtagattccacaaagttgtgttccaatttgcacatatctctcctggcctaaatccttgtaaaaatacacacatacaccatacacacacacacacacacacacacacacacacacacacacacacacacacacttactcatgaatgcattcattcctgttaaggtttcttaaagcctagctacagaatttctcttcagcatgaatttgttcatgtaacagataccaagcaacaaggcttcaagtcagaaaagtcaatccttcctcaagagtggcatcatattttttgaatagattgttgacccttatcagactcctttcttcagaatcaataatcttgtgtgactggatataagtgtgttacataagaatattagcaaatccgttatagacatatattcccctcagtatgcattttttcagatgctcaaaactacagtaatatgcaaaatatctaagaggttcattatgcactaaagtttgtactcttgtgtaaaggtatcaggaggtacaattcaggtacaggttcagctctttattggacaagttaacaaaagcagtgtagtaaaaaaagaccaaagcccctgtcatcttcggactcctcggactcttccttctttgcttccactttcttcttctcagctggggcggcagcagtggatggagcaggaccaccagaaggtgcagctccagcagctggagtgggcccagcagccccaacattgcagattaggctaccagtgttgacattggccagagcctttgcaaacgagccaggccagaaaggttcaatgctgacaccagctgctttaatgagggcattgatcttaacttccgtgaccatcacctcattgttctgcaggatgagggcagagtacatgcaggcgagctcggagccggacaccatgttatggactgctggctcggtgctagtcattggatgaagtgagggcctcaccccagtgtggcattagcaagctgaacacattaacagggtttgtctgtagaaatcccaatggctatcttaggaagctgacagtgacctatggggacctgtgctgtcccatgcccatgtatgcttcacccgtgcagtgccttcctggctgtgttaaatcaccagtgctgtggactggacttagcccctcaactctcaggggccccttaagtgtcggcagactcagggtcctggtacacaggcgtgaaggagtcagcggggtgacaaacagatgcaaacataaaagagtgttgatctgaatataatttctcaaaggaagcatcagacttatgatacagaagaaaataaggaagttaggtgacacatcacccaaggtacgttgaggttacccgatgcttaatgactctttacacaaaacagaagaatgcatacataaagactgacaggaactaagtaatataacaactgagacaaagtcatctctatctaaggtcagctatattcctaaaagccagatgtgaggtcattatgttcccagggcaagtcctttcttgcccaagccatagttctaattttgatttattgtttagcccaccaccagccagctcttagtaaatacctaactatgctatgcttctgggctagtgaaagtatgtgctagggagttctgctctaggtaaccttctcatgaataatgtaatactctagctcctccttaaaccacatccctacctacttcctaaaccattgtaaattcttgtatatgtaagtgactgggctattattctaagtgattttgttggggactttcttctattaagtaatgtagtctgccatatataactataataagaattctaatcttacgttgctaagcttgccctgagatttctaactctatgtagtagatgataatgcctgctttctttcactatctctttttcaatactggaggcaatctgtcttaatcggtaacattcttatgatatcccaagtgcaaggccggttcaagggctggctaggacattggtgaaggccaggaagcaaagttcaacctaatttaggtatttgacaaatcattccttggaggcactgataataaaacaatactgaaagaaagcacacagacccactcatatattaaccaagtttataggaacatcatggtatgggatgccaaggctccaggagactaagtttccatgaaagtttttgactcaggacttttcccaagcttttgggcttgcttcacagatttcactggagtggctatgacgcaccagcacctggatttgtaaggttctgtaaagaaaggctttcgacgttcactcttctgcctcaccagtcttgatttctgaacttataaatttgaccataagctacttgtgaagtaaaagatgtttaatggaacagaagaatgagggctggtgatgacttaaaagttaatagcaggggtgggtgtggggggtgggtgtgcaagggacatagctcagcggttaagagtgctgactgctcttccaaaaatcctgagttcaatcccagcaaccacatggtggctcaccaccatctgtaatgggatccaatgccctcttcaggtgtgtctgaagagagctacagtgtactcatatacataaatacaaaataaaaaaaagttaagagcactggcctgctcttgcagaagactcaaaattgattccaagcatcaacatggtggctcccaaacatctgcagggacctgattctctctcctaacttctgagtgcaccagacactaagtggtgtacatatatgcaggttggcaaaatgttcatacttgacaatagaccagagaaataaatttgaaaatggccagaaacataataaaaacaataatataataaatcttgaaaaataataaaggctgagaggggagtcatcccttcaggctcatttatgaagggggatacctgcagcagataccctcaacaaactccctggcacattttcttacatcacaccaagaaaacaatccagacttggccatgtgtcccctaagagtttgacattgggcatcagggacagaatgctcaataccacaaatgtgtctgcttcagagctctgtgaagtgagctcagtcagtgcttacctacacacacaccccatgagggatgggaacacaaagcagactgttctcaactttgaaatgtcatgtcttggagagctgcagccggagagcctggttcaaagggaacatacttagtaaagcttgtggtcttagacaaactcatctgtccttccacatacatgtatggagtagtggtgtgtcccaagcactgaactagccagggcacttgggagagaaatggacaagatcaccattcctgatgacatgcagctgacatgctctctgaaatattttccccaccagggatggtatggtgagaccagaagccaaggacaggtggccattaggagcccaggagaagttggggcactgtcagttcactgagagtgagctactgccacctcacaagacatctccaatcttgtcatcacagcagactcagtaccattgcaaaaacaacctcagcataagtctccagaataagccttgctcaatcccaaaataatctgaagtgtgagggaattgaataacaacttatgtaagtagacacatatttcccacagaatattaaacttaagaacatacattaatatttttaaaaattacatttattgttgggtatagtggctcatgtttttaatgccagcacgcaagaggcagaggcaggtggatttctgagttccaggccagcctggtccatagagttctaggacagccagagctaagtaataagatcctgtcttgaaaaaaaataatcaaaacaaaacaaaacaaaaataactgaatttttaaaaatctatttgtggagggggaacacagcttacaggaggccattcttttcttcctcctgggatcagggatccagctggggagtaggtgcctttacccagcgaaccatcttgctgggtcaggaaaacatatttttaaacatgctacatatgattccactgtttacatggaaacagcagacattccatacaagactctgagtcaagcactgctttaatcctttggatgatgtttttattttgtgtttattttaattatcattactgagggtggggcttggggtggagcttgcaacccacagccttatgcatgggatacaggtgctctaccactgagcaacatccgcagtcttcaagagtgaatttaagctcttcaactcatatagacaaacaaatatgcccaagccttaggaagggcattggaattctgtttacagatgatgaaactgaggggtaaagctgaccttggtggtgcacgtctttaatcccagtgctcaggtggagggtgcatctttgagttcaaggccagcctggtatacagggtgaatttctggacagtcaggactacacagagaaatcatgtctcaaaaaacaaaacaaaaatacttcgtttttatttatgtgtgatgtttctttgcatataagtcagtgtaccatatgcgtgcctgggactcacagaggctgaaagagagcatcagttccctaggaactgcagtaacagttggtggtcatgagccactatgtgggtacctgagaacaacctttggttccctgaagagcagccagtgctcttaaccaccaagctgccatctatccagatcctagttcttctctttaaaatgtggctggcaaaaagcatccttgcttcaagtggtggagaattaaatacaactttttatttctaaagcatttggaaaagtgcctggcctttcttcttgatgccaaggagcaaaagcattattagctgtgaggtgggttctgatcactgcatactgtacacagctggtggtttgtaaatcaaagctgggggcagtgaccccagaatcctggaccacagtcattctttgcctcctttgtgtttcaagagagggtctcatgtagctcaggctggtcttcctcaaactgactatgtcacagaggatgtgcctgactctttaatccttcggcttccacctcacaaattctgaggggactaaaagcgtgtaccatctcaacatgtgacatgggtctgagctctgaatgcaaggtttgtggtaccaggctagcacattcccagcctgagttactactttccttttaaacatttttcttattttattgaaaacatattattttttggtataagggtgttttcgcctacatgtgtatctgtgccccatcacatacatgcctggtgcccacagaggtcagaagaggacattgtacttcctggaattggagtttcagttctgatccaccatgtgagtcctgggaattcaaccctgctccacaagtgcagcagagtgcttttaattactgagctgcctccccaagcctctaaatcacttcttaatatgcaggaatgtatataaactggcaacatatccttggcaacctcactaaaactgtgatatagctctaaatgtcacacaggatgagcaatgataaatacttacaaagtttaaaaaaaaaaaaaagaaaaagactggagctggacacttagagctagcttcaaagcacaaggccctctcctgtcctctgcagctacctgcacttgtgtgtgtgtgtggcctgcgtactgtccgtaggtgtgtgggtctatttttgggtctcctattgaattccattaatccacctacttatttctttctataccagtaccatacaactttttattactatttttctgccatacatctttaagttacagaaattgatagctccagatttttttttgttgttcaagaatattttatctatcctgtggtttttgttttgtttactgttccatacaacgttgagaatatttctttcaagatctgtgaagatttgtgctaaatttttgataagaattgtactgagtgtctagattgctttttggtaagatggacatattcattatgttaatcctattgatacatgaacaagggagatcttttcatgttctgatatcttcctgtttctttcttaagatactttaagttcttctcctacaggttttcacttgcttgtttagaggtaactgaaggtattttattttgtttgtggctaaagtggagggttctgtttccataacttctttttcaaccctcttaatcaattgtgtgtagcagggctaaggctttctttaagtcaattgtgtatgaagacactttgctaaaatgtttatcaactgtaattttttggtagaattttttgtctcacttatatacattatcataatatctgaatttcttcttttccaaattgtattcccttgatctcttaagctgctttattgcttgagctaatacttccagtactatatcaaagagatgaggggatagtggacagcttttccttgttcctgattttaatggaaatgcttaaaatttctctctatttagtttgattttgggtgatagattgctgaacattgcctatattttgtttaggtataccccttgcattctgtccctccaaacgtatcctaaaggggggttgaattttccaaatacctttttggcatttggtgagatatttatgtgggcttatctttcacttttttttcctatggtgcattattgtgattgcttatcctggttgtcaacttgactaaacctggaatgcactaccatccataaatacaggaaatacctgtgatcaagatctgcggctttaagaaacaggccttacattgtgacataggatgagaacacttttattcagatcttgaggccatagaggccatgagatggttaggcctagttaaggttgtatatggctttaatttcaggagactaaggcaagcagaactctgagatcaaggccagcctggcacagatcaaattccaaagcaagtcatggttgtatacaccattaatgtagagcatcccttctgctggaggcctgcataaagctgatgaaagaaggacgtctcactcttcttcacctgcttgcacttacttgccagcacatctgttggaacttacttcttcaggaatcctggttattcagaagaccaggcaagacatgtagcatcatgggactgtactagattcttggacttcttgttcactgatttccattgtagggcttgttggactgtagactgcaagttattagtataaagtctcttaatatagagagatataccataacttctgtgactccagaaaaccatgagtaatacaattatgttggtatattttttaaaaagattaacttatttattgtgtatggttttctgcctgcatatatgcctgagtaccacaagagggtgccagatcacattatagatggctctgagccaccatgtgtttcctgggaattgaactgatgatctctagaagagcagtcagttctcttacctctctgagccatctcttgagccgtgtggattgttatatattgaatcacccctgcattcctggaaatattggcattagttcttctttgacagtcggttagaattgtgcactaaaatcatctagcccaggacatttctcttttggttcagagagacttttttctttttttttttttttgagacaaggtttctctttatagccctggctgccctggaactcactttgtagaccaggctggcctcaaactcagaagtccgccttcctctacctcctgagtgctgagattaaaggcgtgtgccaccacgcccggctggttcagagactattaatgactacttctattctgttaggggttataagataattcagatattttaccttttcttgattaagctttggtaattgttatatgtctagaaagtcatccatttccttcccaattgtggagtatgggtttttcaagaaagacataattattttttaaacatcctcactgtccttagttgtgactcttttgcaatttccaatatccttaaattggatactgtctctctgacttttagttagtttggctaagggtttgtgtaagttgttgatttttttcccaaagaatcagctcatggttttcttgattctttctgttttttgttgtttctttctcactactttttttttttttgccttcattcattttatcaattacttcatgtatttacattccaaatattggccgctcttcttagtcccatgaattcttcactacataagccctagcctttgcatctgagagtgctcacccaccaatccacccactcctacctcatactacttgcatgatacatcactggggcatcaagtatgggaccctcttttttatttcttaatgtcatttgtcttatacattctgctttattttcattcctcctgacatcttcacattaggactgaccattcaggagatggtactaaggacttgtttcagtaaaactccaacaccaatagctaagcaaagaacacgccactcagttacaatatatataagctgcatgtcttgggcagatattccactacactattctattctccagcttttagaacccttgctatctgtggcttttcaggcaatgtgttcttctccatctttcctccaccttttcttcctctaacttcctctgcctccttcatctcctcgtctccctcttctttttctgtctttgccctctctaaaatctccagccccacctttcccttctattgcccaatcacaagctctggcctttattcgaccagttaaaatggagagaaggttcacatgaaattacatgagtatatagtccactgttcattggggcagcccctcttgaggaagcagaataagcattaaagtacaaacagcaccagggaaatccacattttgttcaatcccttttgttcaactaaaaggatcttttctctcacatataaattgagcacagcacttgaattatgaaattttaaaagtaaaagtaccctaaacacccaggccacccatcatctccatttagataaagcactaccatctatcctaacttaaaaggcttacaattctatacctgaattatctcctggttttaacttgtatctgaaaaccatcctctcaaatatatatcatgtcagtcaatgctaaacatcttgagttagctatgagagtacaacaagacttcagcagctgtaagatagaaatccaagcatgtcctaaatattacctgaacatataggaagcataaaacatagcttccaaaacccaaccaaactgtggacacagttgacaacctggacagtccctcattccttcaaaatggtggagcatcagtcttcagccttctggccaggatcatctgtcagaactttgtaaagcagaattttgaaggagtgcttagcctgtcttggcagatctattagttgctcttccacatagtatgtccttttcctggacaggacttttgtctgtagatgaagtgaggcaattcttctctggtggctatttcgccacaactggagcaactccactgatgcgcacttcatgtttatacaaagaatggatgctgtcaggagcagatatgtctctagtcgagtgatctttaataatgaaattgccttaactgtagtattctgtggacttctgtctatctatgcaaagtatatctgaactgttaagccttgactactctcaaccatttctgattgaaatatctcaaaaacaaaaactttataattaactcaggactatgattctgttatctgacccttaacttgtattttcaatcatctaaaaatatttagtaatagcagacatagagggacccagtctaagctttgtatttgtaaatgtgttgactgggtacaaatcctatctaataacaataatattactccaaatttttacatcaatctatgaatttcataccattgaaaaccttaactctattgaaataaattctgtagaaatgtaagaaattataagttcaatgctacataaattataaagatttctatctgtaagatatggccatgtaatgttttaagagtaaagttgacaacctattcttatttgtctaatattctaatttctatattactatatcccatctttatcttccctgtgacttttatttacctaagaaggaaggatagagaagaggaaaggaaaggtagaagtccctgagtctaagctctctagctccctccctgtctaaatctacaatatttgtaaaatattccttaaaatgataacatatctatgattcataaaataaccagaaccatccaccacaacataagatactgatacgatgatcttcttttgtctgcttatagctgaattgaggtgaaaaaatcccttctgtgggctgaagggaaaaaacaggaaaattggtttggtcaaaggaggactagttagtgtcatttgccttccaggcattatgtgctgagaaagttcatcaattagatgaaatcttgactatggcagtctgaaaggctgaataggtgatctagatattcttgaaaagttttggaaacaactatttagaagaaacagcttcaatgtacttgaggtagaatcaaacaaggagacagaagggaaggtcgcataatctcaacatcctggagtgtgaatcttagcagtgctgtctttctcttctttcatcctgcactataccaaacttacaagcaacatataattctggaaagacattcatatggagcatgcagggtgcacagactggttagttaagatcaataaaggaagacaactgcctttcttcagagattagtttgatcacatagtcaaactacaatatacattaccattcatgccatcttaaaggatggtatgtaaaaagtcatgagaattttgtacccagtaggggttattgggtgtgtatagacattttagtcaaagccagttccagagctgtctctatatacagagacataaacatcaccacgtatatagcacctagcttgttgattgtgttagtctccctttccttctccatagccaaggtattcaggaggtcttcctttgacatgtctcatttttatcaacttgaaaggaacccatagcttttcttttcctgtggaaatataaggataacccctccacttgtataacacatttgttattttccattctgatttcataatatccttaatataaacaggctggtttagtttagtagttctttccacaatcgaatgacttttagcatctgcaatgttttcttcattagcatttaaaaacttaggtaataaagcattatataatcaattttggagacttttgttgtccccttttgcttgttaagtatcccctttagagttttcttagacatctccacaatcaattgtcatgtagggttatatgatattcctttagtgtattttatgtaataacattttaaaaagctgcttcatcatactagagacgtatgctggaccattgtgtgttttgatttgtatgggtattcccagaatggccataacctctaacaaatgggtagttacagattcagccttttctgatgctgaggacgaggacgtttcccattgaaatccttaataagtgtcgatagtatgatgcacacatttcagtttaccaaactttgtaaaatggaatacatccatttgccaaatgacatttctttttgtacccttatgcttagttcctgaaggtaatggaatttgattgtataatgagcaagtaggacattgcctcacatttcccttggctctttctttaagacttgctgttaacatgatttgtttatggaattctaaagtctcttttattctttctatcagtagctggtcaatttcattatcaccttgtgccagagggcctggcaaacctgtatgcgatcttatgagtgatttatatagtgaatgactcctatttcttatcaattgtggtagctgaaaaaatagtgaagtcaattcagattcctcctgaataagatcaacagtctgtattggaaaaacaaccctttctgcatattgagagtcagttactatattaagagactctagagaatctgacaacactgggagtattgcacataattcagatatttgagctgatttataaggacattcagtgacctacaccttctgatttatatcctgcctttcctgatttattagtctcagcataagatgtaggggctccagataatggagtttcctttattttatgagggagaatccaagtagttctttttatgaaatgaaatcatttgcttttatggtatccatcactaatctctccaagaagttactgcatgttctttaccaagattcaccttgtacccctaaggaggcaatctctgcattagtaaaaggtaccactatttcaggtgggtccattccaactaattgtcaaagtctcatttttttctttttagtataaattcaaagaccttttccatgtagggatttcttactctgtttacgtgctaaaatcatccattctttttttttaaattcatatatttgtttgtttgtttgtttgttttgttttgttttgtttttgagcctgtttccctgtatagttagtgctggctttccaggaactcactgtatagatcaggatggcctcgaactcagaaatctgcctgtttctgtgtccctagtgctgggatcaaaggcatgtgccaccactgcccagcaaatattcattctaatttatcttccctctgcatgggaattccttgagggaaatgagtagaagttaagataactaagatgcaggtcatctttggataaatactggttagttgtgtagatcccttgctccttgtgtcttctctaggccacgtggttttgctccatcttccttccacctccttttcttccatcttccactatctcctttgtttacttgtctgcctctcctccttcccctcttcttcctttctaaaacctccagccccacgttttccttccactgcccaatcacaggcttcagtctttatttgaccaatttgagcaatttaaatggggagaagtttcacattaaatcaccagagtatgtgatccactcctccttggggcagctccatttgaggaagcagaattagcatcaaaatacaaacaacaccagggcaatccacaacaaggactaccctacacaccacccatgacattcgtccattgggccaaccatgtggacacagagccatggcctaactaccatggaagtccctcactaagcacaaaacaactgagtccaacatccactttcctccttccacaatttttccctttcttatgaatttacacctgtgtctcatctggccattggtagacttccttcccacttaagggaaccccaaattaaatcccttaggttcttccttttcatcagtggcatgaatgtaagtttctctgttctggaaacatggactgaggcaggaggtctatccccatgaattttgctctgagaacatttgagaccctgatacgtcaagccaagaaattcatggtgaattcgggtgacacatactgaactcaggcggtccctcaacccgtgggagaatcaagatttcagtattcaggtgggcaaggaatcagtgtcgagtgtcaatcagacaagaacacaagggagtgtggatctgaatgtaagttctcaaagtgagcatcagccttataatacagaagaaaaaaaggaagtgaggtgacacatcactcaaggtacattgaggttactcgattcttaatgactctttacacaaaacagaagaatgtatacataaagactggcgggatctaggcaatgaaacaactgagacaaagtcagctctatctaaggtcagctatattcttagaagccaggtgtgaagtcgttacgctcctgggacaagggctttcatgtgcaagccatagttctatttctgatttattgtttatctcaccaccacccagctcttagtaaatacctagctatgttattcctctgggctagtgaaagtatgtgctagggaattctggtctagctaatgttctcatgaataaaatgcaatgctctagttcctccttaaaccacagtaggatcttcttcctaaaccattgtaaattcctgaatatgggagtgacttggctgttattctaagtgattttatggcggactttcttcttttaagtaatgaaatctgccatacataactataataagaattctaaacttactttgttaagcttgctctgaaatttctaactctgtatatcgtaaatagtaatgctttatttctttcaatatctctctttcaatactggagtcaattcgtctgtataggtcatagttactaaattccaagcccagtgtaggctcaaggactgcctaggacattgatgaaggccaggaagcaaagttcaacctaattaagtatttgagaaatcattctttggaggcacctataataaaacaaaagtgaaagaaagcacacagaaccattcaccaactattgcaaggacaaatctgaaacaaatttgtttatgggacgccagaatcgttccaggagacaagtttccttgaaataatatgcgtcaggactgaggccaaggttttgggcctgtcatgcaatttttactgtagtgggtgtggcattattgtatagttccccaccacctctttagttctgattctttttgacatcattactaatttaaattttttccaaagaggaagttgttgctactcacaatacatattgttagaaataggcaagtgtatatgtgtccataactgcctcttctccagccatcttagccttggcagactcattggatggtgatgagaaggagtgaaatcatttgaaggcatttgaatgcttggtgttaactgcaagcctcccacctccaccggatgcatggcatgaactttgtgccagggataattctgccttcccacacttaagaatccttcatcaaattcgcagcctactctggttggactccaacaatctcctgccttgcagctgcctctttaggcccacaggacctgacttgaggctcaaaaaggggaacacccacaattgtacggactgctgtctatgcagggcctcattcccctgagtccaaatgtgatccttaacttacccaggtagaggctttgtttcacctaaacttcctcagctttgatgaccagggactaaaccctgtctataaacattgggctttcctacccaggaaaacccacttccattagtatagtggagtggtgccctaacatcataacgtcagtcacctgctcccttgctgacacagggctgaggatatgtttgtgtttttccccaggaatccacaacaccaggatgaatggcagtatgggacacccaaccatccagggaaaagtagaaaagggacgaaccctgctcctcctcagaactttttcgtgaggagtctgcacttgtaggagataagtctctacttgtctgtgatccctgtattcataccatttgctttatatgctattaagtgcaaaatatttcccaggcctatgaacaaactgtcccatttcagcaaggaaacttgagctaacatagtcttaaatgattcagtactctcagaaaaagtatatccttgctcaatgagagcagggtgtccattcttgcttttgatatggggtttattggaaaagtttgggacaacttaaaaaggtcttttgacacatcctggatagtatcttatgctataattgtaataataataataataataagtattgcttaattgtcttgtacaacacatctcttggcaatgctctatttgcataggtatgcttcaactactgatggttcttgagcatctagaataaggcctacccagaataatagaataaggctattatagcttagctcatagaaattccccagggttctgtttaggttccctccttacaccctgatatgccctctgggatggctgtcctttcagggctggtagtcaatgaagggtaagaaactgtttggcagctcaacataagacacacatagtcaaccatatggaaggacatctgagatggggccaaaaaactctgactcctactgtgctatcaaaaattaaaataagccaggcaatggtgacacatgcctttaatctcagcacttgggaggcagaggcagtggatttctgagtttggggacagcctgttccacagagtgagttctaggacagccagggctatacagagaaacaatcttattttcaaataagatttattattcaaattgttcttttagtacatcttgaaatgataatatctttaaaagaagaaagaagacaatatttattgttttaaagactaagctttttttgagcatctgtgagaaggctcagtgtaaaatgtctgtaggatggaaaggtagaaacctgaccttaatcaatatataaaaaatgtgcaggggctagaattatggctctgtgggtaagaacactgaatactcttcctgaggttatgagttcaatttccagccaccacatggtggttcacaaccatctgtaatgggatttggtgccctgttctggtgtgtctaaagagagctatagtgttctcatatacataaaataaataaatctttaacgaaatgttcaatgtagactgtacaaagttgtcttccaatctgcatatatcagttatgccgaaaatcactgtaaaaatatgagtgtgtgtctctctctctctcccttatattactaatggccaaaatcactgtattaataccatacaaacgcgcatgcacacacacataccataaaagtttctatttaatttttgctgttacagtatctaccatttctagataattcccttagaagtcactatttaaagatgcagttccaaaacacaactaatgggaacatgaagaaacatgaagtatcaaataatattcacatagccatagcaagtgagatatattgtgagatatgcagttgattgctgattattctacttggttccatctctgattgatgagctatttaatgtttttgatattctcttctattaaacatctgaacatgaaaattgttaaatatgttgacaaaacggtaaatgttagggttacatcttctaccattggacatgtactcaggaggctgacacataaaaataaagagttcaaatgtagccttgcctaatgattgacatccaaatcaggctggatagcaagcatcatctctagggattttgtgaaaatctgaaaaacaaaaccaggaaccaccacacaacactcttcacaagcaccttacttggaaagtatgagtatacacagtgatatttaaataaacagtggatgacagagatgatcagcatgcatgttatacattgggggcgggtatcaccaagtgaaaatgcaaaagaagatgaccaggatccacagaaggaatataacaatggcctaataaagttttgtgaatggatttgcctcacatacattaaaatttaaaatcggcttcaaataattcaaaatacaagctcccacaactattaatgatcacgagagacaactatgatgtttagtcttcatcaaaaggtcacatgaatagtgtgtttctcttgtgtgagttctttcctacatttacttgtgaatgcattcattcctgtcaaggcatctagaagcttacttacagaaattttctttatcgtgaatttgtttatgtaacagaaacaatactgcatgagtcacaagggtaacagaaatcatttcttcatatttgttagaagaggcaggcaaaatcctggacatatcacaccaagcttcaggtgccatgtgagaggatttattggcagaagcagcccctgagaatggtgagaggtcagaagaagagaagggtctgtgggaagagggaacactcttttattcagtgcacaagaatgggaagcatgtgaaagggaagtggtgccatgttgggtgccatggcaacagatgcagcggaagtgctgttgcctacagatgaggagtgtcctcacagggtccagaagatggctgtaaagacacttctcgctgtccacagatgcacctgatgcacattgcttgtatttgtaggatttctcttcaatataaattcttttatgacatttttgtgatagtgaaagcaaaggctttactggattgattactttcatagggtttggcttcagtgtgaattcttttctttttgtagactctagagaccaggtttttttccatattgtgtcgcagtctaatcttgtaggacatttgtctgagggaaatgcaaaggcagatacagattaacacattctcttttccttgggaatgtcggcataaaggaagcacaaatgttttatgtaaacttccattaatatgcagcattgataaaatgagtttcaataacaacaacaataaacagattccttaacagaggtggaatgctcctcatgtgcaaaatttaatatttgtaacccttgtgactcacgcagtactgttgcaaaatcatgttttgcacattagtaacactcacgaccctagtttgagaggctgaagtatgctcatgtcattgtggacactttcagaacaattacccttatgtacattgatgcaaaatactcaataaaatactcaaatactgaatccagaaaacatcactaagaatctatccaaaatgatgaagattgttttctcatccaatatatcttgaagagtttccattccctctactcttctcagttcctgtccacttttcatttgttctggatcaaaccccttttatgtctctcaataggaaaacaaacaaacaaacaaacaatgaaacaaaaaaaatccatagactcactaattgacaaatctgcccccaaaaagccaaggtaaaagttatatttcaaaagaactggtgcaggcattagtatttgtacattagaaattctagtctcaaatttctggtatatatttggacaattttgtgtgaagcattttgctgggtgttgataaagtatatgataaagtatattttctatgggtcgttataagttaagatatcaaaaagctaaaatttcaaaggggtaagaaattttttggctcagctctgagttcattagtcagaatgaaagactatgattgatgtttactggttagatgacataaatgtgggtgtctctgcaaacactagttctggtagagtaacaatccatgagacaaaaaagaaatctagttctataccgctctgtaattatttccgcactggttgtgggtgtgttgtgggttatagccaatgaaattcctacagcactcagagaaaatctttcccagtgcctgcgttaacatctgaagtaaaaagtctcctggtagtcagaagtcaagataaactacaaagccccatgggacaattaaccacacacaagataatgactgggaagaacactggagggagcctgcctctgctcagatgagaagcagaagagaaatgagtgggaggcaggctttgtatagggtttagttgtaggtgatggattttcaggattggaaatatctgcggttggagattgctggtattttatgttctgagcttgagcaaactcagggatttgtgagtttttaaaaccagtaagtatgctatccattctccctgtagacaatgttgagtgtaactttagattctgaccccagggtggctaattttaggaataattaagcacagtataattttggaaagaaatttcttggtaataattgtctcaatcctctgtgcacagtgaagatgaaagtgtgactacctcaaaagtcttttgcaaagtctatgtgagtctttcttaaagttggattctaaaactaaagggcctagaggaggatcgagcatacggtgtaaaggacaccaagctacaagatacatgtcacatctcttgcaaggctggtttgtattgcctgagaaacaatgatcaagggaagattgtctgggacaactttatagtttgggactttcaggtgttttgtggcaccacatctagcacagctcaccataccacttactacatccattccctcacttctggtcagaaaaaaaaaggtgtacttcttttccactgaagagagagacctctgtggttttatattcctggctaccttagagcttatttttgaccacaagttccttttgctctcttcagaaaaaaatatattttatggatgtttatagttttaggatgttaatgttgtgttagtgtaaatagaaaaacagtcaaatatttttaaagaatataaattatgttgttctgacccatccagcaggtccagttattcgagggtctccaggggaccttctcctaagaaccaaatggggggagagaaaagaaggacacccagtgcgaggaacccttctgaataacatcaaggtgtcactgtattagcaaggtttaaggcttaaatgcacaagcaaaaaggggaagtacttctcagcaggaggaatggggcagcagaaatttttcttttggcgactaaacgggggaagcaggaacttggtgatatcagggtacatcttgaggtcaggacatcctgcactgacttgaggctggaacaatctgtggttgttctctgagcggtgcgttggtggcctgcttttgacccccttttcttctcgggggaagaggcccaattcagagatcaggacaattgtgttgtcttaatagctcccaacattgttcagatatacaaggtgtgattacattgtttgactctatagacatcaaacatgcaagtgctgctggcataatcccagcaatcagaacactggggcaggtgtattattcttcatttggggtcagactattctaaatcaaagtgactttccatcctgtggtctccaatttcctcttttggcctttctgaagtctctacatgggttgaagttaattttctaaacttttatgcaggtgtgtctgtgtatttttaaatgtttattgctatattgctagagaactaagtgctagcaggatcttgatattgtcatttctatggcccatcaccaggcttacatttgtaaatacttgtctccacacctgctgagatatttgaatggcaggcagttttctatgcccattggtaatccacagaattctggagatgtctcacacccgattgcttgtaagaaaaaacgctaacatccaattcctgggacaagaattggagggtggaatttcttgatggaaaaagtgatgtagggaatagaaagcaggtggaagtgatttatgggagacaaagaagagaacagataaatgggaacaggggcagagaggtaaagagcaagttacacataaagtcataggcttgaatagtctgaaatttaaatgatcattggtagactgctccaatgaaaggcctctgctttaaattatatagaaacctccttctcataatttataacactggtgtatccaccagtactcacgctacactcatgtacatatgcaatgtgcatatatatataacacttttcacaagggtgctttgggtatttaagtcaaattagatattgattggttattcacaataaattcatgacatcattgacctagcatattttggaggaaggacaaattttagatcaatgtctttttggttggttctgtatatacatttcactttttgtagatagcaaagcccttcccataaccagtactgtggaacataaaagccaatgtgcttggaggcacatgcttgacctcttcacacatagtgagttgtgtaagtctgctcattagcaatgaagacttattgtcagtttgtaaaaagcaacacctttgttgtcaatgccatgcagtgtttgcttatttttatgaaaccactttgtagaacaactcagttgataaaacccagtggaaaagacaagatcaactggaactccatctctgtcagaattcagagacttcattagaatcaccttcatacacttataagctggttctttaaaaaaaaaaaatccaaatatcttactaagaatacagccagccgaagtccatggagtcttgtaccatggtgcttttctacgcattggcaggaccacaagtgtggcaatgcagtgtacaaaagttcttaccttctaatagatggtgatttttctcggaccttacaactatagttagtgcaacttgaagaaatttaagatttaaaaatgcagttctactgtgtattcaactttatggtttagcttttttttttttcaaagaacaatgtaaaaacaaacattattttccttgtatttcaatcaacttttataacctaatgtgatgccttggtgcaatgataatttattgatacaatggtaatttatgtactttttccaggcatgtccagaaactgcctgagtgtcatttgctgaaagcttgaaatgcagaggcttagcataaccttccaaaatgaatataccattatgtgtactgattgataaacggtaatgtctataatcacttggatccagttacctcatcctttttaaaactctgttaaagatttctgtatactataccattccttctccatgtaatggggttttcttgatgttcctgaaaatattgcaaaggtctttcttaagaccggcaatggtgatacaaaagccaacagacatacatacacagtacacagatagacacaaacacggagacagaaggcagacacacaggaagagagagatacacaaggcagtattcagcaagttacagatttaaattaactgaatagacacacaggttggaaggctcagataagagaaagtagcgaattcaactttggactcacagttagttaaattacctctgagggaaaggctgttgattctttccttaactcagatgcattattaatcaccagtgtgtttaatgtattcacatatgcagaatcaattaacttttgatgtaattttttttttttgcataagcacaatatgagaaaatataaaactcaccacaatgtgtaacaagtagccctgcattgtgaaaggtgtccatgggctcagaaccctgttctgtaaagaaagaccatcaggtctgggcttgtgcttctgagctctcacttccatgctggcctagaatccattttaactctcaccatcatcacaaagtttttgaacctcagaagtcacaagagaatcctggaactcattacttttatgaaaagagttgacctcatgccatattctctaaggggactttggtaattcttgagtcttcttttcccagcctatgaagatatgcatgggtgtacatagagtattatagagcacagtcagggaatcttctatgaacaaatggctaaatagtgcagtatgtattgtaggtctttttctatttccttccttccttccttccttccttccttccttccttccttccttccttcctaccttccttcctaccttctttccttcctctcttcctcccttccttctttcctttctttattctttctttcttttgccaaaaatctagacgcttattcaaagaaatttttctttattgcctcacccttcaagcagtaaataatattgtgcctaaacctaaaatcattttaattcatcattttctttgactaaggtatccagctcctctaccttttgtccaagtctaataatctgtctctcacacgttctctatgagatattattatttgccttattgcattttcttttcaggctcctttccttgtttatttctaagcacatattgaactcaattttcatatcctatgttgtcctcctttccttcaggcttttgctattattctcttgcccacgaatcattttgttcctgtcctctatcagttgacatatgtggcttacacactttgatctctttgatcatgactctgggttttcaattctttacctaggatatcatgtaaattgctctctttataagatacattcacagttgatagtttgagcaaaagacattgtatcttagttttactttgttttgggtattgagcatcagaattcagagggactgcttattgtgtgcatttttagactagactcataatgtgagaagttaggcaggatctattgtatctgaaggattcagaacccaggtgcagtgtcctactacattcagttctggtctagtctggcagtaaccttgtgggaagctgagcagagtagatcctgagaagttgtgtttccacaacagagttggaggagtggttcctgatggggagggtgggcctcctgaatgattagataagtttaagaaaaagacaaaataaaaacaaagaatcaatcaatcaaaaaaatcaatcaatgaattaaataagcaagcaaggaggcaaaaatccaaaccaacaaaaattgctctgaagaactgggaagctaattaattaaaaattcctgaaggaggtgggcttagaagaacatcaggaagctggtgagtattgggcgggtccagaaggagtggctctgaggaaccaagaggaagtgacaggaatttccgccattccagcattctcaatgtatctcggctgcctcgtggtcaggaagtcatggagggagactagtgcctagtgtgtggggaacctgaaaacttccttaagctgcagttgctgtgctggcctcctaggatattcagcagctggtcctgtcatctgccagatcagaggtgctgttgggctgggaaatgggtaggagcgggacaggtgtgtggagcaggggtgcattttctgctgccacccttacaattctgttgttgatatcttaccattatcaggaagtttgagttcccgtgaattgagtttatggtgatgttttaattaattttatggttgccagaatatttttctaaaacaaccctgtagatccttggccctctctggactttgtatactataccgggagggttgtctttgcaaaggccttaataaagctcctcgaattcaaattcgttcatgctttcttaactcccctgttcctccatttgccattttatttccctttctccagggaactgagtaggcatcccgagagagctttgtaggtatttgtcatatggggaccagtacagatttgatcgaattagaaaatattccttataaagcaccatcatatggctgtaaatattaacattaaccaagcaaagttatagtctccgttatctgaacacagaggtatatgcatactttgatgtaaatacatcattgagaaatgtgtctacatatgctttgttattaatgtcacaccttaggtttgaataaaacatgaagtcaggattgcagcaaggtacttgtgaggagaaatttccttaaggaaatgaggacaacataggatatgaaaattgaattcaataggtggttataaatacaaaagaaaagaaaagaaagaagaccctgaaaagaaaatgtagtcaggtgaataataatcattcatagagaatgtgtgtgagacagattatcagacttgtagatatatagtaggttctgttaaccctgagtgtcaccagagaaaaaccaattccaccatgtgggccagctttatcaaataatacatcgcgaccaagagatatactttggtcaaatgctacaggcattttatagtccactgtagtttcctatgaggctttattattttcctaagacatgcaacccgcagcacttcaagaagatacctggtgaggtgaatttttgacgtttcagtctgagggagaaagcattcagagatatctggctggttccaaactgcaccaggctatcaggtggggggaggggaattgaggatgtgttggaggatagaggggcaggtcaagagataaccagcagccaagaaagcacctatccaactctgacttaattgatatgttaacaggtaccccaggtagccattcttcctgaatttctttgaatttttccaaggttcagcccagcatgctgtgcggtgatgatttcaggagtaggtattttaataagtggaaaacttactatggatttttttcttttcttttttttttgttttttgttaattgtttttttcgagacagggtttctctgtgtagccctggctgtcctggaactcactttgtagactaggcaggcctcgaactcagaaatctgcctgcctctgcctcccaagtgctgggattaaaggtgtgccaccgccaggcttttactatggattaagacaaaattagacaacatcttttgaataatcttgatcacttacttactggattactatctggattctgggtcagaataattttcttccagtcttccctcctcctcttctgtgttgcttggaaaaagactctgtatgtgtgttaactgtgtggctgactctcacatctttagggtaaactggaatactcggagaaaaataggtattctcatgatatcttctctttccttcatatttatccttttctctggcattgacgtctttcatttttgttccatgaacagttccatgttcattctaaactatattttctcattttcaggtctccatatgcttagtcaaatctccataactgtaaatcaacactaagagcactggatagttaaggtcaaggagactctcacaaaggatccaggtatgttagaggtattgaacaaggggtggagtggggctcacctgtcagtacaaagaggacatgaatttgattttgccagattctatttccttaatgattctggaaaagaataatactagatgtgatgatatggatttaccatggaaggcaatgctgtcagctgtcacttgatgtcaatatttaattaattttaatcctgggaaattgctgctgcccattgaaatcaaagtttcttttatccagattgaaagcagcatcaggctatgggtgtaacaagggcaatttatacataaagcaaatatcatcagtagattccctcctagggcctgtgaccttccttaccggatttttaggcagattttcactgtaatctatggattttttttttcctgtggagcttgaaacagaaaacctgttacccacagatagtcttgccagtatcataaaaatttccatgccttgtctggcagattcagattgcagcaagtaggttgaaaacctgagtatatacattgataactctgcttccagccccaatttgcctatcagtttttgttactatggaagttaccaccagcgtgtctaagatgtctgttgacagtgtctgatatgaggtggttttctccagaaggtctacttgctttctgaatcacctattctgtccactctaaatgttttcctgtccttgacctgtgttcttattgatgttctgtgttgcattaatccccattagagtggaataattatttttgaccttctctgtcctgtttgttttagttttgagtctgcttgccttatttctgtggtatgcttcttctcttatattcttgagaacttttatactgagcagtgtgtactttttaccacagggctgtataagtaagtttcattctcctattgtcactgtaatttgggaggattcctgcctacatctattaacctaggcctagtcatgtaagcttctactctccatacagtattatctaggcctgttgtgttttcagcctctgaaacttgctgctgaaaaagcccctcctccccccaccttcttattccttctcaatgtttacctggctgattcaattcggtttttccagctcaaactcctctcctagctgagttcttctctcagacactgaattgttccacttggaattaaattaactgtagaagtcttttctcgtcttctggctccttctctttctcctgctcattctgtctttgcctgtgcctagcatgttctctcttcagtctgagtctgtaaaactctcagaacccaggtgcagtgtcctagtacatccagctctggtctagtctggcagcaacattgtggggaagctgtgcagagaaattccagagaagttgtgtgaaaggcagcctgcaacagaattggaggagtggttcctgctggggagggtgggcttcatgcatgattagataagtttaagaaaaagacaaaataaaaatgaagaatcaaccaaccaatcaatcaatgaattaagtaagcaagcaattaaaaatccaaaataataaaaattgctgtgaagaactgggaagctaattaaaaaggtcctgaagtaggtgggcttagaagaattgcaggaagctgctgaatattgggcgtgttcagaaggaggggctctgaggaaccaggcagaagtgacaggaagttccatcttttcagcattgtccttgtaccttggctgcctcatggtcaggaagtcctggaggaagactagtgcctagtatttgcagaacctgaaaacttccttgctggcctcctaggacattgagcagctggtcctgtcacctttcaggtcagaggagctgttgggctatgaaatagggaggagcagggcaggcttgtggagcagggtgcattttctgtcgctactcttcacaattgtgttgtggatatcttactattgtcaggaagtttgagatcctgtgaattgggttcatgatgatgttttaatcaattttctggttgccagaatatttttctaaagtatccttgtagatccttggctgcatctggagtttgtataccgggaggtttgtctttgcaaaagcctttataaagctcctgtaattcaaattcgttcatgctttcttaactcccctgttcctcaatttgccatttcatttccctttctccagggaactgagtaggcatcctgagagagctttgtagatatttgtcatatgggcattggtggagatttgattgaattagaaaatttacattataaagcaccatcatatggctgtaaacattaacattaacctaacaaagttatagtctccattagtttcacactgaggcatatgcactctttgatgtaaatacagcatccagagatgcatcttcatagtcttagttattaatgttacaccttaggtttcattgaagcatgaagacaggattgcagcaatgtacaattgaggagaagatatatagtaggttctgttaacccttagtgtcgtcagagaaaaaacaattctacaatgttggaaagctttttaaaatattacatcttgaccaagagatggactttggtcacttcctactgccagttttatatgccctgtcgttttctgtaaggctttattattttcctaagacatgcaacctgcagagctgcaagaagatagctggtttttgggctaataattgggttcttgggtggggttaatttttggcatttcagcgtgagggagaaagcatttagagttatctctttgggtccagactgaaccagttcagcaggtggggggaagggaattgaaaatgagaaggagaatagaggtcaggccaagagttaaccaggagccaagaaagcaccatcccaatccctgtcttcattgatatgttaatagttaccccagttagcctttcctcctgaattctaatcctcccaggttcagcccagcatgctgtgagaggatgactctaggccaagctatttttataaatagaaaacttactatggattaggacaaaattaaacagcaactttaaaataattataattgctcactttcttaagaaaaatgactccttgtttcatgaaaagcactttgcccatacacagtcatggtttgttgagtgctacactgtggacttcttgcaggtgtggtaattgttagaccctgcattcagggctttttcagagatctcttgttggagaagttcaacagtttggatcctgcatgtcataatagttttctcacattcttccttgttcctcagtgtttctgggaaaaggattctgtgtgttaactgtgtgactgactctagggtaaactgaaatcctcagggaaaaagagacattctcatgatatcttctctttccttcatgtttatcctttcgcctggtgttggcctccttcatttttgtcacatgaaaaggtccaggttcttttgaatgatattttcccattttcaggtctccattttctcagccaaatctgcataaatataaatcaattctaagagccctagatggtaaaggccaaggagactctattgaaggatccaggtgtgttagaggctttgaacaagggctggggtggggctcacctgccaggacatgaatttggaagagaaagacaaagaggacatgaatttggtcttgccagcttctgtttcattaatgattctgaaagatttcactaagaatattagatgtgatgatatggatttcccatggtaggcagtgctgtcagctgtcacttcatgtcaatatttaattaattttgatgctgggaaattgctgttgcccattgaaatcaaagtttcttttacccagactgaaaacagcatcagctaatgtgtttgaaaagggccatttacacaggaagcaaatgtcagtcttggattccctcccagggcctgtgaccttcctcattggattttagccagattctctgtttagtctacgtatgtttctcctgaggagccagtctcagcttgaacatgaaagccttttgttacccacagatagccttgccagtatgatactggaggccatgccttgccttgcagattgagattgtagcacacaggatacaaatctgggtatggccattgataactctgcctactgccccagtctgcatagcagtttctggacactgaatgctaccaccagagagtccatccacaatatttgttgacagagtggatggtctgatctgagttgttcttctccagaagatgcacttgctttctgaatcacatcttcggtccagtctacacgagtttaagtccttgagttgtgttcacactgatgcagtttgttgaatttggccttattttattgtggatgccaacaagagcttccttacaggaggctgatatagctgtctcctgagaggctctattagtgtctgacaaatacagaagtgggtgctcacagtcatccattggacagtgcagagggtccccaatgaaagagctagtgaaattacccaaagagctgaagtggattacagccccagagtaggaacaaaaatatgaactaaccagtatccctagagctcctggagactaaaccaccaaccaaagaaaacacatggtgggactcatggctctagctacatatgtaggtgatgatggcctagatggtcatcaatgggaggagaggcccttggtcctgtgaaagttctatgccagagtaaaggggaacacctgggccaggaagccagagagggtcagttggttagcagggggagaggcaataggataggggatttttggagaggaaactaggaaagtggttaacatttgaaatgtaaatgaagaaaatatcaaataaaaaaatgaaaaaaaaagggtggaataatgacttttctgccttttctggactgtttggtttagtttcaagtctctttccatttgttttctgaggtgtgtttctctctccttacattctagaaagcttttatagtgagtggtattagattttccacaggactgtaaaattaacctttattctcctattataattattgtctgggaggctgactgcctctgtctaattaccatggcctagtcctgtaagcctctagcctctaagtaatcttatttagtcctagagtgttttcagcctctgaaatttcctgctgagtaagctccccctttcttctttgttcatttcaaatcctttttttttttttttaattttatttttttggtttttctgacagggtttctctgggtagagtccttgctgctctggaactcactctgcagaccaggttggcctggaactcagaaaagtgctgggattaaaggcatgcaccaccactgcccagcctcatttgaactcttaactggatggttcaactcagctgttcaggctcaaactactcttccagctgactcattcagcctggttctcagacactgaattgctctgcttggccttaaattaactgtagcaatctttttttaaatcttctggcttcttctctttctcctgctcattctgtctttgcccgtgtctagcatgttctctcttcaatctgactctgtaaaactctcccagtaaaactgtgtccttctccctctctgtggctctactctctcaactgtactgtactgctgcccatgcactctactgtattcctttaccattctcttcttcctgtactgtctttctcttcctcaagtagcttccccttcctctctcacctcaggagtgttgggcatatcctgttctctaagatctttctctgatatttcacattttctgccattcaattagacaacactttcaaacatgtgcacctccttctacttagtaaatgtactttcattgtttgggattaaagcaaatcctaaaggcttgcttgtattccaaccacagtgaggaaagctgtgtgccttgtgctgaaccacaccctaagtcagaacaggcttgaatatccctacacaatagtttagtttggcagaatttcttccctaactgaaaactaagattcacaaacaatagtcttcattatgtagatagctgtgctatctattctgacttctaccaagagtttcattttgaacttctttgctgattggtcaatgaaaatctgttctttgcgagactgtattccttagcatttgcaatctagaaggtttgcagacattatgagtggcaaaaatatggttcttattgtctccattccttgtatgggagagagctttactatgtagtacatgaggaatatttcctagttttcttatattcattcattcttcacaaaaaaaaaatgtgttatttccgaagttctaatgaaaatgttatgtcttattcttttgtgcatattttcattagtttattttctatgtaggtttttgagtaaaaaggtgtctaatattatatagatacttaaaaactatgttcaagtatatgttttacactgtcaatgcttatagccacttttctgaatttaacatttcagttgccagttattttctctcagggcttgaaaaatatgattccatgctctcctgattttaagctatggataaatatttagtactactgtatgctaatataatatcacctcttttgatggtaagggctaggacaagacagctggaaagagataaacattgttacagcacttagatgtgacaataggcagatacaggtgggagtgcaggaatccaatatctaagagactttcctcgggaatgctaggctacaatgctatggccttctagtactcaagagtgccaatgtttgcacactgcatgttgctatttgagtttatctactttaaaacagatgtgatgaaacaagtgatagtaaactttgactggaaggctcaagcatgtgtaattatgtctattcagaatcaggtatgtatttgaggaaatgtcagttgcaagatttaaagtcgaagccctagtgttcatattgacttcatggtgaaagtatgtaaacccatgggttattcttcccattctagaatgagctcttgttcagtctccatgaaatggaagatgtgcttttcctgttatacaattagacaaaacaattccaggacacacatttattttatgtatttcttttttttttaattttatgtatttcctccttttgaacttaaagtacagcatctgtcactgaagcaggaatttatgttctgttgctggtagaaatgacaacgatactcagcctgtatgtcacaggtaagaatcatgaagtgacatactttgaaaaatgtcctcattactccctgaaaattcatgtattcctatgcccattttttaattacacacttgatgctgtctgtctacaaatgcccagggcatcaagttttgagtattataaatctatgacagcaatgtatttttccctgcatctccaatttctgttttacagaaattcctgttgtcagtaaattttccatcacactgattacggattatactcatttcatgcatattacaattattagaatattcacagagaaacattctggtagaggatttgcattatctggtttctttggtatttcagatattacagagctcctagagtttactctaatctgtgctaactaaatctcctagtgcttgcgttttcaggtgaatggccttcccacatgaagtgtcccagagtgcttacatagttaccatctcttctatccctgccccatcccttgttattcatgttttcatcctatccttgtgtttcatgtatgttctgaggaaggttttggatgggtatccatgctgtcatatattcataattccatgttccatggtaaatgacagcatgggtttccataactccacttcctccttcttttacagtgttgccttttccccactgctggctttttattcagctctctctgaattggcagtttccctctacaattcatgtttgtctgacttaggctgaaagcaccaacaatttaaatacatttccatatttctacatatagcagtatgtcagttataaattcactctttcggcctgagcttccagtgccgtgtctgtatttcttttgtaggctgaccttaattcaaaccagtaaattatatctttggataagatgtttacatccagcatatgtatgataattctcttacccacttgtaggaattctctggaatttcattaagtttgtttctgccttctttgaattcctgtgcttgttccctctttatgacatttgtccacattgaatggtgttcagattatattttgacttttgcctcttgagtttgtttcataattcattttgtcatgagaattggtattggattagtgatttaggttagggaaattttattaacattgtcaaattgctttagctacagtctctcaattttcttttgctgtgtgtcatttaggtcaggtgacagggatttccatatcaggtgttgtgaataaactttgagaatctagggtggtggaaggaactaggttacagttacagtctaaatatattacttactttcgtgactgtacattgtcaagattcctcatatcattttgtttttaatgtttatatatatacatgtgtgtgtatatatataatatatagtatattatatatattatatatatatatatataaatgtggtttagcattgtctgtaatggtgttatatttatttcatctttgaatcattcagaccttgatgtgaaatttcaagaagaattcaaactttgttcttcactggaccctgggagaaggaccacaacaagaatgagtgtgtgtctggtaaatacaccacaggtcagtgtcctttccacatttctttttaaaaaaaaatctctttttattcaagtcatccaaaagttttaatctctttgtgttgaatgttatctaaagggatatttttctatgctctatattttctcttataataatgagaatttaatgtttttccctttcatgcatataatggctttatattttaacttgatttttatattctgaggatatataattcccttggattagagatctgcatgtctcaaataggatctattacaatgatgctcagagaacagattgatggatattttctatgttgaataagttctgtccttttgtattagtgtgaggtgaggtctcttgtgccacataaattgcatttcagggatggtcaggtttctaaacacaagcttgtgaatgagggtatagaaataagtataaattcacatcactaaagaagatatgaaagagtagaatttgtagaagggaaaattataagagatccactgtcttgaatcctaatagtaaatgtattattagctccctagggtcacagataatggaaggaaaatgtctttcttttaccattagtgtgattgtgagctgatacagatttcaatattctgacacttttttcacacctcatgtcacacagtaattaatgttcacacctgaaatctatttatctcaagagacactgtccctgtggaaaattcacaatatatagatatttatccctccttttggtttcagaaataattttaagtcctgtttttttcacctttgtatttcatcacatgaactatattagtaagatttttctagagaggatagctatggtgctgtgcataaaccaccaattttcaaaactaaatgaatttcctttattattttttgtctttttctttagaagggaaaggcttgaatcagtctatgctaatccccttcagccaagctgtgcattacatagggaaaactgaagggttgtggcaatgtttctatttttcattacgatactattttctttaagtccataagtgtttatctgaaggtttttacgtacactgaatgatacattatgcccctaaaaccataagaacagcaccaaaccgtggggactgaattcagacataatagtgagctgctatatatttagagagaattagattagtttttaaagtagaaacagcacgtacctttcccctttagtcatttgttcatggcacaggtttacatttttgaggcatatttgcaataaagacaatatattgtctgtatattataatttttgataaacagaagaagaatgatagatcatacttctctatgaaaagtgtaattatgatatacatatggtcaaattctgaagaaaaaagttataattagaagactgaaattttcagttaggttaataaatgaggaataatttattaaattttaatgaatatttagtataattctccctcaattttaaaacacagtttgatcaaaaattattatacttcattggaatgcattgccacatatgatatttgcgtatacatacatatctaatcattttatagtgaaagaccatatggtattaatgaaattgttattaagcatatttatttatgtctccacaggagctaattaagagtcaaaggtgtggctctgcagttaaggtctcttcttgcagtattcagattcagttttctgtacctgcctggggacttcttttccttccagaactctttttttgagaatatgttttaccattgcctgcatttctcatgtgaacagagctacgtgccagcaaaaataacatttcatatgaaattaaagtcaataaacattattttaaaattataaatgatctggaaatattacataggacacaaaaaaccatccaggaaagagaatgagaggaaatgtgaagcctgaatgagtttcagtactgctgacccctcatatcaacattttaacagttaggaatgatccctatgtatgataaaaatattttgtatctgtggaacacagagatggagactcttatgtgttcattgtaatgtgggaaaagatttatcctatcaatgctgtatttgggtattaacttttatgaggaggcaccgtaattgtgaaggaatttataatacatgaaaacgctgttatccagcatcccatcaaacaagaaatctgctcctgaaggaaaatgaattatatcagattccaccattttttaaaatactttatttatttatcatacgtaagtgcactgtagatgtcttcagacactccagaagagggcatcagatttcgtatgaatggttgtgagccgccatgtggttaaataattttaaagctctctaaaactgtttatttctattttatggttttgaatacattgttgtaaaataatttccaaaagcatttgattttctgtgtcatatggaacgttcagtggatgccctgatgttgcaggtttattgtgtttaaagaaaaatacttagtcgttttgtcaatccattatttctgcattttgttttctacctgtttcttctagaacgtgcagcattgaacttaggcctcagattgtcaaatggacatgttgtaatacaaatgtgagacacagctgcacataagactaagctagtgtccatatttgaacaaagtggacattgtaaaatttgaaagcatatttttttatcataacttgactatctctaatgggacactgggattctgtttgatatcaacccatatttcataaaggtacattacggcatttagacatcaaaagtacatgttatattctataaatgtttactgcatttgaaattatatcatgcattctcagtgaaaaagaaatataaggaagtctattagtagtttagaaagtttctttgaataaagttaaagttcatttttcttcaatatacgttgcttaaatttgcctgaatgtatgcatatgtgctatgtattcctcctgtcagtagtgttcagaagagatcattggattttaaagaactgggtttaacaatctactgtttagtgccatgtgggtgctgggaatcaaatttcataataaatgacattaaaaacagtatacagggctggagagatggctcagcggttaagagcaccgacttctcttccgaaggtcctgagttcaaattctagcaaccacatagtgggtcacaactctctggaatgaaatctaatgccctcttctggcatgtccaaagacatgtgtacttagatataattataaataaatctttaaaaaaaagacagtatacaatccaaactgcacaccaaaatttttgaaaagaatgatgatagcaaatctttcatttgctgtgaacatctatgtaaatcacagaaaattcttgaagatgagagcctttctcttctcttttcttttctttacttttctttgtatttatttagagagccattctaaatgcgagcattataataagtcattctgtagattgtcagtggaagagcagccattcgtatcttcagacacatctcaataacactttcagaaaacatttatccttcaatattttccttcttcatctgcatcaaaaaaggatatctttttgttgttgttgttttgggtttttttgttttgttttgttttttctgagacagggtttctctgtgcagtcctggctatcctatcctggaactcagtctgtagaccaggctggccttgcactcagaaatctgcctgcctctgcctcccaagtgctgagattaaaggcgtttgccaccacacacagcaaaaaaaggatatcttaggtacttctttttttaagtagaaaaacatttttgtccagtatcaagtaggtagttttccattacagggtctgttaactttcaaggacgtggccttggtcttctcactggaggaatgggaatgtctcagttttgctcagaggacactgtacatggaagtgatgttggagaattacaacaatctgttgtttgtgggtaagaatgaacttcttgttgaattcatgtttctttctttgagtgttcctactatgtgcttatgtaaatgctctgagatatccagagactcctgaatgagggaaattctagttaaaatcataactttttcattgtgtttcctttacatttctctgctttctttggaaaagtaaccactgctatattctctgaggtcactccttatctcttatctagcttcagtgaagttaaaaaagttcaagaaaaaatttaaatatccagaacaagaaattatatttctatacatataatagttgcatttataaaaatcttactattgcattaaaatgtacccttatttatgaatgtaaaaatatacaaggtttcaagtggatatagagctgttggtttgggcaattttgttttctttatttaactttttgacatttgatctctgtgtttagatctgggacaacataatctttaccctagcattttggatgttgaaacaaatctatttagtgatttctctgacactatgggctatatcataaatttatacctgagcaaaattatatcagattcagtgtcactctgaatcaaattgtaatcataaaattagagatatattgtttagagttctactttcgggaaattcactacagatggatcatttatttgtccagcttatgcaaagtataattttcttttttattggtcattttatttatttacatgtcaaatgttatgccccttctccattccctgtctgtaagctctatatcccacccctccccctgttttttttgatgatgctcccaccaccaatccatctactcccacctcatgcccctaggattctcctatgcggggatactgaaccttcacagtaccaagggactcccctcctgttgatgccacataaggcaatcctctggtatatataaagctagagccatttgtacttccatgtgtactctttattttgtgatttgacccttgagagctttgtgggtcttgatattgttgttcctcctacacagttgcaaagcccttcagcttcttcaggccttcccttaactccttcattgtggtccccttgctcagttcaatggttggctgcaaggatctgcatctctttgggccagtctctggatagccttcccttcagcctgtttttcattcttttttgttttcttttttttattaggtaatttcttcatttacatttgcaatgttatcccgaaagtcccccatatcctccccacctcactcccctacccacccactcccacttcttggtcctggtgttcccctgtactgaggcatataaagtttgcatgaccaaggggcctctcttcccaatgatggccaactaggccatcttctgctacagatatagctagagacacgagacacgagtggtactggctagttcatattgttgttccacctatagggttgcagatccctttagctccttgggtactttctctagctcctccattgggtgccctgtgatccatccaatagctgactgtgagcatccacttctgtgtttgctaggcctcaacatagtctcacaagagacagctatatcagggtcctttcagcaaaatcttgctagtatatgcaatggtgtcagtgtttggagactgattatgggatggatccccagatatgacagtctcagctccaaactttgtctctgtaactccttccatgggagttttttttcccaattctaagaaggggcaaagtgtccatactttggtcttcattcttcttgagtgtcatgtgtttcacaaattgtatgatatatcttgggtattctaagtttctgggctaatatccacttatcagtgagtacatatcatgtcacttcttttggagcaattctgggttattatatttgaggtggtatgatgtctaatttgaaaataacatttagcagggtattatcatttccagtcatttgatatagatcatatttgaggttcttctgaggatacatgtaatgattcacagagagagagagagagagagagagagagagagagagagagagagagagagagagagacctttcttgagagtacgaatccataagctcactgattattgagtcccttactccttatataagtaattcatgtcacctctaattgccccccctttttttttcagaaaatcattgcatacatggaaagaatgggaaggtattggatcaagacagccagtacattgtccatgaacacatgaatattcaagagaagtcttctaaatgggacaagcttagcaatgtcattcttgaatccctccagtgtacaccttacaaaactaatcacagctctgatgctcttcaattctcgaaccaaaaaagacttaagcccaggaacactaaagaagtttgcaaatacaatgactctgtaaacagtttaagtttgttttctaccattagtctcaatcaaggaattaacatgcagaagaaaaaacacaaccgaaatgcagaattagacaagatttttgtttctaaacataaagtcatggtgaaaaaagacaatattgcggggaacccttacaaatgtagtgaatttcacaaatatcttacccagagagaaaacctacaaagtcagcagagaatttatcatggaaagaaaccttacaaaagtagtaaaagtgacaaatgctttacccatcagatccatcttagtattcatcagggaattcatacagaagagaaaatttgcaaatgtagtgaatgtgacaaatgttttaaaaacaaattcaatcttactatgcatcagagaattcatacaggagagaaaccttacaaatgcagtgaatgtggcaaatgctttactgataaaaccagtctgagaattcatcagagaattcatacaggagagaaaccttacaaatgcagtgaatgtgacaaatgctttaccaaacaatccaatcttagtattcatcagagaattcatacaggagagaaaccttacaaatgcagtgaatgtgacaaatgctttacccacaaatcccatcttagtattcatcagagatttcatacaggagagaaaccttacaaatgcagtgaatgtgacaaatgctttacccaacaatcccatcttagtattcaccagagaattcatacaggagagaaaccttacaaatgcagtgaatgtggcaaatgctttactgaaaaaagcagtctgagaattcatcagagaattcatacaggagagaaaccttacaaatgcaatgaatgtggcaaatgctttactgaaaaaagcagtctgagaattcatcagagaattcatacaggagagaaaccttacaaatgcagtgaatgtggcaaatgctttactgtaaaaagcagtctgagaattcatcagaaaattcatacaggagagaaaccttacaaatgcagtgaatgtgacaaatgctttaccaaaccatcccatcttagtattcatcagagaattcatacaggagagaaaccttacaaatgcagtgaatgtgaaaaatgctttactgtaaaaagcagtctgagaattcatcagaaaattcatacaggagagaaaccttacaaatgcagtgaatgtgacaaatgctttaccaaaccatcccatcttagtattcatcagagaattcatacaggagagaaaccttacaaatgcagtgaatgtgaaaaatgctttaatgaaaaaaacattctgaaaattcatcagagaattcatacaggagagagaccttacaaatgtcgtgaatgtgacaaatgcttttcccgaaaattccatcttggtattcatcagagaattcatacaggaaagaaaccttacaaatgtagtgaatgtgacaaatgctttactacaaaaggcaatctgataattcatcagagaattcatacaagagagaaacctcacaaatgtagtgaatgtgacaaatgctttacccagaaatcccatcttagtattcatcagaaaattcatacaggagagaaaccttacaaatagattgtatgtgacaaatacaatactcacaatgtcagtcttagaaatcatcagttatttcatacagtagagaatctttataaatgaagtgaacgagacaatcctttaccaagatatatcatctcaaaattcattagagaatacttagagaagacaaacttttcaaatatattgtaggtatgaatcctttccttttggcctatttcctagactgtaacagtgaatacttacaggctagaaacttaactcatgcattgtatgaagaaatatctttgacttcatttcaggtcagagagaacatctaagaactttttagggtaaagaattttgttggggaaaatgttgtattcttgacaacacttgaggctccacactagagaattagtatgattatgaaaatcttgtgaaaatattcatgcaatgttcaaatcttagataatgtcaactatttatgttgggagaaactctgaaaatgtgaaaatgtagaaagcttttcatgacacctttttacttgttcaccctcaaacgttataagatgaagataagttaggaagtcagaagatagtattgtataacactttcattgagacagaaataatccatttcaaaaggaaactatttaaggtctttaatacaaccctcaaaataggtaataaaactggtagcattttgtatatttttattgtcctgtaactaactccaataaaactgaaagattcaacaaatttgctttggttgtttccaatttgcagttgggatactcagatgaatatatgttgcaccttcccaggaaatgcctcaaataaaacatagactgaagtcatgaacatttttgcaaacctgtatcataaagttaatagtggtgatttttaactggtggataacaatacctttgggatgtaacgaccctgtcacagtggttgcttaacagcataggaaaacacatatttccaagtgtcttaaaactaagaaatcattcattgaagtgtagggtagtctgcccaccctaaaataatttgaattcaatgtcagtatttagcattaaaaagttagaaatactgttttacatatggtgctttgtgttaactaaaatacgtaagattcagttcaatgttccaggcaagtattactaggctaagataaaaagaaacagaaaatacgtagaagctttcagagcctcagcaacaagtctgctctctcttgagttcaaggaagtatgaaagaaaaatctacaaaaataaatgaaaacctggatacatagatttcaaggatagctatccagactttgctgtgtctgcatggttctgaagtcattaattcccatttattgaacaaaagtcctataagtctcagaaaaatgctgaccattgggctggtgagatggctcagtggttaagagcaccgactgctcttctgaaagtcctaagttcaaatctcagcaaccacatggtggctcacaaccgcctgtaatgagatctgatgccctcttctggtgtgtcagaagacaactacagtatacttatgtatagtaaataaatctttgaaaaaaatctttttaaaaaaatgctgaccgttgacacatattacaagacattgtggtgtctggtcctgttgtgccttaatactccactctaccgtaaggaatgaaatagatttccattcttttcttaaatcatctgcagaatgctaatattttgcacatctcagaatatacattctgaacaaaaactcaacaactcactactaaggtattatcttcatcttaaattcatgtatgagttcattcatacaaatatcatgaatctgtaaatcttagatgaggtgcatactcatgtactgtttagaaatccaaccatcctggaaatacattgggaagtactgaaagaagtacttttactccgagttcaatatgatattagaatatttatcctaaattcaagaagtttcagtaaattaggatctaagaaaaaaatcaaatggtagaaggaacaaatccatatcactccatatatttttccttgactttaaaaatttaaaaccccagaatcctggaccacagtcatttttgacctcctcgtgttttaagagagggtctcatgtagctcaggctggttttcctcaaactgactatgttacagaggatgagcctgacggtttcatccttctgcttccacctcacaaatgctgaggggactaaaagcgtgtgcctcctcaacgtgtgacatgggtctgagctctgaatgcaaggtttgtggtaccaggctagcacattctcagcctgagtcactactctccttttggaggtttattcttaatttattcaaaacattttatttttatgtataagggtgcacttacatgtgtgtttgtcccctaccacatgcatgcctggtgcccacagaggttagaagaggacattgtacttcctggaactagagtttcagttctgatccaccatgtttttaattactgagctgcctccccaagcctctaaatcacttcttaaaatgcaggaatgtatataaactcactggcagcatatccttggcaacctcactaaaactgtgatgtagctctaaatgtcacacagaaggagcaatgaaaagtatgtaccaaaaaaaaaaaaagactggagcgggacacttagagctagcttcaaagcacaaggccctctcctggcctctgcaggtacctgtacttgtgtgtgtgtgtgtgtgtgtgtgtgtgtgtgtgtgtgtgtgtgtgtgtgtgtgtgtgtatttgtggcatgtacacatttgtatgcatatacatatgtgtgtggtatgtttgtgtgcatttacatgtgtatgtgcagtgtgtacagtgtatgtttgcatgtgtattagcagtgtggtgtgcatgtgtgcatgtatgtttctgtgtgtaggtatattatgtgcagcatgtgtgtgtgtatgcgtacatgcgtgtatgtgtccctgtgtatataacaaaggtaaccaaaaaatcttttttaaaaattagttaggctggagatatggctcagtgggtgggagcactgacagttctgcaagaggttctgagttcaagtctcagcaaccaaatggtggctcacaaccatttgtattgggatctgatatcctcttatgttttatctgaagagagtgacagtgcacacagatacataaaataaataaatctttaaaaagctgagtcaaaataaatactatctcaaaaataaaaagttgttttggctctattggtaaagaacctgacaaagcctgactgcctgaggtttggatcctcagaacctacataaaaggctggacccaggctggagggttggcccactggctaagagcacctgtttctcctgcagagaacctgggtcaactctctgcactcccatgactgttcacaacgggggatatgatggccttttctgacctcctaacaaacctgcacacgtacaggtaaaacacattcataaacttttaaaaacaaaacaaaaaggaaaaagaaaaaaaaaagaaaaattggaaacctggacacagccacatgcatgtgtgtgtgtgtgtgtgtgatctgagtgtttactctcactctgggactgagaaagcacagccctccagcagtcagggcagatctgattggcaaacaccactaaatgtcagcaatgtaagaaaatcaccacatgatcaaaatctatgacactctcctaaagggattttctctgcaaagacatagggtgcaagtttataaaataactcatgtcaaacatttaataactttattaagaaggctgaggcaagaggatgacaagtttgatgccagctaccattaacatagcaaaaactttctcttaaaaaacaagggtctgaggatatgactcagtggttagagaactggctgatttaccagagtacctgggtttggttcctagcacccacaaggtcatgcacatttccacggaatctggtgccctcttctggtctctgtgagtacggcatgcacatggtgcacaggcacatgcaggcaaaacacccatacacacaaaaaggaaaatagaaagtaaattcgttaaattgggcatggtgatacatgtctgtaaaaataaatacagattgacaatgtgttcagcatgcaatgtatacttcttaaataacacaacaccatacatgattttaaaccacagaatgagagactggagagacagctcaatgtttaagaacacttgctgctttgcaaaggaccttggttcgacttccagtatccacacagctccggctccaagagatgtgatgctcttctgacctctgtggacaccagacattcacatggtgcacatatgcaaaataaaactataaaaaactatttagctaagtaaaatttaaagattggggaaaaaagtaaatctaggcaaaaagttattaccccacaaagactgctcaatgtttcttaatcctcttcaggggaatggaaggaactaagagttgccggagtgatgtgaaacaggcatttgaataaacggacataagtgaacatgcagagccttggttcccaagcccaccacaccactctgtcctgagcagtgttcacttagtccatgtgtgctcagtctgtgctgcgtgtgtctagacagtatctgcctatccacacaaggcacagcacataatgatgcaattaggttaagcatttctcactttgaccagaaacatggctgtactggttagttttgtgtcaacttgacacagctggagttatcacagagaaaggaccttcagttgaagaaatgcctccatgagatccaactgtaaggcattttctcaattagtgatcaagggggaaaggccccttgtgggtgggaccatctctggactggcagtcttggttctataagagagcaggctgagcaagccagaagaagcaagctagtaaggaacatccctccatggcctctgcatcagcccctgcttcctgacctgcttgagttcaagacctgacttcctttggtgatgaacagcagcatggaagtgtaagccgaataaaccctttcctccccaacttgcttcttggtcatgatgtttgtgcaggaatagagaccctgactaagacaaattggtaccagcagagtggggtattcctgtgacaacctgaccatgttttggggaggactgtggaaggactttggaactttgggcttgaagatccatccgttgttaagagctctgttggatgttgtgtaggagcttggaagataatgttgagaacactgcagaagatggaggtctggtttgtgaaatttcagagggaaaaattaaagactcttttcagggccattgctgttttgattgtgaagattctgtagttctggttagctggggctgaagaatcagctgtgattaacaagataccagaactactgaggcaaaaactttgcattactgggactattgatgctggttgcctggagctaagaaattagcagtgattaaaaagagaccagcatcattgaggtgacatcttctgggaagtgttttctgaaagcacaaagaggctgtgttccagagattgccaaggttgtactcctgctgcagtgggacttggtaatatgtaagggtcacccaggtggtactggttttgaaggcatgaaggggtcacacaaagcagctgaggctcggcactgtgagaggccatggaaggccattggtgaaggtgtagcctcagttgcaattgaaggcccaggactgaaggggtcacgcagtgttttggagatgccagtaccatgagatgaccaccaagagcagcagcagcagtggagtacaggcatctggagcctagaggacgacgcctgtgctacaaagggcatggctggagaagtgacccaagcccttggaggagcccagaagatcgtgagttggatcccagacattggacggttggagatcgatttttttgcttttgattgtgactgtgaaagatcctggcagaatgtaaaaggtcatagaagccctgaaattggtaaaatagattttattgttagtagaactggcttcattgatttagaaaaatagaggtgcacaatgctttggtcactcctcgaacctgtgtgtctgccaatgttctgaccaggtgtgtgcccattgctgtaccttcattagattctttccttgtttccctcccatactcatttcttgaggaatcaatcattttagaatagatattgtttaaatctggaaatcccctaatctcccccttctcctttccccccgagggcctataaaaactggaaactcttttccctcgaggacgactcctctacccctgcatgggatatgagtcgtccccagagctctggctttccccgaataaagcctcatgtggtttgcaacaagctcggtctgtcgtgagttcttgggtgtccgctattgtcctgaggcctgagcgaggggctcctcatggagtctttcatttgggggctcgtccgggattggcgtgaccacccacgtctccgaagacccacttggaggtgagattttttttgtccaaaaatatttctgtaagccggctaggttctgtgctgaaatttgcagccgcgaagtttcgtgagaaacagagacctttgcctcgggatgaggcactgagtgtgaacagcagacgtgctggaatcaccggctgctgctcggtctgggaacaccctgagcgaggggaaggactctaggagtccgtctgggcggggagtgtactccctcgaccatctgtatttctgaagccctgagcaaggggaaggactctaggagtccgtctggggcggggagtgtactcccttgaccatctgtatttctgaagccctgagcgaggggaaggactctaggagtccgtctggggcggggagtgtactccctcgaccatctgtcagtgtgtgtttgctttttgtgtctgttttcaggtacttgtcagtgtatgtatgtgtgttttttgtgtttgttttgtgttttacgtagtgtcaacaatgggacagactataacgacccccctaagtttgactttagaccactggactgaagttagatcaagggcccataatctttcagtagaaattaagaaaggaccttggcagactttttgcatctccaagtggccagcttttgatgtaggatggccaccggaggggacttttgatttgactcttatttttgaagttaaagccattgtctttcagaatggacctgggtcccacccagctcaacagccttacattactgtttggcaggacctcgtccagaatcctctgccttggataaaaccatggattccccagcataggtcaggttcccgagccctgactctacgagaagcaaaaatgaaaccacaggctccacccgaaacggagcctccttttcaacccacagctccccccaagatctatcctgaaattgaagggcctcccgagtggccagagtccccttcccctcctccctatcctctgcctccgcaggtccctgcgccaggctctgggattgctgccagtgcagtcggagggccagcagctgggacccggagccgacgagcccagagtcccccagcaaatagagttcctgacactacttctgcttttcctttacgggctgtgggtgacccgcccacagacctgcagtctctgcagaccctccaatattggcctttttcatcggctgatctgtataattggaaagctaaccatgcctccttttctgagaatccgaccagccttgtggggctggtagagtctcttatgttttctcatcaacccacttgggatgattgtcagcagctcctccaggttctgtttactactgaagaaaaagagcgcattctcctggaggctcagaaaaatgttcctggagtgaatagagccccaaccaacctacctaatgagattaatgctgggttccctctggatcgaccagattggaactacaacacggctcaaggtagggagaggctggcagtttaccgccgggctctggtcgcaggtctaaagggagcggcgagacgccccaccaatttggctaaggtaagggaagtgatgcagggccctaccgagcccccatctgtttttctggaaagattgatggaagcttatagacgctatactccttttgacccgacctctgagagccaacaagctacagttgcaatggcttttataggacaatcagcattagatattaagagaaagttacagagactagaagaattacatgccatggctttacaggatttagttaaggaggcagagaaggtgtatcataagagagaaacagaggaagagaagagagagagggaaaagcgagaagaagaagagagagagaaacagaaggaaagaagacaggagaggaatctaagcaggattttggccacagtagtaggggaacgtgaaggaaggaataggccagagaatagacagatagggtacctgggcaacaaggaatccagatctgaaggaagaagatctgtccagaagattttagagaaggaccaatgtgcctattgcaaagaaagaggacattgggcacaggaatgcccaaagaagggaagggcccctaaggccctgactctgaaagatgatgaataggggagacggggctcggtccccctccccgagcctagggtaaccctgatggtggaggggacccccacggactttttaattgacacaggggcagagcattctgtgctgaaacatccactgggaaaaataaaaaataaaagaaccatagtgattggagccactggtcagaaacaatacccctggaccactgcacgcactgtagatctgggaaaaggccaagtgagtcattccttcttggtcattcctgagtgtcccacaccgcttctaggaagagatcttctgactaaattaaaggcccagatcagatttacccaagaggggccgagagtaacttgggaatctcccacctccgtagtcttagccctgcagcttgaggaagaataccgattgcatgaaggcataaagcaaacagaggtgctagacctaaaagactggttgactgctttccctagagcatgggcagagactggaggcatgggaatggctgtcagagttccccctgtggttgtgggactgaagacagatgcaacccctataggagtgcgccaatatccaatgagccgtgaagcaagagatggaatcaggccacatattcagagactattacaattaggtattttggtaccgtgccagtcaccctggaatactcctttactgccggtaaagaaacctggcacgagtgactaccgaccagtccaagacctgagagaggtcaataagagggtccaagatattcacccaactgttcctaatccctataacctcctcagctcactccctccagagcgaaaatggtacacagtacttgatttaaaagatgctttcttttgcctgaagttacatccctccagccagcccatattcgcctttgagtggagagatcctgacactggacaaatgggacaattgacctggacacggttaccccaggagttcaaaaactcccccaccctttttgatgaggctctacatcgagatttagcctccttcctagctgaaaactcccaggtaaccctgctccaatatgttgatgacttgctccttgctgcaaccacagagagagaatgttggcaggggaccaagagattgctagtagaactgggtgagttgggttaccgggcctctgctaaaaaagcccagctatgtcagatggaggtagtctatttgggatatatcctctgggatggaaaaacggtggctgacagaggctagaaaaaggactgtgactcaaataccaacactggctactccaagacaggtgagagaattcttgggcaccgctgggttctgcagactttggatacctgggtttgcaacactggctgcccccctctaccccctgaccaaggaaagtggagaatttagatggacatcagaacatcagaaagcctttgaaaatattaagaaggccctgctgactgcgccagctttggcactgccagatctaaccaagcccttcatcctctatgttgatgagagggcgggggtggccagaggagttcttactcaggctctagggccgtggaagaggccggtggcatatttgtctaaaaagctggacccagtgggcagcggatggcccacatgtttaaaggccgttgctgcagtagccctactcgttaaggatgctgacaaattaactctgggacagcaaataactgtggtagccccccactctcttgaaagcattatccgtcagcccccagaccgatggatgacaaatgcccggatgactcactatcagagtctgctgctgactgaacgggtcgtgtttgctccccccgctattctcaaccctgccaccttcctccctgaaacggatgattcctcacccgttcactgctgtgcagacatccttgcggaggaaattgggatccgaagtgatctacgtgaccagccgtggccaggtgttccaaactggtacacagatggaagcagtttcctagtagaaggtaagaggatggcaggggcagcggtggtagatggtaagcgagtcgtgtgggctggcagcctgccagaaggtacgtcagctcaaaaagctgaattaattgccctgacccaggcccttcggatggctgaggggcagtccatcaacatttacaccgatagcaggtatgcttttgctacagcccacgtccacggtgccatctatagacaaagagggttgctgacgtcagcaggcaaggacataaaaaacaaagaggagattttgagcctccttgaggctattcatctgcctgccaaagtggccattatacattgtcctggacatcaaaaaggacacgatgctgtgacaaggggaaataatatggctgatgttaaagctaaacaggctgcactcggccctaagattctgcccttcaggactcaacagatagaacctttccagaaagttgctctgccagaactggaactgtgtagccagagttttgagtatacacctgaagatataaaactaacggacaatttagggtttactgcaaaaaattcacagggccaacgagcagccagtaatggtaaaataatattaccacaaaaagaagggaagagatttattgaaaatatacatcggatgtcccacctgggagtcaaacacctgcaaacactggtaaaagcatctgctttttatgttttaagactctctgatgttgcagaagcagtagttaagagctgtgtaccgtgtgccatgacaaatgcaggacattcgagatatcccccaggcagaagactacgaggtgatcgccctggagcctattgggaagtagattttactgaagtaaagccagctaagtatggtaataaatatcttttagtttttatagatactttttcaggatgggtggaggcctacccaacaaaaaaggaaacagccaatgttgtggttaagaaaatcctagaagaaatttttccacgatttggaatacctaaggtaatagggtctgacaatggacccgcctttgttgcccaggtaagtcagggactggccatccaactggggattgattggaaattacattgtgcttatagaccccagagttcaggacaggtagaaaggatgaatagaactctaaaagagaccttgactaaattgacaatagagaccggcgggaatgactggacagccctccttccctttgctttgttccgtgttagaaacacaccaggaaaatttaagcttactccatatgaaattctgtacggggggcctcccccgctcactgaagtagggagagtgatggattttctagaatttaaccctggttcttcattgtttacacgcatgaaagccctagaagtggtcagaaacactgcctgggagcagctcaaggaggcctacgaaccaggagatttgatggtacctcaccagttccaggtgggagatacagttctcgtcagatgacatcgagctggcaatctagaacctcgttggaaaggcccttacattgtgctactgaccacccccactgctgtcaaagtagaaggcatctctgcttggattcacgcctctcacgtaaagcgagctcctggagaacttcaagatgaatgggaattggaaaggactgataaccctcttaagttacgcctacatcgtcggcgccatcctgaaagagaagaatgacaacccacaccagcctatgactctcacttggcaagtgttatcccaatcaggggaaatactatttgccacctcaaaattagagcctccgggggcatggtggccaaccctgtatttttgcctccgccaaatcattcctacagccaggattactcctcctaatgtggttcgaagctatgggttctatagctgccccgagcaccttaagagctcctggtgtggggggcctaggtggtacttttgcagtcaatggagttgtgttacctcaaacgatggagattggaaatgggccgttgagccatctggggatggattagaattttcttttcaaaataaggggccaggcaagcgtgcagtaatgaggctatacagaaatcaggaatgtaatcctacagatttagaccgtgtgaaactgcagttcacaaacatgggaaagaaatatgctcttgcccagtggattggaggcatgacctggggagttgtgttctacaattatggtagtagacctggttcattgctccatgtctgtctaaacattgaaagtcctccagccctgccagtaggccctaataaggtgctccctgagccaaatcgaccttttctcccaagaccagccccgaccttaccccacactcaaaagactcaccaaatgtcttccccacagaaaaacgtttcgagtcctgttctgtactctatagccccagagcaagttgaactatcacccacccaacaaagactgttaggcctcctccaaggagctttctctgtgttaaatggtaccaatcccaatgccaccaagtcttgctggctgtgtctaacatctggacctccctattacgaggggatggcagtaatgggaacttataataataccaccagtcatgatcactgcagttggggacgtagcctcacactcaccctcactgaagtatctggcagaggcacatgcataggaaaagtgcctctgagtcatcgacacttgtgtaatgttacctatgagagcccccggaccaaattgacttattatttgtcacctggtcccaataagtggtgggcttgcagcactggattgaccccctgtgtatcgacgtcagtgtttaatgacattagagactattgcatcctggtgcagttagtgctcagagtcatctaccatccctcagaaacttctgttgatgagtttgatagatggctgactcgccttcgcagggagcctgggactatgactttgaccccagtatattttatatgaaccacactaagaaggaagctgtgacaactcaggggattagcccgaggcaaactgctcacaaacaatgaagactcagacacatctcaccatgctctagttttagggttctctctgtctctgtctgtttgtctctatccctttctctgtgtgtgtctctgtctttctgtctccctctccctctccctctccctctccctctccctctccctctccctctccctctccctctccctctccctctccctctccctctccctctccctctccctctccctctccctctccctctccctctccctctccccgcccctctctctctctttctctaaggtaaaaaccctagtctggcttcaaatttaaacttcctgcttctgcctcccaaactgctgggatcacagctgcacaccactgaatcctactacaatcactcattttacaaggcaaactattaatttggtttgaaactaatagcaacatttgatacaaccttgtatcaatgctttgttttactaataaaattacaagcataataaaataaaattgaattttattccaacatttgagtccatgagactcttagtttaacatgatgtcactttgatttttccagaaccacagggatataaaaatagtaagcatagtgaagtgtggggcacctgcactgtcctaacacagaatgggaaggcccactgtaacagaaaggctacagctgaaaatggttaagaaatttcagaggagaaaataactttatggtgattcatttcaccaccactctgggattccaattttgtaattcacagtttctcaattgtgcctttaagctggcagtataaggagagagatcaccatttccagaggctgaacttttcaataattaatgaatgatatttttaatatttcatcacattcagtttacattattgtcttagtcagggtttctattcctgtacaaacatcatgaccaagaagcagttggggaggaaagggtttattcagcttaaattcccacattgatgttcatcactgaaagaagtcaggactggaactcaagcaggtcagggagcaggagccgatgcagaagccatggagggatgttctttgctggcttgctcagcctgctctcttatagaaccaagactaccagcccagagatgatcccacccacaaggggcctgaaacccttgatcactaattgagaaaatgccccacaactggatctcatggagacatttcctcaactgaagctcctttctctgtgataactccagctgtgtcaagttgacaccaaactagccagtacaattatgaaacatttatagaaacaagtgactgatatttctgtaaccatcctctctccaaccaccagaagattatgggctgaaagtcaaggaccccattggccatctcaaagccctagggcctcactccactgcatgccagaacatcaaagccagctacattcctaacagcaaacctagcgatcacacctgttagagtgtgggttttctggggttactctctgttgtgtccggccagcagaccacaacctgggttctagcctggaaaggcattttggaaacctggaagagaagaggggctaggtggcgagagaaaagaatgtagccaagacagttactctgatcaaggctcaaactttattgttgcgacactagttatgaaggaagggggaggggacccgattcccgccgaataatctctggtccagtagaaaggtgcacgtgtgtggctccgcaggttccagcagtgggcgtggcagaacgaatgagcaggaagctccaccccgagtaagcaggtttcaggctaggggaggggagactacaactctcaggcaaaaatgatctttgtgactacagttcttaatgactagaaacttgaatttagaatctatgaatgccaggcatgccttaatcccaatagttgtagcctggtctacagagcaagttcactcaagaaaaccttgtctcagaaacaaacaaacaaacaaacaaacaaacaaacaaacaaaacaatcagtaagaacagtgaacctcagggttaacttcaaataagaaagtttatcccagcccatcctaattttgtgagctaaagaaggctgttcttctgcccaagtcacatgaccaagagattctgccaggttattttcagatccactatgtgccacagagtccctgacactaatcactcacgacatgtcttccttcttctgctgctttataccttttatgtgtagaaatccattggctgaaataaagaaattgacatatgcttcctatatcagaacacctatgctggccatactgtaagttttgaccagttgtaatgcatttcgactataagtgaacctataaaatgcaagactgaatcttggtccatcaaaaggctctgaagtcctgggatagcgccaccaggtggcagcaggtgcttgtgtgtgcatgcttgaaattatgctttgattaaaaaataacctctagcccaccccctggctactaaaggagtatcagcagcccgagttgagatgctaagggtagaaaagtaccagcgaatatgttctaaattcctatttaggcatagtgtcacatgcacacagtcttctggaaactcaggaggcaagaggatcacaagttccagggtagcaagtgcttggaagtgagactagtcaaaaataagtgagtacatgtaaagtctctagctgactctttctttccccaaatacactggaacagggcaggggctggagagtcagctcagcggttaggagcatttgctgttcttgcagaggacctaggtttagttctcagcacccacatggtggctcatcctctgcgtgggcaccaggcatacacatggtgtgcagaatgcatgcaggcaacacacacacacacacacacacacacacacacacacacacacacacacacaaacacaaatatatatatccaaaaaaatcacagctgaacactaaaacaggttggtataatttggagagcgagtgtccccttaaggcctggacgctctaacttgctcaacagcctgtggtaccattgtgaggtggcagaaccttcaggagttgggactagatggtaatttgggcatgtggtctggaacagaatggttgccccactccctctgtgtcctcagggtttcctctctgcttcccaacccccgtgtgtgaggggtcacttcagatatcctgctgatgtatcagttatttacagtacgattcataacaaacagtaaaattacagttatgagggagcaactaaagttttagggctgtaaggcaccaaaccatgaggaactgtattaaagggtgacagtattaagattgaaaaccacagccctagaaggtcaacagcctccaggacatgccccaggcagtgatatacttagcaagacccagaaacaagtgccaatggactgcagaccacaactctgaacctatatgccagtgctcttttccttatttagggtgattttctcacacacttttctcagcaacagaaacctgacagaagtggggctggagagatggcttagcggttaagagcactgactgttcttccaaatgtactgagttcaaatcccagcaaccacatgatggctcacaaccgtccataacgagatctaactctctcttctcgagtgtctgaagacagctacagtgtacttacatataatgaataaataaatctttttaaaaattaaaaaaataaagagagctgacagaaggatgtctgcagagatccaaactggaaaggcccactcttggggctggagatggctcagccataaggttcaagtattgcttttgcagagaacccaagtttggtttgaagcattttctgtcccaagacatccccacatacaaaaacacacagagacacagtttaaaataataataaaaaaaaactttataaagaagagacattctcaggccaacacagtttagcagatagaagcacttgctgccaagcctgacagcctgagtctcagctcaggaacccacagtgaaagaggggaccaaccccagcaagctatcctttgacctccacatgcacactgggttgcgtactcccatgcacttgcacacacgcacaccaataataaccttaagtataaaatgtaaaaataaaaaagacactgggcaggagagatagctcagcagttaagagcactgactgctcttccagaggtcctgatgtcaattccattatctgtaatgggatatgatgccctcttctcgagtgtctgaagacagcaagagtgtactcatatatatatataaataaataatttgggtagaacccaaacatcaactccaaatgcactccaaaccacgtgagctctgctcatcagtgcctctgtcaccagtgtggtagtgagcctgcagcccagtgaggaccaacacacacaggcagctgccaacacaaatgtgcctgctccaatgccaaggtaaagcagaacaaagcatgatctctccctccagagaagcactggctgtgggtttgtggctagcctgatctgaccgtgagctccaggccagccagaatggcacagtgaattctgggattaaaggcaaatactgccacaccagaactaaaacattagaaaaagcaggaggtcagaagaaacatgatccctggagtaggaatggatggggtagtggcagcattctgctcagcctggtggaactgcatggagtagggtgtgcagggaagggtgccagctcttttccttctttttctttctgcagaggtggtttggtacccggggtttcatggatggtaggcagtgctgggagtgagtgatgaggtggttactgaggtaaccaccacagacctgagggctggcagccctaagacacatataaataaaaaataataaacattaagaagacttaagccaggtgttactcatgatgatattttaaatccatgtatttatgcatggctcatgtaatactttttgaataaacaaatgtagagatggttggtaatgtcacctgagatctctaatactggaaggagggagatagctcagtaggtaatgccattgctgtacaagtgaaagacccacaacatcaggactcccccacgttctgactcaggataggtgacaccccaaatcactcatgagaaacgttcttgatgcaaactgcaagaggtatattagaaaggcaaaaaccgcaaacacctggcaaaaactgcaaacacttggcagcctggaacaatggggcaagttctactccctgccattaatgagacctcttttggacacagttctagttcttaaataatttttcactctctctcaggatctttcaatccccactctttctagtaaatagttctaatcttagaactagacacagttttctaacacacatggaaaagcagaagcataatacgagggcctttccactgaatctcaaggttttctgtgcggtggtgtctaatgtagagcgaatctctatcttggaagcagtgtggggctttcaggtctcctttcagagcagcatttacaattagctcctagcagggcttctcaagccacactagacttctaactacaggtgcagagctccaaagaccaattgatcctgtctgttttttctctttcaccaaattatccccagatagtcggagagtactgctttttcaaacccgttccctcatgtgtaaatcatctctagtcagggtacaaagcacctatgagaattaccttcgcttctctagattttcacataggtctaaacacatacacaaaaacacacaaaacagccagtcgtggtggcgcatgcctttaatcccagcacttgggaggcagaggcaggcggatttctgagttcgaggccagcctggtctacaaagtgagttccaggacagccagggctatatagagaaaccctgtctcgaaaaaccaaaaaaaaaaaaaaaaaaaagagagaaaccctgtctcaacaaacaaacaaacaaacaaaaaaacccacacacacacacatacaaaaaaaaacccacaaaaaagaaaccaacagatctagataaacgcgactcttttgtgtcctccacaagcaggccagcttcaacaacagaactcggtccctctgaccgatctccggaaactaccagacagccctggctcttcccacttcccagggcatcccccagggtggcagcctgtggtcctcccagcaagtctgcagaccacagtcctccggtccttaaggcccgagaggacagctgcaaacagaaagcaggcatttcagaaaacaccatcatctacaaacacaaagacatctttgtccacttccactgggacaaccaaaaccagagaaatgacccagagtgtctcagaatcagatgggtggttcatgacaagagggtaactcttacacgcgttctcgcgaccggccaggaagaacacaacaaaccggcatcttctgcggcaaagctttattgcttacatcttcaggagccagagagcaagagagcaagagctctattgcttacatctttaggagccagagcgcaagagagcaagagagcaagagctttattgcttacatcttcaggagcaagagtacaagagagcaagagctctattgcttacatctttaggagccagagcgcaagagcaagagcaagagagcaagagagagaatggcgaaaccccgtccctttttaaggagaattatcctccgcctaggacgtgtcactccctgattggctgcagcccatcggccgagttgtcgtcacagggaaggcagagcacatggagtggagaactacccttggcacatgcgcagattatttgtttaccacttagaacacaggatgtcagcgccatcttgcaatggcgaatgtgagggcggctccccacagaggtaacaatttcactaccgaccaacagatgggacgaaggtccctacagatgggacaaaggtctttacatatggggcatcccccagggcaattttaaaaaccaaactcaggtggatccaaaatcaggctgattagtataaagtcaggcagtgccgtgattcagaaacaaaggacgatacacaaacaaaccaacacaaaaagcacagaaaacagaaaacaaacactcagaacagagacaccgaccagcacgaacacattccagaggggatccccatatctccaagtcgattttctggtgtgagggatggttgtgtttcccagcccatgcaccaaatgaaagacccacaacgtgaggacccccccccccacattcttactcaggataggcgacaccccaaatcattcacgagaaatggtcttgatgcaaactgcaagaggtttattagaaaggcaaacctgcaaacgcctggaatcctggaacaatggggcaagttctactccctgccattagtgaggcttattttggacacaggtctaggggcttaaataatatttcactctctatcaggatctttcacaagcacaaggatctgaggaaaatagctgtgtatggtggggtgcacctgcccccccccccagtacactgggaatccatggagcttattgaccaactaactgaattgtttccagattcagagaaggaccctgtcacataaggaggagagtgatagggaaaggcatctgacatcagcatctggcctccctcagccacacatagctgcaggtgtgcacatgctacacacagaggtgggaaatctcaagtgctcaagtgagtgtatttcagataatggccatggggttggtcaccccgtgtattgggaataatgccagacatgggcattattcattatctctaggcccaggcctaaatgatctaagtattaacacgagaagctcatagaagtctaaggctcacctaaaaagcctgcataggggctggtgagatggctcagcggttaagagcactgactgctcttccaaaggtcctgagttcaaatcccagcaactacatggtgactcacaactatccataacgaaatctgacaccctcttctggagtgtttgaagacagctacagtgtacttacatgtaataaataaataaatcttttaaaaaaaaagcctgcatagatcatgagaggatttggagactttatagggactaagcttagcataagcccagtctggagtccagacacatggggcatggtctgtgccagacaaacacatcaccagtcttggacaggttgatgtaacttttcatgacccacctttacaatgatcttgctctcctttaaaaataaggttaatttcaacaagatgtttacattatgatggaatccattcataggcagaggaggcaagttcatggcaggaagtggtgggaacgagacttgcctctcagggaagcttccagactcccaactttcactactctgcttggtaaaaaaaaaaaaaaaaaaaaaaatccccccccccaaatttatccaaatttgcctggatctgagttttaacacacagataagtttgtctaaacacaattgaaggccgctcaaaggaaatgaatggcttatttccttctccagtgccataaagtcatctctgctactgggtgactcctggggagaggtgaacaatgtctagacagcccagagagagtaccaccaacagaacaaagacaccctcccacccaggtctgactcagtggaccaaggagtctggggggttacttggcagagcacagtgactcaaaagaagcttcagcatagaaaaccccaccccagggcaaagtgtaggctatcaggcgcctaaaagatggcactggcctccggtacaacgtcgcggtaaacaatgctattgctactgagcaggcgctagcccgaatctggcgccaacccctcccgagcgggtgcatacaaatcaaagtgccggcagactgaccaatcccaggaggactcgtagctctccccagtgctggggtgtatataagcagttctccctgggtttccagagttcccgtagcatcgaggtgttcctgaaataaaaaaggctgttgagaagaatccgaccgtgttgcgttttttcttgctggacgaggtgagcacaacaggcaagtgaggattcctaaaggctacatgcctggggctctcttctggacttgcaggggcaacttgaaggctagttggttggatctggaattaactctgaaacaagcctctgtgtgggtctatagaggtgtttctacggtggatgaagattcccagaggagacagaagttcaaggaaaatagcctgctatttgtttgcctaccttcattccttgctggtaattgtgcctgtctcatttctttgagaagcccagtttttcagcctttcaatatgggctgaagcccagagactctccaggaatgcccaaggccttcaacaccagattggaactgctaaggcatccagcatcatggatagaggaaccactgggtccatatcatggaagtcaattcaacgtgtcttccttatcatatgtattctgtctcagatcctctcctaaagaaccctgactaacacatgtgttattgtgtgaactcctggagggcgggtgttcttgtctctgtctcccatgtagggagctggtatgactgactggaacctccatctctgaacttctctgaagctcccttctggagcaacaaatgccactatccttgaatcagacaagacagtatgacatgacagagtagacagctgccctttaagatgcaattttagctactgcagaagtcacttcccacagctcccatacctacacctcccacaccaaaacctcccacaacttctactcctatatctcccatgtctttaccacccacacctccacctcccacaccttgatgaccgcctacagtcactttggtcccagagcaagaggtctggttccatttgcaaatctgacctgcttgcagaggtgctctccaccttagtgtccccagactggaaatgctggtgacagctactctaactccctctctgaaaaatgagaaggtggtactcagagtccctgctcctgggttacagcctcgtcctccacctcttgctcctcccccttctctacctcctcctcttcctcatgtttctctgtcctccttttaaatcaaaagagatggatgactgacaagaagcaaatgagtcagacataaggaagtagaaaaagagaatgatgttgccaacttatcattcagaggtgctctctgagacggagaataagagcaaccccatcaatcacacagtggatgcccttgcaggcgatctgtggtgtcagccattgcatgagcaattggaccaggagcctatggctacctgctagctaccacagaggaaggaggctgtgtagacacaataaaaggcgacaattagcccagaggttagagaggacactgaacctgctttcttgcacaggttggactccctgtgagacctacttgggccagactcaaaacaggaaagagatgaggctaggaggtgctcagtgtggaacctgtacccctttgccacactgagggtgggaaggaaacatgagctcatctgactggatggagtcctaggaagctgtatctcagccatggctctgcaaggcgagtgcatcctacatggatggatataagattgggagagcatgtgagacatttttcccctcatatttttctttctttttttctttttttttcctttttttctttttttggtttttggtttttcaagacaaggtttctctgtataggcctggctgtcctggaactcactctgtagaccaggctggcctcaaactcagaaatccgcctgcctctgcctccggagtgctgggattaaaggcgtgcaccactacacccggttctcccatctttcttaactcccctggttctctttttgctatttcatttccctttctccaggggactgaataggcatcccaagagagctttttagatattagtcataagaggaaccattgcagatttgattgaattagaacacgtaggctataaagcaccatcatatgactgtaaatattaacatttactgaataaagttacactctccattaattttacactgagatatatgcaggctttgatgtaaatacaccattcagaatatgtctggtaggtgccacggcaacagatgcaggggcagtactgttgcctacaaatgaacagtgtcctcactgggtctagaagatggctgtaaagacacttctagctgtccacagatgcacctgatgcacattgcttgtatttgtaggatttctcttccatataaactcttttatgacatttttgtgatagtgacatgaaaaggctttactggattgattacttttatagggttgggcttcggggtgaattcttttctttttgtagactctagagacctgttttttttttttccatattgtgtcacagtctaatcttgtaggacatttgtctgagggaaatgcaaaggcagatacagattaacacattctcttttccttggaaatatcgacctaaaggaagcacagatgtgttgtgcaaacttccattaatatgcagcattgataaaatgagtttcaataacaaaaacgacaataaacagactccttaacagaggtggaatgctcctcatgtgcaaaatataatatttgtaacccttgtgactcacaaagtactgttgcaaaatcatgttttgcacattagtaatactcatgatcctagtttgagagtctaaagtatgctcatgtcattgtggacactttcagaacctttatgtacattgatgcaaaatactcaataaaatactcaaatactgaatccaaaaaacataacaaagaatctatccaaaatgatgaagattttttttctcatccaatatatcttgaggagtttccattccctctattcttctcagttcctgtccactttttctcccttctggatctaacccctttctgtctctcagtaggaaaacaaacaagcaaacaaaaaacaaaatccatagactcactaattgacaaatctgcccccaaaaagctaaggtaaaagttataatatatttcaaaagaactggtgcaggcattagtatttgtacatcacaaattctagtctcaaatttctggtctatatttgggcaattttgtgtgaagcattttgctggatgttgataaagcatatcttctatgggtcattataagtgaagatatcaaaaagctaaaatttcaaaggggaagaaattttttggctcagctctgagttcattaatcagaatgaaagactatgattgatgtttactggttagatgatataaatgtgggcgtctctgcaaacactagttctggtagcgtaaccatctatgagacaaaaaagaaatctagttcaatacctctctgtaattatttcagcactggttgtgggtgtgttgtgggttatagccaatgaaattcctacagcactcagagaaaatctttcccagtgcctgtgttaacatctgaagtaaaaagtctcctggtactcagaagtcaagataaactacaaagccccatgggacaattaaccatacacaagataatgactgggaagaacactggatggagcctgcccctgctcaggtgataagcagaagagaaatgagtgggaggcaggctttgtatagggtttagttgtaggtgatggattttcaggattggaaatatctgcggttggagattgctggtattttatgttctgagcttgagcaaactcagggatttctgagtagttaaaacctgtaagtatgctaaccattctccctgtagacaatgttgagtgtaactttagattctgaccccagggtggtttattttagatataattaagcacagtataattttggaaagttagttcttggtaataattgtctcaatcctctgtgcacagtgaagatgaaagtgtgactgcctcaaaagtcttttgcaaagtctatgtgagtctttcttaaagttggattctaaaactaaagggcctagaggaggatcaagcatacagtgtagaggacaccaagctataagatacatgtcacatctcttgcaaggctggtttgtattgcctgagaaacaattttcaagggaagattgggaattttttttttgttttgtttgtttgtttttcgagacagggtttctctgtgtagcctggccgtccaggaactcactttgtagaccaggccagcctcaaactcagaaatctgcctgcctctgcctcccaagtgctaggattaaaggcgaacttcaccactgcccagcacgggaaaattttatagtctgggactttcaggtgttttgtggcactacatctagcacagctcaccataccacttactacatccattccctcacttctggtcagaaaaaagtatacttctctttcactgaacagaaactctgtggttttatattcctggttaccttagaggttatttttgaccacaaggtccttttgctctctacagaaaaaaatatattttatggatgtttctagttcttagaattttaatgttgtgttagtgtaaatagaaagacagtcaaatatttttaaagaatataaattatgttgttcagatatacaaagtgtgattacgttgcttgactctatagacatcaaacatgcaagtgctgctgacataatcccagcaatcagaacattgggacaggtgtattattcttcatttgaggtcagactattctaagtcaaagtgactttctaccctgtgggccccaatttcctcttttggcctttctgaactctccacgtgggctgaagttaattttctaaacttttatgcaggtgtgtctgtgtatttttaactttttattgctatattagtagagaactaagttctagcaggatcttgatattgtcatttctatggcatatcaccagccttacatttataaatacttgtctccacacctgctgagatatttgaatggcaggcagctctctatgcctagaggtaatccacagaattctggagatgtctcacacctgattgcttgaaagaaaaaaacctaacatccaattcctgggataagaattggagggtggaatttctggatggaaaaagtgatgtagggaagagaaagcaggtggaagagattaagtgggagaaagagaagagaacagataaatgggaacaggggcagagaggtaaagagcaagctacacatgaggtcataggcttgaatagtctgaaatttaaatgatcggtggtagactgcttcagtgaaaggcttatggtttaaactatataaaaacctccttctcattatttataacactggtgtgtccacaagtactcccactacactcacatccatatgcaatatgcatatatatatacatatatatatatatacatatatatgcacacacatatatatgcacaaacacacatacacacacatatatatgtaaaacttttcacaagggtgctttgggtatttaagtcaaattagatattgattggttattcacaataaattcatgacatcattgacctagcatattttggaggaaggacaaattttagatcaatgtctttttggttggttctgtgtatgtatttcactttttgtagcttgcaaagcccttcccataacgaggactgtggaacgtaggagccaatgttcttggaggcaccagcttgacctctttatacacagtgagttgtgcaagtctgctcgttagcaatgaagacttattgtcagtttgtaaaaagcaacaccttttgttgtcggtgccctgcagtgttcgtttatttttatgaaaccactttgtagaacaactcagttgataaaacacagtggaaaagacaagatcaactggaactccatctctttcagaattcagagacttaattataatcaccttcatacacttataagctggttctttaaaaaaaaaaaaatccaaacatcttactaagaatacagccagccgaactccatggagttttgtaccatggggctttcctatgcattggcagaaccacaagtgtggcaatgcagtatacaaaagttcttaccttctaatagatggtgacttttcttggaccttacaaccagagttaatgcaacttgaagaaatttaaaatttaaaactgcagtcctactgtgtattcaaatttatggtttagctttctttttcaaagaacaatgtaaaaacaaacattattctttccttgtatttctcttgtgatcaacttttaaaacctaacgtgatgcattggtacaataataatttattgatacaatggtaatttatgtactttttcaagtcatgtccagaactgcctgagtgtcatttgttgaaagcatgaaatgcagaggctcagtgcaaccttctaaaatgaatatactattatgtgtactgattgataaacagtgatgtctgtaaatgcttgttgtcttgatcacttggagccagttacctcatcctttttaaaactctgttaaagatttctgtatactataccattccttctccatgtaatggggttttcttggtgttcccaaaaatattgcaaaggtctttcttaagaccagcaatggagatacaaaagccaacagacatacatacagagtacacagatagacacaaacagggagacagaaggcagacacacatgtagagagagatgcacaaggcagtattcagcatgttacagatttaaattaactgaatagacacgcaggatggaaggctcagataagagaaagtagagaattcaactttggactcacacttagttaaattaactaagtttaatatgttcacatatgcacaatcaattaacttgtgacctaattttcctattttttttttgcataaacacaatatgggaaaatataaaactcaccacaatgggtaacaagtagccctgcattcttaaaggtgtccgtgggctcagaaccctgttctgtaaagaaagaccatcaggtctgggcttgtgcttctgagctctcacttccatgctggcctagaatccattttaactctcaccgtcatcacaacaggatttgaacctcagaggtcacaagagaatcctggaactcattactttcattaaaagagttgacttcatgccatattctctaaggtgacttgggtaattctcgagtctcctttccccagcttatgaagatatgcatggatgtacatagagtattatagagcacaatcagggaatcttctatgaacaaatggctaaacagtgcagtatgtattgtaggtctctgttttcttccttccttccttccttccttccttccttccttccttccttccttccttccttccttccttccttccttccttccttccttctttccttccttccttccttctttcctttctttattctttctttcttttgccaaaaatctagacactttttcaaaggaatttttcttaattgcctcaccctccaagcagtaaataatattgtgcctaaacctaacatcactttaattcatcattttctttgactaaggtatccagctcctctaccttttgtccaagtctaataatctgtgtctcacacgttctctatgagttattattattcgccttactgcattttcttttcaggctcttttccttgtttatttctaagcacatattgaacaaaatttttatatcctatgttgtcctcctttccttcaggcttttgctattattctcttgcccacgaatcattttgttcctgtcctctatcaattgacatatgtggcttacacactttgatctcttttatcatgactctggattttctattctttacctaggatatcatgtaaattgctctctttataagatacatacatagttgatagtttgagccaaagacatttaatcttagttttactttgttttgggtattgagcaccagaattcagagggattgcttaattgtgtgcatttttagcccaggagtctagactcccaatgtgagaagttaggcaggatccattgtatctgaaggattcagaacccaggtgcagtgtcctactacattcagttctggtctagtctggcagcaaccttgtaggaagctgagcagagtaggtcctgagaagttgtgtttccacaacagagttggaggagtggttcctgatggggagggtgggcctcctgcttcattagataagtttaagaaaaagacaaaataaaaacaaagaatcagggctggtgagatggctcagtgggtaagagcacccgactgctcttccgaaggtctggagttcaaatcccagcaaccacatggtggctcacaaccatctgtaacaagatctgactccctcttctggagtgtctgaagacagctacagtgtacttacatataataaataaataaataaacaaaaaaaaaacaaagaatcaatcagtcaatcaaaaaatcaatcaataaattaaatatgcaagcaagcaaggaagcaaaaatccaaaccaacaaaaattgctctgaagaactgggaagctaattaagtaaaaagtcctgaagtaggggggcttagatgaatggcaggaagctggtgagtattgggcgggtccagaaggagtggctctgaggaaccaagaggaagtgactggaagttccgccatcccatcattttcgatgtatctcggctgcctcgtggtcaggaagccatggaaggagactagtgcctagtatttgcggaacctgaaaacttccttaagctgcagttgctgtgctggcctcctaggacattcagcagctggtcctgtcgccttccaggtcagaggagttgttgggctgagaaacgggtaggagcagggcaggcatgtggagcaggggtgcgttttctgttgctactcttacaattctgttatggatatcttaccattatcaggaagtttgagttcctgtgaattgagtttatgttttaattgattttatggttgccagaatatttttctaaaacaacccagtagatccttggccctctctggatccttggctctttctggaataccggaagggaaaggggaaggggaaggggaccctgaaaagaaaatgcagtcaggtgaataataatcattcatagagaatgtgtgtgagacagattatcagacttgaagatatatagtaggttctgttaaccctgagtgtccccagagaaaaaccaatttctccatgtggaccagctttatcaaataatacatcctgaccaagagatagactttggtcacatgctacaggcattttataggccattgtagtttcctatgaggctttattattttcctaagacatgcaacctgcagcacttcaagaagatacctggttcttgtgctggtggtgaggttaatttttggcattttactctgaggttgaaggaatgaagagatatctggttgggtccagactgaaccgggccatcatgtggtgggaggggaattgaggatgtgatggaggatagaggggcaggtcaagagatcaccagcagccaagaaagtacctatccaactatgacttcattgatatgttaacaggtacccctggtagccattcttcctgaatttctttgaatttttccaaggttcagcccaccatgctgtgcggtgatgatttcaggagtagatattttaataagtggaaatttttctatggattttttttgtttgtttgtgtttggtttttgttttttttgagacagggtttctctgtttagccctggttgtcctggaactcaccaggctggcctcgaattcagaaatccgcctacctctgcctcccaagtgctgggattaaaggagtgcactaccggcttttactatggattaagacaaaattagacagcatcttttgaataattttgaacacttacttactgaattactgtctggattctggatcagaataattttcttccagtcttctgtcctcctcttctgtattgcttggaaaaagactctatgtgtgttaactgtgtgactgactctcacatctttagggtaaactgaaatactcagaaaaataggcattctcttgataacttctcttcatgtttatccttttctcgggtattgacatctttcatttttgttccatgaacagtttcatgttcattctaaacaatatttacccattttcaggtctccatatgctcagtcaactctccgtaactgtaaatcaacactaagagcactagaaggttaaaggtcaaggagactctcacaaaggatacaggtatgttagaggtattgaacaatgggtggagttgggctcacctgtgagtagaaagaggacatgaatttgattttcccagattctatttccttaatgattctggaaaagaataatattagaagtgatgatatggatttaccatggaaggaagtgctgtcagctgtcacttgatgtcaatatttaattaattttgatcctgggaaattgctgttgctcattgaaatcaaagtttcttttatccagattgaaagcaacatcaggctatggttgttataagggcaatttatacataaagcaaatgtcagcagtagattccctcctagggcctgtgaccttacttatcgtattttttaggcagattttcactgtaatctatggatttttgtttcctgtggagcttgaaagagaaaacctgttacccacagatattcttgccagtatcataaaaatttccattttggcagattcagattggagcaagcagattgcaaacctgagtatagacattgataactctgcttcctgccccaatttgcctagcaatttttttcactatggaagttcccaccggggtgtctaagatgtctgttgagagtgaatggtctgatatgaggtggctttctccagaaggtctatttgctttctgaatcacctattctatccactctaaatgttttcctgtccttgacctgtgttcttaattgatgttctgtgttgcattaatccccattagagtagaataattatttttgaccttctctgtactggttgctttagttttgaatctgtttgccttatttctgaggtatgtttcttctcttctatccttgagagctttcatactgagcagtgtctactttttgccacagggctgtataagtaagtttcattctcctattgtcagcataatttgggaggattcctgcctacatctattaacctaggcctagtcatgtaagcttctactctccatacagtattatctaggcctgttgtgttttcagcttctgaaatttgctgctgaataagccccccctccccccaccttcttattccttctcaatgcttacctggctgattcaattcagtttttccagctcaaactcctctctgagctgagttcttctctcagacactgaatttttccacttggccttaaattaactgtagaaatcttttctcatcttctggctccttctctttctcctgctcattctgtctttacctgttcctagcatgttctctcttcagtctgattctgtaaaactctcagaacccacgtgcagtgtcctagtacatccagctctggtctagtatggcagcaacattgtggggaagctgtgcagagaaattccagagaagttgtgtgaaactgcaacagagttggaggagtggttccccaacagagttggggagggtgggcttcatgcatgattaaataagtttaagaaaaagacaaaattaaaacgaagaatcaaccaatcaatcaatgaattaagtaagc

SEQ ID NO: 229 - DNA, 833 bp, Mus musculus
cccaacagcctttattgcaggaacacctcaatgctgctactgggaccccgggaacccaggaaggtctgcttatatactctcagcccccatccactcaaggcaggccaagccacctcaccaggcatgcagcttcagccaatcagggcggcaggggcatgcctccaccaaatatggacttgtttacaccgccagcattatggtgcacctgcgcagctctcatgatggtcctggcttattttcaggtgtatgaggaagtcaggtgcaagtcataagacttagctgcagtcccgggccgctcctcacatgcctgtaaacattctctgttgtaaacttctatttcagtttatgatttaactttctgtgtaaactttgatgaactttttaacatgtgatcatgtatgctgaaaggtgtttaagggctgaggacaaagagaagtgtcagaactggggggcgggggtgatagattaataagcctattaatttctataaactattgttacccaaaatctgtcttggattgttaatatcttgtgcacccttccgcttgtgggacagattgataatttccctgcaattcaagtagtgggctatgcaagctccctaccttgattccaggagtaagaagacaaacagcctacagagggagggaagctcaggctgaagtcaagacctggtcagcacagggttactgcccacctaggggaggagcaagcggctgagcagcggcagatggagtggtggagcctccctggggctgcgcggggagacagatgggtaggctatcggagaacaggcacaaatactacagaaatacaaatacctgtagatctgg

SEQ ID NO: 230 - DNA, 43820 bp, Mus musculus
ggacttagggagctcggctgctactgctccctccctgggcttcggcaagagtctttccctgtctaacacgaggggtgaggatcatatttttattttggaaactaaaaagtgctcccagggtcggtgatcattaaggggaaatccctgaatatactctccagccaagaaggcagggctgcccgcctgcactagaagaggcagcagcctcctacagcaccactacaggcaccgcgaggacataacaccacagagcagttcctctgccctccgaaacgacaactttcctaccatcttggaggcagaggagagaggggccaaggggagaagtgcaccggctccagccagataaagtccaaatttctacctctcatcgctggaaaaaagcccatacttgagaaaaagcagggaagaaacagaaaggaggtcgtgtgctccgtggtggggaatgtttctgcaccttctgatggaaagaaatctttacaagacacaggttttacgatattattgttttccatgttaactttttccataagggtgacagtggcagcttacttttttttttctatttttttttctttttttcaggctaataatgatttttctctatggcaggtccaagttctgtatctggtggccagtctgtaaattggcacttgagagacttagaggtcacggtattgtctttatttaatgctcgtttatgttgtatgtattcgtacttatggtttcatgtattagaggtaagattttgtggttttggtatctgaggaactgaggctgctgagagtcaattgtaaagagatggcttttgtcttctctcagagcaatgtaagtaaaacctattgactgcccagaaaggcataatacagctgtttatttttcacggtgcaaatagaagtagtgtgtatttaaactctcaggacagctgagcaagccagttcatctatcagcccaagaagaaagatgactcctataaacctagcaacagattgaaagatgccttggattttcttcaagtaaaattatttattaagaattatatctagaattccatttctgttattttcttttagtttgcatagattgatgaatgtctaggcctttggtacattgcatactttgctgcctgcttcttggaacacagaattgaggggtaggcttctcttccctagtgttggaatgttcagaacttccggtgtagtgtcagcctgttgagcgactttgtacattgcaaagatgtaataggtttactttttttaagtgattttttgttttatgtacattggtgttttgcctgcgtgtatggctgtgtgagggttttagatgcccaagaactggacttacagacagttgtgagctgccatgtggcacttgagctgggtcctctggaagatcagccagtgctcttaaccactgagccatttgtccagccccagaatctcctccctttctttctttcttttttttttttttaatgaacaaactttagcacataaacaggatcaaagaaaaagtgcaccaggcatggagacagccagctgctgctgcagcctgacatgtccatggcggaggtgttaggagaagtaggaactagccaggctttttgtatgttgcaagggaattagggatgctcatttaaaattcattgcaaagcattttaggtgtaattgatgtttaaaatgcctatttctgagttataacttttttttaaaaaatatttatttattatatgttaagtacattgtagctgtcttcagacaccccagaagagggcatcagatctcattagggatagttgtgagctacccatgttgctgctgggatttgaactcagaacctttggaagagcagtcagtgctcttaactgctgaaccatctctccagtctccgagttataactttaagatgaattcagatactatttgtctggggagctttattatctaaatttgaatataaaaccttctgtgagtttttcctccttcattggtgggaaaaactgtgggcattaaaattaactagttcctctcacgttggaagtcttacttgtgaggttgtgtgatatttacatttttaaaaatttattaggtattttcttcaattacatttccaatgctatcccaaaagtcccccacaccctcccccgcccccagatatttacatttttgttggtttggtttggtttggtttgttgaaaggatcttgctatctaacccaagctggccctggactcagtaggtagttcaggctagcatggaactcatagctttttgtgccagtattagtcacatcacccactcagcccagtatttgttctgtcccccttggacataaagcacagtggtcatacaagagagtaagcgtcctttgcaggtcgcagtggacctgagaagcatgtgtgtggccccatgtctctcctcgtgtgtgccttcctttatatagccggtgatcgcctccctttacaagctgaagctgcatttcattaaagttaatactttttagggttttgaggggagtgtaggggatgagacaaggtttctctgtgtagccctggctgtcctggcactgtagactgtagaccaggttggcctcgaactcagagctccatcttaatctctgccttccaggtcctggacttcttaaaggcgagtgctgcccactgatcagctagacactttaatgtatgtgttattttattctctcttctgtttggtttggcttgagtcagtcctactatgtagtagccctggctggtctggaactcactgtgtagaccaggatggccttgaattcacaaagatccccttgcttctacctcctgggtgctggaattaaaggtgtataccactatatccccccacccctttgaagttgttgttttgttttgttgttttgtttgaggaagcatcttgtctggagtccaggctggccttgaactccctatgaggcccaaaatagtcttgaattcaaaatcctttatccttcttctatagcctctgaagtgttatatgcaccatgacatcttgttagttctaccttttgctactagtgattttagtattgtaaaaactgagtacttcactgggtgtggtggcacacgcctttaatcccagccctcgggaggcagaggcaggcagatttctgagttcaaggccagcctggtctacagagtgagtttcaggacagccagggctgcagaaaaaccctgtctccaaaaaaccaaaaaaaaaaaaaaaaaaaaaaaaaaaaaaaaaaacaacagagtacttcattgtgaaaattatagtgacgttattaagaaaatgacaactatattctgtccttaaaaggtctcttttaaacagtggtgtatatgtatggaaatgtaacaatacccattattttgtatgctagctaaaaaattaattttaaaaaaaatcttatttagacattgtagatttaaagtaaaagattcatgtgtgattaatgtattagaatctgtcaataagtaaaagagccattcttggcaaatagttgctgacaaaatcaccatttttttttctttaaagaaagaaagaaagcactgacaatagaaattgttattcagggttactaagatttttgtcttgcaggaacttgttttgggggttgtttgtgttttctttcctgagatggtgtctcaagaaccctaggctagcctcaacctatatttagctggtcctcttttctctacctttgaagtgctagggtcatagatgtataacaccatagctctgtctttttacttctagacacacaggttgaccagatgtgtggtctggactcccctctcccccttccattgtgaggtaccatattcagcatattccaacacttctaaaagcaagactccataccaaacagaccatggtagctaatgcctgtgctctcagtcataggaggctgaagcaggaggatggacagttccagagaccttggttgaatggatgaatgggtatcgtccaagcacagagttgcagttactgcagaggctaggcagcatatgtgccaagccccgtgctggctgctatggtgcaccgcacagacctgaagtccatgtatgttctggctctatgtggtaatctccccaccatgactggaggtaaggggctgtgcctatcaatctccactgtaccccacccagcctagacagctgacctcaaaagcccggaagatggcaggtaggtgtgtgcctaaattctacattaacatgaccatagacactttcagtctaaaccttactgttttagaaatggccatttatagtgtttcaaagatttgggttttattgtggttactgggtcttgaaagaaactgttcctgaggtaagcaccgaatgaagcaggcatgtgatcgctttagattatttcagtgtgaaatttctgtaaaaaaaatacacaagtttaaggtaggcatggtggcacacatctttaatcccaacaactgagtagatggagggagacggatctcttcaagttcaaggctagcctggtttatattcaggagtgctcactctagataggtaggtaggaggtagggaagtaggtaggtaggtaggtatctctgattcaaatgtagtcaaatataggcaatctgaattctaacttatccacgactactcagacctgagaactgttacctgatcttatgctaaataagaagggagtctgtctgagagttgctgagagggctgctggtttgtctgtcttaagtctcctcaaagcccagcaggagcccttccagaactagatggtcagtggctgtgctggaggaggcccctttcaggctacaggcagagaatgacaatgtcacacatatcagggaacattattcctcctgatgttaagaaaataactctccaacagaagtcacatcttaagtgataattgggtgggttgttttgttttgtttaattaaagcttcaaagtaagattaaagattgaatttaggtagaattagcattaatagtcaatcttttctgtaatttataacaagaaaaaaaaagtgtccccaaagttatggttagattagttaaatattgtagtaaggagagaaatccatggagacctcaggataataagcaggggttagcagaaaggtgacactgttcatttctgtgacatttctggctaaacaagcttttgtagacccactgggaatgtaaccactatttccatgggaaaataaattccaggttccagacaagtaatttagagatgttgtggaacacagccactaataagtttagacttgtgtgctccagaggccccatcgcaccattgtgatagatagccagagttcagcagtaaggggaaatggggtaaatcgactcttacagataaaatgaagattaactatgatcatagctcagaagagaagactgtcaaagaccgaaaccaccatagcacagaagaaaggggaaccccagtgactcagatcagatcgtcccccttactctgtatgtagtgctgctcctaggtgtcacatgatataatagatatttgtgctttgttttattctgtttgttttgttctagtaagagagacaaggcctcagactagtctggaattaacactgtaaaccagactggcctggaaactgtggcagtccttcagtcccagactcccaagtgttaggattacaggcattcattagccatcatgtctggctttattttagacttagaaccagaaggaggaacagtgcagtggctcacttgctgcactaccctggcaacctggttcaatccctggcccccagataaaggtgataggagaggtctgactgcaccaagcagccctctgaccctcacatgtgcatgcaccgtggaactcaggccgctgccacacgataacgaataattctctaatcagaataggaaagtgatgaggccagagccttctgtttgcctgctactctactgcctcttgttgtgcctccatttctgacttaaggtgacagggcagagcgttgcccagcatacccaaggcctagagtttggtccccagccctagtttaaaaaaggcttaatatagtgtgtctgcatgtgcttctggactagatcaaaaacagtgacaggaaacactgctgctatgttgataaaatgtgtggcatcaccacacatgagatagatagatacacacacacacacacacacacacacagttgctggcagcactaaatacatccatgggaacttgttggctaatcaggatatgtcccacctagaacatctcgtcaaaatgtagtgtgaccatgctattatattaagatcaccctgtaaaatagacatgaaggagctgacaagatgcatggaatcatgggggcgggagatgcaatgcaaagtttttttttcttgtggaaaatcaaaataaataggtgttgtgtgttgtagtttaactgtgaaatgccacaccctatcttacactggccttttttgcccactgatgaccttgtaggaagtgattagatgataaggcttcaggatttgtagatggattgatccactgatagttgatcgtctgatggcattgttgagttctggttggaagaagtgggccactgatgtgtgcctttgagaaatgtatcttgttcccagcagtgcttctaggttcctgcttcctggttgcctggaggtgagcagctttactcctgtatactcatctgccatgatgctctgtctcaccatgacctagaaacctctgacacagtgagccaaaataaatctgcccaccctttcagtagtttctttctggtatttggcacttcaaaggaagtctaaacacagctgagttgatactaaagtccataaaagaagattcttttttttttttcaagatttttatttaaatgagtacaccatttctgtcttcagacacaccagaagagggcatcagatcctgttacacatggttgtgagccaccatgtggttgctgggaattgaactcaggacctctggaagagtagtcagtgctcttaacctctgacccatctctccagcctagaaagaagattctaaacattgtttacccatgagtcaaaaagaatgtgtggatctagagagagatgtgtaagaaagaaggaagtgctggagagagagaaggagaaacgaaaagtgtcaggggtgttttgtttatgttttttgctttatttggagacaggctcatatagcccatgatggcctagaactctgtagccaaggttagccttgaacttttggtccttttgcctccatgtatagactcctggcatttcaggcatgaaccaacatagccagttcatgcagaactgattgatgataggaccctatctccccagcaagtcccagtcaaaataccttattttaaatattgacgcaagtggatttaaagggtaactttttttttccccaagttttgttgtcactatagatggctctataccataacaaaaattttataagcctgtctttcgttatacaagtttcctttaaatcattgggtgtttgggggtggcagatgacaacacatgatggggacccaacctttcaactgattaaataaaagtcgatcttcccacagtcacgaaccatctctgtgtccacaggagttgtgtgtctgttctaaatgtatgaggggcagttatgtaatttactaccaacagaatttatccttcaaatgtcatgtcgcaacaatgggtcacctccgtttgtggtaggacacacaggtgcttcctgttgccctgcccaggacgatgttaacatcaacctcagagaaggccgttggaccagcctggagccaaatagtagccactgtgtctgtattgaggaggtagggagaactgtttcttaaaatgtatttatttgtttctggttttgagagaagattatcacattatatggctctgggtagcctgatactgtgtaccccatgcaggctgcaaatcacagtaacccaacttaacttgactaacactgaacccagagggaagtaccactgtgcccaagaacaggattggagagctagcccagcattaagagcacaccaaaggaatccaagcactcacatagtgtctaacaaccgtctataactccagttccaaaggatccaacacgcttttctgaccactgtggacaccaggcaagcatgcagtatacagacatacatgtatgaaaaacacctatactcataaaatataaacaaaatttaagagcaataaatctgagtgctttatacaacagtagttactagtggtcaggtaagttatcacaagtaagtgtgtcgacccctgagataaactaagaaaacaattcatggcagccataacggtgcacactcatatcccagtatgaaagaggctgaggcaggctaatactgtgagttcagaagttcaagaccagcttggccaacatagtgtaactccgtgtcaaagtaagaagggctgaggatgtagttctcttggtagtgtgtttgcctagcgtgcataaagccccagcactgtataaacagagtgtagcagtctgtacctataatcccagccgctaaaggcaagatccaaagttcaaggtcatcgtcagacacacacacacacacacacacacagagactgtttcaaactatgtggggttgggcgtgggagaaggaaagtagaatggtgggatgccattctaagaaacaccatgtaactgttctcacaggccatttgtctttttgttgctactgttagaaggaagtttctgtgttcttcagatcaaatatgtatgtgtgtatacataaatatatagagtacatatgtattccaacatgggatcttcattttctgctggaggagtatgctactattctctttcgcttcaagaatatcttagctgagatgagaaaaattaagattctttaaagacatatttattttatgtgtccgagtgttttatctacatgtatgtaaatgcaagtgccctcagaagccaaaaggtgctggtgctggctcctgaggctgcagttagagtagttgtaaggcaaggtgtgggtgctggaaacgaaactgggtcttcaaccagagcaataaggaaaagtgaatgattcttttaagcagggaggaacaatttgtgtatttatcattccatttgctgagctctttgcccaaacaatatttctaatactgttggtcacagtgacacatgcttgtctgtctgtagtcccaaattttctagagacagaagcaacagacctctacagcccaagagtctgaagtctgtctgggcaatagaacaagacccagagaggagggagggagaggaagagagagaaagagcgagaaagcaaaccgcatgtaagcattctggacatgtgtggggtttctcatttcaaccaattctcccaactctctggttatataaccaagtgtcctacagctcagtcaaaactgacgctgtgacaccagttaccagggcttattatcagaccccacagggttagtggctcagtcacacaagacaaccctcacttcaggtgctagttcctagtatcaggtcctcaggctaccccaactaacatcccacgtggccaaagtgaggttgtcctacaacctctagtttaaagattagctagaactcattatacaaacagcaacactcctggtttattacagagtctaaccctggaacaaccaaatggaagaacaagatggccaggacactgtggaggtgctggagaggcacggggtttcggtgtcctctctggacacatcaccctctgagctcaggtgtgtggcctccatcctggaagcttccataccctggcatgtgggatactgatggccaggcacgtagacatgcttaattattaactccatctcctcccctcttccttccccgaggccatggggtaagcaaagcttccaggcctctgatccaggtttggtgtgtctggtctccagttattcctaagttgtttggggcaggtcaagagtcactcattagaaagatactcttttgacccgggaattccaagagctttcagaagtctgtggaccagggacaatggccaaatatcagcacaggaggcacacacatctgtcatctggaagttatgtggaccagagaggctttgtgtcaggaagcaaggataaagagcatggatacgtttcttatacaatatatacagacacactatcttgaaataaagcaagaagcagtcatctagcgctgggactggagagatggctcagtggttaagggcctagattcagttcccaggaccacgcagaggctcagtctgtaaccctagttccagaggctctaaggggggggggggggagcacagtgatgatgacactgttacgtctcctacccataatggactagtaacgctttttttaaaattgccttgcaaatgtattaattgccctaattttcacttttggattattctcattaacaggtactcttttttttttttgttttttttgttttttgttttttgagacagggtttctctgtgtagccctggctgtcctggaactcactctgtagaccatgctggcctcgaactcagaaatccacctgcctctgcctcctgagtgctgggattaaaggcgtgcaccaccacacctggctctctattttatttgtgtgtgtgtgtgtgtgtgtgtgtgtgtgtgtgtgtgtgtgtgtgtgtccttggcatgtggaggtcaaagggtaactttaaggagtcatttttttcccaccacataggaatcccattcaggtgacgaggtctctgtctttccccactgagccatctcaccagctattggctaagagtatgtcagcacactacaaacacttttgttttaagaaggaaaatcttttactgggtctcatggcatatactttttttttttttgagacgcgtctcactatgtactctgggtagcctcaaacttgctatgtagaccacactggcctgaaacccatgcctcttgcctctgcttccccggtgtggcatgcacttttaatcgcagctcagaggcagaggcagaggcaggtggatctctatgagtttgaggccagcctggtctacttagtgacttccaggctagccggggctacaaaaatacaacaaagaaatgctttcttttcaattacagatagtgagtatgtgcaggtgaatgctggtgccctcaagggtcagaatcccctggacctggagttacaggagattgggagctgccctgtgtaggtcctggtactgaatgaggcctctgcaagtgcagcaggtactctgaaccactgagccatctctccagtccctgtaaatacttttcatcttaacatctggaaggaccagcaagatagctcagcaggtaaagacacctgctaccaagccacatggcaaaaagaaaaccaactcctcctgaaaattgtcatctgacctccacttgtgtgccacggtgtacacacacaaacacacacacaagatataactggtgtgttcctgtgttttgttagctgtctatcctcagagctcctcagtttcacactctttccttcccagcgactcagtccttcctgtctttcctgacctcagcactccggaagaatactgctcttaatttgatagaattggtactttggtgtttttccagtgttttttgtttgtttgttttcatgattagatgaaggttggtatattttttgcaagaatctcagatgtaatgacctgtaggtgatgtcaatgtattattaataagtatatcattttctgtcacctccataacaagttaccacagatttgctgtctgaaagcaacacccatttcttatctcagcttctggtggtcagaactatgagtaacttgtgcaatgctaaaagttcctctgtgggttggacagccttctcatccaggttaggtacttgcccgttcctttctctaagctactaggagatatttccataggattgccacatgaccgccatctacaaaggcagcagctgttcctgcaagcagacctcacactttccctacttctagactcaagtctgaaatgttgcataaagttgggcatatggcacatccctgtaatcccaccgcctggaaggcagcctgaagttaaggactgctgcaaatctgagtccagcctagagtacaaactgagaccacaatgcgagaccctatttcaaagaaaggaagaagatggggaaagaggaagggagggagggaaaatggttgttttcactggtggtggtgagccacccagtgttggtgctggaactgaacttgagtccccgcaaaagcagtacaagctctcaaccactgagccgtctctgccacatggctttatttttttatttaaaaaaacaaacaaacaaacaaaaaagacctaagaaaacaaaaaaaaagaaaagaagaaagaaaaaaatagaaaaacaacaacaaaaataaccctattaatcataaatggaaaaaaacaagtttgtagtggagaaagcagcattttaactagtggtcagtgttatcatcactagcaaggttggtaaaattctggttgccctgtataaggatgatgggtggctcacaaccatctgtaatcccaagtccattggatctgacaccctcttctgacatccttgggcacacatataatatccattcaggcaaacacgcacattaagcaaaatcactttattctgagtaagtcacaaaaacatcactgagctggtaagaagaagccacttaagcccagttccaaactacacatcttggtgaacttctgtatagttacagtggtcattctgaagaaaaggggctttgcttaggactttacacattttatttatttatttatttatttcaagacaaggtttctctgtatagccctggctgtcctggaactcactctgaccaggctggccacaaactcagaaatctgcctgcctctgcctcccaagtgctgggattaaaggcatgcaccaccactacccaacaatatttattttatgtatatgagtacactatagctgtcttcagacacaccagaagtgggcatcggatcccattacagatggtcatgagctaccatgtgggtgctgggaattgaactcaggacctctggaagagcagtcagtgctcttaattgctaagccatctctcctgctcagggctttatactttactactaactacattttgtatttaatcttggggttcttgcataattaagttttttgagggagatatttgtgtctatgcaaaggttctgtttctctacaatatgtctcttttcttatatgacatcactatatggtcctttcttctatgtgctaattatgtgcgttctgctttgtcgtggagacttgcctctgatgctcagtctgttgtcagcctcccaaatgctgaggttacaagtacatgtctctacacctaccttaaattatcacaagtttaattaatggcctaagccaacacaaagtgtattgtcttgtcattctggaaacaaagctccaaaatagtatttacttggctaaaatgacgccatcagtaagaggtgtggtgaccaccagccaccgtgcatactctactacagcacacacggtttatgctggcatttggtgggaggctattctagtcaacacaacagctagtcctagccagacagaccacatagttagcctccatctcaaaacacgcaaacaataacagagaatcttaggaaggccccactgtacccggagacagccgggataaccccagcctttctcctgtcttcatcgtgactagattctctctctctctctctcttttttttttttttttttttttttttttttttttttttttggagacagggtttctctctatagccctggctgtcctggaactcactttgtagaccaggctggcctcaaactcagaaatccacctgcctctgcctcccaagtgctgggattaaaggcatgcgcgccaccacgcccggcttgactagattctctggtctctttctgactctgatctagatggcttgctctaaggtctctggttctgttaggcccacttggataatgcagggtcatcgtccccattttaagaaacttaatgtattaacatgtacaaaatgtcttttgctctgcaagcctgttcacaggtccagccaaacatgacacccttgagaggcactactctgcttcccacatgaacatatttggactaatgagacaactgaccactctggcataaagctgttttgttctgcttaagctcaggcttgcactgtgtcatcatgccctgcttagaaagtgattcttttggttctgtagattaaactagggattcattcctacatggtagtaagtactctacactgagaataagctccacgctcttttgcttgtttttctttaaatagggtctctgtagggatgaccttctgccatctgtttccacctcccaagtgctgggatcccaggcatgtgctgttataccccatgcatgtggtgctgggaaccggactctgggcttcatacatacaaggcaaacgctctgctgggcacctctaccttgttgattgtgttttgtttgaagacaggttttcactctagtccagattacactagaactcccgatggcctcaaattcacagtaatcctcttgactcagccagccaagtactacgatcctgtatattaatcatgaccatgcctggtgcttttaaaaaaactgtatgtgtacacttgtctaaatccttaataaaagcaaatgtcactcattcccccctggcaggacactggtttcaattctgtcctccagcaacagtgaaaactgtcgacccatctgtctgtccccctctttcatgtttgtcagtggcacagatttttacccagctgtaaaagcaatgattctcatccaccccactgtgctgctctgctgtataaagagtggtttataaacccctacacgcatctctgcctgggaattacatctttaaagccacatacagaaagttaacaatctaagccaggtgcagtcatgtgtgcaggtggctgcattgacccgggaagccagcacaaaaggttcacgtaagctgaagatctccaagtcacactaggcagcatagtaagatcctatctcaaaagaaaatcacttaaaaacaaataaatgttctcagcatactcttggctataatgcatttttattttttattcacttattcattaagtaaatgtttattgaagatctgactctgaaaaagcactgtggtaaatattggtggcaaacagtaagatgtaataaatcataacttaaaatatagaaaagccgctttcagtagcttaatctcaggatcattggagtagataaagtaaccttcctatgagtgttgcggccgccagcagctcgcaacgtgaacggttcgactgatatggctactcgagctgtaagagaggaatctagacggggcgaaagaagaaatggagctaagacaaattcattctgatcaaagttcaaattttattgttgcgacactagttatgaaggaagggggaggggacccgattcccgccgaataatctctggtccagtagaaagttgagcacgtgtgtggctccgcaggttccagcagtgggcgtggcagaacgaatgagcaggaagctccacccctgagcaagcaggtttcaggctgggggaggggagactacatatgagcagttttaaaagtcaagttcccccctcgtttcaactgactagaaacagggtacctggtgtaaagcactgtgtgcagacaggggtgggggtgggcagtgggagacaaggaccaggaggacccaatgccagcctagagcacgggagatccgctctcacaaacagtagaggctagcagcaggtaacgggtctggctgtgcaggcctggatacctgaagccaatagatagaagttcacaaatataggagagaaaaatataagaaatcagtctttttcaaaagagttcaaagacagcctggactatgtagtgtgcctctgcacacacacaaggaagtcgtttaaggctttctattttagtactgacctttacagtggtcgtattagaaatcaccctgggactagagagatggctcggcccttgctgttgttgcagaggacccagttcaatccccattacccatatgacagcttacaactgtcacacaactccagtatgttctaggaaccagtatggtcttctgaactcagagggcattaggcatgtacacatacatgcagagagagcacatagaataaactaaactttttttttctatagccacaggattttctcagtgtccactttcattctctgaagcttgttttaaattttatgtgcataggtgttttgcctgcatgtatggatgtgtaccacatgagtatctgatatccttggaggctcagaagaaggtatcagatctgctggaactggagttacagacatttgtgaggggctgtcacgtgggggctgggaactgaacccgagtcctctgcaacatcacccagtgctccactgagcaactctctagcccccactctcattcttttttacagatcagactcttgtggatgaatctgtggtttagttctgtaatccaaggtcctcaggaaatgaggcaaggaggttctaaatgtcaggccaggctttgtgagatcctgtcagagaaaatcattttagaagggctagagatacagctcagaggcagaacacatctagtttgggagaggcactgaagtaccccaagaggaccaaaggagaagggaaaccaaagtggagttcctacagccatccctggtggtgtgcaggtacatgcattatcactcctgcactcaggggcgtgagacagaaggaagtgtcacaagttctgaggacttgctatggagccaaggataaccttgaattttttttttttttttttggtttttttgagatagggtttctctgtatagccctggctgtcctggagctcactttgtagaccaggctggcctcgaactcagaaatccacctgcctctgcctcccgagtgctgggatcaaaggcgtgcgccaccacacccggctcttgaatattttttaaagcgttttaatttattttgttatgaatgttttgcctgcatgtatatttgtaggccatgtgcatgcctagtgcccacggaggtcagaaaaggacactgggtccctaagattgaagttacagatggttgtgagctaccatggcacgctttgctgggaatcaaacctgggtcctctggaagagtagccagtgctcttaaccactggaccatctctcctccctctaactctgaggacctggaattataggcgctgtattaccaagcctggctgatgcttacttacgactaaagatggcttccagagccttgcgcgtgctctgaaaacacatggccgactgaactacttctctagacactacttggtgacattcgacgtacttggattagtaaggcactcctttgtgaggacacttccagaggagcaccagctcctacgtgtggaagaggacccgccttcaacgtggatggctccacccagtgtgtggatggctccacccagtgtctgtgggccagaggaataaaggagaagaggaaagaagccatttctccttcggcttcctggaggccatgaaggaagagcactgtcccaccacaccttcccagatacagtggactggaaacaaaatcaaaattgaattttcctctttagttgtttctcgggtatttttgtcacaatgatgaaaacgtctaacaaaatgatagtagcttatcaaccatagaactagagtttccatttagagaactgatcctgcggctttctctctgagcacatgaatgatggatctatcaccgtgttggcacccagtaagcagtactagatgtcacgatgtcttcaaactcgttcacagcttagtgatttctcccagctttggcagagttgaaaaactgtaatttcaacagacagaaaatacacagggtgaaaatctcagaaatagactaagtgccacacagacttagatttacatcaaaatcctgctaatatgcagaggcgttttttgagacagggtgtcaagtgtcctaggcaggcgtcaagcttgctatgtacttgaggaacaaatgaactttgatcctcctgaaagttgggaatatataccaccatgcccagttttaagcagtagctagtgtttgaacccagggtttcctacatgctaacaagcaccccaccagctgagcctagaacagctttcatatttgctttatttctacacaggagagcgtgtttcctatatggaaacctgttttcctattttaggacctcaacagtataatgtttttcttttctttcttacctctctttgatttgtttttactctctttgagacaaggtttctctgtgtgggcctggatgttctagaacttgctctgtagaccaggctggctttgaactcacagagatccttctaccgctggaatactgagactaaaggtgtgagctaccacatgcctcatgctcttaaaaccagtctcccagtcctacctgtaacttttctcttaatgtgtttgcatttggtgcacttgtgtatacacatgtgtccaggggtcaaggagtacatgtgtgtataagcatgcacatgaaggcctggggttgatgttagggctcttttaccttgctcagtaaggtcaggtttctcaatgaaatctagacctggtgatatggctagtcttgctgggctctgctctggggatcctgtctctagccttctgaggcaggttacaggtggctaccatatccatccagcttttatgtggactctggagatctgaactggggtcctcatccttttgtggaagtcttagtcatctcccaggcccaatcctacattaaaaaaaaaacaaaccaaaacccggaatgagtagggtgtggaggctttgtctatattctgagtaagcagcagctgaggtaggagaattgataagaactcaaggtcagcttgagctacagaatgtgaaccttcttcaaaagtggaaacgaattaaggtggaggagagggggaggaagagtggggaaggaggaggagggaggagaaaggaggaaaagaaggaggaagaagaagacagacagacagacagacagacagacagaccctaaccaggtgtgctgtgatatacctataaacatagcacttgtaaaatggaaacagcagagtcagaagttcaaggttgtctttggctacagagcaagttcaaagccaggtttgggctacatgagaccctgtctcaaaacaaaacaacaaacaaagaataaaaaacaaaaaccagaccaagttcagtatggaatgtcttaatcccagcactccagacaaaggcaagcaagtttcttaggagtttgaggccagcctagtctggtctacaaagtgagaccctatgtcacacacacaaacaaataaacaaacaaacatacatagcataacaacaacaaaatgaaaccccatataatgtgaaaaggaaaaaaaattcacacttgtaggagtctttgaaatttgaaatatagtaaggaatattacttattaaaagttttagaaagtagaaaaccactgggcgtggtggcacatgcctttaaacccagcactcaggaggcagaggcaggcgaatttctgagttggaggccagccatgtctacagggtgagttccaggacagccaggactacacagagaaaccttgtctcgaaaaaagacaaaaaggcaggtgaatttctgagtttgaggacagcctggtctacaaagtgagttccaggacagccagggctatacagagaaaccctgtctcaaaaaaacaaacaaacaaaaaaaaaaaacaaaaaaaattgaaaacctgcaaaaatatgacttacaagtcaaaataatatgtattatttttatatactttaaaatataaaatacattttatattttaaaaattattatttaataatatcttaaaatgtattaagagtttgcgtgtgtgcatatgtgtatgtggtgtatggagacacactcacatatgtgcacccttaaggctagagacactcacatatgtgcacccttaaggctagaggagggtgttgtgtgtcctctctcctgccttaacagctatgaaatatgacctttcactaaccctggaactagcctgatgcgcactacagttgcaatcttcctgtcttgcctacacacaatactggggttccaggtgtgtgtggctgggttatgtgactgctggggattcaaattcaggttctcacgcttactcagcaagtggtccttcccactgagtcaccgacccagcccttcaaaacaagtctgtagggttttctacttgtttgcattttgagtcaaggtcttgctgtataatatcctcctgcctcacctgagtgaatacttgagtgttgagattataaacctgtctctcccataatgcctggccgatgttataatttgagaggttttgggttttatttttttcattctggtttttcaagacagggcttttctgtgtagccctggctgttcctggaactcactctgtagaccaggctggccttgaactcacagaaatccacctgcctctgcctctccagtgctgggattaaaggtgtgcatgaccactacctagcaaaagtattttatttttatgatttatttatttttattgtatgtgctttggtgttttgcctgcatgtattctgtgtgaaggtgttagacatcctaggactggagttacagatggttgtgagctgccatgtgggtgctgggaattgaactcaggtccttaggaagagcagccagtgctcttaactccttagtcatctctccagctccttgaaagtgtttttatgagcatatataactatacataatttacactgggttgctaatgcttacaactgcttttctatcaattttggttatctataaagaaatcaaagttagtattcaaatgaactaagaaactgtgttgtatgacagaattgcattgtataacttactagttaatattgcaacaacaacaacaactgaatgagactcacggagcagtgccaagttgaaatgagtcattggatcggtattatggtgattgaatggggaaagttaacaggtatggtaactggtccagaagaaaaacatgactgtttggtttggtttttcttggagctaggaattgaacccagagccttgactatcaaggcaagtactttaccaggaaataataataaagtacagcatagttaatcaaagttaagaagaagttgtaatgataatgaatttatcatttggattggaaagaaaaggataaccaacatctttgatgtgttagcttgatgaggagtaaggagaggtctaagaactaactatgggccttagataatgaatggtagggaatggatgtgtggatcctttttgccatctctgtgtgttagtaccaggacactccaagccccggcctaactatgtgacccttgacctacattgctaggacaacgaccctcaatcccacaacccatttggctcagttcccaccctcactggcgtgacgtcattttccatataaattaggggatcaccccctccttgctctcttttcttctctctcttctctttcttctcttccccctctttctctctttttcctatcctctgcccttctacccgctttgccacccccctatccatgcacaataaacctctcccacatggaaccaccttgacctggtctgctgtctggtttatccgctcaaaatatacatagattaatagtatctgatattaattaacatatcactgtgtacataaactagcctgtatcagagactagcagaggcaacttaatgttgtgtaaccgtgctgaatcagaaggcatgaaagaagagttctcaatgagggaggatgacctcctcgtggacagaagagcctatttaatacaattccttgcccagtcccctacccagcaattgaatgcctaggagagaggaacttactctgggggtaagcatttggctcgttctattcaacactggcaccaggcatgaagagcaaagtcaacatcactgttcccatttaaagagcacaccagatacttcctggaatataacactgagtaggcacaatccttacctcccagccttaatttaagctattagcggtaacagcagactgttgtattagaagcagtaaaagcccctagggatctttttggtggttctagcataagttttctatcccattgcaggttgtttctcatctggtctctcaggacggcttcttttgcatgtgtactttacacatatgttcatttacgtatatgttacagcagaacatgagtagaagaaccaagtccagtcagaaaggttacagtgggataagatatgggctctttgctctgggggtggttttggctgctttttgagatagttttgttatacatcccaggctggctgtgaactcatcacatagctcccgcgcctccaactcctattctcctccttcctgtcttagcctcctgagtactgacagtacaagagtgtcctcttatactaggcaccaaatatattaagaattagagggcactagagatgcctcaggggttaagagtggttgctcttcgctgggcgtggtggcgcacgcctttaattccagcactagggagggagaggcaggcagatttctgagttagaggccagcctggtctacaaagtgagttccaggacaaccagggctatacagagaaaccctgtctcgaaaaacaaaaacaaaaacaaacaaacaaaaaaagaatggttgctcttcaataacagttttttaaatgtttgtgggtaagcaggcagaaatgtggccctctgtcccacccaataagctgtgaaatttgaaaaaaagaaaaaaaaaaaaagtggtaagagtggttgctcttctagagggcccaggttcaattttcaacatccacatggtgtggttcacaatgaccctgtaactccagtcccaggaggtctgaggcccttttctggctgccttggccattgtatgcacatggcacatatgcatatacatagacaaaaaactcatgcacataaaaatttagaaaaagattagatatttcctttgatatctaatgatttacacaacatgtcggattttcctaaaatcatgctgtttgtcctactatctgattatgcactgggactctgtgtttaccaaagagtaatgcatgttacaagccaatcctaagttaagcacagagtagaaaggtacattttagatagatgcttatttatttatttatttatttatttatttatttaggtagaagctcacctcagtctcccaagtgttgtgattacagctgtgtaccaccactactggccatgattacttaaataatctatgagatggcaatatgagtggggaatatgagggaagcacattagagggaagtgaccagagacgctgcaggtgaaactgagacgagggagatgcctctcccatctacagagaacaaaggtttgaaaagagagagtccaaatatattaagtacaaacagttggccagtgataaaggctgtggatgctagaggacacattccagttactgaaaaataagcccaattgccaagggaacaaaactgtccgggatacttatcccttaactgaccattctctgaggcttgcagatgcaaaacaagccctaccccacaaaaaggcttggctgtgtacttcctgctaagcaaacaaaaaatgtccacagtatgcatggggaagctacaggaagtgaccctattattatttatatatgcaatgaaccacctcagataaaacaacttcctctcagcattgggggaaaaaagggcttaaaatttgtttattataagcaggacatgatggtgcacacctttaattatagcacttgggtgatggaggaaggcagatctctgagttcaagaccaacctgatctatacagtgagttccagatcagccagggctcaagaaaacaaacccaaaacaaaacatttatttgagtatgtgtgcaggtgccatggactgcaaatggaggtcaggacagctttcaggagtcagttctctccttccaccatgagtgtaatacacacacacacacacacacacacacacactgcagttaagtccaataaaatggtaatggagcagcttcactctagaacaggagggaccctaagggctttttccagccccacaccctccttccctcctttcagcttcctcttcccacctgaggtcaagggtcaaggctaggccaagttccattctccacccaaaggaacattcctgagtaaaaaattctcagaatgtcctgacagtcacctgaccctttggaaagtcccaggtagagttcaaatgcgtgtcatgcttgctagccaatagatttaaaggtcaataggcttagctaataagtttgaactgtaaccttgctgatgtaacctgtgcccctaaaaagtataaaaattgcttgtacctgggcagtggtggcgcacgcctttaatcccagcacttgagaggcagaggtgggcggacttctgagttcgaggccagcctgatctacagagtgagttccaaggacagccagggctacacagagaaaccctgtcttgaaaaaaaaaaccaaaccaaaacaaacaaaaaactgcttgcaatagccattcaaggtcaccttctcatcacttacctccaggaaaataaacttcttgcttttgcatcgatctgatttgcatctcgaaaggggcatctcgaagtaagtaccaatgtccaagggttgcggtcttacatatacaaactataatgttaagcattttctctgaggagtatcactttagttaagactcatgttgacctgtagtaacccagatcacacaatcggtaagacacctaccagaaaaccatctcctgaagccaggtgtggtggtacagacctgtggttcagcatttgggaggtaaaatcagaaagactggaactttgaaggcagcctgggctacaaagtaagactttccttgggaaaaaagagatcaaaacaaacgcattttttttttttctttagatctatttaaaagattaagactggagagacagagccggtcgtggtggctcacacctttaatcccagcactcgggaggcagaggcaggctgatttctgagttcaaggccagcctggtctacaaagtgatttccagggctatacagagaaaccctgtctcgaaaaaccacaaaataaaaaataaaagactggagagacggctcagtgctaagagtgcctgctgtacaaccatgagaccgagtgtccgtccataggctcagtgctgtaggggtgctgtgggggtggcgggagacaaaggactgatgggacttgctggatggctgcctagatgcgcttctgttttgggaagagactgcctcaaaggaacaaggtaaagcagattagaggacaccttgtagcatgtagttttaaaaaatgaacccaagctaaatccggctatgtgccaacatcagcggtctgtctaatcctagcctagtgcatagcccgagaccatgtatttcttctagccaatgcctctctcataaacactatctctgcctctcccgcgcttcaagatcgctctcttgccatcccactacactccaagggagagtggagctcggtcctttgcccaatcttcccgttccaaagcctggccgaattcctggctatgctctttccctgctgcccacctgagctgccaagaatgaaaaaacaccagacaatcgtagtttaaaaccaacagatgacacaactgctgcgcgcaaaatctctcctaaactcatcaactattctatgttgggaatcttccggtggtagaggtcgccactgggtctaacagatcccatctacatcctgcctcctttcgtccccacctcgctctaaaaaggcgtttgtagccgggcgtggtggcacatgcctttgatcccagcacttgggaggcagaggcaggcgaatttctgagttcgaagccaacagccagtgctatacagagaaaccctgtctcaaaaaaactaaaaaaaaaaaaaaaaaaaaaaaaaaaagctaagagtggcttcaaccttatcctatactcgcctagggatttgcaggttttatactggacacaagagcaacaaagtttaatatataagaaaatatttataggcgctaaattgaaaatatttcattttataatctatattgttttcatctacatacgtacctaagtgtggtacatgttacatgtccacagtgagtgactattcttttcttatagtggtgttccaggatggccttgaacacaggactgccccaccttgcattaagtgtcagatgtgtgccatacctgctccatgttgacatcttacacctttttttttttttttctttcgagacagggtttctctgtgtagccctggctgtcctggaactcactctgtagaccagactggcctcaaactcagaaatcgacctgcttctgcctctgcctcccaagtgctgggattaaaggcgtgtgccaccatgcccggctactatagttttttaattgttagcttaactggtggtgaggtgagtctggttctaacagactaacagtctgttatcaaatgctggcactgacacaaatacataaatactcaggagttttgtctacttcaatacttagtatatggttttcttgttctaaacgccctgtttagttttgctctctgaaaccaagcatagtggcaaaaatctataatcccagcatgtaaagagacaggaagaagaatcaatggctaagtccatccttggctacacagtgactctgaagccagtctgagatatatgagatcttgtcacaagataaaacaaacaggaaaaatacacacacaccacacagtaaattatactaaaagtgttaaaattttcatcaaaataaacaaagaatatctaaataataaattaattttcataggctgtggcagtaagcattgttgattgggctaccacaggagaattcattaaatttcttagaacctgagacaggaaggcttttgttctttttaggaaaatataaacaaagtagaggtcatataaagcatgattattgctcagcctaggaactaagtccctgacacactcagatggtgactttccatccaagatcaaggactctctcattgcagcctctggaagcggtaacatttgagtctgcctttacaatggagccctcagttactaagcagactgaacaccagctctcaggaactagccaaaagttttataaactttctgattttactgtggggttattgtaaggtgggagttataatttttatccacagcttacaaatgaagaaacaatgtttaaaaatgttcaacacttctaaagttaaataagatctgatttggcaagaaatacttcagtaagttatccataactagcatgcagtttccctcttctgatggaaattttattttactcttagaccattctttacgctttacaccattcttgccattagtatctaagtgtatccttagtttctggaggacagtccaaagatgtatggtcagcttaggcatacctaggtcctttcctgagtatccacttcactgcagactactgcgggaaacacagagctgggagtcatatcctctcgaggccagcagtgtggagtgctgaagaatacgggagggaggcacaggaacaatgtactggacgcaaactcttaacataaagaatttatactttcaggcagctaggagttttagtaagttatccgtaatcaatcatggtggcccaaccatgtagtaccagctttataggaggtatgtgctgtggtttgaacctagggccacatatatgttccttcactgagctatgtcctgagttcagtgtactttaaagtatatatcttcaagacatatcactaacgacaagtatttctgaaaaggttaagatgacaaactttgtacaattattttgtgtgcgagaaagggaacctagggcctcacatacactaagcacactgtccaccaccactcagccagccctgaaccacttctaaaggactgatggcacactactactctaaaaccattttattcttatgccaggaaaatggtgtcctatagttggggttttagtgcaaagagaaagaaagaaatgagaattacaaaagaagagagttttggggaaagtgaactaaaaccctgtgctgtgctgaggatgcactggcggaggagcactgcccagccagcctaggccctgggttcaaacctcagaactgcaggtaaaacaaaacaacccacatctttaacttacttttggatcatctcccaagttaataataaaatgttggggtttttgtttgtttttaaagatttattttgtgtatatgaatacactgtagttgtcttcagacacaccagaagagggcatcagatcacattgtagatggttgtaagccaccatgtggttgctgggaattgaatttgaaagagcagttagtgctcttaaccactgagccatctcaccagcccgataaaatgtttttctttaattactttttgttgttgtttttttttttttttttttttttttcgagacagggtttctctgtgtaatcctggctgtcctggaactcactctgtagaccaggctggccttgaactcacaggaatctgcttacctctgcctccttagtgctgggattaaaggggtattccaccatacccagctttcgacaggatcttaactctgtagcccaggctggctatatttgtatgtgtagaatttgtaggattcatttcctcctaccatgtaggttccagggctcaaactcacattagttagagttggcagcaagcacctttacccattttgagccatcctgctggcccataaatcttctgcataaaatgtggagactgaatggaagatctgtgttgtttccttaagcttcaggggttgagtctttagcctcacatatgcttggcaactactctaccagtgagctatgtccctagccctgaatgatctatgaaaataaaaaaacttcacactttaatatcagtgtttttaacatgaaagagaaaatgatagttttattaaactagttaatgcttgcacacaattacatacattttaaactgccaggatttttgataagtacaataccattttcggataagcatagtataactttaaatattacatcattcagactcatgttggaaaacattaacttataagggattacagcaatgtccatttactgtctgtagcaaaaagggtccctgttagatgtctcagcatatggacggctcctctactgcctgagcgccctcggtgacagctttgacacacttggccattgtctgtgaggctctgctaatggagtctgaaagacattaagagcatgcattttgttaatacaacttcctttgttgtttttaaaacaatgtctcagatttcaggccagcccagaattcaatagtataccaagttagcctcaaatctggggtgatcctcctacctcaaattcccagggaagagccactaatgccatttttttttttttgttactgtgactttagaacacacggagaattttaatgtacacatgcaagaacaaaagcctgtgaagctggaacgcaactgtaggtaagcaataagccctgaacataagctctttactgcccacggtttttagttagggtcttagctatctctggctgtctatgaagccaaggatgaccttgaactttgatctgtctgcctccacctcccatttaccacaactttctggttatatgtttttagtctctagcagtaattaaataatcacataaaaactagattacatgacagtatgaaaaattaaatgataggaaattctttaaaaatctaaggaaaaaaatggacacaatatgctctgcttatcagatagatgttgtagctcacactcatcgcgctccagcacttcacaagatgaggcaggattgctgtgtgtctgaggtcaacctgggcttcaagagatagaatcatttccaaaaaaacccaaaaaccccaccagaggctggcatgatggtatggctggacaagctgagtttgatctatatcccaatatagaagcttaatgtacaggcacatattagtaatcacagccctctataggatgagcaccaggaactaagagaatcaccctgtagcttgggttagctagcctggaatataaaacatcctagagtggtagggtttttctgtatccacagcactcaaagaagctgaggtagaaggtggtaaattggaggccattgtgggctacataagaacaccttcccttggggactggagaaatggctcagtggttaagagcactgacttgagtgctcttctgaaggtcctgagttcaaatcccagcaaccacatgttcgctcacaaccatcagtaatgagatctgatgcatgccctcctctggtgctgagttcagcaagtagaggtcctgaactcaaattcccagcaaccacacgatggctcacaaccatcagcatagctacagtgtactcatatacataaaataaataaataaatatttattgaaacaaaaaacaaaacaaaaaccaaaccttctcttaaaaagagagccagacagtggtaccacatgcctttgagatctctgagtttaagtttagactggtctacaaagtgagttccaggatagccagggtgtcacagaaaaactctgcctcaaaaagggaaaaaaattaaaaagctcaatttgtttgtcattcatgtcttgctatgtggcagaatttaatgttgaactccttaatctcctgtcaccaagtactgagactccaggtgtaacccaccatgagcagaaaacccgccaatctttgaatgcatgtaaatcttcctgcttccagcactcacaagtcacagtactgtttcactgtagtttgtgcttggttgtatagtgtacaatgactccaacttgcatttatttttaaaactgtttggaaatgtatcattggtgtgtgaatgtgagggggtatgagcatgtccagtgtttgtgtggaggtcagaggacaacttttgggagttggttctgctactgtggggtccggtttacatcacaagcttttacacaataagccattctgctggatctgatcctaacacttctatcacctcactgaaataaccttactagtacatgctaacttaaagatgtataaacacagagtctgaaatgttaagatcatttgcaaatcttgcagagggctgggattatgttcctaacacctccatagaggcttacaactgtctgcaactctagtcccaggggatccaaaaccctcttctcatctcctcaggaattagatacacaaatagtacagaggcatgcatgtaaacaaaacctatacacattttttaaaaggtaaaattaaacatcattttaaggctcataagatgtagttcagttggaaaaatgctgcactagcacacaggaagccctaggctgggtctccagtaccataaaaattgtggtggtgcaggcctgtagtctcagcacttggcactgtgagaaagaagagtacaaattcaaggtcatcctctgctttgacaagatggttttaaggtcaccttggctacatgaaacccagtttttaaacagggggggggggggggcccgcagagagatggctcagaggtgaagagcaatgactgctcttctagaggtcctgagttcaattcccagcaaccacaaggtggctcacaaccatctatctgtaatgggatctgatgccctcttctggtgtggctgaagatagtgacagtgtattctcatacataaaataaacaaaatctttaaaagattaaaaaatagaaaaccaaacaaatttatgctcctatgtgcttttaggtaagaaattatttacatatcaactgtctcatacctttatcaactgttgtcaaagttatagaaaatgaatggtgatctgcatttcttaaaagcgttctaacaatttacaccagaagccctgtttaatatattaaaaaatctttaagtattctgaatattctatcaataattttcagaaaaccttgagagtttttttagtactttaaatttctattcattgatttttccatatactactaaattttacaatttaaatctgttaaaccttttgggtgttcaaactttgctttcatgtcagaaacacacagaatgctagaaagctaggggtatagtgcccgtgcttaacatgtacaaaatgagccttgacacccagatctaccgcctaaattacattagctttgatgtctaacaatgtcagaccagaggctcctgagatgtcctcagtggacaagggtgcttgttaccaagcttaatgacttgagtttgattcccacaaattgtcctgacctccacactcttcatggtgagcgtatgcctgcccaagcacaagtaaataaatataaaaaaatcaagttctttagattaatagcaaatattgccaaaccaaaaaaagctatgaagctaaaggattctctgattctctgtgagtaggtagcagtcaaacttacctgtcatatagaagtcttttatagttagctgaggtggaacgagtgggtcagcaagaacctcctggtttactagctggaaagagagagagagaccagaatcatactgaaaaccagtactaccatgccaagatacagcacattaggaaaactgcacacaggcaagtttttaccttggcaagctcacttgcttgctgaaagtaattagtttcttcaatatcatcatatcgaaccagattaggagagacctcttcaagacggttccttacttgatccagagtgtcatatggaagagtgatacctgcaatctacaacacatcagattcaccatgacaaacaactttactacttaaaaaatgtcagaattggggcaagccaggatgactcaagacatcaggcatcaagtctgaagagagtcaatcactaggacccacacagtgcaggaagagaacagattccctcagagccctctaaacctccaaatattgttgcagcacgcacagcccatggcccaatataataaataattgttgtttagcaggctgagatggcctggatctttaatcttagcacttgaaagacagaggcaggcagatctctgaatttggggccagcttggtctatagaacaagttctagggcttcaaagagaaaccttgtcttgaggaaaaaaaaaaaaaaaaatcagggttggggctcaatctccagcaacaaaaaaggaacaaaacaattcataatggaaactatgataaaataactcggtattactagaaagaaaaaagtcttttagtatattttagcaggcatttttttcctttttcctttcttaatttttttcctttttcctttcttaatttatctgcagaatgttgctctgtggtagagagaatacttagcaagtatatggtcctgaagtaaaagatcacagagacgatgctaggctaactatcaatgcttcttgcttgatgttaatctacaaggaaagtaccaacttcaattcttcatttttctgaacactttatttcctacacaaccaggttatgccactaacttagccttaatgaatgaaatcgtagttcagcggtggaggccctgcctagtacctgccgaggccctgggttctgtctccagcactacaagctacatacaggaatttattgaacttaggacttcttcgtgcatgctaagcaagtcctctcccaactgagccacatctccagttgcttaatgaatattaaggaacaaaaaaagacttcaaagaaatgcctcaaaaataatacctcagagagagctcttatgattttccagtcttctcgtgccaagccaggaggcgtcactgctactttggtttgctgagctctgccctcagtattgacataagtagcagacttttctgtgtaagcagcccctgggagaataacatcagccatgggagcaccaacatcaccatggtgtcctgggaggagaaaaacagtgaaccatattttagtaaaaactggactgggctggagaaatggctcagtggttaagagcactgactgttcttccagaggtctctcatttgttttgtcaagacaaggtttctatgaaaaggcatacactaccatgcccagccactttcatagtttataaagtgagactaagagtgcagttcacttttaaccccaaattctcgggaggcagaagcaggtggatccctgagttcgaggccagccaagtctacagagtgagttctaggacagccagggctatatggagaaaaaaaccaaaaaaagaaaaaaaaaaaaaaaaaaaaaaggtagtttagtggtaaattgcatagtttgcatgaccatcataaataaaaaaacaaataaataaataaaaatggcaattaacaggtggtatactgtcttcccatataatagtagccagtgtaactcctactgatctcaaggttctcctgccttgatccccgcactgggaatacacatgtgtaacactactttagattttatagtccagttttggtttttttaaaagatgtatttattatatataagtacattgtagctgtcttcagatacaccagaagagggcatcagatttcattacagatggttatgagccaccatgtggttgctgggaattgaactcaggacctctggaagagcagtcagtgctcttaaccactgagccatctctccaccccacctatgataagttttaagaactgcctcaaactctttgtcttcccatctcatcctcatcctgggctaggatcacaggtatatgctactcctctggttaacaaacagattttgtttcttatgatttttaaaataaggtttattatttaaaaattgcaaataaaaaagtcaatattgggactggagagatggctcagcggttaaaagcatctactgctcttccagaggtcctgagttcaattcccagcaaccacatggtggctcacaaccatctgtaatgagatctgacatcttcttctggggtgcatgaagatagataccgtgtactcatatacattaaataaataaattaattaaaaaaagtcacatattcatgttgcagacccaaagtatatacacttcaatgaactgctatatagtcagaacagttattcaaaacagaagctgtgtatatcaaacacctcttagtatgcatcaggtatgattctcttttgtttcttgttttgttctgttttttcgagacagggtttctctgtgtagccctggctgtcctggaactcactttgtagaccaggctgtcctggaactcagaaatctgcctgcctctgcctcccgagctctcttttgtttctactgccaagttgctacttaccttgataaacaatgaaacaatcctttggcaagtcctgtcgcgtgatacaacctccatctgctcccagaagaaacagcattttgggagggttcttcctaatcgcttctaccccaggtttatagccaaggtccaaagcagctacctggcttgcaatcctgtaaaacaattatggattttcaaatacatgcagcatttaagtataagcaatttgagtaattacataggaataatttgtagcttcttttatattcaactcttttttttttttttttttttattttttttttatattcaactcttaccactgaaatataagatgcatagcagagtgtctctctttttctttttgagacagggtttctctgtgtagccctggctggcctagaactcactctgtagaccaggctggcgtcaaactctcagagatcctcctgcttcctgagtgctggaattgaagtcatgggcaaccatgcctggtttctctttcttttcctgtggttttggagactgaactagactcttgtgggcgctaggcaagcactttaacagtgagctactcatcttcctcctcctgaaactgtttttcatgaattaatatgcaatgaagtaactatgaaagccaactgtaaatggcttaaattcaacacagtaagacataaaacttacagtaaatcaaacatgttttagagtaaagccgcaggattttaaaatcaaaagagagctaggtgtggtagcacactaccataatcccagcaaaggcaggaggactattagagtgatgttctgtctgaggccagtttgatagtaaatcgtggattacatagcaagatcctatctttaaaaaggaaaaaaaagtaaaagggggtggtggtggctggagagatggctcagtggttaagagcactgaccattcttccagaggtcctgagttcaaatcccagcaaccacatggtggctcacaaccatctggtctacagagtgagttccagaacagtgagctacacagtaagaccctttctcgaaaacaaaaggaaaacccaccaaaaaaaaaaaaaaaaaaaaaagcagacacagacagacagagagagaggagggaggaggaaggagggaggaggagggaaaagcaatgcaggaacaccattactacacagactggaatagaccctttcagaacggcttcctacaactgtttccatgttttagtgaagataatctaaggaagaagctcacaacaacagcccttctaaaacatgcagagacatgcaaaacagctcttgaaacctctgcctgctttagtccagccattctactttataacctatggacaaggggatctacagttcagttccctgggttattgctgcttgcttacttagcttagttttggagctgagagtggattcgagtcttgcacctggataggtgtgctcgttacaccacgcaattgcaccctagtcactcacatggtggctcacaaccatccgtaacagagatctgactcccttgtctgtagtgtccgaagacagctacagtgtacttacatataatcaataaataaatcttaaaacaaacaaacaaaaaacaagtaacaaacctatgcagaatattcataactttccactctgcagcaacaccggttgtcactcgaatcttttgtaccatgttggacacagctacaagaattgctgctccatcatctctctggagtgcagaactgcctaaaaccaccattggttttttagcatcctttaagacctatttttaaaaataaataaataaataaatagatagatagatagatagatagatagatagataaaaaaaacctgttgatcttaaagcgctatatgatatttgcatctactgatatgcaagtttggggatctaacatgaagaaccattaatttacttaacatctgaattaatagaaacatcttgcaaatgttactatgaaaaagcttagtatcacataaaacagattttatacaagtaagaattaaatgattaggtttcaggccagcctaatctacttaacaaattccaaatcatccaaggctacataccaagataccatctctaaacaaacaaaaagaataaaaaatttaaaatatgacagaaaaaattgtgttgcagtatcatctcctactacttcttatctgtagagatccagacagaagagaaagcagggagagcaacagggcattcctaaagcagggaagagtttgctttacgccacagtaagggagtgagtctcaaggagataggaaactacaggcttggggaaggttggtaagtaaaactgaaaatcaaatagctcacactcgtataaaaatactaagttaaaagagcctgagagacgctcggaagcccttgtagagtaggaaggagttcagttccctgaacccacatggcagatcacagcatctacttactaactctaattcagggtacacaatgtcctcttctgacttctgtagacattaggctggcaagtgatagatatacatgaaggtgggcaaaaaaacctcatacatataaattaaaataaataaatttaaaataataataattaaaaattggagctggagagatggctcagtggttaagaacctgggctgcttttccagaggacctggggtcaattcctagcacacacatggcagctcacaactgtctttaactctagttccagaggatctggaaccctcacaaagacatacatgcaggcaaaacaccaatcacataaaaatataaatctttaaaataatagtaacagttaaaaaccagcaacagtaggtatatattaacttaaaagcacctcgcagaatgaatgcctccctgaagcaatgtcttgcagaattttaggagagtctcctagatggtcgtatctgtaagtgaggtccactggactaccgatgagggccacttttaagtcattatgaagccagctgaaacaaaaacaattttagagccaaataagcatagcctttggtttcaacaattctaagtcctacctctatttacaatcataaaatagcaaaagcacaaaagaactcacagactatttaatcttaacacatataatttaagatgtacctttcaagataagagtgttgtaaaaatgtataaataattcagggagtaaatctgttgtgtggcaatcctaagtaccagtctaatgtaaacaaaaactattttagaataactgacctgtagttatattcctcagtacatgctatgtcagagtcagttatttctcaaatatccacaaaaataaactgtcatttatttattctttatagcagagtactaaggggctacctccttcaaaactattggagtttttaggtttttttaagacagggtttctctgtttagtcctgccagtcctgaaactcactctctagaccaggctggtctcaaaatcagagatcttcctgtctctgcctccagaatgctggaattagaagtgtgaaccactaccgccctgctatccttcaaaactatttgtgagtatggtaagtctaattctcgtttgtctgaagcagtactaattttacctgaagtagtaactcccttccactctcaaccattttacaggtgagataataatctaggtagataatacagttgccctattttaaatgtctacaacacaaatgaaaaagacaatagatgtgggaggtgttctataaaataactagcctgtactctataaaaaaaagtaaaatgtgtgtgtgcgtgtgcatctttaaggaccaaccaaagacctgggatgggggaggctccagggagtctatggagtcactctagctgagactcctagcagtgggggatatgaagcatgaagtggccactcctatagccaggcaggaaccctagggaagtgataaggacaccaatctacccacaaaagtttccacccaaattttattctgtctaaaagaaatgcagagagggggctaaagagatggttaagagcactgactgctcttccagaggtcctgagttcaattcccagcaaccatatggtggctcacaaccatctataatgagattttgtgcctcctggtgtataggcataaaagcaggcagaatattgtgtacataataaataaatcttaaaaaaaaattaagattgttccctgagtttaaaatataggtagccagtttttgttttgttttgtttttgtttttgtttgttttaaaaaaaatgaaaagaaatacaaagaaaggagataagggaaagactgggggaatggccaaccaataaccagctcaacctgagacccatcccatgggcaagcacaaatcacccacactctgatactctgttatgcttgcagacaggagcatgttgtcctttgagaggctccacccagcagctgactcagacatgcagaaacccatagccaaacactggatggagcttggggactcttatagaagaataggaagaaggattttagcatcgaaagagatagaagaataggaagaaggatttcagcaccgaaagagataggaactccccataggaagaccagcaaagtcaactcacctggacccttggggctctcagagtctaaaccatcaaccagataacatgcacaggctgatcctaggcctcctgacacatatgtagcatatgtgcagtttggccttcatgtgggtcctgaacaactggagcaggagctatcccaaaagttgttgcctgtacttaggatatgttctattagctgggctgcctcttctggcctcagtgagagatgaagtgcctagcctcacagagacttgatctgccaggttcagggcatgaaaggtgaggggtggggggagagggggagatacccacaggagccctcatctgctcagaggaggagagggggtatggaagaaggatcgtgggaggggatgactggaaggaaggagtgagcaggaggtaaagtaaataaaatggggtggggggggaaatggggcccgaaatgtcatgacattaattgcaatgtgactctagatagatgctggtcaagaacaaaactgctataaaagatggggctaaggatacaactcagttgacaggtgcttatgtagtatgcaagaaaaactctgaatttaatccctagtaccaacaaacaaacaaaagtcagagggtgggacgggcaagactgctctgcagggtgaggtgcttgccaccaagcctgacaagctcagttcagtcctgagactcaaaggtgaaggagggagccagctcctaaaagctgccctctgactgccagatgtacactgcactagagcatgctcatgcacacacatatacatacataaaataaagtttaaacacacatgcccgtaactcatgaaattacggttggtgagatggctcagtgggtaagagcactgactgctcttccaaaggtcctgggttcaattcccagcaatcacatggtggctcacaaccacctataatgagatctgatgccttcttctggtgtgtctgaagacagctacagtgtacttatctataataataaataaatccttaactggagcaggcagggcagaccgaagtgagcagaggtcagaaattcaaatcccaacaaccacatgaaggctcacaaccatctgtacagctacagtgtactcatatacataaaataaataaaaaaaaatctttaaaaaaaagggaagttcaagggcagtcatgactatatcataaaattttgtttaaaaaaagtacaggacaaagtgtcgtagcacatgtctatctataatgccagcactggagagataggcagttaaaggttcactctgaatatgtattgccctagagactagcctgggtcacatgagaccctcactcattaataaggaagccaagtggggtggtacatgtcgttaatctcagcattcaagaggcagaggcaggctgatttcttgtcagttctagaccagcctggtctacatagtgagttccaggccagccagggctacgtaatgagaccaactcaaaaagagagagagagagagagagagagagagagaaaagaaaaagaaaagaaatatatgaacaaaaacaaagtacattaaaaggcagagaggtggggtagaatgaatgtgttaggaatccccctccccccagcctctgtatcactacaacttattaggaatcacccaaaatatcatttccatatattaaattaaagaaatcacgtattttaaggttcttattaaataaggattaaattacctctttctaattctagcattaaacagcggtgcctcaaaacgtggatttgtaccaactagaagaacaacatctgcttcttccacaccagcaattgtggtattgagaagataattggaacgtaagtctgtactaaaatataaaatataactcaagtttaagaagaaaaacaaacagtaaccacataagaccctgcaagtaaacctaacacatgctataacacacacataaagctaatacatgcacgagtccacagactcgtctcggatcataaatcccagtgcactctcacacacaggttttcataaagtgtgtccaactgctgtcctgtttacagcccaagttggccttgaacttgagcagccgtcctctcagctaccacatggttgagactaccacacacaccgtgatgccaggcaggtgtgtccaaatgaaactaaacttacaacatgtattaaggactacattcttctgtaagatttagctgttgatttcgtttattagcctgtgttaactacacatgatgggtgagaattccactttcatacatgtgtaatctgatcacgttcacctctcattgccctcggagcttccttcccacccctctaagctacctttgctcagacaggatctttctacgttcatgctgtctggtttgacttagatgtgaaagtgtactggtatgttagagaacccagtgtgtcaaagattgaacagtgacattacagatgtggctgcttttttttttttaaaaaaggaaaacgatagctgagaacagttgtaacactcatcttcaatccaagtacttaggaggtaaagacagaaagttcttctgctacacagagttcaaggccagcctgggctacaagaaactcaaaaatcaaaatgaaatcccaaacagcagcctggagcacagcttactgcttctcacccagctccttcagtggggaagatctcttcagtgcataagttgtcagagtcaactttattaagcaagtctttcagagctactaaggcttcagcatccaccaagcctcctgcaatcgctgccacagcattgccttcaaaattctgtaactggaaacagaaaagggcatctctaagaaacctacagtcagcaaagaccatgactgttcaggaaataaaccaagtcattttcaagcatccagagtagcaggaggcacagccgtctctcctgaattagtgtagctaccactgcacattaaagaagctttttacagcaaatgcagaggaaaaccacactggaaacaatgcagaaatcaacaaattgtggggaccccagccacaacagacacatctacaccatggctcttgcagctattgctcaaggaaccagaaaataaagagtctaagagccagcgtaccagaagtctgctgtaaagcagtgtctcctagaaaggctgcataaacaagatccgaataccaataccaacaggaattttaacatggaagggagaaaattccacaggtctcacctctagacaaagaactgcaagcaactgactgctgggagaaaaagaattagcttctctcaggaatgaacccccatataggttgtccagtacagagcagtcagtcagccttgaaatcatatatacacaaacaataaaaatgtagagtctatttgtgcatgtacataaatttatatatttactatatatatatataatataaatataaaaaataaaaaagttttttcaattaaaaaaaaagacagaggctatcaacttgagaatagaaggggaatgagagggattcagggataggtcactaggagggcctggagagagaagccagataagtgatacagttctatttcaactataaaatgaaaatatatatatatatataaaacatgtatttaaaaagacattgttgtcaaaaaatattagctagcaaataaaaaacatttaaccttttctttttctggtgaattaaattaactaacatttgattattgaaataacttccgagttctcaaaatactcatacagtcaaggaatttaatgtattttgggtctgaatgcaatgaaccacttatatttctttctaataaactgattcctagc

SEQ ID NO: 231 - DNA, 11554 bp, Mus musculus
tagatcctcactggccccacagtgggaaagggcagaagcagagccctgtcccagctttcctgacccaacacttgctcagcgggcaattcttgcttcctcccctttctgatggggttacagaagcacagagggattccagactcggtgtctatggaaacagccccatcgcaccatagaagacaaaaggcataccaggtctggaataggagagagaggggagaggggagaggggagaggggagaggggagaggggagaggggagaggggagaggggagaggggagagggagagagggagtaagggagggagggagacagacacagagagagtgtgtgtgagggagggatggaggctacctatattcagtcaatagcatagaaaacatatgaaggaatgaaattattgaaggcatacagaaagtggaatttatagaaagaggtcaaacataccagcaaagtcctcacgctttaacaaggatccagtgtttaatttgacccagtgacttctggtgtgttccacaagcacactattatctgactccaaatagtcaatgtttggacaggaggtgctgtacagttcagcttgtccatgcagatatatacaagggtcaaatgcaagagagacactgagtcagattgttcctgatggctgttactaaacttgaggtcacagtctataagaagccaggttcagccacccaacctcgtgaagacaaacatgcaaattagtagggaaaaccagaaaagaagaaatttatgcaatgtggctatgttgggaagaggaacaaaaagacccagtgattccccactagtctatcttggggttactaaagtgagactgaagtttaagttaaagcccagggcatactaagcagtccaggatgaggggtgatgccacccattactggactgtcaccatctctgtgaggttgttcatccctttcctggaggagatgagcatcagctctggcccagggttttcttctcccaataccagattcccagagaaatctcaatttcttggaattcactgtttcaatattgttaaagctaaaggctcttttaagaaaacattcatttctgtcaggttaatgtcaaatacaacagtggggcctaaaagggaaggaaataaagagactactcagaaagggcagcggtatccattttaaggctttggaggaagaggtgatcctgcacttggaggaagaagtcttttaacgtgtgacttggagggaagaaagatggctgccgcaaacccattatacaagatatgccattcgaagtccttagtggtctaggatctggttgcacagggatcctgataatttcttttgtggaagtattgggtttcagctaggagttaatcagcctacatttccctgcagtatttcaggcaccctactgagatgtctgtgactttccaacaggttctctggaaagaagagcctagagacaaggtaactctcccccatcttgggtagcttatttctcagagctgattctgagacacctcatgttgtaggaaggttagggttaggttagggcttgtaatcaaactccctaaatgtgctgtttagagaatgacaggccaagaaacttagagagagacctaggaaatttagaccacatcacagtctccctggcactaaatcttgtggtctcaaggagcaatctgcttcagtgtcctctttcctatcagcatattatagtgagaattacagaatctcactaggctgcttgtcaatttcctagttctcacttaagtaaggagcctactcaactcctttgagtgagaatcatagctgggtgcttgtcaaacaagcctcactagcatggagaattacagcaccaactttgaggttagagagaggtgactgcagacaggtgtgtcctcagagaaatctagacagatctagactaactttccactcaattgctacgagagacttctacccctttcagcaatgtgccaaggcaaaaaaaaaaaaaaaaaaaatacaatgcttacttcaaaagggataagacataatttattctggaggcaaatgagtgaccatggcctggaaatagactcacattacaccagtagtatgttccaatgtggtaacgatgttatgatgttttatagaaacaaagctaagaaagtcaaaaggcttgaaatatattggtggaaacatcgggtaggtagattacagaaaatggggacgtctaggagtacctgaccacatgcttagccatttggttggtggaagctagtagcgtgctaaattaatatacttgaaaagactttacctgataatcacaaggatattaggccagacacagaagcaggcaaaaaaaaaaaaaaaaaaaaaaaaaaaaaaaaaaaaaggctaataagagagctaaagatagcccaagacaaattataattaagctttgaacctacaacattccatctctccagccactgaagctgtaattacttttacagaacatttaatgttcagtgtggcttcttcttttgagttgggaaaagaattttgaggaaaggtctcactatataggccttgctggcctgaacttgctatgtagactagactagtctctaattctgagatctacttacctgtgcctccacaatgctggcattaaaggcattcaccatcaggcccagaaaaaaaatgtgctaattattaatatgtattaattatgttatatgattaatatattctactatattgatatattatacattaattatgagattaaggattcaataatatgcactgtatattatccatacaaacttattaatatattgtataatatacatgttaggtttcaaacccaggacagatgaatgaggtgcctacttaccatatcaaagcagacactggctgccaggttctcccagtcctcagtcccaccatcacagggtcctcctggctggcatacctcagacttctctagcccaggggatagactgcccttctcacacatgccctttcctatgtaatccagccattttggtcatctgtcccctttgggcctcctagctgctacacctggctctcctgctgtgtcctctccttctctcctcacatggcacagctcatgctcactcaggactctcccagatgtctctgcctctagccacactctttcacatatctataaaaagccttttcctccaccatacctagaagcaaccatgtcctgaacccctttcatctggtacccatttttttgtttgcttttttaaaaagattttatttattatatatatatgatgagtacactgtagctgtcttcagacacaccagaagagggtatcagatcacattacagatggttgtgagctaccatgtggttgctgggaattgaattcatgacctctgaaagagcagtcagtgctcttaactgctgaaccatcgctccagcccaatctggtgcctatttaacacacacacacacacacacacacacacacacacacacatttatatatttaatgtgtatgggtgtatttctatatgtgggtatgtgcacctgtatgtaggtatctgcagaggccagaaaagggtatcaaattccctggagctggagttacaaatggttgtgagcagccttgactgttaggatctgaatgtgagttctttgcaagagcaggaagtgtccgtaagctctccttccttccttccttccttccttccttccttccttccttccttccttccttccttccttcctccctccctccctccctccctccctccctccctccctcccttccttcctgaggtgtgtgcatgttggggtgggggtgggggtgccttccttcacaaatacaaggaaatcagggtattagctgtggctgtaacattgcatgtttaaaacattttctacctttgtctgcaggctgaatgttactgacctgtcaactctgtctacctttgacagaactataaggtacctacactcaaaaaatgaatcaagaggaagtaaagaaaacatatgaatgcactcagagaagcaagctgttaaaactcagtatcacatacattctcaagttcaagggccagacttaacactgtaattgagccccagagcagatcactggacgcataggaatgtaactgtgggagcgtgcaatccttggccagcaaacccaatttcctggaggacacagtcttattcactgaaccatggagctgtgcaagcccctgaaaatcattacccagcgccagagcgatgctgggagcatcactcctgacgcaggtatttaaagtagtgctgctgcttgagctggctccactgagcacggtgcgaccttggtgaattctggtggggaggacattactgagaggcagagacatcactgccagggtgcttcagatgagggtgtagaaaggtttccctggtggacagagtagctgggcagggaaaggatccacctttttgtctctgtagcaaaatcttaagcctcattgtgctactaccctagctttaatcccagcactcgggaggcagaggcaggcagatttctgagttcgaggccagcctggtctacaaagtgagttccaggacacccaagactacatagagaaaccctgtctcgaaaaaacaaaaacaaacaaacaaacacaacatcaataaaaaaaaaaaacaaaatgaaaagcaaagcaaagcaaagctaagcaaagcaaagctaactgacccagggcaaatcctcctgaggtgctctcccatgcttgacctaaagcagtcatttaagataaccctgtgctagagatgccgataatctggatgaacaccaagggtgtttcttgatattctccttgtcatgggatttaattacttgggggtaatgaatcactgagtcacacatgagagtttggacccaagaacttctaattatggactctcttcatgaagaatgtcctatagacatcataaggagatgacctgggctgaagaacttttaattatggactctcttcatgaagaaagtcctattgactttataaggagatgacctgggctggggcgatgatggctcagtggatacagagaaactgcctccaagcaattgactgtgacccaaataactggagaaacccagccctcacagttgtcataacctcctcatggacactgtagcaagcatacacacagctcaccttgtacctaaaataaacataggttaaaaaaaaattaaaaaggaaatgactagtggctatcaatctcctaagtgagttcaggtctaggaagagtctgagcccccccccccccccaaaaaaaaacagctttagaagtagtctttcttttttgagacaatcttacaatttatttacctctggctggcctggacctcatttaagtagaccaggttggcctcaaacttacagagattcaacctgcctctgtctctacctcccaagtgctcggattaagggcaccacacccagtagtagaattatattaaacatatttgtatttataattgctaagaagattggaaagaatgtagatgagtgaaagaatcaaaataaaagcaaatatgactataccttaataatcagactcctgactgcttggaatctgatccagtgatctgtatgtgaggtcttctagaacattcattccatgcctaactccccatgaccctggtgcctaaccataatgtccaggatccagaaagaacacttggttgtataaaattttactacctaagagccctggaagatggttcaatagataaatgtacttgataagcaaacctggctccctggggaccacatacaaattcagatatggtagcacctaactctcctttagggagatgggtgtgtgtgtgtgtgcgcgcatggtgtgtgtgtgtgtgtgtgtgtgtgtgtgtgtgtagacaggtgaatcggtcgcaagctggtgggctagatgcctgcagtgtgcagcatggcataagtaagtgacctttcctccacaaggtaggacatgagaacagattcctaaaactgctttgacctccacaaatatacgatggcatacactgatgcccagagaactgaagggaactagaaatcacattaaatgaaagaagccaggctcagccaacacagcctgtgttttagcatacacagactctagtaggcaaaagagagactctaagggtctacttgtgaggaaatgaggaccattaggcagagggaaggggttgggagatagaaaaaaaaatgggtgaagagagtcaaatatgtagaactgtcaaaatatcatgacaaaaaccattactttgctcaataatacatgccatttttttttaatttaaagctaaaagtaatatgcataagaaattacttccccctatctgggcctaatgtaagagacctggaaatgcctaaagtttcatgttcaataggttgagtacaatttcttgctatggttaccctttcattgctatggctaccctttcattgctatggttaccctttcattgctatggctaccccttgcattggttatgagaacataaccaatgggtaattaggaacatttgcatttgttaagactagcaaccaatatattggaggaaatattgtgttggtatagaaactctgaaaggttaaaaactggcccagaacacaggtgttcaaagcaaaggccagtcttcggctatgaaggcaggtgtcccaaactaggacaaaagaaaaggccaccctgtaaagttgtccgtaaatccaacaaaacgtaaaacatcctgagtcatgaaagtgagcaaagtaccctctcctcactaacgtgccgagctatgctcatggattaaagcttcctgcactgcactgtttgaggacctccaaataataaccacaattaacaaatatggaattatactcacatctcagtacattcaagaggcacctaactatatctaacgaatcccataaagccttataagctaaccaccaatacctgcagaacatttatgcaatgttctcactgatgaggcatacttagctactatatatatatatatatatatatatatatatagtatatatgtatgtatatgtatatatatggagagattgactatgatttattacacggtgcttagtctttggcaagaagccactaatgccaatatatcttttagtataatgacaggagaaattacaataaaaaaatcaaagatacaacaaaataagcatgaaaagcaacatttacatgagagcaaattattaagtatacatgtacagtaagaacagcttgtgacatggaaacaacttctaaatgtgatgtcaatctatgattatagagcgacatttatacctaccttctacatagacaagagttaacatttgataacctaaaagtgttttgaaagttgtgtaaagggcatggcgacaagaaatgttagaaaaaaacatcaggtagagagaaaagttaacaaaaaagtataaaagtttcttgttcatagaagagaatgacagtcttaaaaagaaaatggcaagaaaaaaatctcaatatccacaaaaagtcatttttcctccactcattaatctcaaaggcttgaaaacaactcactttttatgtttcctggcatttaacaagtaattatcaactcaccagtgaatgtatataacttaaagtgaaagaaaaaaactacctgatttgatacaaaaagataaaaatgaaaatcactgtaatgatagtacactttttgtttgtaattccttctaaggtcttttcttgtttccatctcctgtacttacgtaatcctccatctcaaacagtgtcaagatcattttctaggggcgagagaaacggcgtagtgccattccttgaacagaagtctggcagcgaacatgggttctagcacacctatgggacagctcacagccattaactccagccccaggggctctgacacaccctcttcaggaactacatggatgtgcacagatccgtacagacacacgcatctacacacaattttaaaaattaactaaaatagagataatattctaaagcaaaaatgtgaagcatggagtccagaaaggtttctgtaagaatactgggcgggggctggagagatggcagtaaagagcactgactgctctgtcagaggtcctgagttcagttcccagcaaccacatggtggctcacaaccatctgtaatgggatcagatgccctcttctagtgtgtgtttgaagacagctgcaatgtactcatataaataaaaaataaataaatctttaaaaaatgctgggtggtggtggtacacacctttaacccaatcactagggtagcagagacaggtgaatctcttgagttcgagacctgcctgatctagagttctaggatggcccgtacgacacagagaaaccatgtctgcagaaatcaaaggggtagagggagtatgaacgactgatgctggatgtggaagcagacagctttcacccccaccatctagaggttgaaacaagacgatttataattggttcgaggacagtctgggttacatggcaagactatttccgacaaacaaaaacaaatccctagtgaattctagtaagttcaatatatttacatagtttcttcagattttgcattttctaaggcattcttaaaacaaacaaaaagccgggcatggtggcgcacgcctttattcccagcatttgggaggcagaggcaggcggatttctgagttcgaggccagcctggtctacagagtgagttccaagacagccagggctacacagagaaaccctgtctcgaaaaaccaaaaaccaaccaaacaaacaaaaaattgtatccagtccttcacattgctgatgtttatgggaatgaacaaatgaaaccctgtgagaggactgggccactactcgatactcttgagtttcttgtactttgccaagcaaagattttaccgggcaagtatatgcacatgtaccaaaggaagccatctcttccagccaaacttgctcttcatacaaaacagtcacactatggagccatcggtgaccggaaactcagtgtgtagatcaggttggccctgaattctgagatcccctgcctctgcctttcaagtgttgggatgaagggtgtgccacaccatgtctggcctaaagttctctttacccatgagcagggccaggtgtttcacttgcttaatttaacctttacagaagttttcttcacgcgcagtcttacgggtgttacgacgtctcttctagttctgcgttcaaggttactgcctggtgagttcttctatgtctatggaaagagctataataactgaaggctttcccacattctgaacacacaaagggtttctctccagtgtggcttctttcatgtgacttgacatatcggaaagaacggaagggtttcccacactgagaacatataaagggtttctccccagtgtggatcctttcatgtattttgagataactaggagaacgaaaggcttttccacattgcacacacgcatagggcttcactgtggtgtgagccttctcatgtcttctccatgatatgcgactacagaaggcttttccgcattgcttgcataaatagggtttttcaccagtgtgagtctgtttatgactgtgaaaggtactaaaccaactaaaggctttcccacattgcttacaaacgtaggggttcgagccactgtgaattacttcatgtcttcttaaatgatacaaagaaaagaaggctttgccacactgcttacatacatatggtttctctccagtgtgagttcgttcgtgtatctgaacttgacgagaagacctgaaggctttcccacattgtttacatagatagggtttctccccggtatgaatcaactcgtggtattgaagggaaccgagaaaggtaaaagctttcccgcattccttacagacgtaaggtttttctccagtgtgagttcgcttatgaatctgaacttgttttggagacctaaaggttttcccacactgcttgcatacatagggtttctctccactatgcatcaattcatggtacttaacggagctgtgactagtgaaggctttaccacattgcttacagacacattctccagaatgaattattttatgtgttcgaaaagcgctttcacagctaaaaaccttctcacattgcaaacacacgaagagttgctctcctgtgtgagttcgttcatgttttcgaaaggcgcccgaggaagcaaacgccttactgcatttcgtacacttatacggtttctcgccactgtgcatcatttcatggaatcgaagtgaactacgatcggtgaaggccttcccacactgcttacacacgtagggcttttctccagtgtgaatcctctcatgcgtcagcagggagctcgaacgggcaaaggtcttcccacactgcttacacatatagggcttctcaccagtgtggattctttcatgtatttggagggagctaggaaaggggaaggctttcccacactgcttacacacataggatttttctcggctgtgatattcttcatgcctacgaaaagagctagaagaagtgaatgctttcccacactgcttacattcatagtgcggttctccactggagctctttccatcgttctgactggatgggagacacctggaatcttccttacagtgactagtttcaggtttctcctcagtgcgaattgttttttgcttctgaaaaggtgtggaagaaatggaggtgttcccagattctttgtgtttatacaattcttttccatattcctgaatggcatacagtttgtgtcctgggtgaggatgaggggagacattcacagataaatggccaataactacttcttcatagacagggctttcatatgggggaactggacatgacttctggctcacagcacactctggggtccagttaaagatttctgcacgctgatgaccttcggtatattcacagagtctctccaacaactgactactgcgaaaaaaattttaaaagttcattactaaaaaattgtttactaatgatttaccacaagaagtggtagttatatcccctgtaagagtttttaaaaatgtttgaaccatttgctttaaaatttggtttaaggacatttacaataataataaaaaacaaaagataatttgtgggtggttgtggtatactgtcttcattagtggcaagtgctgaataactacatcacatttaaatatatttttcaatatttagtactatatacagttttgatgtactagtgactaaaacagtgttggattctaacatacttgtatccccataatgacttctcttgacaactggtcctattataaaaagaaattttatttttgtttcatatacaacacatgcctagaacttagaaacacatcactacaacattttaaataatattatggacagagtaaagttagtacatatgaaccatgacatagtattacttgtggtaggtatcacggtgctccggttgttagtaatattaggatattctgattgcagaaggttaatgggtctgcagttttggataaaatttgttaaaattaaaacagtttgaagcaag

SEQ ID NO: 232 - DNA, 5027 bp, Mus musculus
aaacaagaagaatgtcacagtgagagcaactacatccggtgttctgccatcaatatttccgagcaaacggtccacttgagtggataaatatatcatgaagattcctagtgtatactgagtagggacaagccaggacttgcgacgaccaaagttcttaaagtagacggcatcaaccaagggagcccagagcaacttaagactgaatggccagaagacaaaactgaagaaagcctgatctgtatagctaacatttttgctttgcaaaatgagggggatgctccccgccaggcctaagggaatgccctgaagcacgtaaagaaagagtagtaacaaaatgctacttagttcggatctatagctccgcggggctttaggtaagtcaccagggccggcatcacctagaagaacttcccggtccccctccccgcccaccgagtctcggcgactgtcatcccagccgcccggtggcagcgggccactcttcatatccagagcgtggctaaacatgcctgaccgccgctgccgactgctgtccttgtgggagatggtcggtgacatatcagagacgacgcagagcccggtgtgtgggggcctgaggctggcgttttgatcagtctagtcccaggtccaaggcagtctctctggacccgggtcacggtggttcaacgccgggagggcggacgcggagagactggtcgctgttttgcagcagggagccagatccctggcaggtggcccaggcgaagcctgggtcgctgcccacaggagcgacttcagggagccggcaagagctccccgtgcagccgcacccggcttgaggctggcggagcgtgccgtggcgctgcgacggagtctggctcttaactgcagcggggactcgaacgctctcttgcccgtccaccagctgacactgcagcgggcaccctcctcagtagacaccagaggtaaaggataacttcctgcctcgcgcttcgggaagtggttccctgccaaaatgggttccgtgcctcccgacggagccagcgaatcagaacaagttccggtggcggcgaccgcgagcaacgtttgctaggaaccattaattccctcgattctaaccccgagggaggaataacgccagcgtaccgagcgtccaggacggaacgtcttaacaaacccggttccgtttgcgcatgcgcttgcatggaactcgtgtgcctcggccattgggccctcgtcgccacgtgagcgcgggttttctggattggcctaggccttggtgataacattgcacaaggtctgtaggcgagtttgtacttatttaattcagtacataacttccaggcttgtagttgggtaataatgctgctttgtgaacctgcagttactaagctttggtgtcaggttgtgggtcctttatgcccgactaaatggaaacactcctacctaatacacagaacgaataaggctgtccatttcccccaatgtcaaggaagaaatgtaggggaacgctagatacacagagtgaaggaggtaaatttcagtctgctgcatcttatttttttgccaatggaaacgtctcgaaaccacctttctcctttcatgtcatccatggttatgcattttaagtgcataacgacgcacttcttcgagttttggtgaatcgttggaagctcttagagcttgaaatgttgagatactagatttagtatttcagtgataacaaagaaataagttttccaagaattttattggattcataattggccagtttttcaaatgccatttcaagtgtaatagtacatgctttcttcattaaaaacaaaaacaaaccataaattcccttgtggatttgctgccttcccacttttctgatttctacagcttattaaccacttagctaatttcccatgttctcttctcatttctccctgggtccttccttttcctctcctcccccttctctccagctcttgtatggtcatagaaatgtgagactttgcttattattattattattattattattattattcgtctttcattttcattgtattgatactgagtcctgggttacataagctagcatatgtacccaggctggtctcaaacttatggccatactcctgccttaacttctagagtcctaggattctatacatgagccaccacacctagtctgatatacttcaatgaaagaacacagtgaccatgaagtcttctaatctttgttaaagagaggaacagagttggttgtggtggtgcatgcttgtaatccagactagtctataaaacgagttcctggccatccatggatatatagcaagtctctgtctcaaaaattggagtggaaaacagtttatagtgttatctatgtgagaccaaaagtctctatttttttcaacaggatcttactgtatggtccttactggcatgaaactcactctgtagaccgggctggacttgatcttacagagatccacctgcctcttactcctgaacgctgagattaagggatggactatctctcctttttgtttctgattttcttttcttttcttttcttttctttttttttttttttttttttttttttttttttttttttttttttttgtgaggggatctcatgtagcctatggcacccttgagcttgacatgtacttgtgatggcggttttgagctcccagtgttcctgcttccacttcccaaatcctaccattacaggcatgggttgtcatttctgaaaaagtctcaatgtcaatgaatacagaataaagtttatcacatccattttagctctgcaaggcttttaggaagtaacctacaaggctgtgttggttggaataaaaatggcccccatgtgctcaaatatatgaatattagtcatcaagaagtggctccctttaggattaggaagtgtggccttgttggggtaggtgccaccttgttggaggaagtatgtcactggggatgggttttgaggttccagaaacttccaaggcaagtccaaatagctctctctttctctcttcctgctatctatggatttggatgcagaactctcagcacacagtgtgtgtgtgtgtgtgtgagagagagagagagctcttgagtgcaggtgtgtgttctgtgttaaacttttaagtgctattgctgtttggtatcatacctttacattggtaccaacttctctcctcctcattctctgcagttcctaagattttccctgattatatgtatgtcatttgaagaagtgtatgagtagactcatataatatgtgacctttggtattaggtataactgtattcccaaaattagtatccttgaaatacaaataatatgtttatagatcaatctgagtagatattatatttgttctttttattgtgtaaagccattgatttttatggatacaacatcagtggagttttgttttgaggcatgttctaactatatagtccagactgacctcccaagtgctagggtcgaacaaacaaacaaatttattctaacttttttctaattctttaaaaatactttacatgtatacagtgtattttgatcatatccaattcaaattcttcctcttgatttccccactacaaccccttctcacttttatatcttctatcttcttcttcttttttttagagcctactgagttcaattagtggttccctgcatgtatgtatctttggaggctaatcactggagcatgggcaacctaccagcagccacacattcaatgaaaaatgactcttctcccagcagccaacaattatcaacagctcctgagttagggatggagccttctgagcccctctcccatcaatgttctaatgttgactggattgatcttgttcaggtaatgataggtcctgtgagttcatgagtgcaatggccatgtaatgcttagaagagtactacacagcacattccctcatcctacagctgtcacattgtaccatgaggcttgttggggtggcaggaaatggttatcaggtagggctgaacatttaaccatcacttattttcagcattttggtcagttgagtctttgtgtggacttctctccactgcagacagaaggtactttgacaacggttgaaagcagcactaatgtatgggtataatcataaatatttagagagcagtttgatgtttcacagaagaacagtagtcagtttcccctcccaggacctctgatctcctgggatgggcttttttttaaaaaatattttttattattacgtattttcctcaattacatttagaatgctatcccaaaagtcccccgtaccctcacccctactccccgctttttaaaaggcttacaatagcatgaattccttcatacgaagcaaacacaaatctaatcagtaagtagttttactagcttatttatttattccatttttaaatgaaaaacatgtattttgactagacattatttatttatttttagaaagggcttcatatagcccaggatagcctgaatctcactacaggctggcttttatcagtattttaaataatttcttgcaaatattactcctcagctatagtactgttttttctttagtggttgtgggggatctttctggaataagcactccaacactattgagaatgaagtaaagatgccaccaaggtaagagactcagagtttcagagcagcctgagctacattgtgcattttgagatgacccagctcagagtctcttttataaaggcattaattcctttcatgacagctccatttcatgacctaatcacttctcaaaggctccacattcaaagattaggggttaagactaaggagaataatatggggagacataatcattctacttatgttatatcagttcatctccttctacaaaatagactcattacattccagtactccaaatgcttttacttgcatcaactctaaatccaaagcctcatctacatatcgtctaaatcagatatgggtaatgtggttaatatcaattgtcaacttgaccaaatctagactcattaaagaggcaagcctgtaaag

SEQ ID NO: 233 - DNA, 5170 bp, Mus musculus
ctttgaatctagatttttattgcttttttttttctcgtgtccatatgtagtttggttcaatggcatcttttcaatatgtatgtatttttaagtattaaaacataattgtgaatgtgtctttatgtgagtgtccttgccactcgttccaggtcctcatcaaagtaatagataccaatgaccaccgcccccagttttctacatcgaaatacgaagttgctgttcctgaggacacagagccagaagtggagattctgcagatcagtgcagtagatagggatgagaaaaacaagttgatctacactctgcagagcagcatcgatccagccagcctcaagaaattccgcctcgatcccgcaacaggcgctctttacactgctgaaaagcttgaccatgaagccattcaccagcacgttctcacggtcatggtacggaaggcaccctttaccctgccgtctctctttctgactggcaggtttcctgggatggaaaagcatagtgattttatttatgtatttatgtatgtatgtatgtgtgtattattttatgtttttgtttgtttgtttttaatccacaagaaagaagaaccccagtagataacatgttgacttttctctcccaggtccgggatcaggatgtccctgtgaaacgaaactttgccaggattgttgtcaatgtcagtgacaagaatgaccacgcaccgtggttcaccagtccgtcctacgacgggcgggtttatgaatcggcagccgtgggctcagttgtgctgcaagtgacagctctggacaaagacaaagggaggaacgctgaagtgctctactcgatcgagtcaggtaggtcggaagccgtgcagtctcgtgactgtgcttgaacggcgtatctcgcattttctaaaactgcttctaggtgctgaagcatacttccacatagcgctgcagaaatggattaaatcttttttaactactgtttaatgtataaggcaaaagggatttagggggggaaaaaaacctctgccaaggaacaaagataaagtcctaataagcttgagtgtcaagaattctggagattaccagtattaacataaattaagactgataaatcctacgggagtgggggaactttatttttctaattcagtattttttttttttttttggagtcattttaggctcttaaactagtcaggcaaattctggcttagtaattcaacattttaatgagagtattttctctggctcagaaatgccaggagagtatgatatctccctgtgttgggtcaattctcagagaaaaaggggataccctgtgtcctgtgccttgtgaactagccccacagtccttttgacagtagagtatcatgcatagaatccagctgttgaaacaggccacagagtggtggcttctgggaaggggcctgtcacattgtctagaggtagcacagttatagcccaagccaggaaggtcagctgagcctgggccaaggagttccagaataaaatcaggaaagagttggccctgctaaatacctctaagtgtagagtctggagaaggcttcagtttcccaccgtcctcacagtcatcggtagtagaagacatagagccagtttcacgcgtcattttgtgaaatggttttagcgtatcctaatctactgattttctttaagcctagaactctacttaacttgttgtctgtggtctctgctaggcattgcatgcagagattgcaggttatagatctcagactctaaatctgagtatatagggagcaagtttgacaaaaatacttgcccatttgctttctgtgccaattaaacttatttctttacgtgttgggaaactcgtttgtttcccttaaaagaaccaggttgactttgttatttacagataagattttctataccacctgggatgagagcgttaaaatgcactgttaccaggttagtgccttggataaaggagataaagaattttttccactgcttgagaaattcagcagttagaaaaacagtgcattccattcgtgcatgcccgagcatttcaatgaagagactttgtcatagacaaactgactgggtttatgtaggcgaaaatgttcaactttccgttggctttcacataattttcaacaactgggtggttaaaatatgattgttggtgtctgagtgaaggcatgtgcattctttgagtgtttgtaatgactgatgggattagtaatttggtattctgagaatggaactctgtgtctccccaaagaatagagtaagcgccattggactgttcccgtgtggaataaggctgtaagacacagctttcataatgtaatgtgctaaaaaaaaaaacttctataggaagccactactgtgagagttcagaagtgtgtgtgtgtgtgtgtgtgtgtgtgtacatatacccattggaacatggtgaactgtaaaatgttcatattgcctttcattgaacatttattcataattagctgtttctaatttgtatctgattgcatttaataaagttcaagagacttggttattaaatttacctgcatgtttaattaggagaaatttattgagcaatagtttttctctgatttgaagtcttcagagaaagtaatttaatgaaagggtttttccagtagtaactgaattacgcacaagagactaagtgctgtactctgggtggtgtcggcttgtcagagaagcagattagagcattactttcctactgttgtcagccctggagatgtataacactcggtgaatctacggattagagttggctttgtccctcaggtttacagtataattgccactgacacgtgggagaggtttccacactgtcagcaagtccttactgaacacgcacgggccatgtgtcagacataggaagagatggggtcccactacatgtctcttttctgtgctatctagtaaatagtcacgacttaagggcaacattgacttgttagtccagataactcccccgttgaaatgcaagactataatttaaagttataccacttcagcaagcataaatgtcaaccccaccctggtacaaagttcgcccactaccttattcccattctcagggggcaaacctgttatttcagggctgagaaaaacgtacctgttgccagtcgctcactttccgcagtcggcagtctgggctgccttctgtacggctgaagctttgtgcccgatacgtacctgtgtgaggtccaaataccaaatcactctgggctcctgtttttaccatttttatgtcagcaacgggctcagggtcctgttaattcaatgctaggataccgcagatgatgatattgttgaacttcacattgtgtatgcatagtaagaatgttatccatactatagagaggattcaggagctgggtatgatggcatacgcctttaagcatagcccttgggaggctgaggccggaggatggtgagtaggagtcccgcctgcgatacatagtgttttcgtgttgagtctcagctatacagaaacaagagagaaagcaaaaataaataaataggaggaaagagaacacgtgtataataaaaaataaacgtagccacaccggatagggaaggaaggaggagtcttcaggcaggggcattctggtgaacgaaaaatgaaagagtaaatgggtgactagagagattctgagaatagccagggaaggctgcgttaggggagaacagggtggaatatggggtccctggcatgagaggagaggagagcagagaggatgttgatctgaccggggctgagaacactagtgcatctcttgaacactgtcttgcaacactaaacatgttgattcacttctacatttgaggcctaggatgtatgaacttttacgagcaaataagatttccctgtggaaaaataagataaacacgtgtagaagaatggatatgaatgttgccaaatgggctgctttccaaaacaggcctcagaaagctagggggcttgggagagatagagtcacttgccagaaaggtgagcaggtgtcacctcctacccagccagtcaagtttggaaggtgagagtaatgggcaggtggacaaagagaagcatctgaggtttggtgattgcctgaggcacaaggataacctagaatcgagattctcccaaatgcagacaggccggaaattagcgtctgcgcagcctggcagaggcctgggccaaggctcagcccagaccttcagggtctggagaagcccggggcctcctccctgtttcaaacccaggcactgccttggggcttggacacagagccaggccaacctaatgaaaaccagactatgtctggcctcaggaaaaaaaaatgtcatggatttttggaaaatgtatttaatgaaggaaatgaatttggtagaggaaatgcttactcttaatggggagagagaggggcttgctaatccttggcttgacagatgacactaagtagtttgctggtagtaaaacccagcaagaggagtgtgagaaaagtttagtggcaggtgacccgagctgggccaccaagtgttcatcagggaagaacggatcccgttctgggagtgatgtatagatgtttgtttataagacagaaaagggatagcgaggatcagcgaaggggtagaccccagagaccccccacggtgcccatgctccatccagaacatggagagtacgtactggtctcttaggaactcccaaccctgtggggttttgaggcattgggggaaatattgaatctgcgtgggcgagcctgggaaggtccgaggagatgccagcaaagcccatctgtcgtagcggtttgcttctcggctgcatcagtgcggttgatgtttggaagcaaaaacagctccttgttgccgagggaggccgttgtgcgtggcgtacgctgtttttgtctcttggctgctatcatctacgtggaagcaacgcttcctcctttccaagtgctgttgacagccgagctctgccagatgtccccctggaagcaaaatctctcctccttgagagtcaccaactacatgatcaagtcagcttggcaaaggttaagaagggaagattgtggacatcttgaaaactcctgaagggcggtgggctacagaaaacggtttctcggtcccctaacttcttacaagaagaagccctctgaaaccccagcgtaaaatttcttagt

SEQ ID NO: 234 - DNA, 14917 bp, Mus musculus
aaattgccttgaagaaatttggaggttcttagtagaagcgtcactttgaagtgacatctttactcgtaagtaatttctactcataattaatctacagatttgttattcttttgtaggatttatgcatgtgagtgctctgttttcatgcacaccataagaggaaatcagattccattacagataattgtgagttaccatgtggttgctgggaattgaactcaggacctctggaagagcagccatctatctctccaccagatttcttctttaaaaaaaggttcaggacccagagcgagcggggcccagagcaagcaggagctggatggagtgagcaggggctggagcaagcaggccagagcaagagggagaagggaaggggaaaagtaagtgagaaagaaagaggggtggaaggaaagggagggagggagggaaagagggaggaaggggaagagagagagagagagagagagagaagaaaggttcactgggcagtggtggcacatgcctttaatcccagcacttgggaaggaatttctgagttcgaagccagcctggtctagagagtgagttccaggacaaccagagctacacagagaaacctggtcttgaaaatcaaaaaaaaaaaaaaaaaaaaaaaggaaagaaaaaagaaaaggttcaaatccctatggcaatttattttaatgggtttcttgatttatctgaaacaaaatgtggtccccaaaacaggttaaatacacacatagaagcagtgtatggatgtgtcctccaaaaggacgatgaacacagatcagaaaataattgtggtactagggagatggctcagtgattaatatttgctgctcttgcagaggacgtgggttcagttcccagcacccacatacccagggtcacaaccatccataactcccatgcactcataggtgtgcattcatatacataaatctttaaggccatgcagaatttaatcccagcacttggaagacagaggcaggaggaaatctgatttcgtagagagttccaggacagccaggttatatagaaagacctgctttcaaaaaagcaaaaaaagagggaagaggaggaaggaggaggaagagagaggaagacaagatggggaaaaaaaagcagtggtttctccagtacatcagtccacattcccacaggtacagatccctaaggccaggcataacaatgtccccttctctgccaaaatatccaggttactgcagtcaggagaggattggctagtcctgtgagcagtggggctgactcaaaacattttttcaaactaatcaacagctgaactggggtccctaagttccttaaaaaacaatatttgaaagtgccaggtctctttttttcccacatttttttaattaggtattttcttcatttacatttcaaatgctatcccaaaagtcccctataccctcctcacccctgctcccctaccctcccactcccacttcttggccctggcgttcccctgtactgaggcatataaagtttgcaagaccaaggggcctctcttcccaatgatggccaactaggccaccttctgctacatatgcagctagagacaggaactctgggggtactggttagttcatattgttgttccacctacagggttgcagaccccttcagctcttgggtactttctctagctcctatattgggggctctgtgtttcatcctatagatgactgtgagcatccacttctgtatttgccagacactggcaaagcctcacaggagacagctgtatcagggttctttcagcaaaatcttgctggcatatgcaatagtgtctgcatttggtggctgattacaggatggaccaacatgtcaggcagtctctggatggtccatcctttcgtcttagctccagactttgtctctgcaactccttccatggatattttattccatattctagggaggaatgaagtatccacgagttagtcttccttcttgattttcttacgttttggaagttgtatcttgggtattctaggtttctgggctaatatccacttatcagtgagtgcatatcaagtgacttcttttgtgattgggttacctcactcaggatgatatcctccagatccatccatttgcccaagaatttcataaattcgttgtttttaatagctgagtagtattccattgtgtaaatgtaccacattttctgtatccattcctctgttgagggacctctgggttctttccagcttctggctattataaatagggctgctatgaacatagtggagcacatgtccttcttaccggttggaacattttgctgtagtagatggtgctgccttatgcttattacaaagaatttaaaaactgagaaagggttcagaaagtcagcccatttcatttgtccaacatatatattttttccttccctaatattctaggttcaaaataaacatttaaaaaatcaaaaaaaaaaaaaaaggccaactttcttttgttgccaggtcttttgttgccaggtcaacagtcacagtcactgaggaatgtcttggttttgttgacgaaatctaaagattataaagccctgttcgaaggtccctggagtatgcaatattggaattctacccagggcgttgttttctggtctaaaagtataggctgcccaccacagttggcaacttggtgtcttattttgtattagactggaaaaaaaaaacacaacaaccacctttgcagtcggcaaaggtgttcaacagtaaacagggcgggtaagctctatggaagaaggctacattgtattttttaataaagttttataaagtcaagtgacacttgcaagaaactgagcaaagatcacctataatgctattgtcaccactgtgacagttaccttttacatcttcataaaacactctaaaagcttgttttgtttttttaacttaccacacttttcctgcgctatttctttcatcttggtaaacatcacattgatcttctattttcctcttctggcttggaagttatgtccaattttgggcctacctttgtcattctttctttctgtgtatgtttgcattagcttctttgctcattgctgtgaccaagacacctgacaaaagtaacttaaggcggggtggaccgattctggctcacggcttgggaaagcagtgcctcacgggctgggaaggccctgtgggagccgccctcagatttggctgtggggggtctaagattgcttgttcacatctgcagatcagaaagcagaggaaaaggatgccaagcttcctctctccccacattcagttggaccttgcctcctactcggtccttgctggagacagccttgtgtacatatccaagggccgtcccctttgtgattctatttagccaaactggcagtgactattaaccatcacaatactaaaattattactagttgttggagggaagatgatacagaaatacaattttaaagggacagaaaggggaagaatgggttgacttttaaaattagatggtttaaacgggtacaaaagctaatgaattaagtgcactgttctaatcaggatgacgttctgtttgtaatctgtttttgctgcctctgacactgtcatgaccaaggcagaaggatatgaaacgtatggaagtagacaaataaaagacagcatctggcaagctgctatggtggtgctgatgacagtgacataaagcactctacaggatggagccatcactatccaactgttaatttatgacgttagggaaacacagtaaaatccaaggaccgcatggcaaggcataatgtaagcaggaaatgtgaatgagtgagacagacacaacctagtacaagaacacacacgagcagacgacagcagacgtggaggatggagaccaaggattccaaaagtggggaaggagaacaaacaggaataaagagcaaaggatatgtgcaacaatgccatcctgaagtgctttactttgtaaactaacttaacacaaacgatgcacacacacacacacacacacactggagtactgctgaaccataagtctgaaatcctattagtggcaaaaatgcataggactggaggtcactatgttaagtaagccaaacacagaaaaaaaaaatatgctcttccatatgtgaaaacttttaaagttagccaggcatgatagaacatccccttaatcccagcactcagggagcggaggatctaggattcttgagttcaaggccagcctggtctacagaacaagttccaggacagcctggactaaacagagaacccctatctcaaaaaaaaaaaaaaaaaaaaaaaaaaaaaaaaaaaaaaaaaggtaactttcaaaatagaaccacggttgtggagattagtggttgcaggtcccaaaatacagatcaaagttatagattctagagcagctatgctttaaaagagccatcctcacatttgtaagaactagcaagagttcaaaagttaatacaaaaaaaggagctatgttgataaccctgaccattgcatgctgtgtgcatgtattgaatcactcactgtgcacctaagtgtgtataattatctctaataaaaggaaaaataaaatatatatctggttttgttattacacagattccaaatatcccacctaaagttaacacttagatcaaatccgatgctcgactccacacactttgtcaaccgtgtatcttgcaccatgtcctagggtaagggctagggtctggtgaacattacagaaggtgactaggccaaaatgtctggaccttgttgtaaggcaaagagaaatggcatggtccaatttgtgttttaggaacagcatccttagccatcaagatgtctttgtgaataaaagcacttaatacaaaagccaacaacctgcactcaatgccacaacccaggtaaaaagctgaatgcagatgcacacacctacactcccagcactcgtccagacagaggcaaggtgggggagacagaagaatcatctagaggctcaaagggccaactaccctgaagtagcatcatggcagaaactaaagagactgtgccctggggtacaaggtgaaaactgactttcacaggtcaccctcagaccctacaggtgggtgcacagtggcactcatacatgggaattcacatctatgtgacacacacacacttgctctcatactaaagcagtgtggtgatcactggaaaccaggaagaagggacagagaggaaggttatatagcaggcaccaaagattaactgaacaaagttccagtgttcttcagcatagctgactgatggcagtttacaacaatttattgcatatttttataagaattaagagagaaaggtctgaaagtttccaacacaaagcaatgttgtttagaagaaatgaaaacactaattaaggtaatctgaccatttctatgaacaggtattgaattatcacattgtactaatacatttgtacagctgtgtgccaatcaaaaaatgtaggcccagtgtggtgatgcatgcctttaatcccaccaccagggagggatgcagatctctgtgagcatgaggtcaccctggtctactaatgagctccaggacagccagagtaacgtaatgaagccctggcaaaaacaaaaaaaacaaaaaaagcactcttattttacatgatgtttcccaggcttttactagattttaaaataactaagaaaacagagaaaggtatattttattggcattttggcctagcacagttcaattcaaataaaacagaacaaagtaatttatttagatagttgagtataataacaatttacgtttctgcttcgccgtcgtctgattgtgttcatgcgggtgcagtcagtccccactgctgcgcccaccagagcacccttacatgtgcagcacttgatacatacatttcattgtcagacttatctgctcagcaatgtaaacacttgctacaagtaaactttaaaaggtaaaagtgaatgatactaatcaataaatcaaacagaaccatctccacatgacataattaaacattatattaatactgtctcagtaagaaccacaaattcataaattcacaaggaaacagaaacaaagagtgaagtgaaaactcctagaatagtgttaaaatactgaagaacacaatgggaaattatctaagaagggaaacaataaatgataaaacaaaaaaaaagatatggttagtagtgagaacgtccttctttaaaaaattactctagttagtaatgtgagttgggctctctgtgggaatttcacatttaatgtctgctgtgggtttattacctcactcaaattttttagctctaaataatttttttaaataaccaaaaatattaaattaccttaacaaaaaattgctactataaagtcaaataattcttaagccataaaataaatccaatttaacaaaatacagaatggcatatacaatgtatgctaaaaagaaaaccagaaaattacttcacaaaaaaagcaaactagccatatatcatcactattgatttgttcctggctcttattaaataacccctaacaggtcagggaggatgcccagtgccactctagagctgtctgcagtatacaaataagtggtatctgtaatacaaagcaaaccattctaactcattaaacataattaaatcatacaagacttcaaagttacaaaaccaattataatactgtatcaggcaaaacaaacttgttctcattgctctcattatatgtttcagcttaatctacaatcatcaacatttttccatgtcacctcacaccaaactgacacaaaacaggtttagagagagacctctgttgtttccacagataaatgaaaaaagcaaaaggaactaaagtagtaatgtcagttgagtgtctgacacatctggcatgtcaagcagcactcgacactgcaagtttcttcaaatgatccatgaacacttgtaagctaacatcatccgtgagaattggtgctccggactcctggaggaagagaaggatttgtaattagaacacaggtgtcactgaagatgtccatgcaagtctcaaaacagacaaatccttttaaacagagtaatggccaccataaggaccctagatcctgagagtgaaactcatctaaattcctaggatttcctgagtaacagaactgtctttgttgtatagggactgctcccaaaacattaaaatttctgctagtaaatgaactatctcaggctggggcaagttaccagaaggaccaccagtgtggcagagtgaatggttagggctctcagatggcctgacctggtgagccttcactgctggtagaaactcagccagccaccacagaaatcattacagatgcttcaaacacactgcttaatgttttcagttatgtgtaaaccaatgaaaatgttaaaaattcattcaaacaacaaagggagaccacagctgcctgccctatgatccagtgtcccactcctgagcctgtccctcaggatctgaggcctgcacagagatgcatgcacactcacattatacactacatccacaacagctagactatggaactagccaagatgaacacatgaacaggtacagaaaatgcagtgcagtgcacactgaaacattattcacatacaaagaaaccatggcagttgtagaaaaatggatgaaacttgaaatcactactaagaaaagtaagccacagtcaaaaaaacaaacatgtttcttctgatatgcagacccagacttgagggtgtgtatgtatgtgctttcattttcagtgaagacacacacacatcttcattggctcacacatacatggacatatgtgtagggtagactaggaagaaggctgagagagggagaagtcacattaatgggagaggagataatgcaatgggatatatttggcatcaaagctgaagcaggaacttagtgtgagaagaggaaatgggacagtggagactgataagggtagagggactggatgacaaactagaataaagaataatgaaggctggaggggtggcgccaaccactcagggagtttgaaactcttttggaggaccagagttagatactaagaaaggacccttatcagatggcatacaattgcctataactttagccccaggaatctgtggctacctctggccttcacaagcactccacagatacacacagacacacacatatacacataattaaaaacaaaatcccgccaagtgtagtagcacacatctttagttctagcactcaagagacaaaagtagatcaatctctgtgaattctaggtcagcctggtctacagagaaaactctaagacagcagagctacaaagaaagaccttgtcttaaaaaataagtatataaataaaattaaattaaaaccataagtggaaattttgaagataccataagtaaatatcactgtgtattctaaccttaaaaattaataaataatagggctcagcaattaagagcacagactgctcttccagaggtcctgagttcaattcccaggaaccacatggtggttcacaaccatctgtaatgagatctgatgccctcttctggtgtgtctgaagacagctacagtgtacttatatataataaataagtttttaaataaattttaaaaattaataataattaaaaagaaaatagctagagtttacagagctggctcatcagtcaatcaagggcacttgctctagcagaagatccacatttggtttctagcacacacatggcagtacactcctaactacggttccagctccaggggatctggcaccctcttctgccttcgctggcctcctggagcacataaactcccacagagcccgcatgcatgcacatgcatgcacacgcgtgcgcgcgcactcacgcgcacacacacacacacacacacacacgtaataataataaatcttctctctctttactaagataccttgatctccagactcccttctccctggcatttttaacaaaaatgctagccaaaaggaagcaaactcattcattcattcattttctctctctctctctctctctctctctctctctctctctctctctctctctctctctctcttgctcgctcactctctctcttcctttcttcttttccttccctcctcctttccttccttccctccttctttcttcctttttctccctccctcgctccctcccttcacctcctttctttctttctgagtaaggttctcactgtgcagtcctagctgacccggaccttatacagaccaagatggtctggaattcactgactgctgggattaaaggtgtgcatactatgcccagcttataatattattttaaaatagcctatgattatcaatttttctatttattttaattgattttgtataattaacaggaatgaaggaaattttctaatatccattttaataaaaactacattagaaaactatattgataacccaatcaattggcaacgaaattttactatggcaagtaaaagtatttcccaggagtctacatttctgaattttttcattttctcctgattcacaaattccagcattagtaaaatttttaagtttaaaaacaggaaaattatagaaatcagcagattagtagcatatatgagaattcacagatccatggtactctggcatgccacagacatgccaaaacatattctgaattaaggaaaaatcatgaaacatgttaatgcctaaggacgtgaaagaactggcaaggaaggggcaatgtgctggaactgaggaaatggagtcagaaggcctgggttcctgggtctctgttgcttctcagagcccactgagtctgtgtgtttctgcagctgcagacttccctatgcccaccagtgctgtaaggatgaccgaagcagcacaaggcaatggacagcaggcagcacactcagtaagcacatgtcaggacacatgtttgggaaatcatcactgtatgacactcaaatctgtcctcattctatactcgccatttcctcaggagagctcaggtgccaccaacaacaacctagtggctattgcttgtgttcttcctgtagaaaacttttttttgttttacttagtttacacctcaacatatccactcctagatctctgtatctcctatgttgtttatttatacctagtacaaagatattatttcaaatgtataaaatactaatgctcaattctatcaaaaagtagcagggagttgatatctatttttcaagtgagtctttttctgtttaaaatataccaaaagagaaatgtgaacaaccaacctaacctacaaatcctttatctacaatggtgtcctgcctgaaagatatgcagggcaatggtggcacaaaacttgtgagagtgaccaaccaatacgtgatttgatttaagcccactacatgagatggaacccacacccaacactgtttgagtaaccaagagcccgagaatggacatccctgagacctaggataaaaccgaatactactgttccgaaaacaacatagcaataaaatgatccctaatgacactctgctaaatactcatagatcagtgccttggtcggccatcatcagagaagcttcctcctgtagcagatgggaacaaatacagagacccacagccagaccttagggaaacagtgagagccttggaattctcattcctaaacatggatctccatcaaatccctcccttcagagctcagtgatccccaaggaaaggaggccatagagtgtacgatccagaggggatggagaacaccaagaaaacaagaccctcttaattagtggctctcagccttcctgatgcttcaaccctgatagctcatgttgtgatgaccaaccataaaattatcttcactgctacttcataactggaattttgctactgttaaaactgtaatgtaagtatttttggaaatgaaggcttgtcaaaagggtcacaacccacatgttgaaaaactgctctaagtcaacataatcaaagctcatctgaactcacagaggctggggtagcacgcacaggcctgtgcagagccataccatgtcctgtaatgtccactatggcctccggcttagtgtttttatgtgagtcctgagtgtgtgagcgagtgagtctctgtttctcgtgccttctcttggctctcttccttctgtttgtttgtttcatgcaatttgatgtgttagcttatatcatagcacagcatagcacatatcatatcatatcatatcatatatcatatcacagtcccttagaagcctgtttgtgttttctaatgagagacagaaaaggagtgaatctagacaggaagggaggtaggaaggaactgggaggagcagagggagggaaaaccacaatcaggatgtattgtgtgaagggaaaatctattattaataaaagaaacaaaagtaagtaaaatatatccggaggctcatcaggtaaaggtacttgacatgcaagcctgaagacttgtgttcagtccctgtacccacataaaggtgaaagtgagcgctaacttgaatgttgtccttgacctctacatgtgtattgtggcatgtgtgcacacagacacacgtacatacatatatactacacacaccaataataagaaataagataaattttaacaaataaagcacatccgggattagctagctaggctcaagccttacagcactgaggatataaagcatggcctaacagtgttgcagcgatgccctctgcaggccagtcatgggtattgcttaccactggagttttgtttgaatgagaacatgtgtgagtttgtgagtgtgcatgtgtttgtgtgggggttctgtgtgtgttcttttttgttttttcattattaaacatcatcatgagaagtctttttccccacaggtttcttgtgtctatactttgattgttcatctgtttctgctttttccggaagcatagctatcatccaaagtgtctgtgacatcctagttccaacttgtcactggctgaatcaaggcagctgactttgaaccgaggccaccttcattcccctcaagaactaactcatcttctggaactgagatactgagcaagcagcacacgtcctccctggaactgtggatatattattcacttatcaagtttccggcttgaataagcgtcccactcccgaggaaggacgctaaagaaaggtgagcatacgcagacctcggcctgtgcggaaggaagcccacgttgtgctcccatcatgctgtgctcaccgggcattcactcaggacagcaccaacagtcgcggctcctttccatctcccacctgcatcagcccagagcacatcgcactcacatctgtgagtctgacatggatgcgaccgaacttcctctagaaacttcacaataactgcatccttcacagtgacgttggtattttcctcaatgctgacatctgaatgctaagaatggacttcatcctcatagtccatgaggcagaaaagttgtttgtttttttgtttgtttttgggttttggtgtttgtttttttgatacaatgacctgtaccccatgctaaccccatgcccagctatcactgggttcttgatttctagcaataagaatagtaagaggtcagattccattcattgttagcaaaatattcagctagttaattcccaagctagaatcattaaattaacttaaactatcaattctaaatctgcagttagtgtggcttgggttaaaaacagggccctgggccagcaagaaggttcaccaggcaaaagtatctgccggtaagcttgctggcctgagttcagcccctaggacccatataggagaagggaaaaacaaactccccagttgtcctctgacctccacacacttgttccttgtaggcaaaataaataaataaaatgtagttctaaccccaattttctctcctagtgggagaattaataacatatgcttcatataaattttagcaattaaatcaaagtgcataaaaaaaaataatgtcactgtaagaaggacagcaaatggctcaatggataaaggcatctgcccaatgctgaagtccaccctgggaaccacagctaggaggaaagcatcaactctggcaagttgtcctctgacttccacactcactctgcgtagtagtacacacccacattaataaatattgatttttatttcttttctttttttggttttttgagacaggatttctctttataaccctggctgtcctggaattcactttgtagaccaggctggcttcgaactcagaaatccgcctgcctctgcctcccgagtgctgggattaaaggcgtgcaccaccacgcccgacttataaatactgatttttaatcacaggtcacgaaaggccatcgggccaggtgtggtggcgcacactcagaagaatgaggcagaagggtcataattcccaggcaaggaactgctgtgctgcctgtcacagcagtaacagcgcatggctgtggccaatggatgagagggaatggcaagcgaaataggcaaaacgggtgtgagcaggcagagaagggatgggggttataggaaccagctggagccttggaagtagagctcactcactggctcgctcgctctgtggagagaaaagcagggccatcagacgcccatggaacagagttcactgcttttgcctccagtggactgcagctaaactcggactccgaaggttctatgcgacaggatcattttcttattttccaatggagcaccaactaccagttacactttctactgtccccttatattttctcacagaaattatcattaaatatataagggaaatatagcttttactaaaataactaaggacaaagaaagaagttctttccaagactgctgttcacacttacctgcccccaggcatacatgttattatgagtctgtgaagggttgactttcgaaaggaggaaacgagccttaaaagtaaaaataaataaataaataaataaatagtgctgatcaaacacagacttagtaagataagctacagacaatataccatttaaacccaacttaactgaatattttggtaattttgttaaaatgtaatacttacaaagttaaattttaaaatgcatcaaccgaaaaaaatgcattaaccacaatacaaataatatactcttccaacattacatatttgtagcattcataagataatagactactgaatcccaaactcaacagataaaaagttgtatgtacaggactagagagatggctcagcaggtaagagcatgactgctcttccagaagagctgggttggttggattcccagaacccactggtgacacacaactatctgtaactatctttaacctagggcatctgactccctctcctgacttcttccagtgctgcatgcttgtgttatacggacatcaatgcaggcaaagcacccaaacacatgaaataaaaataagactgcaaatgtttatttgttaacacaaaccttattttaaaatgaatgtgaaaatacagttttatcaactactctgaaacaaaagaagtctaaagcctcgtaaaaatgattttaatccacaggtgataacttaggcaacatttatccatcctctacaacagctaatcaatcaataaataaatgagtaattagataaggaaaataacaatacacattaagatattgatgaatgaattcatcaaaaatcttaattcattctagaagaacaaaagcaatttaatcttttgaaaaatgtttttctattccctaagtagctctagtcctagaataagaagcctggaattcaattaactcctacttaggattggcaagcttacaaatgtaatctcagtatctaggagactgaggcagaaagaatgttcaaggtccacctgagctatgtagctaagacactatctcttt

SEQ ID NO: 235 - DNA, 2477 bp, Mus musculus
gttggtgtcgggaggaggcgagagtcggcttagcctgtgtcgcgtctgtctcaggaaccggacggagagtgagggcaccagggctcactctctaggggggctgccattttccgcgttcacgccgtcgtgaggagcgcagcccggactctccacgacccctccgactccctactcgcgggcctcgaggccgcggcggccaccgagacagcgccgcacctcccccaccccttcccctcgtcccccgcccgccagggcccggccggtgccccacccccgcctgcctgcccgcccgaccgcccgcccgctacgccgccgccatgtcggcgcaggcccagatgcgcgctatgctggaccagttaatgggcacctctcgggacggtaagtcgctgccagagccctgggggtgggggaggggccgtgcctggggagggggaggcctccgagggagcacttgggcgcgcgcgtgcggccgagtaaggggttcccagattggtagcgcgaggtcccccccgtctctcttccagtccaatcagggcttggcaggcggtcttgggggcggtgaccgtgcggattggcgggaactgctgccaatgcggcgaggcggggcctgggagcagaaaggggagtttgtgccttttgctgttgacttggcggggttgggagagcccaagtctgtcttggagtagtggggcggtcagtttgactattgatcagggaccggcggggcgctcaggtctccacccccagctccagctcctttcctctgggctttcggatcacccctcgccgccgtcctctagagtgtggagagaaacatcccctccctccctggtcttaacgaaaccactactaacccccagttccagggacgcttcgtcgagcccttacagaatcaacttttttttttcgtgtgtgtggaaaatctgacccaaaccatggtttcttaaagtgggtgtgtttggccccattttgtagaagtgtttaggcctatttttttttcccaccgagagacctccattttgttagaccacgtattagagacttcagtaaatattggcaaattttacctgtgctgaaaacagaatcattttggatatttgatgcccactgaattagaattgaaggaaagggcttttaaaaatacagttagattagaatccttagaaagagttatttacgtgtttgtttctaaaaatgatgaaatgttgcttttgggggataattaacaatgtactttcaaattaaagttcagcactttcttaaaaaaaaaaaaaaacaagtccaaatcctgacttgtaaaaactcgtttaggcaagttttttagcgatttaaatgctttttttttttttttttttttttttttggacaagtttggcttacaagaaaagacgtacataaatttagcttaattgtaaatcctgttgaattttcttgagttctttgcggaaaatatgggagaagatagaacctatttcaaatcttttttagcaatacttaatacagctttcagtgtaaggttaagtcctaataaaaacccactggaaatttttcttaaagatagatacaggtggataacagatttattgtatagagaggagggaaaaaatggaaagaaaataagatttatttgtgagtagtaagtaatcccttgaaagttaagtaattaaaaacaccactggaataacctaacctttcatgcttgggtaagaatgtttataattgcagcatgtcttaactttcttccttctccatcataagtgaggatatttagaaggggcttcatacaggaacttaacagttcaatatttgtaataacattttagaaatcttaaaggcttaccttatgtaatctttaaatatgaattgatgccattattggtaacttctgcatagataggatttccttatgtattttactgggaggttagttggatcaaggtaactatgacctgacaatttacttttcttttttttttccctgtgtagtcctggctgacctggaactcactctgtagaccaggctggcctggaactcagaaatcctcttgcctctgcctcccaagtgctgggattaaaggcatgcccggctgacaattttctgatagcagcccccctctagtattacaaaactgaactgttaaatatgtagtatatctgtaaatttctctttgtagtcccagaatgaagctggattcttaaagtttaattatttttttacttaaatttatattcctgtgtctgtccctgaatattttttaatccttcagacctattgaacttaaaaataaacacatatttatgagtaaacaatagtatttggttgaagtgatttgattttcagtgctgtattgattcagaagaagcatcaattttgcctttgtagaacgctaaggcaggagaatttcagtgagttcaaggctaccctaggttacatagttccaggctagcctgagttaaggcaagaccctgcctcaagc

SEQ ID NO: 236 - DNA, 83266 bp, Mus musculus
aaaccaatagaatatctttatttgatgacacaatggccagcaggaacttgtcagtcaggaacttgcccaaactgtgtaccccaagtctcattgttctttgcttcttatgtacaaaaaccacatcctgattgacacatatctgttagaaagaacagtcattaagaattgaaatttcagaagccaacaaacaaggttagtgcctttagggactttccaggatcctggaactatttaatagatctttgatggattggatctttattttggcctgtgttggggcctacctgctgggttttagggtcacaatggtgcctctaacatggagtcggttgtgctaacgtcttggggtctgttaagataactgatacacgagaagcttctgggaggggagctgagaagcatgggtagctttagatgtggggcgacactgttacaaagcatcctaggctaagaagcttaaaacaggcaggcacatcttaaagtgaattggcacagccataccatactgggtcctaaggagagtcctctcctggctttgctcaactcccagaaaccagttcacattcttctctggagggtcccaattttcttctctggagcacctgcatttttccaactggggctgaaggctgcatccctttaccttgtcccattcctaattctgtccctgagatcctcatccctcctatagggaccctgtgactacctggactctacatctccgtgtgcaagtcagtggcagcaggataatcctgttgtccctgtcacactgcactgccacaggcttcaggcttgacgatgtagacctcctcgagacaattactctgtcttagaaaatcgctgtccctgggcacgcctgtcatctcaaaatgttttactatgtataaaatggtaagatctaaaactgtacttatatttgacggggcagctcctacagctagttaatttttgaactggttctttacagttttgggaatcaaacccaggtccttgtgaatgctctgcttccgacctacatctctagagctcaacagctattcatgtgtgtgtttgtgtgtgtgctgctttcctttgttctcagaagcagttgtatttcttatttattgtgattctgtatttttaagagggatgcacaagcactgagtatagaatgaagctggggcacatttctgtaatgttttctatcttggggaagacttctttctgttctcttaggtcagtcaattgtcatggtagataccagttacaagctacacagggcctcagactggtacttacttgtctgcctctgacccaggggaagcaagcaattacagaggctcagttccttcattgcttcaatttccaagctgtgggtccttcacgatgcagctggattctgggaagggcagcaggcagtagaagagatatgcctagtgtctcttgccaggaacatattgtatatcttccaggatggcatcattttccgactgtatatttatgccagagctagtgctccaagaaaataccatgatcaaccaaagcattatttttcctagaaacaacaggggcatgaggctgtcagtcaagctgatagagggacctcccctggctcttttctgagcagctcatggccatgagggaggaaagcatcaatgatgcacatgtttctagttcacccccttcccttggggcttagctgattcatcctagtgtctcccatcaggccctgggctgaggctccttttgggagagaagggtttctaagatattaaagggatgctattatggcaattacccttgagctggcaccaagcatggagactttcaggagatgtttttttttttttttcttttatctggctgtacgtttgggatgcttaaacatcccaaatatatcaaacacccattcaacccataagcaactcaggtcagtgaatctcagacaagagaaatcacaggagagaggtgaaggagcaaataaaacagatacccaagacacacagtttccaaagaacaggcctgccctggacgaagaagcactggaagatgccatcctctgtggatacagccagttgctttaggacagtcacatatacatgtattcgtttttgcacaaaatttctctaacatatctcaggcgggttttaaactccatatctttgtgccttggcctccctactgcttacatacagacacttgccaccacacccagctaccttctgtcatttgtatttacagtctacagacttggggctgcatactagaaaagacctttcagaatagaatgagtttgccctgccccacccttcactttctcagtagtcagacatccttcttgcagagtccagggaaatgtggtatagcctgtaacatatggacctcagtctatatagaagaaagatgcacaagcaggcacctgtaatcacagcactcagggagcaggaaaataatgagttcaggggaaccggggttggataaggcaaaccctggctcacccccatgtacacagagcaatagaaagctgctcgtttatagaattgattttcatgggaattttttccttccacggccatgcagcaagtatttaactagaaccacaaccacagaggcagcaaaagcaagtcttaaattgtcttgtagctcagtagaccaacgactcaccggagaagcctgggaggaaactagatacctgtgactgtgtcgagattctcgggaacctgaggagtttttctcctcaatgaaacaatgtctcactctcctgttggaagaaaaaggggaaaaactgaatccagacattcaaaataattttcaagagacataattatatccttctttttaatggtacataaagggggttcccccatctaacacacccacaagaccttggcataaaagaaataaatttagtattgtccacatgcttctttggcatttaaaagcccttcttggggaaaagaatttattaaatattgaaatcagttcaatgtctcttgttgaaacctgtgctttaataggcttgttaaatttagattatgttaaataaaagagagaataagatgagtgtttctcccactcagagatcctgaatgccacaggataactggatattgctaaagaactttaccagtctagattcacccctgtgtgggaggaagagaagaatacttcaagacaacatcggaaaactctgttctgtaaatgtgcgctgcaggtcacagcctgtctcctccccagaaagagcaacaaagcctttctcctctttccgtttgtcttagttagggttttactgctgtgaacagacaccatgaccaaggcaactcttataaggataacatttaactggggctggcttacaggttcagaggtccagtccattatcatcaaggcaggaacatggcaacatccagtcaggcatggcgctgaaggagctaagagttctacatctttatctgactgctgctagcagaagactgactttcaggcagctaggactaggatcttaaagcccacattcacagtgacacacctactccaacaaggccacacctacaccaacagggttacaccctctaacagtgccactccctgggccgagcatagacaaaccatcatacctttcatagtccatctcatttctgacttgtattataaatatacatatattaattaatatatcatgtataacatatatagtatactatatagactatatagtatatataacacatatatactacatattatgtataaactatatattatgtatatataacagacatataggatatatagtatatgtatgcaataaattaataatatgaaataaactactaatagcatggttccaagcactgtacccagttaactctgaatacttgcagtgctctatgaggagctattacaactattatcatcactgtcattgttttaatcattgttgtaatcattattgttattattgctgcctatagatgagaaaagtgagacacagagaagctaagcaaagtatccaaggccacacagcaaggattcaaactcaggaatccggatgtattttgtatctgtctagctgccagaacacatagtatcttctataaaactaggtactttccataaaaagctaaagtatgctcttatccccagcccaattcctaagcctctccttctcatgccctaagttaaccattacagccatcttgggaaataattttcacacatatgaaaataaatagaatcaccatgtttctgagcctggtgccatcattctcaatcattcctgtagctacattttcattgaaaagcagccccttgtggctatataacaccccattcagctttatgtagggtttcccatattgatagacaggttgcttttgatatttcactaaattaaatagcactgaagcatatgggcaggtctgtctcaagggcaggccgcaaaggcaggagccctttagcctttaacaggtagctccagcttacattctttgcagtggtacatggatatgagggtttcttcagtctcttcatcacttccattctatagggtgagtttcaatgacttcttgtttccggcccctttgttgattgattgcttgattggttcattcattcattcattcattcattcatatagggtctcagtatacagcccaaactggcctcaaactcaaagcaatccctgtctcagcctcccagtctgtagagtgctaggatttcagtcacagtctactgctactgaattctcacctttaactttccggctttttgttctccacccacagaatgcagttggatgcagagtgcaggaagagtttgcttctgggcagaggaaagcaggccctcaaaggtaagggtaggcgatgggtgaagggcccacagtcctgacctgcatttgaagctggctgacttatctaaagctggtagtttctctaggggtgaagcacacctgtgtggatgtttgacttgtatagggagggtctatggactaccagaaagcctctggctgagtagtgctgtgtcatggctcacagttgtctgctaatgagttccaggcagggcagactgtctggtctccacctaatttcttttatcaaggtccagctcagtgacctcctactccattctgactcactgccctgtaccaccacacttggctcccatcactttaataaccaaacataaaaaaaaaaaaaaaaaacaaaacaaccaaccaaccaatcaaacaaacaaacagaggctgccaatcttctgggtaaaacctgagaatgcttttctctgctctgctgttcagcttggcccttgaccactccatctacttttgctgcatgtttctcccattcagagtgattcaaggctaaatttagtggtttccttgattcttagacaaatatagtaaaaacagaatgttaatgggcattttactttgagatgtggcaaagttattaggatttctaagattctccaaccctcaaatgctatgtgcctatttataggaaaattcaaaggcctgtgactggagagggtggtctccaatcacagtacccagctcttaattccacaaatagttggtgaggaggtgccaagttttggtatggcaataagtgcaagagacacggacatgtctccacacacatgctgttctgttccccaaagaacttcagatcggtgactgcctgcttcattgaatcaagtgtctactttttaatattttttttcctgtggctcatatctttcctaagatctctaccccaatttgttggctggcctttgcaaagctgcccactcctgcctgtccaggctggttactgcttcaaacatccacccctgccgtgagatctctacagggtgtgcatgaatattttggaaacacaatcaatatctgcatttactacaactggcctggttctgtgaaaatacttcagaacagagggtgctagaccttgcaaatacacatctgctattctccccgagggatttcatgggtcacccccatgtctgcatttcttaagggcacagcctgactgattttgttgaggactgtctagggacagaaattgcatattcctccagtgtgtagggcaaatttactcacacattgagaaacagaaattatgtgtcataatttaaggatttatcatgtatttgttttttttttccttgacatagagcttctataacacttaggattccctgagtgacaagaacattatttagtctaccaagcctgagactgtggtaacaatggttattatggtgggcacatgtagattcaggatggaggctggttgccagagcaaccaaccatgtagaaagagggctggatatttctgccttgtttctgttctatggggagggtggagagtgagttggtcatcaatatgatgttattcttagtaggcaagttgtggaatcagcatgggtatcatcagcaggtaaaaggatgaagaggatgtggtgtgatttaactgtaaagaaagaaactgtgggccaatggccacttatcagtgagtatataccatgtatgttcttttgtgattgggttacctcagaagctcggaatacccaagatacaattcacagacctaatgaagttcaagaagaaggaagaccaaggtatggatacataggtctttcttagaaggtgaaacaaaatacccatgggaagagatacagtgacaaagtatagagcagagactgaaggaaagaccatctagagactgcccctaccaagggatccatcccatctacagtcaccaaacccagacactattgtggatgccaacaactgcttactgacaggagcctgatatagctgtctcctgagaggatctgccaatgcctggcaaatacggaggtggatgctctcagccaaccattggactgaacacagggtcactaatgaaggagctagagaaagtacccaaggagctgaaggaaattgcagccccataggaggaacaacaatataaactaaccaatacccccagagctcccagggactacactaccaatcaaagaatacacatggaggtacccaggctccagctgcatatataacagaggatggccttgttggacatcaatggaaggagaggcccttggtcctgtgaaggctcgattccccagtgtagtaggatgccagggcagggaagcaggagtgggtgggttggtgagcagtaagaggggggatgggatggtggttttcggggggaaaccaagaaaggggataacatttgaaatataaataaagaaaatatctaataaaaaaagaacgaaactatgtcatttgcaggcacatggatgtaacttaagataattatgttgaatgcaatgagctagacttgaaaagacaatatcacatattttctctatatgtaaaaatctacactgaaaaaggtaatatgcaataaaaggggaccatttcaggggaaaagagcaaggggtagacatgaaagaatagtgggtaaatatgatcaaagtctatgatatacttatatgaatatcataatgaagcctgtcactttgcataaataatgtgtacttaagatttttaaaaatcattagcaaacagtgatttctccaatcattccagtatagtgaaccatccatgaaaacatttaaacaaagtgattcagggcctttgaggttggtgttgagggatgtgcaaactcttctaccccatacatatcctgcgttttgtatcctttccattgactgtttaaaactaaactttatgtgacaaattgcactgtcttctttatgacttggcagcagtgaacaaagcagtttctagaacaaattatctgaactaatgaaggtgagcatggttggtcagaagtactgggactgcagactctcttggacatggagttcagcttgtaagcaaaatcctcctgactttgtgatggcttctcatgatgccagaattcaatttaattggtggtttctcctttgaggtcagagaactagagacatggagaattgatcagtgtcagataccccaggagagcctgagggatagttttcctctgatccaggaagtggacaaggtgcctcttgtgatgataagcccagggtccctctcctgcagtgcctcatctgcctgtggaggtgtcactctggccttccttcatcagcctgtggagtcatgaccgaagacccaggaaaggtgctgatgctctgaactgctatttggtgagcaacatctttgccttcatttcaggtccaggatttgtatcttccagcagcatccagtgagctatagaatcacagctggatccagggcagaggatccctcagccttggctttgtaagaactgggagctcgtagtcctgtgggtagtgatgtttgtgcatgggatggactttaacagcaccttcagcagtcctgatcctgtatgagagaggccagcagcacacagctctgggtattgctgatgccttcaggagcagaacaacccctggctgagaagatggctctagtgaagataagcatttttgttcttattaataactaatgaggtgtcatatgctggttttattatgctaaaattatcatgaatcttttaaaaaatgtcccatactcacagtgctaactgattacatagcagccggctgctcatgtgagataaagaggtgcatcttggggagcacactctgggggagcacactgaacttctcagatgctgtcaagataggctagggaaatgtctcttctcactatagaagacaatagcctggcaaggcacatttggatcagccatctagtccttaatagcaggatgggaaacactccaacgaggtatattctttgctcacttctggttttcacggtttcaattttagatttagatcaagttccatgtcctcatgggaattgtctgtgtcatctgaaaaatgctaacagcatcagtaaagccacatttaattttaaggaaaagaacatttaaatctacaaactcagttcgagtaaaacctaaactggttcacataatagaaaacagagtggtgccccttcaggcatagctggatccaggagctgtgtggtgtgacaaaatttaattttacctctgtcttttagttttcatattgcatggagcctggtagtgtcaggctcaatgacagaggctctccctcagagtggagtatgctcagcagtccctgcttacatgctatcatcttcagataatagaaatctgcctgtgtcccagcagcagtcaccctttggtgttttgttttgttttgttttgttttgttttacctcttttgttttccagtctatttgagtgacaaggctatgagcatggccacctttaaagcatctttgatgcatttattggcttgattctactttatgtgctaattcctgaatctggctcagaaagtcagaagggagaaagttcctcaaactgctgctactgaaaaaaaaagtataattatttctagagagacaaacaaccaacgtgagttgtacagacagaccttcctataacagatttatagaaaagtcactagacttaaatgtgttaatcagatgtgttggattactataacaaaatgcttgaggcaattgacttataaagaaaaaaattttgcttgggctcactattgtggaggtcccagtccagggcatcccatgtggatccctgacaatggcaggaatgtcgtactggaaggattccacagagcacattgcttttataatgaatcagaaagcaaagtgagactagaaggggcatgccttctccttgatggtaatgattcaatcacctagcagcatcctgccagaccctatctctaaaggtttcatttctttctagtgatgcttttaggggcgttccgtggaacattcaagcttcttggaagcattcatcagcaaacaagcttcctattgtaaataaaggaaacagagcccaggaatcttgagatcaccagcagttctcatcaaaaccagacatgatcaaagccttactttgacatggcatccaagtttccacggtgtaactagagatacgcccataatcctggaccaaatcaaaagtcctgggatcaatttgttccgtaatcaatgtgagtgtgtttactttgaaattttacttgcttaaaaaataacctgaggtgcctgtaaaaacatattgattccctagttactatctccttgattaaaatttacaatgcctccgatttggccaaggaaactgctatccttattactgagcaagtttgtagaagttgctgatgccactaattcaaagccctcgctgaattttaacatctactggaagcaggggggatttggaatgttccactctttccagatggttctaacgaacagccaggtttgagaatcaatgcattaaatagcacctgggaccttgctatcaatagagaagccaatgtctgattctgccttaacaagcttgtgtgtctagtctatccgcatcctgtgtgagtctaacacaccaaagtttgaaaagcactgctaaacagtggcaagaacactatctgaacacattctagaaatatggcacactaggtccaactcttgactatttaatccggatctgcactgtatcaacatttccaataatttgtgcacaccaaagtttgagaacctcattcagaaactcatttgaaaaccaacagagtcaactaacctggtcccttggaagctctcagagatggaaccactagccaagggtcatgcatgggctcaagcgaggctttgacatatagggttgtcttgtctggccacaagagaggatatgcctaaccccaaagagacttgatgcgccagggttgggggatacacagaaggtccctaccttctcagaggagaaggtgaggaggggttgggagagggactttgtgagggggtgactgggagggagaacagcattcatgatgtaacagacagacagacagacagacagactgactgattgattgattgattgattgatggacagacagacagacaaacagataaatgtaaaaagtggccattgggctgatgataaggtccactggataaggctgcttgatgctcacacctaatggccaacatttagtcccaagaactcatgtaaagatggaaggagagaacaacttacaaaattttcctctgacctccatataccatgtatggagtacaccatggcaaatgcatgtgcatgcccacacacattacatcacacaaataataaataaaaatacataatttttaaaatagttcattcccactagccactccatgatactctgattaactgggtagcaatctcttcaccatcaattttatttttttaatattgttttccattttgaaaatttaattataatgtaaatacatcagtttccagtttccttccctcccctcccacttactaccacccacctcctttctttcaaatttgtggcctctttttcctaatgtcattacatactagtatgcatatatacatattactaaatatatctacagatatttccaatatccaggcagagctgaaagtacctcataaaatgggtgcagcttaaatgtcagctgtatcacttaccagtaacattattcaccttgtctgtaacacagaacagacccacagcactgtgtccagacatttcctacacccagggctttgctgcatccccagtattcagtcttagagactgggaaacacttgtttgtatgctcgagttcaaacacctgttgccaaacagagtccagaaaatcaggagctaagctcactttattattagcagtagtaatagtagtaatgttatttattattattattattgttaatcattctcattgtccttattactttagacatggcaaagaggattataattttcctctgggatcaggcttgctcctttctctaatatcatggagtccttgaagggagcctgggtagacggtctaccctctggatcctgctgctgtttaagcaacaacttttgctcccattcaaaagttatatggtgttttatgcaacagtgagttttgttatgggctgagagggagatgctgtccttcctccaactcctttggagtcctttgcctcattaggtgttcaaacaatgaacccaccacggcagactaataggcaaaaggagctcttgccttcctgctatgttgtcaaaaggccggctggatgttgcatgcgtttctgacctaatcagctgccatccgtctctttattgagctcccttggagcactggagcaagccatatttcacaatctcacagcttaaatcagttttcctttcggagaaaagagcctaaggataaaaaaaaagaatgttggacaaggcttgtgtatgcaagaccctttttgatgacggcaagtttgtttgcacaatctgtgttctttgcttgaagtcagaccacaggttccctcaatagggccagagagatgttcatgagaacgcgtgtatctaaattctaactaggacctcaggtcagtcagcatgcagttgagcttacaggagggaggcttctccaaacattttgagaatggaaacggtagcttatgggtatgtgttttgctctggctccaactctgggcaatattggcttccagctttttctaattatttcttataaaaattttgttttgatcagcatgtttgtatacacagctcctgtttacattgcataatgatcagctctggataattagtatgtatatccagcagcttaaactttgatcatgtctttgtgatgagttcattcaaattcttctctattttacggtagtttcagtgtgtgtgtgtgtgtgtgtgtgtgtgtgtgtgtgtgtcagagagaaagagagaggcagacagacagacacagagagacacagacacaaagatagagacacagagagagtacacatgtgtgaataagtgtgtgctcttcagaagtagacatcaggactctttctcaagctctccccctgcctcccctgctccttattttggaaacaggaccttccccacctccctttctctctctctctctctctctctctctctctctctctctctctctctctctctctctctctctctgaagttttactgattgctagctgtcccgtcagatccacccagatccacctgtcccctcatctcccaatgctggggttacagacatatgcaccgtgctgaccttttatatgctggggatccaaactcaagtctgcattcttttttttttttttgaagttgtatcaagaccccaaaatgtattagccaggcccaaggtttaaatacacaagcaaaaggggaagtgcctttcagcaggaaggatggggcagtagaattgcacaaggaaactgggaagtacagatacttatcagcgggagggatggggcaatacaagcaaaaggagaagtatttatccatgggagggggagcaatagaattgcacattcttaggcagttacacagggaagcaggaacttggtggtgtcagggtgtggtcaggagagcggtgatgacccagggctggaacatcccgtagttctcggaatccatgtgtcggtggcccgcttttgaccccttttttcttctcggggggagaggcccaattcagagatcaggacaatagcgttgccttaatggttcccaacatctcccccgttttaatattattataaaggcatattgtataataaatttgtagccacgtttttaacaatcacctaaacgtctgtttgctcaccgggtgattctctaaaaccacgaaggacacaaggacaagtcatctatgaggcttgaattaatggtcccagtctgttgggtataacttgggctagccaagggatttaggaacgaagcaagctccgtgggtagagatagaggtctgatccccagtgtgcaatattaggggccatgtacaggattgactcttaggcccgcagattttatggcaagcactttaccaactaagccatctcccaggccacttctaactaatttgatatatatactgcatcactgttccttgtgtgcactcaattgcactacagagcactggtggtcactcctcatatcaaacactaacattgtttttattgcctgactccccggaccccctatcctgtgcatggatgagtcttcatttgacttagctacagaatggagcatgtgaactacttttttctaaagcagtgatgacttcagttgttgtctgaaaacctaaggaaattggactgcatatggacagaacatatggaattatctctaaggatttcagatgtgcttcccagtcaacattcttcagtttctgtcatctgccaagcttacctcctgagtttgtcttcctgataaccaaggtactgaagcagatacttgcttcccatatgcacaaaccttgttaaaacccaagagaacttctcttccccaacactagaacagtcctgaacctctcactgactgttctaacttacttaacctgcctaatcctgaaactaatcatgtctaggaggaatatagtatatattaatcaatccaagagcaaagttatatttgtccaaacaatgagctctttcttaacaagaacattgatgttgggaagaatgccaacattttaccatgtagttccttctttctaaccaagcattaatatatataatatattttataatatatataatatattttaaatgagagaaactatgagccagtacaagttttaattcctaaaccagttcaatgtgggctttgcagacaactaaaatatttcttaaaatgagacacatgagacagacacatggacacccaactggtttccagagacctgtgcaaatttggcacaatgctgttgtaaaatgttatagcttgaaccataaaattatataattacaaagaggaaggcagttcctatgttctagaaaagacaacaaagaaaaaggaagaggaagagaagaaaagaacaggatgagaagaagaaaaaagaagaaggaggaggaggaagaggaacagaaggaaagacgaaaagaagagaaaggggcaaaaacagggaaaagaaaagaaaaggaaataaggaaggaaggaaggaagggagggagggagggaaggagggagggagggagggagggagggaggaaggaaggcaagagaaagggagatggtagccccatttttattccaatcctttatcctcaggatttcattgtcacttgctttatcgaagactcaactcctttatctaatcaccaatgctttgatctttgtgctcacatcctgaatccattcttttactcttacttgtaggagactgatgttgtagactgtgtagtttgaaatgcttcatatttagtaagtgaacagcccagaggtcagtgggcatggtacaaataggagggtcagatcactagggtgtctttgtgtcattctctgagtcacttaccctgacagcacattactgctgcagccacagcctgtgaagagcatctctctctgacatactctggacttctgctttcctagtttcctccattccttcttgagacccgtgcgtgttctgcatccactatgatggctttagcagtgctatgatagtagcactgtgtatacacaccccttcgagggtgtgtcatatgattctggccagaactctgggtgtactcttttattcgacatctttatctctgattccaaaaatcactcctgagggcacgtatgtatttatgtatgtagtatgtatgtatatagctaaaataaacaccctggaggaaaagtcacactgagacttaacatttttccatgtgcaatatctatcacttagccaaaaattcctaggttcagaaggcctgaaactaaacagaaccacaacagaagtatacaagatgattaaggttctggaagtagacatgggatttaaaatagttctggctagtctggtaaaccaaattaataaaagggtaaggaattttaataggatccctggaatctgatttttaaaagtattttcaaaagggctttcaaatctgctgtatgtggaggtaaacacctctaatccgggttcacagctgaggttggaggatggagcctttaagactagtctggtttgtattgtaagacccttgatgtgccagggattagagatacctgggggcaccctctcagaagcaaagaagcagcagatggggaagggacactgtgagggggtggtgaagagggggacagtttgggcgatacaaataaatttaaataaatcccccaagggcattggatgtacctccgtggggttgtgcttgcttagcatatgaagtgtcccagcttcagtcattggtgctgcaaaaatatgagaataagaaattaagtaactacatttgagaactcagtgagcagtttaacaacagacgagaagaaactaaaagaaaaattactgaactagaaaataggaatttgttttaaaaaaaacccaacaacaacaacaaacaaacaaaaacagaagaaaaattgatacataatgtatcaaaaatggacccaaaatgttgagataaaactaacaaccaccgtgcgtggtggcacatgcctttaatcccagcactcgggaggcagaggcaggcggatttctgagttcgaggccggcctggtctacagagtgagttccaggatcagccaggactatacagagaaaccctgtctcgaaaaacaaacaaacaaaactaacaaccaaaccaggctggtaagatggctcctcaggtaaagacaccagctgcaaagctagctcagcactctgagttcaaatcatatcattgaaggagagaattgactcctgaaagttgtcttgtaaccaccatatttcacttatgctatgacaagcattcacacacacaacaaataaataaatagaaaaataaaatgacaagggagatttagggacaaaatgaaatgaattgacattctgaattttgagtttcacaaagattggaatgagctatatttatttatccatcacctatcatttatgtctcctcttcatccctccctggctgcctttctgctagcatcatttctggggaataaacccagggcttcatgcatgacctttagtgggaatgataactgtgtttatcatctctcacctatctatctatctatctatctatctatctatctatctacctacctacctacctatctagctgtctatctagctgtctatcacccatctgtcatttatctatttacctattaatctatcatgtctacttgtgaaaataaagatacagatactgaaaagctaaagatatagaagtagagaatggaataaaaatagtcatctgaaaactgttagttacggaatttgctgaaatcttgtacaggatttaaaaaaaacacacacacacacacacaaaacgaaccaacagttgcttataggaacacattcttagaaaacaacaaaaacccaaatacaacagggaagttgtaaaagcacctagaataaagggcatgttgggggtagatgctatcaaagaggtaacaatgaatcggatggtcccattcctaggagaaataatggaatctggaagataatgcaatgatttcttcaaaatgctataagaagataattgtaatccttgtgaaaatatctttttaaaatgaaagtaaatatattattaagcaaacaataactggcagttcatctctagggcagattacacagtgggctgtgcaaggaaggggtcttagatacatactcagtatgatgggatctctgctctcctctgtgcttgctatacatagtagcaaagaatctgattatagatgtatggaacatgtctttcttcttccttccctctccagtcccctcccttcatttctccctcatattctctctctctcccttttgttctttccttcctcattagttttgtctgccttgctcccctctctcttattcacacagccacacagatagatgatagatagatgtagtgggaataagagatttaagtgttaaaacaaaatgaattaaccttgtgaaatttgagttttataaagatgggaatgaacgctatgagcctttctatcacctatctatcgtctatctcttctccatccctccctagctacttatctgcttgcttcagttctaaggagtaagcctagggcttcgtgcacgttttgctggtgtgttaccaccaaacttcatatgtccccagccaacatttaactctttgcttcacttcgtatcaaaacttgagaactctatctaatcttaatagaccaacctggtattcatgcttgccttctggaaatatctgtcaatttgaacagcggtgtgatagcaaattctttgagtttcctgaagtttcagtggctgcctcttcttagattcttctttggagtcactctcctggcttgtcttctaaaattggaacagaatggagccctttctaatccacactttttcctctatccttgtcaacaggtcacacttgaaaggtgacaggtgtactcagttgaattcataagaagtcagcatgccctttccacaaacattctatgtctctgtagccatatagtgtttgtctcagccactcagccttccatgtagcatggcagcattcattgacaatacatgaattaacatactctgttccaataaaactttattaatgaaacagaggatgaacacaatttggcccaagggttatagtatgttgatgcctatgaggacactcacatcagaagctctggtacactttttgttatgaacacgtttaaaagattcattttgattatatcttgctgtgtcagctgggttgggtccctgtccacagatatggacaaagcataatttagatgtttctctgaagatttaaaagtgagattaaaatttaaattaatagaatgaatcaagcagtttacttctaccaggtaggtggtcctcaagcaatcagttagggactttaataaaacaacagccaccttcctagaaggtagctaagcaaatagacaaccttcagagtcaactactgcctttttttcctgagtcttcaacagtttgggcatccctacatagcttcacacacacacacacacacacacacacacacacacttcatttcattgatctggagaaccttgaccagtatactcccaatctgtattctgcaacattctttgtcctgagctacaagacatttatagtcaccaccatgacagcagctagttcattcctcttcagagtctcttccaagaagtagagattctttaaagacaaattatcacatctcaaatggaaacactgatgtctaaccggtgcctacaagcctgtggaagggtgagtcctggagccctagagggagctcatcttcctaacaggacacctatcttttagctccagtgcagacagtgttgccagctttgtgcctccttctatccttctgctcttccttctgccctggaacagtgatcttctacatagtcagggctgctcttcactgagccacctgcaaggcctccctgtactgagatcacaggtgtgtactatcatccctggtctctttcactttttaaataaaagacagatatccagcactctttgatctttataattcctcaaacttgtcagaatttaaaactccgtttctctgccagtctttccagactctttttttttttccctgtgatctctgcactccacccaatatcatgtgatctggctctgatttctctctgcagttggcttttctacctccaaaccttggccacctattgctccttctacatatcttatttttgttcccctcactgaagtcacccctttctcccacatgaagtcttcctagattgcaggatataagtaagtcaatggttcttccttaaggtgaataacaccctcttgtacctccccacaatcactgcatagggatttctgttgtttctgccagtaagccgtgtactgtctgatctagagtggagagcatctctcattcatttgttctcagaacacaaatggtcccgaaacccatggtgtccaagctctcaggttctgactaattaactaggtgatcctccaccttcagcactgggtccccagatggtcttaaccttctctcaagcctggctactcagactactggacctgggatcaggccatatctctttgttgctcatttgctcaaaggttttcagacaggtcgagcttgtggcacttgctctgcccacaaggtccagccagagaacctgctctgtcttgaccaaccctggtctgcttctagccaccacccaccccacccccaacaccttctccatttttgatggataatctttactctgacccctgaagaatatctgagagactgcttatcattttaaagtttttattgtactttccagaataagtgtaaaccctaaatttaccagtgactacatatgaaaacttgatcaagctattgcacttttatgggtctttgttgtcccacgacacatacaacatacagatagagaaaaccaaaggcaatgtgtttaaaaattacttagtgtacaggattcaaaattcaagagttagtaaataatgatgcagcagcagcctttcctcttcccacagaacctctgaccctctgtcttcccctcaccctccgccagcctctctctcccccactcttccaactcttctgatagatcatttttctataaagatgctaatgaattccagctgtggcatcacagttgaccatagcaactgactcagtgttgagatatcagccatcaatacatgaatcagacaggctgagaggaagaggagagaagaggctgaacagaggtcccagctgttgagtgacaagtgacagaagaaagaaagaatgtgatagagagctgggaggcagctctgtggataaagcacttgctgtgttaggctaaagactaaaaggtttggatccccaccatccacataagagtttgacacctcacctataatcccaacactcagacaggtcatccctgggacaagctagttagctagactagttggatttggggagctcttagttcagtcaaagacccttccttcataaatgaagagtaatagagaaagataccaaatattaggcttactcctacacacacatacaggcacacacatgtgcccactcaccagtgtgtctatgcccattcaaacacacatatctgtggggacaccacactcacatacagagagtgtaattgcatactcagtaccacactctgaacctgtggtcataagggaattaattagttcattaaaaattagataggggaggtactgcttttctcaccatatttaacctctaccagaggccagacagattgctttgggaggggcagccaatgtgaaatgtagacatccagagtaaaagctgaaaagagagatttgtcatctgaagtctggaccaagagaggaagggaaaacgaagagagagtggaggacacagagcaagaagagccactggctttcctgaccttcttctcctggatgtatttctagggtggcagacgcaggtttcccagtacatatacaactcggaactttccccgatatgtgatgttcatggaagggtgttcagctccttctgacttgtctctctgtgacccttgtcgcctctccccatttatgtacaggaagtctttatgaggtggctttgttagtttgccaacagcatagagtgtgtttatacttactaagactgctacagcttcagtgagagattcatcttatgagactcctgtggtatgtgtggtcctatgttggctgaaattctattatccaacacatgactatataaacaacatggagcaaatgacagtgtttgctgaacgtctaccaaatataggtgttttctctcatacagtcttctcaagtgcttggcgtgggttctacccttggcatgataaaagagggcctcagcagtgaaagaccattttctagagccacagacatagcatgaagtttaaagccaggcagtctgatagtagagaatgttgtggtaattgttcagtaactttaaaaagaatgtttcattcttttaaaacatttcatttaaaaagaaatgtttggtgaatgttctcgtgtttgttctctgttgctctgataaacaccatggctcaaaacaacttgagggggagtaatagtgtatttggttatccttcaaagttagagtccatcacttctatgtcagagtccatcattaaattaagtcagggcagcagttcacatggaaactgaagcagagaccctggtagaatgctgctgtctggcttactcccagactttgatccaacttccttattcagcccaagtctgccagtctgtgtaacagatgctatcctcagagatctctggtcaagtgagagagttcaaccaaaggggagagaatgcaagcagggagagggaagtgcaacctcagcctgcaacccactgctccaaaattggtgcagcagctagactctgcactgcactgcgcagagccagggaaggggaggggatctgggtagcaggcaaggtacagcagagcctccagtggtgaaagtttccggagagttttctcttccccagaagtgttacagatcttgtaggagagaagctctcaggtgatctgtgagggagtaattctcatacctttattccttctggataggatcttacatacatttgggggtgggttggggtctgacagccgatactttctattggcttggtctgagatgttagggatgcctcagctgcatgtggaggggctaggggtactgtccctatctgactgtttgtcacgatcttcagtggggtgctgtggtcatgtgacagaggcttgtcaggagcaggtgaagctcctactgtcttctcatggttctcagaggttccagggcttccaacccactcaaccttaccaagttttctggcatgatccactgcctcacccaagtctacttgcttggggatgacaccacccacaaagagctggaccattcttctcaaacagtaatcaagaaaatgccccacaccgatatgctcacaggccaacctgataaaaacaatgttcctcttgagactctctcagagagctctgagctgtatcgattgatagaggaatgagaaatctgtatcaccccttctaagaagaggaggcagaaagattgtaggggtgggaaggtgagaggaatgctgtgaaatgctgcccagtaattgcaatcagaaacacaaaggactaatggaaacctacacaagatagagccctttaacattctgtcatggatacagaggtgccctcagcaccccatccattcctaagagctcttggctgcatggtaccataggaggggataccattctcttcaaaggcatagtcagtaggggactatttgggacaatgaaggagttccaaagggcaagaaagaggggtactactcactaatagcagcaaacaatcataatacagtgtatacatgcacaaaactgtcatacaagttatcttagagatttggaaagtatttaaacatctgaattctgcttgaatatacatgtgcatgtgaaattctgccttgagcaccggagacaggataggtggaccacacagactgatgatacagtcccttgacatccaacacctggcaaatgtgagacctaggaccccaactccagcctgcaactttcaattttatttttctattacactcagctgctttccaattcacatgtcttcatattcaaagaggctattaacctactgcatccccaccacctgaggtctgcagagccatgcagacagagttagcatctttgtaactaaacatcgctggagactgaactcatcagcctggaggaatgccatctcttgtctttcaaacaagataaatcatatcgctctcctggaggaagtagaagatgaaggtaacatgaccccatggcatctccagctctgtggatattggcttccttcccggggtcctccactctacacagagaggcatgaaccagctggttccaaggtccttccaggttttataggaaggaacttatttttagtactccccagaacagacctcatcattcttggaaccaggagttcaataggaaaacaaacaagagcaaaaccttggaaggtgagatgtcagccaggtgtggtgatataggtccagctgtttgggaggctgaaacaggaagattatgaactcgaggtcgttctgggctacaaagtgaattcaaggtgttgtgttttatataagaaagaaagaaagaaagaaagaaagaaagaaagaaagaaagaaagaaagaaagaaagaaagaaagaaaggaaggaagagaaccaaggatatgttttgtagatccaggtatggtaaggtggaagggggtgccttggcaggcttgtgctgagccatcccttccccgaggtaccagccatacaactggtatagcatagaatagagtttagggcatgggaaggggagttgggaagggaggagagagagagagagagaagagagaggagaggagaggagaagaaaggagaggagaggagaggagaggagaggagaggagaggagaggagaggagaggagaggagaggagaggtctctagctaggaaaacatggagggggaggggagagatggagaaaggagtcaaggagagaaggggcaaagagtaagagagtaagagcaagagatggagaagggagcaaacaggcccttttatcgtaagccaggcatacctggctattgccaggtaactgtggggcagagcctagaaagaatgctaacacaaggcgtacctggacaacttgtccagatcatgtctcaaaaaaggaagagagagagagaacaaaagaaaacaagagtattaaaagtgtgaatgtaggttagtgctaggccacatgcctaacactttcaagtctcagggtttaactctcagcactgaaaaaagaactataattttaaaactcctcttttctgacattttccaatgtgctagaaggtactctggaactaataattgcaagatttttctatagactttaaaatacagaaacaggatgttacctggagaccttagctttgcctactattgtagttccttcccctcatgggacaggttcttctagggaagctaacctcagtcagtagtaatttgaagatgctggaactcagaaaccaggtaaacgaacctagatttagttcccatgttctgatctatttccttatattgtagaatggacatttcctccttgaatgctgtcagatgagctgacacaagaaaggcttggctcagagggagagagagatgctcagcagaggaaagccaaggcccataagcagcctgaagtttccagcatactacagtgctggcttgggtagtgggacatagcagggcagagagggtgggaaacagaggagaagaatggagaggggagagatgcagaaagggagagtgggggggggaggaaagggaggaagagagaggaaggagggaatgggtgttaggataaggcagtgggatacctttggcaggaccagggccaaagtgtgccactaggagatcacactattcaacagatgtagcacaagaggtttattgggggagggggagagcaaatgccattttagagtgaggatatgagagagatataaacaaacagagtaggagacagagagaatgaacaagatattgatctttcaaagcaggctcctgtcgcataatatgaaactcataggacagccgagagaggcagtctatctggctgaggcggggaatgaaggacgctgatgctgctgagttactgaaaggaaggctggtggaaaaattagtggggaagggggttataggaagatagggagaaaaagggagggaaggacgaagggaggttgatcaagagcccaggtagcagggggaggagcaatctggaggatgggtttggagaacctgccagacaaggagaactgaacaagcattgattttcccaaggataattgataatgtcttcctttttttcctcctcccactgactagttctcaatgttcatgagggctagactgtttgcaacaaaaatttttgccctttgtgagaagagacgcttgctcctaaaggtctgtggaccgaggcacagctcggaaagtcagaatttatgaacccaatagcacagtgccctgctccactggcctcccccaaccctcttggctccttgtttgtttaccagctcacagtcagagatctgaaagttggagggattcgagggactctgcaagtgagcaaacctccttgtttaccccccacggaccttgctgggaagtatttagcaagcagattcctgaaggccattctccttgtaaggaaccccattggtgatttaattaagcctacgtaaatgctaaatgggattcaaccaggatgggatttgctgatttgtatgtgctgaaataaatttctcgttccgttctaattgaatagattgaacacagactgtatttgttcttatcctgcagccacttccacgggagcgataaattggaaatgtaatctggcttggtatacgaggtttttttcccagagaaaaatcgctctgccaggagtgagagaaggacagaaaaaatcttttcctttcccaaagtcaagtgtcaccacccaaggcacttctaaaatattatatattacatgtgtatgtatgtatacataaagtatatattatatacacatacatattcactgctcatagcattatcattgtaactcaagtgccccatgtatagacagaaaagtagaatatttatataaccctgctagagattattatctttgttttgttttgtttttttcacgtaagtattgcacatagacccaaggaagtaatgatatctttgagagaagttacatacataaagatgtcccttgccaggctataatgctaaaaccaatggaataacgaagaaatgttgcagcaacatctgagaaggaaagagataagttcattctgacgctttttcaataggaaaacaggcaacttgactgtggaggctacaaggattatatgggaaaatacatgaagtatatcgtgagttaagtttataccctgacctggttaccttaacactcagtcagacacagccgtgactcacctgggaatgacatctcaactgaggaattgcctgatcagattacaccatgggtgtgtgtgttggggggggggcagtgtgcagaaagaccctacccactatgagaggtagcactttctgaatgagtttttcagagctgtataaaaaagcagtaacgtggattttgttactccggccctggccttcaacagtgatgggctgtcgtcgcctgtgagctacaacaaacccctttcttcctccaagttgcttttggccgaagcatttttatcacggccacagaaaggaaaccagagtaccagctatgattgcactgtttcttgggttttattttcttaaaatgacactttgcatgaaatacccagaataggaaaaaccatagaggcagaaagatagaattagtggtattaagactagaaaagaccagggagggcttgtctgaggatggataatgggttctgagaaagatacaagcagtcatttcacaacatcacagtgcaatgctaagacactttctttaacatagtttagataatagttttctaaagaaaaaatattttttacctgatttaaaaaaaaccactaaaatcaggcataatgataggaagggatgttttaacacatgtagctattctatataaggttagtatatctgtgtcccaaacatcactttttatagggaaaaattccttaaaatctttttcttcagcactgtgtaatataggatgaaggtctctagctggagtatccctactatgctcccatggcactctaggcttcaatatcctctacaatttcaactcagagccctgatcagccctcctaatcctgtactcttttccagtctctggtagccattctattaactattaatatccccaattttagatcggacaagtcagtgagaacatgtgaaacttgtctatatttctttcatttgaagtagttttccagtctcttccatattgtatgagaagacaaacattgttctttcttgtagtcttccagattaccatactgtgtgtatgcaccacatactccatattcatttgtcctctggtacgaatgcacactcattttgtagtatagctgaagtgaacaatgtagtgatagtgttagccaaagcctgccttcagcaactcagtgttgtctgccacatcatcaccagccaccaaatgtggcacacatagcctttaaaatgttcctgtcatcaaagccagatctctgtctcctagtctctgtctttctgtatctcctctctttctctttctgaatctgtctctgtctctgtctcaggctttctctctctctctctctccctccctccctccctccctccctccctccctccctccctccctccctcatgagatctgttgcatggtatgatttctgtggcatgtcttggctctaatatgccaaggttatctgctccataaaccctaacattggtacctgggactcaggagaatatcctggttcctgcatgctccccactggaaccctatcccttatctctaatccacctgcaacagactcactttctggctcaccaactgctaggcaacccatccaacagcagcaactgtaaattttccctgtgatctgtgtaaacatttccatgagggagtgactggtgggtatctgcatccctctcgtattcttggagacagaggtacccccagccatggcctttaacctttttgctaaccccatctctgaccatttcccttgggtgaggctttgattttgagcttgggttttcacatttgggcttcatttgaaagtcctgataccagatgttgaacaatatgataacaggttgtgcctgccttgtttggtctccctgaatcttgaccacaccttgaactttaggccttggaccttcccctcttcctcactcattgaaatgagggttccaaatttatttttgcaatcaaaccattcctcaatatcccttagataatcaactcaaatgtaactaaccaaggggaaggggtggggacatatgacagaaaggcattctccattccctatttctttttttctctgtttggttttgtttggtctcccccagtccctgccctcccttcccctaccctcactgtataaatgtcctgtctttaagctagaggtgatggatctgcaagtttgtaacaaagtggtaggctgagcctgacctagcataaaaggcaaaagaccaaagaaggccagctgccagctgtagtgttcacatgcccagtacacacctgttctgcctgcagcatccaccctaagccaagctgctgatcagactctcctaaggtatgtactgatcatttgttttctgctgtcttctaacacccacaaaatttgattccaaatcctacagtccaattcttcagctgctgcttccctctggcccactgggccctacacaggaacacatacctacatgcttctctggctcctgcagcctgctgtgcctctggcctgctgcatccctggggacatctctcttctctcctgtctccccaggctctctctgcctccagtctgcagtgcctcagcttcagctctcagctatctcttggagcttgtaggaacatacccacatggtgttcagttctgtgacaccctcccctctctctcttcctccagggactcagattttattactaaagcttggcgctggtatagttcaacggccaaaagaattggcacacttgatttctgaactcttgtagattgcaacaacttctgtagccacactaacaaatggtcctgaagtctcttatctctacggttatacaactctccatccttagaccttttatcgctatgatttttctgttctctgctctcagacaatcgcttaagactatgctgtaaactcttatctcaagattcatgtgtttctaattgagtatggtttaaaatctataaaatctgtaacgaaatctggctttaaatttgtaacaaaagactcataattaaaatttatacatgtgtgtgtgtacgtatcttataaactgaactctttgtgtgtttatgtaacttggattcagctttgtgtttatatgtgtatgtaacttggttcaactctcatttaaatagcagatgtttttaaacagtgcctttcatccacagcaatgacctcatcagaatataagctgccacatggctggtaaccatcttaactatagttaaagaatacatgttataaagcgacaatggcaaaatgcctaatcctacgagctctctgtttatcactatatccctgttacagactaaggaagcaccaataaatctcaaatagtttggattagtatagatttttgtatgatgataaaaatttaaggttacatttgctataacacactatatatgtgattcaactctggtttacaatatactgtagtttgtgataaaatgtaatgttataaagatctacccagactaaaaaagatatatgtctaactactgatgtgtttgctagctggctaatatcatgatgctagaaaatttaggtaagtaacaacctatgtttgataaataaggtatttttgataatcaagatttataaattcccaaggaatagtcagattcacagtaatatttggcccccttgtctttgcttactttaagctttagatatttggataaactaaagcttatgaaaacctgaaatattcctactggtgctctatagagggctcagtaaagttgctagtctctgtatagactgtacttatgattaaaagttttattttaatactagaagagattcaattaaaacaattgtcattttaaggccaaacctaacaaggatagagtgtaaagtcctagacttatgaaaagtacaaagttattgtaaactgttaaagacatgcaagttaatagtcatctcataaatgataaaattctttaatgccttcagaactgtacctggagtcatgcaaagtattcatccaattaattgcagaaataagctttatgtagctccttgtatgtgttttcaaattaagcctataccaagaaactggaaacatgtaaaatctacccagttttagatatacttaatagataatggtcctcaaactcttcagagatctgctgaataagagcatttacaatgtttgttaaccaaaccaaacccaaccaaaccaaaaccaaccaaccaaccaaacaaacaaacaaacacaaaaacaaacaaacacaaaaacaaaacaaaaccaaccacaccagctttccacagtggagagaagtgctcatagcagcccacctaagatctcctccaagaaggtgtgtgtgtatgtgggggggggggggaacagaaaaacctggagcttgctttaaaggtggcaaagtcagctgctaggtgaaaaagtgctctcacctcagttttgcctttccagtgaggcctttaagatactcatgctctatgtatcaaaagatggcctattaggccatcactggaaagagaggcccattggacaagcaaactttatatgccccagtacaggggaatgccagggccaaaaagtgggaatgggtgggtaggggagtgggggagagggtatggggaattttgggatagcattggaaatgtaattgaggaaaatacataatatatatatatatatatatatgtagcacttcacccacactcctataaataaattgcttccataagcaaaatttgagtgagataaatgttttccttgatctgttattagtgccccagatagggtgaatagtggtttgttcatgttttcccagtaaaagtcaggcaacagagtccatcattgcattctaagactatgcttactcgggctataatcagctactgataaaggaatgagacaataccaaagcaagcttaccctcgtgaaatatgggactacgatggtcaaccttggctttttgtttccaggaccctgtcctaactggggacaagaaggacactggaaagctgattgcttgccttgcctagagaggttaaggaaaccccaagtcctttctccataagaatgtctgttagatcttctgggtcctattggccaaagactgacactgccctgggacctctgcctgcaccagccatggaggaacctagggtgactgtccaggtagtcactaagtctctatcatttttaatacatttggaagctgcttggtctgcagttcctgataattcaggtgaaatttgtccttctcagatctctgatgacattgacaactaagccagtaatagatttgtcagtttaacagcttcaaacaggcttcaggtgccttcttggatctcttcatgtgtaaaaatcagggcacagacctcactttcttagagctactattaggtatagacacagtttaccctgctatcagactctaaaaagagataaacttacaaaacagatttcaatgtaacttttaagaatttctttatttaaaagaactcgctttacagtgactgctctcagtaatcacccacctgtgtttcataaatgactggataaaaacaaggtgtagagtttatgtacggtatagcatatgaaagtttagtggtaaggagctaaggaaatgttctaagatgtgtaaatgcaagttgtaaagggctgaagacttgaaagcttaagttgtgagggtctaggaaggtgttttaaggtgtgtgaatacaacttgtaaaagcaataagaaagtgacttaaggtatataaaaataaaaataaatgcttcagatttcttcccctctctaagttattgctatattaggacttcaaaaattgtttgtttgtttgttttttaacattaatcaatgtggttatgataaagtattaatctagctctgataaatgctgaaaactattatcatagtccaaactcaagattttaaatttcctttggttgtcctttaagtatagacttaaaagtgcacttcacattgtgctaaaaaatctgtctaatctgcgcacacctggtcttctggatagaggaaagagttttcatacttttaaaccaaaatcatttcgagccaacaagcttctgctatgactcaaagttgtgagtctactgcgttttctacaatgcagagtcagtaaaaagtatagacaatagtaacacataccctgttgtatctcgttttgcaaacctaaaacaatcttttaagcttcaggaatgaacttgaatccacctctcgtgggtcaaatagactccagagaagtactgcaaatcaataatctgtttccccaactgcctattccacttgctcctgagggtggggtcttcctccccgcttcccatggacttgggaatcccctcccccaactaccatgaccatggatggacttaaccagctccaggtagtccctcaaaatctacttcctgtaaatcagtttctcagaaaattggacatagctatacctttcctgaggacccagctataccattcctgggcacatacccaaaagatgctccaacatgtaataaggacacatgctccactattttcatagcagccatatttataatagccagaagctggaaacaaccccgaagtctctcaacagaggaatggatgcagaaaatgtggtacatttacacgatggaatactactcagctattaaaaacaatgacttcatgaattctcaggcaaatgaatggatctagaaagtatcatcctgagtgaggtaactcagtcacaagagaccacacatggtatgcactcactaataagtggatattagacagagtgtggaatacccacgatacaactcacagaacatgtgaagctcaaaaggagggaagaccaaagagtggatgcttcagtcctacatagaagggagaacaaaataatcaagggaagtagaggatgggaggaacttgggaggaagagaagagggggaggggaaaaagaggggaagaatcagatatgggaaatgaaggagatgtgcagaggatcaggaaatggaaggaggtgtgtagcaatggggggtgggaaactgggggtagcaataagaaagtcccagatgccaggaaagcaagagccttctaggaccccacgggatggcattagctgaaatacccaacaaaggggaggcagaacctgtcaagaccatattcagtggttaggtatggccctccagttgagggatagggccattcacccatctccaaaattttaacccaaaattgctcctgtctaaatgaaatacagggacaaagagtagagcagagactgccacagactggactcagtcgctcccccccccccccaggagaatcagggtcccggtacaggtggacagggagtcggtgaaaagtgacaaacaaataaggacctcagagagagtgctgtatctgaatgtattgtctcaaaatgagcatcagacttataagtgacttttatacaaaacagaggaatgcatacaaaaagctaacaggcaccaactgagataaaaatcaatgttaacaactgggatcaaaagcagccccacctaaggtcagctttttcttagaagccagggacaagggcttctatgcccttgccatagttccaattctagcctattgtatagtccaccttccccctaggccattgtaaattcctgtgtatgggagtgagacagctatctattgctctaagtattttctctagctccttcttagaccacaaccttccttcttcctaggtcattgtaaattcctgtgtgtgggagtgactatgctattgttcttactatgtagaccagccctgagattactagctctattctagtagaatgtaatgcctgatttctttttttcttttctttattttttttttttttttttttttttattctgagacagggtttctctgtatagccctggctgtcctgaaactcactttgtagaccaggctggcctcaaactcagaaatctgcctgcctctgcctcccaagtgctggagttaaaggtgtgcaccacgacgcccagcaatgcctgatttctatcactgtctatcaacactggaggcattttcatctgaatgagtaacattcttacaaagatcaaagcccgagattggctcaacaatttactaggatattggaacactggtgaaggctaatctaacttagctatatgtcaaaatcaatccattgaggcacttataataaaacaatattgaaggaaagcacacagatccgttcaccaactaaagcaaggacattggagcattcgttttacaggatgccacggattcaggagactaagtttctgtgaacttttcacctcgggactatgtccaagattttgggcctgtcatactagtcactcactactggagtaggtatggcaagagactaaaggaaaggccatccaaagactgccctacctggggattcatcccacatatagacaccaaacccagacactattgctgatgccaagaagtgcttgctgacaggagcctgatatagctgtctcctgagaggctctgccagatcctgaccaatattgatgctagcagccaaccattggactgaacacagggatcccaatgagggggttagggaaaggactgaaggagctgaaggggccttattttgcatcaatgggaggggaggtccttggtcctatgaaggcttgatggcccagtgtagaggaatgctagggccctgagtgggggagcatcctcactgaagtaggatggggtggggggggggagggatgggggttgcagaggggaaattgggaaagggaataatatttgaaatgtaaatgagtaaaatatccaattaaaaaaaaagaatattgaataaaattcatttgatttattttttaaaaaaaatctacttcctggacagattcaaagtggctagctaccggtggtccagcctcacaaactgttccagctgttgccttcatgtccctagccccagatggtcccacagagactggacagcaagtgaaatagactgctcttccaggacttgaccagcatttcagcctttgggggatccacaaagatgttgttgccccagacagcagaaagaaatctaagagcatggtccccccaccccccatcctttccttaatatcaccttttcctattacctcattttttgtaataaacatagggaggaatgttagccagaacctgcctttcatgacacagcaccagcagctactttattaccaccacactaaaatgacaagcataccctttaaaagatccctggcatcatggcctgctctccatctcctggtctctctgtctctgtctttctgtctttgtctttccatctttgtgtcactctatgtctctgtgtctttgtctttttgtctctctctctctctctctctctctctctctctctctctctctctctctctctctcatggcctccccaccaataaatatctttgtgagatccattgcatggtataatttctgagacattccttagctccaatccaccaagacaccttgctctcacatgaacactaacagatagatatgtgtaaacacttgtctctgatatgtggataccatctttttgggttatatgtttggacgtagggtatctggaccacataggaggtctattttctatgtttttgggaaatttctgtgctgttctccattgtgtttggaccaattcacagataaaaataataatgaatatgtgggctaaaggaaagccttatgcattattctttgtctttttaatgtagcctttctaattagggccaggtgataactcacagtggtttttatttgcatggaagttaaacattaaatcacaatggagtttctattattcataataacctatcaaatatatgaatgatttgaatagattatcttagagtaaaagagaatagtttgaaatagctaaataccaagtatcaataaagtacctaaataccaagtatcaataaagagataacaaagttaatttactgtgattttattagtacatattatatacatgtatcaagacaacacttgacttcaaaaaagtatataattgtttcatttcttgacattttatatgtttaggaagcataagtattaacaatttgatttaaccattactcactttacagaaatatcaaatttctatgctgttaaactaataaaaaaaagaaaagttacaatgtacttacattagttgtaaatgcatgctatactctaaatcagctggtagcttaaaaggagatatcatatgtaggagatatcatatatacaatagatgtggttaagacaacagaaatagaggaaaacagagagagcaaaggacaatgagcacccaaaggctctgtacacagtaggtactattcaacgggcagcaattactttaaacatgaatggcctagatatctcagaagacaaaggctgctacagccatttaaagatatataatctatttgtagataatcagtccattttaaatgcagaacacaaataaaacaaaaattaatggctaaaggaagtcatcctaatacaccaatcaaaagatatctactcagtctgtattaattcacacagtcaggccacactttggttttattttggtttctctcgctagagatcaaacctagaagcttaggcatgctcagcaagcactctaccacttatctatagtcccacagctcttttcactcttagtttgagacagagtctaaggtgcacaagttggtttgaactcactctgtagccctggctgacattgaacttgtaatcctcctgactcaacctcttacagacttggctccaaatgagacttttgagtttgaggtaagttgaaagagattcccccaaggagatgcaacagtctttacacacatctaagaaagcggggggggggggggagggggagagcttaaaagagaaagtggagatgccaacaccctctgccagtgtggtggttttaatatgcttggtccatgggaaatgccactattaggaagtgtagccttgttggagtagatgtgagcttgttggaggaagtaagtcactgtttaggtagactttgagaactcctacactttgtctctgcccagtgcataagagaccctcttcctggctgcctttggatcaagatatagaactcttagctcctccagcgccatgcctgcctgcacactgccatgcttcctgccatggtgataatggactgaacctcggaaactgtaaggcagccccaagtaaatgttgtcttttataagagttggcttggtcatagagtctcttcacagaagtaaaacccaaactaaaactttcagaaatggacagactcactgctcagaatgtccgtgaggacggaactgtgttgctgcacactgagctgtctgaaggtgattaaaattcataggctttcttatccaaaatatcagaatgctcattctcctttagaccacatgaagattcatcaaatgcatgacattatgagaaaggagaaaataaaccctccatacttataagcctagagtagagatcaggtgagatattctcccaagtatcaacggaatttaaccagaaatccataatagaaagctgggaaaagaattgaaaaagaaacaaacaacaaaaaaacaaaacaaaaagataggaatcaaacatcaagcttctcacctgcttgaaaaagtctctagaaaaaaaattaaaaatagtttaaactaagtaaacagaaatagggaactaacctgccagaaacacaatggcagggttggtgagatggatcagaaaatgcaggaaattgccctttaaggctaattgccgtttaaggctaatggccagcgtctgatctctggaatccacatgaaggttgaaagagagaaccaactccacagagttgtcctctgacctccaagtgagctctgtgacacactccagccctcacttagcatcatgtatgcacacacacacacacacacacacacacacacatgcacacactcatgcacacactcatgcactcacacacacacaaataataataacaacaaattaaaatttttaagtgttttaaaaatacacattgggatacagtgaaagcagggttcagaagaaaacatacagtatcaaatataaattttaggaaataaaatgtgtttttgtcatttattgtagtcttacatgcattataaattctacattaccttattgttttgtttaaatgatgatatttttaagaggcttaaaatatcagtttcttgaaaaatactaactaccaaagtttacacaaaacactgatcaattaaatagtcatatatccattaaaatatcacattcattgtcaataactctcctttaaatgaaggggttgtatagagatggtttcactagtgaattctaccaaacccccaaggaagaaatcatgccatgcctttgtagtgacttctggaagatattaatagaaaaacagctatcaattctgaactgcctctatgaagtacttaagacctcaacatcaaacactctttttttatattaaaataatattttattaaataaaataacctataattgcaaatgtagaacaagtcgttttaagattaatggtcattatttcttttttttcttttttttttattaggtattttcctcgtttacatttccaatgctatcccaaaagtcccccatacccacccccccaatcccctacccacccactccccctttttggccctggcgttcccctgtactggggcaaataaagtttgcaagtccaaagggcctctctttccagtgatggctgactaggccattttttgatacatatgcagctagagacaagagctccgggctactggttagttcatattgttgttccacatatagggttgcagttccctttagctccttgggtactttctctagctcctccattggaggccctgtgatccatccaatagctgactgtgagcatccacttctgtgtttgctaggccctggcatagtctcacaagagacagctatatctgggtccttacagcaaacactcttaaggcatcataagaaaggaaaactatactaatatcgcctctaagcataagtattaaaaaaaaacacaccagaaacagaattcaacaagatacaaaaatcatcctatggggctgaggagacagctcgccagacaagccagagagactaagttcataatgttcaggtaagctcgaaatctgagtcttggtatagtcataaatatcctttgcaacataccggatatatgactgtaatccatcattcaacaggttgaggagcaaaagtcagagatgatcgaatcaacccagaaaagcattggcaaaatacaacatctatttataatgttaaactctcagaaaacagggataatagaaacttttccaacccaaattttaaaagtctagagaaatctaggcctggcatcatatttgctgatgagaattgagaggcttcatctcagaatctgaaataaagcgctcatgtctccacatcctttctactcattttgtgctgaagcaggtggctaaagctgtaacacaagaatgttaaacaaaattagacataattagaaagaagaatagagctgcctttgaagactgcatggctgtataaaaaatgctaaaatgtgcaaaaacatccatagctaataaatatagtaagtcacaggatataaaattaatgtacaatgtcaatttctgctctacatatcaacaaaggaacaactgcaagtgaaattaagaaaacaattattatttgcatcaggactaacaaacctataggcatctgtgtaataaaataatgtattaaagtctgtgtgaggaaaactagaaaattgttaagtaaatcaaagaaggacaagagcatgaaagagtaaatcatgcatattcacaaataggcatagttaagtctgtgagcatatctgctctttccaacttgccctacagggtcaatacaatcacactcaaaaccttcctacagggtcaatacaatcacactcaaaaccttcctggtttcttctgtaaatgatgacactgcatctacgactgacatgggaaggcaatgtcacagattccattgtttacagtgagatcacgggtgaagcccactggagaagtgcagagacagaagtctggctgcaggacttcatggcctactgcaacactgtaacaatcccaatggcacagtcttggtacaagaacaggcaagttaagtttgtgggagattggactctcttttctctttttaaattaacgaatcttaactagatgagaaggatggggaaggaagacaggatagggtgggaaagaggaggggaagtaagaggaagaggaggggacatgggggagaggaggaggtgaagagaagaaaaggaatggtgagaaataggaggaagaagagtagggagggggaggaggagcaataatttttcacaaaatttagctcaaaatagatgttgagtgtaaactgtggacagctgaaagaccgcaggtgacatcccgttttgtagtaagttttagaattaacaccaaagcacgctttatttaaacaagattagttttccccgcccctccctgagagactattgataattaatggtgcctggggagaggagagccttttccttccacacgaagtccatgcttcagtagcctggctccagtaaataatctccctcccgtgctcctgaagccacactaattaaactcaattagtcccacacagaaaaggcatgagaagggggcagggcttgcagagaagaagggcttcaggcgaaggaagggtgatggtaggagggaactgggggcgggggtttcaaatctatatttattatgtgtgagttgataaagtatttttttattgaaaatacccatagaactcttaaatccaataatccaataagagctcaataacaagagagcataacgttttgctaattaaaataagaaaaagagagctgggaattcatcacagctggcagagtgcttccatgtctagcatacatgaagcccagatgtataaacaaggcaagcgacacacaccccataatccctgcacctaggacttggagcccaggagatacgaagttcaagcttatcttggggcttatcttattttccaggcagggtctcatgtatttcagggtggcaggtttgaggtcagcctaggatagaggagaccctgtgtgtcgaataatataaagtaaatttgacagacacttctcccaaataatatactgacagaaaataaccacaaatagtgcagagtgttgttgtcattaagtaattggaagttaagacagtaacataaataaataaataaataaataaataaataacagacaagctcaaatgcagacacggttgaatagcaggaaaaatgattgtggtttgttgatgggaatggagagtatggaagccaccttagaagatagcttagtgaattagataaaacactaaacatagccttgctaggatatatcagttgtacccttaggcatttaccaaaaatagttgaaaacttacgtgtgacaatgtgctgacacatttatagcagctttatttatatgagctgaggttaggaggcaagcaagattctcttccatagctgggtgaataatctgtaacgtagctatgcagttggctattattcaagggtttaaaagaaacacgctctctagccacgataagacagggagaaaacttaatagcatttgctcagccaaagaagtcagtgtgaaaagcctgcatactgtattattccaattctattacagtccacaaaagacaaagctgcagagacagtgaaaggatggcggagggaaggaggggagtgattaagagtggatcccatgatgttggagtactgggaactattctatacaattgtaccgtgatgttatgtatgcagttttttagcatttgtccaaaataatcatagaattgtataatgcaaagaaagaccttgctataatctaagggctttagtttataatgatgtacaatgatttcggcaaccatcacaatacgtgcccttgtgcaagacggtagtaacagagaaatccatttgtggtaggctatatgggtacctggaactctttctctctgcttgactcccccaaaagttcaaaactatactaacagggggaatttggttgatttttctgccagtttctggttgcccaggtgaaacagccattctttcccacagcagatgctgctgagaagaaaggctagagctgcctgggaatgtaacctcccttcccactccactagcatgtgttcccaggaggttcctttgtgttgtgatcatcttttcaacctagtgataaagagctgcagccgccatcccttctgcttggtgctcagggtccacccgatggagccccagccagctctgcatttctggagtctctgttctccctcttggtgagcttgtgaacatcactagagagcagcactagagaagtgtcagtatttacctccaagactgttgtgaggtttaagtacgccaatccccaatccccagtcttcaataaatatgagctgttatgctgttattgtttagacaccctcacacaacacttacatcaaatggaagaaagacaaaagattccagctcaaatcacttctggactgtcaaaatgcttaaaagaaacaggaaggtaggatgcttggaagcctctgcccagaggtagatgagtggagggaaatacatgtcaaaatggtttgaaatctcctctgccctttatctgggtgtccaatggagctcacaccaaatccctttaataatccccttctgtgaacttcaccctaaccttgtggcctccctctggacaggaacctgtgttgaagcatgaacactgtccccaagtgcaccaccccctctggctagagccttcctcgtcttaaaccggaacccagaagggtcagagaacccagcatgttgcttcttctttcattccctctactatttatatttcactccacatgcctggagcccatcacagggaaaggaacatgttcagaaaataaacagcaccgccgcccgatgctgtgcttgctagaagctgttagtataatcttgtttcttcactttggggagcttaaagcacagaaattgctttccctcaagtcttaatatcaaaggacgcaaagggattcaaagacagtttacagcaccacaatccactgtacagatgagttgctatgtattttcttgacacccctcaccctcatgtttgaaacttgtacttctttgtcctaagagcatcttcaggcatcaaggcatactggccttgcttaattccctcctctctctaatcccaagaggctgtctgcagaagctctggtatttccatggcatctccctgaaaggacagagttagcactctgattcttcttgctattgtgacaaaaatcctgggtaaacccggctttctctgttgaatttgaaactcacatactagacaccatcccctctctagattatagtttttaaaagagaagaattaaaaaaaaaagaatctgctcaaattgacatttccatctcccttacttatctgagagtggcaggctgtaatttgccaacaggctcatattcaaacacatgggatagtgctgacatcatgtggtttttctcccttttccagccccagcatcctacccaggtggacttgcttaggtcagtagatgatgtgaaggaaaagagagagagagagagagagagagagagagagagagagagagagagagagagagactatagaacaatagttcttcatgatctatgaaggatccccaagatcctttcgtgagtcagttgtgaagatgttcctaggtctatcaggtagaataggatcagacactggatactacctacacaggggaaggaaatccaggttttcttttcgttttacatctattccagtgcagacatatggctcccttgatgctgtgaatgaatgaactttgaagaggaaaacctgactcagcttctggctccatagattggtagctatccatcaagggtgagcaaggaaatcaccgggaaaacagtctcctgcatctggatgagttcccatctgcttttggtggtgctacaccctctgccagtggcacattctttctgtccggttaggagctcccttgagctgctgttcagttgctgacttgtgtgctgaagggccatgctttctaagttcttccccaccatcactcctgttgctttgtcccttgatgcttcttcaatatcacccccccccacccccccacccccgcactagcattcaatttccttcttgctgggttgtagcccttggaggttctttaatttgctgagagtaaatgtggtagtaaattacttcagtttttgcataattttaatataacttataacttaataacttattttgtcaagtttgctgtaagctcacagtcagcaggaatctgtcctctcaggagtctaccacaggcccaggttttgagagagattcctaacatctgctttgggggttgaagtaagagaattcttcactctcccagcaggttgacagctcagagtctattctgtgtgggaagtgagaaaaaactcagattaatcagctatgactcatgtaagtccaaggcaaaaaattttactcagatatctttaatgacccctcttgtcaacactcagggaaatgtgttaagagttagatcaccagactgcagtaccacagcaggatgttgagactctgagggatgggtctagtggaaagaaatgaggtcactggagataatactggaaacttcctcctcctcctcctcctcctcctcctcctctgtcccctttgcttcccaacttccttgagttaaacaacaatccctactacgatgttctgtctgcccacaggcccaaagaaatagacccacgtgaccgcaggttgaagctcatggacccacggagcacagtaatcttccccctctataagctgtttacccctggtactttgccaccatcgaaaggatagaaagcagactgaccaagttatgagagaagagggctcagatctagcatctttttcctagctctataatttattcaggcacccctgtcattgctcctccttgctatccttagaggccatattcccgatagtagcttttctgtgagagaattagagtcccagccccagatggtctgatctctgctcagcccggggagtcactattgtccctagatttcccaaggcgcatcctttcttgcttgagcctcagaatggcttttatttaattgaaatgattttatctactcatcctgtgcttgagagcagagagaggttttggcatgtggttttatttcaggcatctgttcctaattcctgcagtgttctataggtttctgtggtgctttgctgctctggggcccatgtcagctagtcaaccacagccatcagtggactgatgccctcagcatccagggtcctaccagcttcagcatcacacctgaagcacatggatgttacgtaatcagaagtccaagacatcctgcgcatggcccagctggggaatcagaatctgtggtcagcttctcagggacagagttgagctctgaaccttcatgggtcaattctggaatttggagaagctgctcagaagtggaagaaagaacaagacaagggggctacacccaacacgagtgggtgtcctgtacctgtgcttaccagggctctcatgcatcacatgtctgtgggagcgtactgttcctcttgtgaaaagtgagtgtgcaaaggtgatccttcctctgcatctcggcaacattggagctgggcttggccagccagctttctgtgactacctgagctattaaccatatagagatgaaagatttagtttgatttacaagttgagttcagtctaaggccaagtgctcttgtcaattactggctcttgatgaggcagcacaacatggcaagagcagctagcaaagagggtgctcagtgtttggctaggaagggaaaggagagagagggagagggagagggagggggagcggaggggagggggaggggagggggagcgggaggggagcgggaggggaggggggggggggagggaagggggaggggagggggaggggagggggagggagagggagaggaaggaggaggaggactaggatgaggacgaggagttaggaaatgaggggagaaagcaagagtagaaggaggaggaaaaggaggaaagggggagaaagagcgagtctggcccctcttagctatgcctataaggaactgtaacctcccattcagcccacttcttcaaggctccatgctctgagaaacttaagttgcaagttatagcaggatacaatggcagaacacttgggttgcaaacacttgctccagaaggtcttgccagctgacttgcagaaggttcttgttaggacttttgagactattttcattaagtaactcccaccacttaaataacacccatcacaacagtgatagctaacttcctgagaaaaaacacaactgccaacaaactgtctttcaaaatagcttgggcaaattcttgaacaaaacctccatgttctcttttgtcctttgggtgcagtggaggccatatttttttcaaggtcttggcttgcagttttaagttgtgtctacgcctcaattaagccttttgcttggaaattaaaggctatgttttaattggggtttcctgacacctgcacagtgccatctcgctctttctttgtagaaaagagacttttgtttcatcattgtcaaccaaaaagatgaatcagttttcttagcccaagggggataaaaatcaaagagcaggtaaggagattggaattagtagcttggcagccaaccagagcatgactgggctgtggctgcagatgaattaatggccagcggatacagcattgccagatgatttggccacttgggaggttttgtaaacattgccctggaagaatatcttgtcttagggtgacattataagactggcaccagagtgggcagggtgatggagctgtaatcaaatctcagctctcactctgggatggcctcagaggggactgtgggacttcggagactctgggactctctctctctctctctctctctctctctctctctctctctctctctctctctctctgtggggggaggtcatgacactttagctggaggattataactgcaagctcattctgagatacatagtgacaacttttctcaaaacccaagcaacatcattaagttgaacactatataaagtggggtgcactggaaatggggctgctgcagtgaggtagatcttagcaaatggaacatgtcttgagccctcagaggaatcctgtctgtaggggagagtcaagctaaatagcctcaaattctttttttttttcatttgacattttatttatttacatttcaaatgttatcccttttcctggttttatctccaaaaaccccctacctcatcccccctccccctgcttctatgagggagctcatccacccacccacccactcccacctcaccaccctggcattcccctacaccggggcatcacaggaccaaaggccattgatgccagataaggcatctctgattgctggaagaaaggggattctgggtggaagacttctccctgtattgtacatccttgtctttctttggcctatctctcatgtggagagtgaatttttctttacttagttttcaatcactgaggtagaagttgcaggcccaaaaacgcatatacaagtaacattatacaaatggagcagttatatctagcaatacatatgtatattcatacacactcacacacacacacacacacacagagagagagagagagagagagagagagagagagagagagagagagagaacagcaattaatgaaaaaagaggctatgaacttgaaaaggagcagggagggtatagacaaggctttggagtgatgaaaaggatggaagagatatgtatattataatctctacaatacgcaaaaaattacaatgagaccactctcttctcttaccaactgattttctctgcatttcaaaaacccctacatcttgcttttatcatttagcactgttctttcggctactgtatgatgcataaatcatcatggttgcttgtcttctatttattggcattttttagtatatttctaccccagaaccttggtgtctgctgtgctcctgggaaagtttctctcttgcattatcctctggttgacaccttctggtcatctgaatttcaactcagttcaaactctatttatgtaaagaagcaggtactgtggccctcatcagaagcaccccttccagtaaccagccaaatgtacttaaattttcccaaggctttcagccatgttttagtcagggatcacttatagaatgaatctatgtaatatgtgtgtgtgtgtgtgtgtgtatatacatatatatatacatatatatatatgtattatatagttaaatacccctaaatatatgtttatgtacatataaaaatgaatatatatgcatatggaaatgtatatgatgtatatatgtatgtgtgtatatgtatgtatgtatatgtgtgtgtgtgtgtgtgtgtgtgtgtgtgtgtgtgtgtgtgtatacatgtacacacacacacacatacatactcttggggtccaggaaatgcctcaaaaaccacacaaaccctgatctcagtcagacagggagagtttattgagcatatactccagaaccagtcaaccgagtcatggttcagattcgggaattgaaccatgaccctgagctaggatcctacaaggttttgaagccccaaatccacaaacatctgtaccaaattacttcactggtcaggatttagagatacaggatttccttaggatcatgtctgtgctgtacacttactgactctgctcccattggttggggtatttaactgtggcaggagacttgccttgtctaatattcatgtatcaacttgtctaccaggatgggacttgtctaacattcatgtcttaacttgccaaccaggatgccagttacccaggcacacatctctttctgccaagtaggatgtcagttcctagggaggtcttgggaactttagctttactggaccctactcaaaatggaagtcttattccaaatagtttcctttttgggtacagctgtctctcctctcttatgttggggtccatcccaggggcagcctataaaggcaaatgccataaagcttacacgtaggttaagctgttgtgtggctggctcccatccaagtgtactgtgggtaactatacaaaacagttctactgacttgtattgtgacaggtttccaaggacatggaatataacagaatgtgtaatcaatcttggctttagaaagtttcctagtaacagcagaaacatatgagaaagtttacttataatgacaggccagccaggtaacatttacctaggccttaatattccatctaggctttaatattttacctaactctctctctctctctctctctctctctctctctctctctctctctctctctctctctctctctctctctctgtctctgtctctgtctctctctctcttcaaagatctggattagaagtgtatccacccacatcaaattaagcaaaaatccctcacaggcatgccctccatttttggattttagttaattccagatgttttcaggttgacaacgaagaatagccatcacaacccactatttgtaaatattttctttgcttactatcttcctactatcgtgtgagtgtcattggaacaaaaggtttattcaccatagaatcccttgtgattcaaactattctgttcttggaaacagtaaacgaagcaattaaggccagcttttctgggttcaagccttagttctgtgtggcctttatttattgagagccttcccatgcttcactctttagatggtgacaatcggtaattctaacacgacaggttggtctaaggactgaagcactattacacacaacatgctttgaacagcaccaaatacaaagtaagcactcacagatatttgtggttactgatcatgaatatgttaaatgaatggataaagtgtctatgcgtggagatgtcatgaccttattgtggcaaatgtgattctaagcattttgtgaaagaaaatcacctatgttttcagagtaatgacatgagtttgtatctgccacactctatatgactgtaagttgggatcttggccaattagttgaagtccctgctattactctgggtggagtcctcgccttgtgctcaggttggttttcctgaaacctctccaaacccaacctcactggctggtgttttccttgcaatgatgttgactcagtcccccacttgtccctgagtgttctgtcgagttttcctctttgcagagtctgcctctcagtcccagactctgcccagagactcttgaagacactcagcagggagcagagggaggaaggggcagtgagaataaaacccaattcttgtagctgttgcataagtgaatccaaaaagtaccagtgatctgccccaaatggctttcccttcatacaaataattattctgcccagatggtggaaatagccctgctgttataggccacatttccaagttcccttgctgtgacttccacactcagagggcagtgggaagaagcaaaaataaacctttctccaagagggctgaaaccattagatcagatgagatcagatcagagctgttgattgtggtgcaagggttttactttctcgtgaggcctcaataggaacttaggcctactgtgctgcacagttcacacttcctggataattcaaacctgagtgtgtgactgttccctctgtccttctgtctgatgagagcatccttccgcccccacccatctccaaaattttggagtgactgttaaccaatatcctcgtattcctggacactgatgtagccaaagaatcatacagaaagtttatctaggacagaggagcagcattggaagagtctgcagcatttatagaaagtgaatagaaaatcctggaatgtttgagttgttcctgaaggatatgaaggcccagagatcagctcagactctaccctggatggatggaaggagggagaattcctataatacaaggaattcctataataacacacaactattcatacttgtttcttatacacatttaaagccttctcattctgagaggcttgtgtttgtgtgtgtgtatgtgtgtatgtgtgtgtgtctcaggtggagagaagtctaagtgtgtgtccatgtgcctgaatatgcacttttctatataaaggcatgcttatatgcttctgtaactacatatgactaagaatgtgtgttcaaaaagatttctccctccttccatccatccagggtggagtctgagctgatctcttggctacatcagggttcaggttgaacatttccaatcagtgatggggacctttctgccaaccagtgcattatggccaaggatgctgtctcatctgaggaaagactcgatcacctggtacctgcagtcagtacatggtagcttagagcctatgtcctactgctctgaatcactgatgcatacctaaggctttcccttttctgcccagctagtcaagccccattgagcaatgctttgatgttgctggaaccagaaggtaacaatgagccatcgttcattctgaagtttctggagtatgcttagatgtgctctggaaatgaaagtcgacaaaaacctgaaagaagaggcagaaagttccaaagcttgagtttcacaagcaggaaccattggggatgccaggtgaaagttaccaaaaagctgctgagggactggggcaggcttggagcatcatgcttaggtattggttaggatacccaaacactcaggtggcagacaggcagctggaggcaaatctgagaatagaaggaacagaaattaaaaatagcaataagctgtgccccaaaagagaggaaaaaaaagatgtttattcacagagcagccacccccggaaaatgattggcactctttgttttgttttgttttttcattccttatagcatccataggccataaaaatgtagctggaaattaagaatatcactgtccctcacaatgcctgcatggaggcctcagctcatggctccactctgctctttgaagtagctcaccagacatctctgcattgggcctgctgtagcctcctcagcatccttggaatcccattatctcttgctactgtgtcttcatggagaatggtggccatgcctctacaacctggtccctacagtgaatccaattcattatggtggtgtcatctaacctttcctgcactgcacaggacacagacccagcaggccagggagacttgggttttttgaatctgtgtgagccaccaggcaggtggcaggatctccacccattcctgaaggagaaccagccatcactgtgtgactgtctcctccctctccatgatgttgacatcataaactgtcctgaactaatcccattagccttgccctggaacggttgcttctggttttcctggccataagttttaatcaaacctgaccatccacaaaaactctgttttatcaaatggatgagagctctgagtggtcctcttcctcggtctgctccctctgatctgcctctccatgtcctctctccatctccctctcgtggcctttccttgtcttctttcatctctctcccacctgcactcttctctcttcttccttcatcttctctacctcctctctcatctcttactgaccttttatttctttttatcttatcatattctgtataaccctcaagagcaatcacttggccgtcttctagcccagagcttccaagctgtttgtctgtcttgtggagcagaaactgaaacagaagaagcaggatgacacttgtctaccccacaaatccacggggcaaggcatcctctaggcatccagagtgtgctggtcgtttttagttgacatggctttggttatttctgtcttaagtgtcttgattaatggttcatactttagtcaccagaccccaaacttacctataatcaccctctccccaacctttctcaagacattactttgtctctttgtaaaacactcaaacatgaagtaaaaactttctggacatccgcttgtcctactgactatggtaatgcagagatgagccaaggaaagagcccaagtgctccagcccagcacccacaggtatgcatggctgtattggacagtgtggttcaaccttgttcacttgcccaggaatgctctgttctttccatttatcatagttgtcattgttagtataatgtgtaagtagtaactttattaatcatggagtgattttattaatgaccttattaattactgaaacaaatgtttattgaggaactactatgaagtattccttccagtgtagacagtgtcatatggtttctgtaaagcatagggtaggctgcatggaatacaatttcatgtgcagtgaatgtttgcagagtgcagcttcactgtgctctaacctgcacacatgcacacaagcatagctaggacataaccactgcacagtgatgccctgcacagatgtgcatacacacacacacacacacacacacacacacacatgcacacacagagctatgatttgcttttactgtcctagaaataacccatcctttgatggctgctgcacagtgaagctcacaatgaactgtgtttaacaggaccattaatttattaggcactcacttaagacggttgaaccacattagagcaaatgtgttcttgggggctctgtgagggctgtgtttattttctaaaagttgccattaggtctagatggtgggaagactgccagaggccacattatgggagccctggtcagtctcctgtgccatgtggctatagaattagtgtgctacttactgatgggcaatccatcccttaacaaggtcccaatttggctcctggaataatgagatgagcctttagggaccatccatctctctcccacagctgagggcacttctgaggaacatggtcccttaactggcttatgatgtagtgcagctgagctgaggctggtacagctcatttatttctcaggggccaaaatgaaattttcagtagaagctcctccctcctcccatgaggctctgccagggctgacatatttgaaagggctatatgttaggtagtgaggggttggtccatatcccagatcttctgaacaatcctagacaggcaacttattcttcctaaaccctaattttccgcctagtgagacagagatccacatgagaaaacagtattaattgagaacctactccaatcattttataggttaagagacgaactaattcacgtgaagtctattctcaggaacattgacctataagctcaagtgatcgctttgaatgaaggcacatttcggccaatttagatgctggggaggcatgagacaggggctgtgtcttgttgggcatctgggagagtgacagctgagttgagctctgacagatggccaggtgttaatcggttaagcagggtgatggtggtgatgatggcggtggtggcagtggtggtggtggcggatggggaagagctatgccagacggagagaacagcttgtgtaaaggcctggagactggagggaacacggtgtgtttagaaaccgaaatcgagccagaaggcctggcgcacagacaaggaagggctgtaaggtgggcgggaagaggctccttagggaacctaagtagaatgctgaggacaccttgttcagaactggggtcacatcttatggaaaagagaaacctgttggaggttttaagcagccttcgtggtgtttacacatagccatcactctgccagtggaatgggcgcaaagctggaaggagaccagactgctacatgtggaaggaaagattgtaggaaatgtgattttatataaataacaaagacttatgctgaatcagggacaaaagactggagaaagttaagctacatgatacactgaacagaactgcatcaaccaagagaagaggctctaactaggactcccactctccctgtccacactgtccaagaccacttactgcatgggcaagtgatcactagtggcaagcgataccccagacactcaatagacactcatggtgcccatctgtccccttaagatctttgccaattgagtcccaccagctctgtcacagcctcaaggagctggattcaaatccctttcaccttcttccagaagctttcaaacttcccactttctaacttgagcctcaagtgccagcaggcagccttgggctggcagagctatgggaagaatcttgcacagcttaaggctgggaatagctgtgccaagatgtttctcgattcttcctcctgaagtgtctgactcagtgtgctgcagttttttaaattattattatttaaacctattatttgtgagttttgtgtatgaatataataaattttgatgaaatctgccctctactagctctgctccagctcctcccatgcttcatcccctcaacttctccatccaacttcacgaactcatctgttaaagccattgagtgcactcgtactgcctgtatgtgaagggtgtagagcaccctctagaacatgggcagtctaaagtcaagctgataccgactgttcttcatagaacctggccaaatcctgctgctcttgaactaaaaggagatacccagtggaaactgagcatctcccttcagaccaggagaagggaggaaacaaaccaatgggaggataagaaggcgctgaaactgacaaactacagaaacaactcccataggctgtgtgaggaaatccccacatttaggaccccagtgttctgatctgtcaattagagctagtggtgggtcctccattggagttctgttgagaaagaaagtgaaagtctgtgatggaaaatgacagtcaataaagtacttggggacaaggaaataataaatgcataagtagcccagcaggatggctgtgaattcaatccagcctgggcccaaatccaacttttgccattcctgacctaagttgaagatagtgagggaaggcactcgccttagcatcccaccagcactaaagggtaaaacagttcagggctctaacctcaccaagcttatatttccagagaaggaagaaattaaataaccatgcatgtttaaagaacaaaacaaaacaaaacaacccccaccccaccccccaaaaaaacccatctcgcaatgtcaacaggactctgaagaaactaaaacagtgggaaatgacagagtagctacctgaaagagatgcacattggactgctgtgtgcacatgaccttccagctcagagctgactcagaagaaacgtaggtgatgataccacacatataggcaggtgattctcaaccctggttcagggtttcattagaaccagctagaagttgcttgacagccattaaaatagtattgtttgggggtaattcttaagcacacaaagggaagtcagcctcagctttgtaaaaatcatgtacagaatgatctagcctggtattttcatcatgaagtactcgatcagggctagtagagcaggaatcacaagcaggccattgaaatgtgaggtatattatcccatagttcccagaggctgaaaggtcaaggttaaggtctcaggaggcaaaggtgcctttatctgctgagccatcttgcctatatcatgaagttgtattttaacagactaaaatcagaactttaaccctaatgtggggaggaaaacacaacttatatgtcatcataattagtcctcaccagtttccccccccgtttcaaaccttcctcttgattttctcgtcttcccatttggctcttcactccagagattcttgtaatcataacgtcatccctttctggaactttaaagcaaaacccttccaaataagtaccttgatttatgataggagaggaagaggaagagagggagggggaaggggagggagggaggggggaagagagagggaaagagagagagagggagggagagagagggggagggagagagagagagagagagagagagagagagagagagagagagagagagagagagaggcaaagacttcccagatggagcatgcctggtagtgttactcatgctattttgttctctgatgtttaacccacaggagtaagggagaaaggagaagtctcccatcccagaattgccacttcttaggggacactagcagtgtggaaccacagcactgactgttatctgtaaaaaggagatgctatgggctgcaaaaatggcttggtagttagcactggctgctctgcctgaggacctgattgaatttccagcacgcacatggtggtttccaacagctgcaactccagttctgtggactctaacatgcttttctggcctccttggacactgcatgaggatggtgctcacacatacacatggcacatggcaaccaattaaacagaacacttgtcctaagcatggtcaccgagctatgccatatggtgttgacagagtcaggggcttttgatttcatagggttttcaaggttggtgccttggtgctatgtgtgagccccattctaagttggagagagctattttcagaacagaaggcagaggggagacttgctagcaagtttcacagtagccaccatcatcagaggcacaatggctgacaactcttacataatttttcttttctgggctcttgtcaggaccagattccagtgcccactgggattttatacaggaacctgtgggttttcctttgacattgaagacaatgtattctccccaaggagggagacatcaagcctctgccacgtctgtagataactggaggatgaagagaaaaaggagctcctttggctcaaaggcccagtagtgaaggtgacctgctttatatgcttatatgacatgatggcaggacaacctttacatgcaataaaatcataagtatgggttggattttctcaggaacctggccaaagacaaaaagagtcatgcggttttttttccaaaggcaatccttcttccaaggtgagagaagaatgaaacttagtgccaaggagagaagcaatcatgttggagaactcgtcatcttaagttgcttctagctttagtcactgccattgataatctcctagtcaccatggtccttcctccccactgatgatcttattcagttcctgagttcagttctgacaaaaagggattcaagggttttccacctctaaagggagcttggcctggagtaaggcttgctgcgatgtgacagtatcagtgctagtctctccatcccttctagttcaacattgactagacccaagtctcagacagtgcctcttctctacagaacactctgtcatacatctaccatgctgaatctcagaagctgcttcctgctgtaagtaatagtgagcttaacactggcctcaaaaacccagattcttgctcttttcttatggcaaagttgaggaacagacagtgtcaaagacatccacttagatgtgccctcaagggtggaaaggactactatcttgagaccacttccagccttgtaagtgcttctttatggttataaaatagtattgatgctcaagccattgattcttgacaagacagtatcagaataggaagtagaggaaggggtggtggccatagaatactctatcagcaaactcctcccaaacttcaaatagaaattttcagtgatctacatcacattttcaaataatacataaactaaaaaaggaagttggctgattttgcacaaagtgaacccaagtgtgaaacaaatctcataaaccatgagtcagactatcacacagatgcattctgggccaccgtccaaatccagctgtccccaaggaaatcacttgcctgacttcaaaccactgatggagtttcctttttccttaactttatataaatggaattacatggaatgcccttaggcaattgtctacgtccattttgtgagacttagttaaggatagatataatcattgatgttttattgctatgtagtgggccattgctcacacaggcatccctcattatatataggagacagcttctaggctgcacaagacatcaatgtgtgaggaaatccacatgtattataaaaatgccatagtgtttgtctacaacattcatgcactctcctttcatgtatgtgcaggtacatacaaattgtatgtttatacatatggttatggaggacagagatgaaacttgggtgttcttcctcaaaatccatccactttgttttctgagagagggtctctcactggaagacacctgactactaagactctctgactagtatctgtcttcccatcactgggatacaatgggaggcacacaaaaacatgccactatgccaaactttttatgtgaatgctggcaattaaaatcaggcctccatgtgtatacagcaaggactttaccaacagaacagtctcctcagtgtcatattacctattaggttttcaaaaataaccctaggttacttactatgcttaatgcaatgtaaagggtatatagttgttttactgtatgatttaaggaccaatgagaaagaagaaggatatacatgctcagtggtgatagccaccaccttagagtaaatgggcagataaaattcctcctgtcaagtgagaccaggaagcaagcaggtattaatatcctaatatctaacaaagtagacttcaaacaaagcccaataagaagagataaagatggttgcttcattctaagtgccattattatcttaaacatatatgctccaaagccagggtgcccagttctatttaaaaataaaataaaacaaaacaaaaaaccaagtactgctggatttaagaacaatctacccaataaaagattatttcaatgcaccactttctccaataaagaggtcatctggacaaaataaatggagcaacattaaaattaattggtatcatataccaaatgatcttaaacaggtatctatagtatatttcatccaaacaaccaagaatacacttagaagattttctaaactaggcaacattctagaatacaaaaaaaaatttataaattcaaaatggatgaaatcctatctgactacactgtaacaaaactttaaattgacagcaaataaatctccagtaaatacacaaactcatggagattaaacaattcattactgaatgatgagtgggaagaaataaagaatgaaattaaaaaatcctataactaagtgaaactaagaaatataacaaaacctgaagaacttattgaaagctcttgtacagtccgacaagggagtttacagctctaagtgcccacattaaaaaatggtaatgaacaaaaataaatagcttaaggatgctactcaaaagagctggaaagacaagaacaaacaaaacctaaacctaataatctgtaagaagatccaataaagttcagtgaactataaacaaagaaaatatcatcaatttaatacatagatagatagatagatagatagatagatagatagatagaggaaataaagaaataaatatataaatatatataaataaatgaaatcaatgactctaagtgaagataaataggattgacaagtctttggcccaattaacacaaaaggaagagaggaccacaattaacagaatcagaacagggtaacattacaaaaaccaccaaaggaattcagagtagtgtaatagaatattctaattttcatacctatattccactaagctggaaaacataaaacaactggattaatttctatattgagccaaattatcaaagtcaaaccaagaagttcacaacgtaagcagactctttgtgtgtgtgtgtgtgtgtgtgtgtgtgtgtgctcttttttttaaaaatattttttattattatgtattttcctcaattacatttagaatgctatcccaaaattcccccataccctcccccgacttccctacccacccattcccattttttggccctggcattcccctgtactggggcatataaagtttgcctgtccggtgggcctctctttccagtgatggctgactaggccatcttttgatacatatgcagctagagtcaagagctccggggtactggttagttcgtaatgttgcacctacagggttgcagatctctttagctccttggatactttctctagctcctccattgggggccctgtgctccatccaatagctgactgtgagcatctacttacgtgtttgctaggccccggcctagtctcacaagagacagctatatcagggtcctttcagcaaaatcttgctagtgtatgcaatggtgtcatcgtttggaggctaattatgagatggatccctggatatggcagtctctagatggtccatccttttgtcttagctccaaactttgtctctgtaactccttccatgggtgattgtttccaattctaagaaggggcaaagtgtccacactttggtcttcattctcagactcttaacaaaagagtagattgaaatatgaataaaaagccttcaagcaaataaacatattaattaattaattaattaattaattaattaattaattaaaaatccaggaccagatggattcccagcagaattttaccagatattcaaagaatttccacagccaacctttcttttttttttcatttttttattaggtattttccttgtttacattttcaatgctatcccaaaggtcccccatacccacccccccaatcccctacccacccactccccctttttggccctggcgttcccctgtactggggcatataaagtttgcaagtccaatgggcctctctttgcagtgatggccgactaggccatcttttgatacatatgcagctaaagacaagagctccggggtactggttagttcatattgttgttctacctatagggttgcagttccctttagctccttgggtaatttctctagctcctccattgtgggccgtgtgacccatccaatagctgactgtgatcatccacttttgtgtttgctaggccccggcatagtctcacaagagagagctatatctgggtcctttcagcaaaatcttgctagtgtatgcaatggtgtcagcatttggaagctgattatgggatggatccctgacagccaacctttcttaagtgactcaaagattaggagctctcccaacctctgtctatgaagacagtatgactctaataatcacaccaggtaaagacacacacacacaaataatactttaggtttaggccaatatttgtgatgaacatagactcaaaatactcagtaagatatttgcaaacggaatatagacataaataagattataaagcataccaaatttactttatccctgaaatgcaggagtggttcaacatatgcaagtcaataaacatgataaaccacataaatggactaaaaggcagaaattgtgtgagcatctcaatatttacagaaaaagcctttgacaaaatccaatgtgattctatgataagaatcctaaagaatgtaaggctagagggtacacacctaaacacaagaaacccataaccaacctcatcctaaatgaggaaaaccacaaagcatcccactgaagtcaggactgacacagaaataccaacatcctcacttctcctcagtattttgcgcaaaatactagctggagaatagggtaagatgacattaaagggatacatatcaaagtcaaactgtctatctgtagatggcattagatagttttatctgaaaatgaggcagaatacagaatcaacttgcagcacagatcaatatagcttttcgacacgccaacaataagtatacagagaaagagaggatgggcaaaccgccattcacattagccccaaggaaaatataatatctaggaataaacctagaaagtgaaggatttctataatgaaaactttaagccttcgaagaaaaagataaagacgctttaaagatgggaagacttcccatgctcatggattggtacaattaatattgtaaaagtgaccattttaccaaaagctatttacaggttaaatggaatctcaaccaaagtccacatttcattcttcacagaaatagttgaagaaattcctaaaatgtacatggatctacaaggacatcagacaaccagaacagtcctggacaaaaagagcaatgttggagggattattgttccagatatttaggtctattctggaaccatggtaataaaaacaatatggtgtgtgcaagcatacacacacaaacacacacacacacacacacacacacaccctagacaagcagataaatggaacaaaaatcaaagacccaaatgtgaatacattcaaccatttaatatttaacaaagatagcaaaaacatatgctggaggaaagaaagcatcaacaaacagtgcagggtagactggttgtccacatacatagaccaaaattaaaactgtatctatcactttgtagaaaaaaataactcaaaatgaatcaaagtcttaaatgtgaaaactgaaacactgaaattactataaaagctgggcagtacctacatgatatgggtacatgggaaagacttctgaataggactccatttgcccatgaattaagccccccaaattacaagtgcttcgcaaaaatgatgggtttctgcacatctttaaaacaaacaaacaaacaaacaaaaacaacagctgaagaatcccacagaatgggtgagaatacttgccagctatgtatagctgaaagaggattactatttcgaatatacaaagaaaaaaatgaccaacacataaatggacctgggacctgagaattctcaaaaaagagaagaaaatggctaagaaatatcccccaaacatcatcatccctagaaattgtgaaaatgaaaatcaaaacaactttggtattttattttaacccaccacactggcaaaaatcaatggaagaaccaacaacttctggaatggatgtagagaaaaagggaacctttgttcactgttggtgggattgcaaactgtggacccactatggaaacctgtggagaactctcaaaaagctaaaaactaaatctatcttaagactaagcaattccatccctggcatatgccccaaggactcaatctcttactctaattctttctcagtcatgttcactgatgctctattcacaaaaattaggaaatgaaaacaacctaattaatcgtcctacaactgatgaagggataatgaaaatgttgtacatatatactatggaataatattcaactgtaaagaaaaatgaaaccataaactttacaggtcactttatggaattaagaaagattatattgtgtaatgtaaaaaagatccagagagacaaataccatattttctctttcatttgaggttcctagcccccaaatcttcagatgttagtacatattttggagtaactgtaaatatctggaaaataaaaaggtccacaggataagggggttgaagagtaatagaaatgggactagaggagaataaatgggaccagggaagtggggagagggagctgccaataagggaagtgaatacaaatgggaagagagaaaataacaatgacgatgtctgaaaaactcataaggaatcatactattaactgtgtatctaaaaataacacatacaacatctagttcttggtataactaacaaacagtgtttaaattaattttcttccatctgggctggcaatgcttcctccaagatccaactataactaagaaaaattccaatataagacatgagaaaccctctttagagttgttggtcaagggtgtctaaaagcttcccaaaacatacagcctattgattttggcattggttgctctcagatgtgaaagctaagtccctatttctgaggacatcatgcacttcagatcagattcagagactctggatctgacatgggtactagtttgcatggcaccagaagacaccatgcacactttcaaatgagagaagcaagcatagtccgaacccagctattatgcctatggaccacaacagtcacaagcatggcacaataactccaggagtacaatagtggcacacataccttggtgataatgaacagattgataacaagacttaagatttgctcaacaatagggaatgcataactgatactggaactttaccaactctttaatgcttgtgaagtcatggatttggagaagagtttacaaacacccctttactaaaacagcacaattcctatctcaacatttgtccttatacccagataagtgaagtcttcaccccctcatcaaagacatttctttttgcaaaaggcagaggtaattatagaaaaccacaagtaatcaaaatgcatagttaaggatcccagttccaatgggtacatctgtgaaacagacctgcacctaagagccagagaacattgcagggccagatgttatagaaattttaaacctcaatccagggtttctaccccacctttgattatatgattctcagataaaagacacagttttattatttacaataagccttaatcagcaccagagctgggcagatatctacactctatattattaaaatctatatcctattgatagcccagagttattacttacaatgtttatctgggctgttcttgactccaattagccagccctcagggccatgttttcttgactcctaacccatgacatcttctgtcgccgccgccgcctcctcctcctccctctttttctctgtctcctcatggtatcctctgtctccccctgcctcccgaccaggaacaccaagcactgcctatctcaattctgcctggctataggttataagcatctttatttactaatcagagataacttgggggcaaggtcacatagcatcatttgaatctgggtgtggactgtgtgtctctggagcaactaagtcttgggggtccacttagcatcacaatacatagcaaaagaccagaactcaatatcaggaataaattgtaaacaccagaagatcaggaaacttgcttttgagtctgtgtcttctactaacgtcagaagctacacccataaagtctcatcaacatgactgactaaaaatgagctgaacaagaaagacaccaaaagacatcccaaagtagatagaagaaaacccatgaagccttaaccctacatacagatgtaggtaattattgaatgctgagaatggaagaaatagtcttctccaggggagagcactccaattaattagccacaaaatgatcagccctgaaaattaagaaaattgtattcaggaatacacacacacacacacacacacacacacacgaaacaattaatgaaaacatgagcatgaatttataaaagtgcaagaaagagtgtataaaaggttttggatgggggaaataatataattatagttgaatctcaatgattaaagaagaagttagcaaaactttatgaaaataaaaaagcaaaagtttcatagatcataggcagatgtccagcagcccaaggatgatatatttggtgattactgtgtgtatgtgcactaattccaccaacagatggaatgccaggatccatgtcctacctagaaggccccaactaaattctttcagtctctctctaattgggtagatacatttggtaaaatgggctgacaattgaaaattgtctcagatatcttggggatttgatttacttcctggggtttgagacttggctattctattcaaatcaaatctggaaaaagtggagaagcaggcatactgacaattgactgccgtcacccttccttcggtcatcagctcaggattgtgtagggaagaaaagcttgcctcaggcacatcagtgcctcccagctggataaattctgtccaagagaataacctctctcctatcttcagcctattttcctgcacccaggtttgtgtctcttttgctggagccatgtctggcttgtctttgacagtttatactgaagactgtaagtcaggggtgaatcataaatacagaccaatatccttgcatacacaccacatcctgcagcttctatctatatttctgtcccatcaggttcccttccattagagaattttctatgagcctatatctcaagaccctgatggaaatgatatttttaagaggcacaatcatcttttgatagcatctggctgaaaagtcctgacaatctcaggctgattctaggagtgtgagtaggttatcatgggatttccctagatcttgaattccacttagtattttgaagagaatcttaatatttcaataaggatgactgacagagtaccaattcctattcttgctacaataaaagaatcaccatggtgttcaaattttactgtacaggatatttggtgaatgcaagaagatctactatgacgcccttcactgtattctgttttgattggcaggtttctctctgtgtttctcaatagactgatagagcattaggcaggagattgactctcttggaagataagtaagaagctgaccaggctagtttatagctgtggcaatgggttctaatataatggcccagagggagagacactttcacagtgtacaggataccaaagactcagggtacagattatagcctacacatctgacctgtggagcttgtctcctggggatccacaaccaggactaccagaacaaaaagactaatggatgtcctcctgggatgacatcatggggagataaaaatcctgtcaatgtctctcaaagggattcatattttctttactgaacatggattcggattggatgatagcagcacatattggacagcaccagctctgcactctccacattcattactgcatccatccttccatacccctgctgggtattccacctccattaccctccctatcgtcagtatcgttttaaataaggtttcctagaaacaggctctgcaagggaaaattgcatgcttcaggcttccctggggtttctctctggagacatacctgtcaggagtgagggagacagaactgagcagacagcaaagccggcttccaatgtgactgccacatggaagctctttcaagggactctggattggggtagtttttggagctctcctaagctttgatccttctattggtacagcatctgctcattgcttagagtcaccccaaagaagggacataactttgaatgaattaatatcttaccttagaaaacagctcagtaatgagcagtgagaacccccatgctccacacaattctcagcatctgatgcttctagaggatgcaccctaataaagagatttggataggattccaccttgtctattgaaatcatcaccatatcttttagcccgaggcttatgaaaaatagctggggatgtggccccatagcagagcatttgcctgtcatgtgcaagttcctgagttctaattccagtgctttataaagaagataatagaatagaaggctccaaatcaagagaacagctgccctgctggaaggatggtaggaccattttctgtccaatggaccaaaacacctactgtgttagagagtataccatatgccacagacacaatggcaagataggcaaagaccccaacctatggagtgttgattatagttagttcatgtcaaccatgttatgttatactgggtaatgacaaaggacacaactaacaaggtgtgtgatttccttttcttctgtctgcaaatattgagctttctaaaaatattctaatttaatttaatttttttcttattgactttacatttcactcactgctccctccagataaccctccccagaattcttcccccattccctccttcccttctcttagtgaggaggactcccctgggtataccccaccaccaccctggcacttcaagtttctatgaggctaggtgctttctctcccactgagggcagacaaagcagccaagctagaataatatatcccaagtagaggcaatagcttttaggatagcctccattccagttgttcagaatccatatgaagaccaagctgcacatctgctacatatgtgcagggaggcctatgcccagcctatgttcttcggttggtggtcagactctgaaagatccaagggtccagatgagtttactttgttggcttccctgtggagttcctatccccttcggggcttgcaatccttccttctcttcctccttaagagtccccaagctccatctacggtttaactgtgggtgtctgtatctgtctgagtcagcggttgggtggagcctctcagaggataacatgctcctaactgcaagcataatagcatatcattaatagtattggggattggtgcttgcccacgggatggatctcaaattgggacagttattggttcccccagtctctgctctatcccctgtgcctgcatttcctgtagccaggataaatttggggttgaatgctttgtgtctatcactccactgggattaccatctggatacaggaggaggtgacctcttcaggttccacatccccaatgtagtgaatcacagctaaggtccccacattgattcttgggtacatcccttatcctaggtctctgtctcatcctggagatgccctccacctcctcacccccatcagttgcagatttccattcattttcacggctatctagccatctctcctgtccttcccgatacccgatgctgaatccccacagtccccttcccatcctcctctctcccagttcccttccttcccccttctaagtgagattcaagcttcttcacctggcctttctttcttgtttagtttttttgggtctgtggaggatagcagggcacctatattttatggctaatatctacttataagtgactacataccatgcatgtccttttaggactaggttacctcactcgggatgatattctcaagttccatccgtttgcctgcaaaattcatgatgtctttatttttaataacaatattattccattgtgtagatgtaccacattgtctttatctattctttagttgaaaggcatctagtttgtttccagattctagctattattaataaagctgctacaaacgtagctgagcaagtgtctttgtaggatgctcgaccatcttttgggtatatgcccaggagtggtatagctgtgtcttgaggtagaactattcccagttttctgagaaactgccaaattggtttccaaagtagttgtacaagtttgcactctcaccagcaatgaagatgtgttccttccccttgctccacatcctcaccagcatgtacaatctcttgagtttttgatcttagccattctgatgggtataacatgaaacctcagagttgtttgatttgcatttcactgatgactaaggacttcgaacatttaagtatttctcagccatttgagattcctctatggagtatctttgtttagttctatacaccatttttaattgggttatttggattgttggtgtctagtttcttgagttctttgtaaattttgaatattcgccctctgtcaaatgtattgttggtgaagatccttttccaatctgtaggctgctattggcagtgtcctttgccttacagaagctttacagtttcatgagatcccatttatcaagtgttgattttagaccctgagccattggtgttctgttcaggaaattgactcctgcaccaatgcgttcaagggtactttccactttgtcttctatgagatttagtgtatctggttttatgttgatgtccttgatccacttggtcttgagtttagtgcagtgtgaaaaatatggatctattttccttcttcagcatgtatacatccagttagtttaacaccatttgtttgaagatgatttcctttttccattgtatggttttgacttatcaaaaatcaagtatgcatagtctttgattttattccattggtcaatgtgtctgtttctgtaccaataccttgcagtttttatcattattgctctgtggtatggctttaggtcagggatggtgaatcctcttgaagttcttttattgttctggattgttttggttatcctgggtattttgtttttccatatgaagtggagaattgctctttcaaggtccataaaaaaagttgctggaattttgatggggattgcattgaatctgtagattgcttttggtaagacggccattttcactatgttaatcctacctatcaatgagcatgggagatctttccatcttctgatatcttcaatttctttcttcaaggacttgaaccatactccctgtatagttcagttgtctgatggaggtggaggagaggtggcaagagaatggaggcctccctggaagagcagactgctccacaaatactaagttttattgagcacaagttctttccatacagatctttcacttgcttggttatagtcacaccaagatattttatagtattaatgtgtattgtatggtatggtatggtatggtatggtatggtatggtatggtatggtatggtattccagacttcctggttgcttgtgtcagaaattttttagagttaacattttctttgactgataaatcagcttcttctattgtatcttctaggcctgagatttttctctcctatcttctgtattctgttggtgatgcttacatctgttgttcctgttctcttccctaggttttttcatctccaggatttcctcagtttgtgttttctttattgcttcaacttccactttcaggtcttgcacggctttatgtatttccttcacctgtttaattgtattttcctgtatgtctttaagggatctatttgtttcctctttaaaatcctctatctgtttgattgtattttcctgtatttatttattaataaaataaaggattttattaatttcctctttaaaggactctataatctctataaggttagatttaaggtcattttcttgtgtttccattgtgtttataggtcaggagactcaggtctcatgaagttggacagagatgtggcagggaaatggaactctccctggtgtggcaggctgctcagggcagcttggcatggcccagagagctcagagagcagggaagatgggtgggaggagggaaactccctgtatggttcagttgtctgatggaggtagaggagaggtggcaagagaatggagtcctccctggaatagcagactgctccacaaatactaagttttattgagcacaagagaacaccaaagtgagtaagtctgtattatggactggctttgtagctagatggaaatttctataccagaaatttgcatggcaagcctcttccttataattaagactggctttggtgtcatttcatttggtcaatgtctgttttaagatgattgacagctgttttaaagttaagtagacaggtctgcagatagaaccaagccagctgtctaacacatatgccatgccacatgtgtggctatagaagcagggaatggccattgccagtggaaacctagagctacttgttctgggaagcaagaactgtatgcccctgagatgaagttagccataggttttgcttttacttcctctgtcttcttagaaatgtgtttccaaagatatctatcccagatgtaatacagcttttcattatccatctgcatttctacccgtatttgttcacagggttctgataaacaaatggtaagtacatgtgcaccttattcttgaagggagactcccttttgtcctctttggcttgcttctgcatggtgtgggaaagtgtaccttcactggactccagtgcatttttccatgattaagagaacatccactcccacatacagataggaggaattcttagcactctaaagtagagaatataaagctttggctaattctacttttagtgggtacaagaccgtatcagagatctggagataaggtgaagtcctcaagggtagtgtcttatccatatagcacatgaaaagtacagcttcagaaggcacccctgttagaatgtgaacccacaaattcatgactgtaaagtcagtccataagttgtctatctgtccactggacagttgccttgacacagacaggagaatatccttgcctttgggattcctggctactccttcagcaagactgaatactgtcttacacagctgtctttttttttttccattttttattaggtatttagctcatttacatttccaatgctataccaaaagtcccccatacccacccacccccactcccctacccacccactccccctttttggccctggcgttcccctgtactggggcatataaagtttgcaagtccaatgggcctctctttccagtgatggccgactaggccatcttttgatacatatgcagctagagtcaaagagctctggggtactggttagttcataatgttgttccacctatagggttgcagatccctttagctccttgggtactttctccagctcctccattgggagccctgtgatccatccattagctgactgtgagcatccacttctgtgtttgctaggccccggcatagtctcacaagagacagctacatctgggtccttttgagaaaatcttgctagtgtatgcaatggtgtcagcgtttggatgctgattatggggtggaaagtttggagctgagacgaaaggatggaccatgtagagactgccatatccagggatacacagctgtcttaactcaggttacaagagtgaactaaataaccaaggtgaaataaattaacttcctaccagtcataaaaactactagtcacagatcaatatactacccaatatggatcctagggtggaaatttctcacatggtgaggaagggacatggtgttcttgaatctcttaacttcctgtaaggacactaatcctgtgggaccaaggctgtacgttgtggcctcatttatctttagctatctctagataggcactaattcacgtttctttgggaggaagtcttcaacatgacgattttgggggatacataattcaacccatttcagtagcattagatagttacctaaaagaaaatattcaaatgggctatttgaatgtgtgtgtgtgtgtgtgtgtgtgtgtgtgtgtgtgtgtgtgtgtgtaagcctcaatgacttttaaccctgttttggggacaggttctcccactttacctggagctcactggttggactgcgtgtccagtaaatcctaggatttttctggctaactctccactggcattacaggcacgtgttgccattcatatatgtgggtgcttgtaatctgacctcaagcttgctcagcaagcactctatacacaaagccatctcctcaggcccgtcaaaggaatatgcataacagagtgtcagcctagtacctatgctctttcattctctaactcagcatccttctgaatgatcacacattcctcagtaacactcctcactacttgagaggtgcccatgaacttgaggtcaatccagatgtacagtaaagccagttttgccatgaagtattgctctctgtgagtcagaggacaaggaaatttccttttaggcagggggtggtcacaaacacaggtctcaaaacccatcatgcactattgtcatattaccagcaggataccttgcatcctctgttgtcagagctttacacagccttagaggctgaaagggtgggagtagattctaggcaaaatagaactgtgtagattcctatgcatcaatggcaagtcaagaaatcatatcttaggacagtgttgaagtgcagatagtgtctgctcactattagaccttactccatagcagcaggacctcagttcatcagttatggctctcaggccggaacttagatgctccaggtatatctaagttcctacttcttccgttggcctagaaatcccaagtaaaatggaaaccaaactaaatggaaagttctagaagtgcttttattgggtcacgctgaaatcttgatattcttagaggctgagccttgacagcaccagtgccagaacgtatgaaggctagacagtggctgaatatttaggctctgtagtattattttaactgcagaatatcattctgtaaccattatactcaactgctgcaaagcccattttattttctctttagtagactcctatggggtgtcaggaaccagtccattgtcctttatccccagactgcaggcctttgtttgacctcacacaggacttgaatatgatccagggaatattatcatcaccctataaaataaagtttgctcttgggttgcagtagcttccagagtacatcatcccacacgtcctttctaacttctggtctaatattaccattctttttttttttttctttaaatattttttattacgtattttcctcaattacatctccaatgctatcccaaaagtcccccataccctgccccccactcccctacccacccattcccactttttggccctggcgttcccctgtactgaggcatataaagtttgcgtgtccaatgggcctctctttgcagtgatggccgactaggccatcttttgatacatatgcagctagagtcaagagctccggggtactggttagtaatattaccattcttaactccatcatggacaggaaatgtctgcattctttatcagggtggtaagcaactaaaataacaaaacttgaaatttggagtggtgcaacaaaacacagttccaaaggaagatatcatttttttccatgtgtgtcaaaaatctaatgtggattggtaggaggagcctggggaggaagctctgttactcaggtgtctagactcctctctcttctggcttcaacctcctctgggttctctgagttcttggccactggtagagaaatggaaagaagagaatgcaatcaagaagaaggtacgacccactccctctgcttcctggtcctggcattcccctgtactggggcatataatctttgtaagaccaaggagcctctcctcccaatgatggccgactaggccatcttctgctacatatgcagctagagatgcgagctctgggggtactgtttagttcatattgttgttcttcctatagggttgcagaccccttcagctccttgggtactttctctagcttctccattgggggatcctatgttccatccaatagattactgtgagtgggtgggttggggagcagggcagggggagggtatatgggacctttgggatagcatttgaaatgtaaatgaagaaaatatgtaataataaaaaaccaaaacaacaaaacacccatatgcataaaataaacctaaaaaaagttcaaaaaacacattaaataatttaaaaaaaaagaaaagaagaagaagaagaagaagaagaagaagaagaagaagaagaagaagaagaagaggaggaggaggaggaggaggaggaggaggaggaggaggaggaagaggaggaggaggaggaggaggaggaggaagaggaagaagaagaagaagaagaagaagaagaagaagaagaagaggaggaggaggaggaggaggaggaggaggaggaggaggaggacgaggaggaggaggaggacgaggaggaggaggaggggggaggaggaggaggaggaggaggggggaggaggaggaggaggaggaggaaggaggtacgaattgtcgtaaggtacgtgtattccctgggcggaaggaagcccagccactaagtgtcatcattctaggccccacaccattactcagcagagggcccagactctccatgtttctctctttttattgcagagaagtctcactgaactgcttttctctacttggccttgacccgctcttaattgcaagggcttcagggagagagagaacctggtatgtcatttcctaacatgagacatagattctgccagccgaagggggtgaggcaaagaatgagtccattgcatcaatgctaagtctatcattagactatacctcatcaatacaaagtctgtgattagactataactcatcaatgcaaagtctgtgactagactacagggctctatcccaggtaaaaaggatttagaaaaagacagcaccaactatggcattaataattcactcaaggccagcactgaccccaggcctcgaaagggctttagtagaaacagcctgacccattgcacagagatgccctttggtaagggtcacaccctatctactagtttataggtgtgtgtagagaccagcagtcaatgttgggtgtgctcatctatggctcttcaccttatgttttgagacataaccccccagagatccctaaatgtctagacttggccaggcaataacatgcagatatctacctatcttcttcaccttatgttttgagacataaccccccagagatccctcaatgtctagacttgaccaggcaataacatgcagatatctacctatctttggctccttaggcctgagcttacagtgtgagccaccatgctgggccttttacttgggaaatggatggcacttcttcaattcctcttgttcttcacagcaacccactaaagagtgcccaaccatttctccatttgcatctgaattcagaggttacacagctagctgggagtcccacccacagccttgctggctttctcacctgctttgcctgcctgctggggccatactcctcaccacttccctagaaggcagcatctccagaaagcaggctgttatgtctgacagctgggatgagtttgcagtaggctttgcctggcaacacccaagattgctcccaaacggtgttctcctggctttgtctggggaaacctaattgctgcaattgtgttataaaattatcactttacccatgcaaatgggccagagcgggctggttgtctattcctgtggctgtcccagattattaaatgagcagctggttccaaacacgtttgcagcaggctaattcaatggctgcgtgcgcttgcatattcatggctccgagttcccagcccaggcttgcaggaccactccaaaggggcgctaaaagttaatttatcttgacaatttaaacaaatatacttcccggctttagtgactccaccagatttcagtgagtgtcttggcaggaagaagaagccagggatgggtgggtgggggtgatgtttgctctgggacccaggttcatgttcagcacgaggaagataccaccacaaaaactggcagacacaagagctcctcatgggtgagactgctcccagttgctgacttcaaattttgtgaccttgggcaaactacttttagaatttattttattagcataggggtactcaacacaagatcagttctcttcatgaataagtgtggaaggtatcacttttgattgtcaacagtgtcgcagagtagctccctgacattttgtcttccgaatttgaaactctgctgcttgattggcacttcccctgacctaccagcccctgaccccacagcttcagttctaccgtctgaccctttgagaatcttagaaatcatgtactttgcatccctgtaacaggtttgtttcatttgccctaaggtgttcaaggcttatctgcattatctcctattgcggaattccattctccttgaaggcctgctagtattccactgcaggcatctatcacatttccttaacctagccatataaggatgtgagcgggttatgtcagtttggttattacggatattgctgcactgagcatagaagcacagactgctccctgaagcttgattgcttttcttcatggttaaatccacagaggtagaattgctgggccatacactagctccaggtttaacactttgggacatgtccaggctcctttctgtagacaccatttttgggttcttgagcgagtacgacgatgggtctcctatggtgtttcttatgtataaaacaagaagtttcactgtgcaggtttgcaggaaacaatgcgatatctcagatgctctcattctggttgtgctgacataaatgtgtacctcctatactccagagcttccagggactaaaccaccaactaaagaatacatatgggggtacgcatggctccagctgcatatgtagaggatggccttgttggtcatcagtgggagaagaggcccttgatcttgtgagggctctatgccccagtgtaggggaatgccaggaccaggaagcgggagtgggtgtgttggtgagcagggggaggggagaggaggaggggatatggggcttttggaggggaaaccaggaaaggggataacatttgaaattttcccctcctggagccccttatcccattcctcctccccctgctcacccacctatccactcccacctccctaccctggcagtcccctacactggggcattgcgccttcccaggaccgagggcctcttcccccactgatgtctggcatggctatcctctgctacatatgcacctggagccacagatccatccttgtgtactctggttggtggtttagtacgtgggagctctggggggtctggttggttgatactgttgttctgcctatggggttacaaactctttcagctccttcagtcctttctctaattcctccatgactctcttctatttttaacctgaatattatttctaaatgaccatattaatagcacttaccaattcacaagagcatcatccttttctagcacacactaaattactttaaaaccagaactgaattctccctatgttaccttgctggtaaatggacttgggaaaaggtcatgggtaagccagaagacacaaagcaaagggattgctattggctcaggaccttgaagaccaagtcccagcctttgtcctcctttcaatgccagcctcatatgtaaccaaaatcttagtttgattgagtcaatggtttgtggttcccaagtacctagtctagtgtatcctgttcaacttagccaccatgatgggtaagaagcagcaagtatcaaaatacctgcgcgtggctgccgacctccagttggttaacatacagatcctggagcctaattgtgctagatactaaaaatgaaaaccttggcatctgtctaacctggctgtgcctcagtttccccatcttcaagacaaagactatgctaactgtgttcttgagtcattgtgaaaattaaatgctgtgcacacatttcacttaaaatagggctgtctctggtacagagaagggggactttctaaacgcggagatagactgacaaccatggttggtttctctttcctctccttccatctcccacccccccccccttttcaacctcctcccttccttcttctttggtttcttcctcttcttctccctctcttcatttcctcccatgtcttttcctccctcggagaggccaaacctagtccatcttgggaccagcctccatttaaaaacaacaaacaaccaccaccaccaccccaacaataaaaacaaaaagagcctgagaactcgacctgcagctgaacccaagctgcatccaagttccaggaagaaccagaggagtttgtctctggcccataccccagttactccctagctactccctccctaacaatcaagattagtctcacagctccagaagtgctttcagacagtttgtgtttgtgatggttcatggttttgcagcagagcacccacctgtcggcttacaatagtctttcaattagatgctttccagactggaaactccctctcttgcttgtcatttcttataaaaccttgtcctgctaaggtctcagggtttcaccctcccatcctactgcgtcagggtcagcagtgggattgaataaaaagactaaagtcttagttcaattgtatcagaatcggctcgttggtggtcttttggggttcacaagtgctttttaaacacctccttttctttgtcttcatcctacctgttccttcattccttccctgtctcttctttcctctctcattcttttcctctcttttcctctcctgtgtctccctcccactttctgtcttcctctggttttcctaggggacttctctgcctctgtcacttgtaaagacaaagacactttgttacaggttgtgggcttgttttcctacttcttaactcaaaatgaagtggcagaggaaaccccctgattttcctaattttgcacagtccagtgaatgaacaagttgacatcttttccctacaaaagatcatcagaagaaacatgtgtgtgaaaataagacaactcacatatcatacatagcaatctcagaatatgctgtactcttggagaagttctggattgctgcttgtaaaggatcaagttctgctgctattacaggctcagcctctgctgaagtccatatgaggagtaactgcaatggttggcattgtgaccgctagaaccagatggccacgacacatctctttgtgttcctcatgctcagtgtttgtatctgcaatgtggataaggatatgtcttacatcctaaggtggttaagagaaaagagctcacacagaggaagcgctcagtacaacacttaaattatcaggcaaagttagtccattccaccatcatgtgagctatcacagaaagcatcaacgtagctgttcaaacatgagaagtgtccagcacctgcaagatccagccactgtcctctaactctggtctgcctacagtcaaatgcttctgccaccaacagattgtgtgatccccttgagcaaagtcttcaactctttaaacctgtctcagtttcttgtctacagtaggaaattcatagtaggagttacttgtggtgggtgctatgagggatgagggaagttatatggactcgctcgggcaaagaatgacatgagagccaatcataaaggcgagcttccatttgctgtactgtacatacttctgctgcgtgcacgacatgtgggggactgatgtcacctacattccagtttttctttaagaataccccatctaccttacctatttcaggatgttcctcttctcttcaaatcaacacacctggggatgatccagatgtctgttcaaagtagaatctatgcttgcccggttccctcagctgcagcaccagctgggctctgcacagactctgagaactgcttgccccaaggatacagagcaggcagagtccagg
